United States Patent 7,745,391 (HUMAN THROMBOSPONDIN POLYPEPTIDE) - sequence listing, part 247

SEQ ID NO: 692764 - DNA, 272 bp, Homo sapiens
  misc_feature (238)..(238): n is a, c, g, or t
  misc_feature (241)..(242): n is a, c, g, or t
  misc_feature (245)..(245): n is a, c, g, or t
  misc_feature (251)..(251): n is a, c, g, or t
  misc_feature (253)..(253): n is a, c, g, or t
  misc_feature (257)..(258): n is a, c, g, or t
  misc_feature (264)..(264): n is a, c, g, or t
atgggtgaccgtggcttgtgggttgaccgtggcttgtgggttgaccgtggcttgtgggttgaccgtggcttgtgggttgaccgtggcttgtgggttgaccgtggcttgtgggttgaccgtggcttgtgggttgaccgtggcttgtgggttgaccgtggcttgtgggttgaccgtggcttgtgggttgaccgtggcttgtgggttgaccgtggcttgtgggttgaccgtggcttacgtnacnncangcatgncngggnncctctngatcacca

SEQ ID NO: 692765 - DNA, 493 bp, Homo sapiens
atgggtgaccgtggcttgtgggttgaccgtggcttgtgggttgaccgtggcttgtgggttgaccgtggcttgtgggttgaccgtggcttgtgggttgaccgtggcttgtgggttgaccgtggcttgtgggttgaccgtggcttgtgggttgaccgtggcttgtgggttgaccgtggcttgtgggttgaccgtggcttgtgggttgaccgtggcttgtgggttgaccgtggcttactatgaaagcattcagttatatgcattcacaaagagatgacttgaaattggaacttatgtttaaaagggaagcagagcataaagatttggaaaatttgcagcccgactatgtggtagaaaataaaaacccattttctggggaggaattcaagccagctgcagaaatgtgcataagtaactaggtgctgaatattaagagtcaagagaatgggctaaatgtctccaagagcatgtcagagactttcccatcaagcccctc

SEQ ID NO: 692766 - DNA, 361 bp, Homo sapiens
gccccccagtttttgggggggggtgtttttttttggtggatttaaagctgactccctggtacaaacagctgttgaagctcaaagctggaggtgagtttttgaggcctttgccattatccagcccaaaatttggggcccgcacccttttgtttggttgaggacttggggcaggaaaggaaagctgctgaacttgaatttccctttcccaggggaaaaaaaaaaaggaaaggggttgctgcccccctgtccctgtttggagattgatgggggttggaactgttttcagttttgatttgctttattcagttttttagcagcttttaaaagtccccttttcccccctaaaggggttttgtttgca

SEQ ID NO: 692767 - DNA, 441 bp, Homo sapiens
atgggtgaccgtggcttgtgggttgaccgtggcttgtgggttgaccgtggcttgtgggttgaccgtggcttgtgggttgaccgtggcttgtgggttgaccgtggcttgtgggttgaccgtggcttgtgggttgaccgtggcttgtgggttgaccgtggcttgtgggttgaccgtggcttgtgggttgaccgtggcttgtgggttgaccgtggcttgtgggttgaccgtggcttacaattttgtcttctgtttccatatctgggtcattagaagccccttcaatcccatcatcccttttcccttcaaatcagggcaactcagagatagctttcttggccgggggcctgatggctatcctttctctcgcaaatatcctcatagcatcaggatcatttaaaggataggcagattctgcggtagaaacatccgaggtagtcacgg

SEQ ID NO: 692768 - DNA, 757 bp, Homo sapiens
  misc_feature (7)..(7): n is a, c, g, or t
  misc_feature (46)..(46): n is a, c, g, or t
  misc_feature (83)..(83): n is a, c, g, or t
  misc_feature (110)..(110): n is a, c, g, or t
  misc_feature (138)..(138): n is a, c, g, or t
  misc_feature (148)..(148): n is a, c, g, or t
  misc_feature (159)..(159): n is a, c, g, or t
  misc_feature (199)..(199): n is a, c, g, or t
  misc_feature (211)..(211): n is a, c, g, or t
  misc_feature (249)..(249): n is a, c, g, or t
  misc_feature (262)..(263): n is a, c, g, or t
  misc_feature (282)..(282): n is a, c, g, or t
  misc_feature (288)..(288): n is a, c, g, or t
  misc_feature (293)..(293): n is a, c, g, or t
  misc_feature (304)..(306): n is a, c, g, or t
  misc_feature (334)..(335): n is a, c, g, or t
  misc_feature (339)..(339): n is a, c, g, or t
  misc_feature (350)..(350): n is a, c, g, or t
  misc_feature (396)..(396): n is a, c, g, or t
  misc_feature (422)..(423): n is a, c, g, or t
  misc_feature (449)..(449): n is a, c, g, or t
  misc_feature (451)..(451): n is a, c, g, or t
  misc_feature (457)..(457): n is a, c, g, or t
  misc_feature (474)..(474): n is a, c, g, or t
  misc_feature (485)..(485): n is a, c, g, or t
  misc_feature (509)..(509): n is a, c, g, or t
  misc_feature (511)..(511): n is a, c, g, or t
  misc_feature (514)..(515): n is a, c, g, or t
  misc_feature (527)..(528): n is a, c, g, or t
  misc_feature (534)..(534): n is a, c, g, or t
  misc_feature (545)..(545): n is a, c, g, or t
  misc_feature (550)..(550): n is a, c, g, or t
  misc_feature (554)..(554): n is a, c, g, or t
  misc_feature (557)..(557): n is a, c, g, or t
  misc_feature (567)..(567): n is a, c, g, or t
  misc_feature (570)..(570): n is a, c, g, or t
  misc_feature (577)..(577): n is a, c, g, or t
  misc_feature (580)..(581): n is a, c, g, or t
  misc_feature (600)..(600): n is a, c, g, or t
  misc_feature (602)..(602): n is a, c, g, or t
  misc_feature (610)..(611): n is a, c, g, or t
  misc_feature (617)..(617): n is a, c, g, or t
  misc_feature (621)..(621): n is a, c, g, or t
  misc_feature (623)..(623): n is a, c, g, or t
  misc_feature (630)..(630): n is a, c, g, or t
  misc_feature (633)..(633): n is a, c, g, or t
  misc_feature (637)..(637): n is a, c, g, or t
  misc_feature (642)..(642): n is a, c, g, or t
  misc_feature (644)..(644): n is a, c, g, or t
  misc_feature (647)..(647): n is a, c, g, or t
  misc_feature (649)..(649): n is a, c, g, or t
  misc_feature (654)..(654): n is a, c, g, or t
  misc_feature (663)..(663): n is a, c, g, or t
  misc_feature (667)..(667): n is a, c, g, or t
  misc_feature (674)..(674): n is a, c, g, or t
  misc_feature (676)..(676): n is a, c, g, or t
  misc_feature (680)..(680): n is a, c, g, or t
  misc_feature (687)..(687): n is a, c, g, or t
  misc_feature (693)..(693): n is a, c, g, or t
  misc_feature (699)..(700): n is a, c, g, or t
  misc_feature (703)..(703): n is a, c, g, or t
  misc_feature (705)..(705): n is a, c, g, or t
  misc_feature (713)..(713): n is a, c, g, or t
  misc_feature (715)..(715): n is a, c, g, or t
  misc_feature (720)..(720): n is a, c, g, or t
  misc_feature (722)..(722): n is a, c, g, or t
  misc_feature (727)..(727): n is a, c, g, or t
  misc_feature (733)..(733): n is a, c, g, or t
  misc_feature (736)..(737): n is a, c, g, or t
  misc_feature (741)..(741): n is a, c, g, or t
tcatggnacgtttttttaaccgcagggatgtttttattgaaatgcntgttatgagtaacacatgaactgcctctggcccaggnggaacttgttccctgataggtgggacnggcccagtggagacagtctaggaggggntaagaagggngccaagtgacngagggcttcaacggcataaggtaaggcttccagggagtcnggtgaaccgagngttattaactctggtgtaagcccgacatggtatggagnttagtatgtgggnntactgatggatgatatggngtgacntttgnaaaaacaatcnnntgactgccgcagtcacacatggaagtannactntgaagtgattngcctaagccagatggtgatccatgagcaatcggctgatggaatgtngtgaataccagcgaagaatagaaagnntttgctgcagcaagagctttatgtcntnacaggnatggacaacttgacatncagccgattgntcatgcatgaccatccagactgangnctnntgagagtacatnngagttnacttgagtggncgcgnaaanatnacaatgcctntancaaaggnatnngatgatgcgaatcagcagncnctgatgcnnagatgnatancntgcgggnttnacancagantnagnancactnggtacaggnggtnacctggnancatntcttaanggttgnagacgnnctntnggtggagncnatttnangaccntgaagntgnnactnttgggctaacccaccg

SEQ ID NO: 692769 - DNA, 291 bp, Homo sapiens
  misc_feature (281)..(281): n is a, c, g, or t
ccaggcaacagtggctcatgcctgcaatagcagcacttcctgcaataccagggaggccaaggcaggaggatcacctgagatcaggagtttgagaccagcctggccaacatgttgaaaccccatctccagtaaaaatacaaaaattagctctgtgtggtggcaggtacctgtagtcccagctactcaggaggctgaggcaagagaattgcttgaacccgggaggtggaggttgcagtgagctaagattgtgccactgcactccagcctggcaatagagcaanctccgtctca

SEQ ID NO: 692770 - DNA, 300 bp, Homo sapiens
atgggtgaccgtggcttgtgggttgaccgtggcttgtgggttgaccgtggcttgtgggttgaccgtggcttgtgggttgaccgtggcttgtgggttgaccgtggcttgtgggttgaccgtggcttgtgggttgaccgtggcttgtgggttgaccgtggcttgtgggggtatcttgtctatccagtgagctttagtcgcttctacccctaggtgctttctccttagtagtcgttacagcagttgaaagttatagttgctagaaaatctgggggacagtctccctcctatgatgaatagaga

SEQ ID NO: 692771 - DNA, 191 bp, Homo sapiens
  misc_feature (27)..(27): n is a, c, g, or t
gtgcccatcctttaaaaacccaggaanaaaacttcaggttgcgcttcctgaaccttgacagacatacgtggcaccacagcttctggcaaagaacaagaaatgtagtggacagacttagccttacagtacctacatgagaatgttccccccactggaaactgacgctaggctactttcttgcggatggattt

SEQ ID NO: 692772 - DNA, 124 bp, Homo sapiens
agacatcggaccgtactcagcctcttctgagtagccccatcacctttttattaatttttggaacaaagtctcgactctgtagccaaggtaggaagtgcagtgacttaatctcggttcattaaca

SEQ ID NO: 692773 - DNA, 947 bp, Homo sapiens
  misc_feature (947)..(947): n is a, c, g, or t
aaagacgctgaccttcgctgcctcggctccagcggccagggatgccctccaggaagtacttcgtggggggggaaagtggaacatgaccggtgcggaagcacgaggtctgcagtcatactcatcagggctctctgaactgcaggaacgcggtggcggctgacatcttgacggggtgtcgatgcatcccctgtagtggcttagtatcgggttctcggccggccacgaagtgtagatccgcaagatttgctgtgccgtgagtcagaggttgcctataaagagtcgcactacatgggtgcataaacgcggggcggaaaatcatgctcccgtgagattgtgaactcaatgagaagcttgttggaaggtcgcaacggttgcgtatatgcgttgcgcggggaggaagacagttgcgagtatgacgcaagtggtccatgtacttgtggtgggaaggtcccagagtagtagtctcgattctggtgggccaagacagttttggcttgctagtgcttgctgagaaagtagtgggcaccatccgaattgtaaatgggacgcttggagatttggggggaagaacgacgtgatgaattgaaatcggtggaaaagcgttggtgcaattggccctagaagaaaagggttggcgcgggactagtagcccagcatcgctatgggggccatcgggcccaaacatcagcgcggtcgacacagtgacggtcagttcgacgcaaggtgggtcgggtagcatcggtgccattagtggacccccgattgttgtatggcgggccccagtttcgtgtggtcttggacaagctaagtgggagaatagggccccataagatggggcctcagggaggagaagtagggaatggagaaggcaaggcctcacatgagggagagtggtatatgggaaccctcggagaagtctccaaggaattggctggtagagcaacagn

SEQ ID NO: 692774 - DNA, 309 bp, Homo sapiens
atgggtgaccgtggcttgtgggttgaccgtggcttgtgggttgaccgtggcttgtgggttgaccgtggcttgtgggttgaccgtggcttgtgggttgaccgtggcttgtgggttgaccgtggcttgtgggttgaccgtggcttgtgggttgaccgtggcttgtgggttctctccattgcttctattttctaggtgaaataggaaaccaaggcacagctgagggtgatcatgggggaggaggtgatggagttctgaagagaaagaaggtcttccaggatagagaagaaccagggcaattagatcctcttg

SEQ ID NO: 692775 - DNA, 345 bp, Homo sapiens
  misc_feature (339)..(339): n is a, c, g, or t
atgggtgaccgtggcttgtgggttgaccgtggcttgtgggttgaccgtggcttgtgggttgaccgtggcttgtgggttgaccgtggcttgtgggttgaccgtggcttgtgggttgaccgtggcttgtgggttgaccgtggcttgtgggttgaccgtggcttgtgggttttagacatgaagtcctagccaacgcctatgtcctgaatggtaatgcctaggttttcttctagggttttactggtttacggtctaacgtttaagtctgtaataccatcttgaattgaggtttagtactaacggtgtaaggaaaggactccagtttcagcttcacatagtggncagggg

SEQ ID NO: 692776 - DNA, 261 bp, Homo sapiens
atgggtgaccgtggcttgtgggttgaccgtggcttgtgggttgaccgtggcttgtgggttgaccgtggcttgtgggttgaccgtggcttgtgggttgaccgtggcttgtgggttgaccgtggcttgtgggttgaccgtggcttgtgggttgaccgtggcttgtgggagaagccggcgataaagagtgttatagatcaccccttccccaataaagctaaaacactcttaacgccggcttctatgacttgggtaattcgtgga

SEQ ID NO: 692777 - DNA, 468 bp, Homo sapiens
gcttagatgtgctctgaccgtactatttgctgtggctgtaaacctgcattgttatgaaaactcaggtaaatgaatttgtaatgactactgaaaatgaaacaggagtatacttgaataagtattgacatttttgtttcaggtcatttactttaagactcacaaagaacatattagctaatagaattcatggccaaaccatgatgtaaatggagctaaggtcagaattagattccttagggagctgaagaaaaaacacggctatgacccttaaaccaatctgctgactgttttctgctgactcttttctgatgcaaagtaaatggtgggaaaaaaaaaactgatactaaaaacaaacaaataaacaaaaaaaacctctaattatccaaccacctgtgcaatacaatagctttctattaaataaaacagaatggaaaaaaaatctccaaatcatgagttgaacccatgaaa

SEQ ID NO: 692778 - DNA, 224 bp, Homo sapiens
atgggtgaccgtggcttgtgggttgaccgtggcttgtgggttgaccgtggcttgtgggttgaccgtggcttgtgggttgaccgtggcttgtgggttgaccgtggcttgtgggttgaccgtggcttgtgggttgaccgtggcttgtgggttgaccgtggcttgtgggtagccttcatcagggtttgctgaagatggcggatataggctgagcaagaggtggtaac

SEQ ID NO: 692779 - DNA, 1034 bp, Homo sapiens
gctcacttgaacccaggaggcggaggtgcagtgagctgagatgcgccgctgcactccagcctgagtgacagagcaagactccgtctcaaaaaaaaaaaaaaaaaagaaagttcaggtgctctataacataagtggtagtctgggtcaaccctattaggggcccttcacggaaaaccattgtgactctgggagcctggggttgccctctgtgttcttgttgaccagtgcacttccctttttcttactatccttattttccccgggatttccatagaacttcccaagatatccgtcacgtggtgaggcatataacccataggacgtggggaccgttgggcaaaattacgtgtacagccaatttctacggtaggcgctgcttataaacttgatatttataatcgagcatatctaacattgctgtaaaatggcacaaatcttaatcggtacagctgggtgaaaatttggatatgtatacacccatcataatcaccacccaaatcaggatatacaatatttctagaaagggtccctcaatgcccttggcacttaggtgtggccccaagaagataagcacatatatcagacgatcggtcaaacatagatacaggcttccacctgtggaccgtatccaacatatactggcgtcaacaaaagcgaaaagggataaaaacaccaaatttaaatagggaagggagaaccggtcaattccacccaagggggcgtcatctttggggagggggtgtgaaatggcaagacactgggatctgcataaacccgatctgttgggatcattgggatataaatggattttaaggattgtgagccattttgtggcacaccgaatattgtttacgacaaaatagagaggggatcaaagtagtacacacaacatgggcccctaaaaatatagccggatatacacaatggtgcccaaactagaaaccaaatccacggctgacataagacggatgagtggacctaaggaaagagggaggaggcgccaccacggagacacgacggggagatacacggga

SEQ ID NO: 692780 - DNA, 272 bp, Homo sapiens
atgggtgaccgtggcttgtgggttgaccgtggcttgtgggttgaccgtggcttgtgggttgaccgtggcttgtgggttgaccgtggcttgtgggttgaccgtggcttgtgggttgaccgtggcttgtgggttgaccgtggcttgtgggttgaccgtggcttgtgggcatggctttttttgtgggctgccacgcccatctttatcaccagaatgagtagctgagttactgggcccagaggctgggcccctggacatgtacctgcagaataata

SEQ ID NO: 692781 - DNA, 1238 bp, Homo sapiens
ggagacgagacagacacctcagtctacgtattctattcatttcctgattgagatcaagcgccgagatgctggtgcaaagagcattgtgcgcgagtatgccgccgtcagccaggtatcatgttggcagctttgggtgtaacgttgcgtcgtagtcttcgacgcagggagggcgtcgtagagcgctcaggatagcctaagaagaccatgtcccttgggcagcatgctagtatgctgtttgccctcgtcactagggccatgcatgagaagcgtgcagggcacatgcagcacttggcgaagcttcaagggggacgaagaacgttaagtccgtagacaagttgtacctctcagtcgagacgcgacgaccgagttgggggaccttcctagttggcacaaaatccgggacttatatttcaccgctcagagggcccgactcaatcaaggacaaaaccttgtcgattacgagcgactcggcactcacgttcctagaacactcagtaattcgttctcctgcaaaaacacgcacgaaaaattgttcccccttgaacagtgagcaaggacgtcaaacgaacttgcctttttggcaatacgcgcaaattgacgcggccattaacaatgctgcaggcgccccagtggaattgcccgttgcgccatccatgctgaaagcgcccaaattggtgcggggctaacaattgaacaaccggctcgaaattttccccaatatttaattctcctttggtttgtaacaccagagccgctttggcattagcgcccacccctacctacttgaaacctttggacttctcaacggaaaattagcgctttattcccctgggctccgaaatccccaatgggccgcccaaggttctccaaggaagcggaacccactcccctaggcccttggacacagtgatctgccttggccccaaaaggggtccctggctccacgcaaattttccaaccggaagcctgatcgaaagcccactgggcagcacagcgttcccggggtatcttcataggcccaggaggtcagttcttctttgccgaagatgggtcaagtccgttacattggcttcctagtagcgcgcaaggagcgaccctttttggtttgacatattcccccctactattccccttatcacagccactttgacacacctattttatccccccccaatgcctagtcctctaaaagttgcctatccaagtaacctttgttacacacaaccacaggatgtccc

SEQ ID NO: 692782 - DNA, 233 bp, Homo sapiens
atgggtgaccgtggcttgtgggttgaccgtggcttgtgggttgaccgtggcttgtgggttgaccgtggcttgtgggttgaccgtggcttgtgggttgaccgtggcttgtgggttgaccgtggcttgtgggttgaccgtggcttgtgggttgaccgtggcttgtgggatcaagaccatcctggctaacacagtgaaatcccatctctactaaaaatacaaaaaataccacgcat

SEQ ID NO: 692783 - DNA, 242 bp, Homo sapiens
ctgtgtctctgtttctctctggtctctcctccattctggtctatctctagtgggagtggtttctctgtgggtgcgtgcgttccttcgcgtgtttctgggtgtgtctgtagtgccccacaggaggtggccctctccctagtggctgtccttctctgatcagcactgtgcgccccggctgagctctacgaccgccgtgacctgcgactgtccgtttcagtccaggagcctcgtgccactcggaa

SEQ ID NO: 692784 - DNA, 201 bp, Homo sapiens
  misc_feature (163)..(163): n is a, c, g, or t
cgagaccatttcattgtgatgagtagtcatcctctagagaagcacttaactagggatgagtatatattctctttggctctcaaagtattctaggtcaaggccatatgctagatatagggataggatgataagaacatgggctagagacccgaacagccacagntagtagaaacggcataacgaaggctaagcactatatac

SEQ ID NO: 692785 - DNA, 826 bp, Homo sapiens
  misc_feature (29)..(29): n is a, c, g, or t
  misc_feature (76)..(77): n is a, c, g, or t
  misc_feature (97)..(97): n is a, c, g, or t
  misc_feature (107)..(107): n is a, c, g, or t
  misc_feature (110)..(110): n is a, c, g, or t
  misc_feature (116)..(116): n is a, c, g, or t
  misc_feature (118)..(118): n is a, c, g, or t
  misc_feature (122)..(122): n is a, c, g, or t
  misc_feature (139)..(139): n is a, c, g, or t
  misc_feature (150)..(150): n is a, c, g, or t
  misc_feature (160)..(160): n is a, c, g, or t
  misc_feature (168)..(168): n is a, c, g, or t
  misc_feature (170)..(170): n is a, c, g, or t
  misc_feature (173)..(173): n is a, c, g, or t
  misc_feature (196)..(196): n is a, c, g, or t
  misc_feature (201)..(201): n is a, c, g, or t
  misc_feature (207)..(207): n is a, c, g, or t
  misc_feature (209)..(209): n is a, c, g, or t
  misc_feature (223)..(223): n is a, c, g, or t
  misc_feature (236)..(236): n is a, c, g, or t
  misc_feature (238)..(238): n is a, c, g, or t
  misc_feature (243)..(243): n is a, c, g, or t
  misc_feature (250)..(250): n is a, c, g, or t
  misc_feature (266)..(266): n is a, c, g, or t
  misc_feature (270)..(270): n is a, c, g, or t
  misc_feature (280)..(280): n is a, c, g, or t
  misc_feature (305)..(305): n is a, c, g, or t
  misc_feature (307)..(308): n is a, c, g, or t
  misc_feature (328)..(328): n is a, c, g, or t
  misc_feature (371)..(371): n is a, c, g, or t
  misc_feature (406)..(406): n is a, c, g, or t
  misc_feature (449)..(449): n is a, c, g, or t
  misc_feature (483)..(483): n is a, c, g, or t
  misc_feature (523)..(523): n is a, c, g, or t
  misc_feature (541)..(541): n is a, c, g, or t
  misc_feature (552)..(552): n is a, c, g, or t
  misc_feature (564)..(564): n is a, c, g, or t
  misc_feature (572)..(572): n is a, c, g, or t
  misc_feature (575)..(576): n is a, c, g, or t
acttaacacaagggttggctactctgccnatagaagataatagtgttcagaggaacttctcttataaaaaccaggnnacgcctgtcggccttgaaantcaccctgtnggngtttancnaacngccagcaatcacaacancggtacttgcngctgctttantgccttcntnatntacctcaagacatgccttatggnatgtntctgananatagaggtcatctnggccttctggaanantaccnggggggngggggggggggggggngaanagatcgaganggggcatgtgttggagctgctcctngnnagtgaagccgtcctcaatgnggaagcgggggatgtggaccaccagcatcatctcctccaattnatccagccactcctgcagcacctctggggggagtnccttctccaccttgggcagggtcttctcagggttgggcaagangaggaccatggtgatgtcatcacctttgaagggnaactgaagcacctgggtgcgttcagccacgcgccgataanggaacttgcgttcctggnacatcatagangctgaacacgantgtccatnagnnttgtagaacagttccttccttgtgttctcagggctgaactttgacttccacagggccttgaagtaaatggtgttaaccagcaccagaacagtgagctcattgatggcttccgagggaatgacatcggtgattcggccttcggtcttattggacacccatttgttgatggccgctctggattgctctgcattttccttgaagtccaggggctggagcttggctccatataccaactcactgatgttctggg

SEQ ID NO: 692786 - DNA, 167 bp, Homo sapiens
ccccaaacccccttttttttttttaaagggggcccccccccccccttggtttttttggtggttggggggttttttttgggcccttttggtgcggggggccccccccggaaaggggggggggccccaattttcctttttgttttaccccccgttttttttttggggga

SEQ ID NO: 692787 - DNA, 259 bp, Homo sapiens
  misc_feature (50)..(51): n is a, c, g, or t
  misc_feature (106)..(106): n is a, c, g, or t
  misc_feature (173)..(173): n is a, c, g, or t
tatgccagcacggagagggagtcgcttcctcctcaacttaaaagtcatanngagaaaattaacacgctccatttgaagtatgtgttatttcccttctgtgtatttnggctgagctccctgatagtggttgctgggtacaggacactgagaaacagctggcagaggagtattanaggactagccagtagattgtaaactcagaagggaacagtgtccccaagtccaagggaggaagtgttcccttctccggtggcgtggt

SEQ ID NO: 692788 - DNA, 447 bp, Homo sapiens
  misc_feature (54)..(54): n is a, c, g, or t
  misc_feature (107)..(107): n is a, c, g, or t
  misc_feature (281)..(281): n is a, c, g, or t
  misc_feature (348)..(348): n is a, c, g, or t
  misc_feature (370)..(370): n is a, c, g, or t
  misc_feature (429)..(429): n is a, c, g, or t
accgggcttgacctgggagatgctcacggggcaggagcgcgtggccctggaacncggaagcgggagtgcggcaacccacttaccagcgggcggacttcgtctggccncaactcctacgacctcgccatcaaggctatcacctccagcgccaaagtggacatgacgttcgaggaggaggcacagctcctgcagttgaaggtgaagtgtctgaacaacctgggcggcctcccctgaaagctcgaccactaccgcgcagcctgcgttcctgcagccttgtgctnggagcaccagccagacaacatcaaggctcttcttccgcaagggcaaggtgctggcccagcagggggnagttacagtgaggccatccccntcctgagggcagccttgaagctgggaactttccaacaagacgttccacgcagagttttnaaagttggttgaaagaag

SEQ ID NO: 692789 - DNA, 239 bp, Homo sapiens
ctcccaactagcccacaacccccccatccaattcacccagcagaccacatagcaccccctgggtgctacagggactcatctacaaactttatgggaaatgtgcacaacttggattttcacaaatatgtggaaaaactgcaatgagggttctgacttacaattcctagggacaactagcagtcatcaagaaaaagtgtatgctagcctcaactttggcagtaagactcaggaaacatttg

SEQ ID NO: 692790 - DNA, 492 bp, Homo sapiens
ttgccagatgcccctaaagctgacttaataaacgtcaacaattgagacctctgcctcagtcactcatctcagctatcagccacatgtcaccatataaaatttatattgccagccgggcgtggtggctcactcctgtaatcccagcactttgggaggccgaggcgggtggatcacctgaggtcacgagtttgagaccagcctcactaacatggggaaaccccatctctactaaaaaatacaacaaaattagccagctatggtggcacatgcctgtagtcccagctacttggaaggctgaggtgggaggatcacttgagactgggaggttgcagtaagctacaatcatgccactgcaccccagcctgggcgacagagggaaaccttgtctcaaaaaaaaaaacaacacgcatttagagtagacttaattggccggaaaaccggtggggaaaatactcacccataggttattccttggaacagatcagcaaaatt

SEQ ID NO: 692791 - DNA, 662 bp, Homo sapiens
gttgtggaacaaatggacaaaatgcagttcaacgaaaaagatgacgaagttacacgacggtggaagaattacttgaaacttggacttattcagcgtggcaactaaatgaagaggagctgaatgcgataagcaacagaaaattcatctctgacaaaagaagttcaagacgttaaaagctaagcaaaatgagtcaggtttctttgggctctctgagttgaaggaacttaagaaagtgatccatgagaaagatggagagatcaagtctgtagaagagcttctggagggagaacttctcaaagttgctaacaaggagaaaactgttcaggatttgaaacaggaaataaaggctctaaaagaagaaataggagatgtccagcttgagaaggctcaagagttatctatcacttccaaaggttcaggagctgcagaacttattgcaaggaaaagaggaacagatgaataccatgaaggctgtgtaggcagagaaagagaaaggactagccaatacagggaagtggttacaggatcttccagaagaaactgaatctctagcacatgttcaggaagtagccccacatcacttggaagaggctcctctggatcacagcttgccaacgtgcgatgctgtgtaacaccaggggaaggacgggcgggttccgtgc

SEQ ID NO: 692792 - DNA, 695 bp, Homo sapiens
tgggagataacccaaaattgtgtaaaggggaactgggaatggtgtaaggtgaaccactggacagaaatggataaaaaaagaaaaagaacattaccagacagatgagcaaatttatcccgatcaatcacacagagtcttgtggtggtactgttgcattaagaatactttaatgtactaaggagtcttcacagagacatgtatagtgattataacagacacagtggaagaaaatcattaatcctatcagaatgttcaaaggtcgttcagagtcacagaggaatatctctctgtacacagaatcattgacaatttcagagctagtccagataaatagacatgaacagttaaagcagagtacaagagatatgaattagcaagaacgctgacgcactacatggttcacacagtgtcgaagacaaagctctatgggaccttgatatagtggggatatttgtccccagccaaatctcatgtgtgaatgacaatcccaagtgttgaaggtggggccgggtggaaggtgtatgggtcataggcggagatccctcacagcgaagatctgtcctctcaaaagtgagtaagagatatcatgagatcagctctctctagtctctctctctctctctctctctctctctctctctctctctctctctctctctctctctctctctctccgcgtgccgaattcctagcag

SEQ ID NO: 692793 - DNA, 146 bp, Homo sapiens
gaagcatgtagagttagattctccagactgtaggctcatcgaataggcatacactgctcttgagaggactggcaagcaggagaggtgcttcattggtgctgcaaggtccggagctgtggtcggcttggctagtgggggtcggctcg

SEQ ID NO: 692794 - DNA, 226 bp, Homo sapiens
atcttcagagatgatgctgctgtgagtctaaagggtccctgactcgtgagctcaggaacctggaccaggagcacactacctcgaaagcttaagatctcttggcagcaggacgcccaagaccagagcctgtgtcacgtcctaggaacagggtggtgcggccgtccctcaaggcaaggtgagcttgagcccttcccaggggcaggggtggggctcccagtttggtctt

SEQ ID NO: 692795 - DNA, 618 bp, Homo sapiens
acagactgccctgagggtgtttgcgccctggacggatggtaagctgctccgtgtgcgattggaaacagctgcgtgagcgtttggcattttcggtcagaatccccgcaaggatgagtgctgacagagagtctgacccgcattgccagaaacgttcagcctcatcagacgacgatctgagatttagcagtcgacaggcagcaaactagcataatgaagagagaaaacttgagttcttgagacttatggctgcaggaatgaaagctcatactggccggcttgatatagcagatcacacatcaacatctcacttacgaaccggtaacgaagacctgacaatccatgaagaactgcaggctcaatatcagcgtgtggtctgttatcaggatgatatcggcgacattgcggacttggcttcagtgaagtagaagaccatgttgaagaaggtgatgtagcttgagatgatgatgattgcgattatgattcacctggacctcaatgtccatatgattctgactgcgagtcacagtcattgatagaggaatttgctgacgaacttcaagctagtgtgcacactgatgcagtgtaggatcccacctccagtggtgcattctgcattct

SEQ ID NO: 692796 - DNA, 620 bp, Homo sapiens
caaagaactttttttctcccaaggactcctttttacctccaattcccttaaagggccttttaaccccccagttaatttgggtttcttataaccagttatctgaaaaaaacgcgtatgggttaagtccaacttttccgcatcccctgaaattccgcaggttttagatattatggaccaccttacttttgatatgaagaaaaaattccgcccgatttaaagcagtattttaaaactgcaagggactatagtatgcttacgcagcattcaaaacccaatctttgtattcttagggcacatgtttacagcaaagttggcccacagatctgcttttgtgaagctgtcgtcccgaaacaggcaccacaagcattgttttgtgccgccataattaaaagatgcacagttctcgctgtttccgaactcatcatagtaagtgcctacatatatctagctaacacatgtcatttaacattttttcccagtactgttacacggagagaagttcattaaggtcacccagaacacaggccctatgacgaaattgggcgcacaatgggtaacacttagtttatacactgtacgtgtcgaacctttataactgtggcttgactcgtgtttcaatc

SEQ ID NO: 692797 - DNA, 2306 bp, Homo sapiens
  misc_feature (94)..(94): n is a, c, g, or t
  misc_feature (98)..(98): n is a, c, g, or t
  misc_feature (100)..(100): n is a, c, g, or t
  misc_feature (104)..(105): n is a, c, g, or t
  misc_feature (483)..(483): n is a, c, g, or t
  misc_feature (485)..(485): n is a, c, g, or t
  misc_feature (487)..(488): n is a, c, g, or t
  misc_feature (491)..(491): n is a, c, g, or t
  misc_feature (493)..(493): n is a, c, g, or t
  misc_feature (495)..(495): n is a, c, g, or t
  misc_feature (498)..(498): n is a, c, g, or t
  misc_feature (508)..(508): n is a, c, g, or t
  misc_feature (514)..(514): n is a, c, g, or t
  misc_feature (540)..(540): n is a, c, g, or t
  misc_feature (843)..(843): n is a, c, g, or t
gattatctggatgaacaaaacagacgtggatgtactgaggatagagggactatcaatgcagagttaatgttaatggttattaattgtgatatanaatncncagnngaggagcaacattcctggatttaaagaatctacagttttgtgcaattgtgatttgagaaactggaaacattgtgccaatggctttgagttcctataacaacggtgttaatttgattaactcactgatatcttttaaaaataatagacatttgcttcctacacctttttgtacatgacctaaagagtatattcccagaagctgctggtcagacacatttagggatgacagttgaagaggacttttttaaagctgcatgtgaatatttcctctgtgtgatttgtctgatgtagaaaagttttcccctcatttttatgagtaaaaacactaagtgggtggcaggggggtgggggttcttatgggagtgtcataccgggctntnanntgncngnagnctagagactntttccnttataagccttcagaaacccaaccangtctttactgtgtctagctttttaaatactgattggttagttttatttttgcccacagtttcttgggcaaaaaggttcttcattttgtctgaaaaagaaattatttgccagaggtatttggagcctctttgaaggggagatagagtgggggtgggttgtggggagggtggagttattggggtttggggttctgtttccatacaacattgtttatttccgattcctcagaagatcctttattatgaataacctcagtgtaatgttaatttcccgtccccatgtcaaaattgtcaccctaagccnttttttttttttttttttttttttggagacgggctcactctgtcagccacgctggagtgcagtgacatgatcttgactcatggcaggcttgacctcctgggctcaaggaccacctcccaagtagctgagaccacaggtttgccccatcacacctggccgatttttatttttttgtagagatggggttgtccaggctggtctcaaactcctgagctcaagcaatgtgcccgccttggcttcccaaagtgctgggattataggcgtaaaccactgcacgcagcctaccctctgcctttttaagatgatgtatttatttaatttttgccatcattggtgcttcaccttcctgcgaaggaaattccagagcctgtatttaagctacctaggcttttacactccctttattgcctttccaaatagtatctcatttggtgtactctagtgtcctatacctcttggaaacgaaagagggcccaacctacaactaagaagggacaaaccttgaactaagtaagaccttacacacccagaaagaacactgggccctccttcttcagggacaatgcagtagccacttggcttgtggaatttactgaaggctatttcctgtaacttgctagttaacttagttttgtatttcaggcagaggtgcgctctgtaatgttgggcctttgacttcacagtactggagagctgttcacacagatgtttagacctttctctctctctctctctctctctctccttttcttctttctcaacaactctttcacagaggcagtcattttgaaaggttgaaatatttggcctttaccaaagagctttttttttccttaagcaaaatcctttcagaaagaaacaaatggggaagggcagattaagaatgcatatgtcccaatccacttctataggagtttaatcatattcacatgagtaaaatgatggaagaactctttaaggtaatcctttgggataaaggatcctgggaagttctctcaggtaaagaaagcttacagcagatttgtaatatatgtctggagagctatttataagaaatttaagaggattgttttgttttcctttattaaagatttaagcctttttactttgcaaaaagaaaactacaaaagttttatagatataactttgctaattttttaaacttttctgaaacgattagctgtagccaaattatgtggttacgttttgctacattagaatttgaaaatgcaatatgtgtggtaaatctactgtttgaaatttataatggtctctgatatgattcgaattttggtaacttttgaaagttattttccccctttagtcatggatttctatttgttttttaatgttaatttttctagaaagcatctgaattgactaggcttttcctatataaaaaactcaaaacttgttaactctgtactttaataaaatttaaaattaaaactgtgttgtttttt

SEQ ID NO: 692798 - DNA, 2469 bp, Homo sapiens
  misc_feature (94)..(94): n is a, c, g, or t
  misc_feature (98)..(98): n is a, c, g, or t
  misc_feature (100)..(100): n is a, c, g, or t
  misc_feature (104)..(105): n is a, c, g, or t
  misc_feature (483)..(483): n is a, c, g, or t
  misc_feature (485)..(485): n is a, c, g, or t
  misc_feature (487)..(488): n is a, c, g, or t
  misc_feature (491)..(491): n is a, c, g, or t
  misc_feature (493)..(493): n is a, c, g, or t
  misc_feature (495)..(495): n is a, c, g, or t
  misc_feature (498)..(498): n is a, c, g, or t
  misc_feature (508)..(508): n is a, c, g, or t
  misc_feature (514)..(514): n is a, c, g, or t
  misc_feature (540)..(540): n is a, c, g, or t
  misc_feature (843)..(843): n is a, c, g, or t
gattatctggatgaacaaaacagacgtggatgtactgaggatagagggactatcaatgcagagttaatgttaatggttattaattgtgatatanaatncncagnngaggagcaacattcctggatttaaagaatctacagttttgtgcaattgtgatttgagaaactggaaacattgtgccaatggctttgagttcctataacaacggtgttaatttgattaactcactgatatcttttaaaaataatagacatttgcttcctacacctttttgtacatgacctaaagagtatattcccagaagctgctggtcagacacatttagggatgacagttgaagaggacttttttaaagctgcatgtgaatatttcctctgtgtgatttgtctgatgtagaaaagttttcccctcatttttatgagtaaaaacactaagtgggtggcaggggggtgggggttcttatgggagtgtcataccgggctntnanntgncngnagnctagagactntttccnttataagccttcagaaacccaaccangtctttactgtgtctagctttttaaatactgattggttagttttatttttgcccacagtttcttgggcaaaaaggttcttcattttgtctgaaaaagaaattatttgccagaggtatttggagcctctttgaaggggagatagagtgggggtgggttgtggggagggtggagttattggggtttggggttctgtttccatacaacattgtttatttccgattcctcagaagatcctttattatgaataacctcagtgtaatgttaatttcccgtccccatgtcaaaattgtcaccctaagccnttttttttttttttttttttttttggagacgggctcactctgtcagccacgctggagtgcagtgacatgatcttgactcatggcaggcttgacctcctgggctcaaggaccacctcccaagtagctgagaccacaggtttgccccatcacacctggccgatttttatttttttgtagagatggggttgtccaggctggtctcaaactcctgagctcaagcaatgtgcccgccttggcttcccaaagtgctgggattataggcgtaaaccactgcacgcagcctaccctctgcctttttaagatgatgtatttatttaatttttgccatcattggtgcttcaccttcctgcgaaggaaattccagagcctgtatttaagctacctaggcttttacactccctttattgcctttccaaatagtatctcatttggtgtactctagtgtcctatacctcttggaaacgaaagagggcccaacctacaactaagaagggacaaaccttgaactaagtaagaccttacacacccagaaagaacactgggccctccttcttcagggacaatgcagtagccacttggcttgtggaatttactgaaggctatttcctgtaacttgctagttaacttagttttgtatttcaggcagaggtgcgctctgtaatgttgggcctttgacttcacagtactggagagctgttcacacagatgtttagacctttctctctctctctctctctctctctccttttcttctttctcaacaactctttcacagaggcagtcattttgaaaggttgaaatatttggcctttaccaaagagctttttttttccttaagcaaaatcctttcagaaagaaacaaatggggaagggcagattaagaatgcatatgtcccaatccacttctataggagtttaatcatattcacatgagtaaaatgatggaagaactctttaaggtaatcctttgggataaaggatcctgggaagttctctcaggtaaagaaagcttacagcagatttgtaatatatgtctggagagctatttataagaaatttaagaggattgttttgttttcctttattaaagatttaagcctttttactttgcaaaaagaaaactacaaaagttttatagatataactttgctaattttttaaacttttctgaaacgattagctgtagccaaattatgtggttacgttttgctacattagaatttgaaaatgcaatatgtgtggtaaatctactgtttgaaatttataatggtctctgatatgattcgaattttggtaacttttgaaagttattttccccctttagtcatggatttctatttgttttttaatgttaatttttctagaaagcatctgaattgactaggcttttcctatataaaaaactcaaaacttgttaactctgtactttaataaaatttaaaattaaaactgtgttgtttttttctcttctgctagatacatatataattaaagtactcaagttagttgttttgcagagatgttgccttcagatgttaatcaggtctctcaagtttcatggagtctatgctgatcctttaattgacaaataaaagatatatatctgtggtgtgcaaaaaaaaaaaa

SEQ ID NO: 692799 - DNA, 1185 bp, Homo sapiens
gcctatcatatagtaaaatccatcccatgacccctatgaggggccctctcgatgcctcctaatgacctccgggctacccatgtgatttcacttccactcacatagagcgtctcctcatatcggttagcgtcctacgtaaaccacacgaacactaatccatataaccaatggtatggcgcgatggtagatcatcgagaaagcacggatacgcaaggtccacacagccacacacaaacctgtacctaaacatggccttcgcatacgtggtataatcgctatgtttattacctcaggaagtcaggtacttcggaggaattattctctgagtgcctgtgttagccagcatgccgcagaccctagccacctaacactcgcccaaattgaggtagggacactgggcgccgccatacttgggcaatcgatcccggcgtaagattgccctagagagtcgccatctccgtgagacacattccggtatttactctggatgaccggaaggtattcgagatcgagcccgtgacgactcacccagtaagttcttagactagaaaaaatcatagcgcgacccaccagaactagagttcgcccgcgaacgtggcttgacttgaccacattgcatagcgtggcgtcgttctcacttttcatcgccgtccttaccaaaagccttcgatgacgatggcctcctctgaagatcgtccctccttttcgaactccgatttcgttcccggcatccggcaaggtcctaaacggagccttcaagacgactttgtaatctttgttacgcgctattcagtgcctttgcccacagtgatcttctccctccgatccacgtgttattacgggccttcgataactggtagccgcgtcaacttgaatcgtagctttcaatccccgtcatagcttaaaatattttcgagttcccactaggttcccaaaaacccagttcacgtttttgcgccttttccgaaaaatgcccgccgggcggtgagttccctggggcaactttttgcgcaccagtaggtggcgattcagacgcataattatcatcagtaagtgttcctccgcaatcttaattgactgaaggggtccttcagacaacggcgacacaacggcacacaagcaacgcacaagagagacaccacaaatagacacacagggggcacccaccgccgaccgagaacttgc

SEQ ID NO: 692800 - DNA, 779 bp, Homo sapiens
cacagctatgtgtatcctgactctgatgcgcgatctgcgtagattggtaccatctgtccaaatgacttagtgttcgagccagaataccagagcgtgaatccggaataaaggttcactctgtaagatatcaatgtggcatgtcgatagactaaattgcgtattgttcgatctcggagggattgttttggggacctcatgatccattggatggtatcatgttatgtgtgacacatattggcgaaggtgataattaggttcaatgaaacattgttgattgagtaaatagggcgaaatttcttttggggaagaagaacttatcaccgttttccgaatgccgatttctcgaagtcggggcaccaaataaggtcccgatagtaggtcctgcacagaatttaacagttcgcgggatccactcgggggaggtggtacagacaggtttgcggttcacgactttggggtgaacccaacccattttaatgtttaaagtttaattttcctattgaccggaggcgttgtcagagcagtgtgcgatggatcgttgggttaacggactttgtaccgctaaaatttttcccttgcgcggatttgccattgccaggggattttgtcccccacccaatactaatagatgttcgttaatttccattacggtcttttgagctccaggccatatggaggctattttttggaggagcttcggaaataactttagacattccgaagggcaacattccccttcataacccaaggaattaaagtatttcctagtcagatatcag

SEQ ID NO: 692801 - DNA, 403 bp, Homo sapiens
  misc_feature (29)..(29): n is a, c, g, or t
  misc_feature (31)..(31): n is a, c, g, or t
acgggtgtcgttctactcccaatccgctngnaatatgcaacccatgttgccccttataggcagcacgctccggctggctccagccactgagcaactcatcctccagcctatagatctcaacccctaacggacgacacaccgtcagcgggtcctgcgcctccggcccccacatcggcagcgacaaatccccgccagggcacgtcgacaatgcccacaacaaatcaatctcggcaaagaattccaggtaatcgcccttctgcgccggacaggccttcataaagtacatgtcatcgtgattgagcccggcgcactggaaaatactcaacacgtcatgcacatcgaactccgtcagtccgtggggcaatacagcacgggtcaggttcgagtgagaacgacccaccga

SEQ ID NO: 692802 - DNA, 608 bp, Homo sapiens
  misc_feature (46)..(47): n is a, c, g, or t
ccctacgattctcgtgattaataaatacatatacatgcatgataannagcatgagcaaattgacagtagtactgtctgagtagttaaatattaaaagccaaggcccttatacaaaggctgggatataagaaaagcccaccaagtttagcttaggcctttcctgggccttaaaacataaaataacgaagaatacgtcaggacccatttaggattaagccagttttattgggaagaaaactccccaaactgctgtgatttagcagaaggcaaagcaagggtaattaccccagcactcacagccatttaaattaagtcaatttactgaggctccagaggaaggtcttcaagactcaatccttagttaatagattaaaagtcagtaacttatgtctttacataaatgtacacatatgtatagacatatagcttaaaaaatatataagctctgaaaaactttgtaattttaagttggtctggcaataatttccaggccttttccctgcaactggttgcagaaataaaaactccacctactcagttaatgtgcatcttgttattgggccatgagaaatagcagcccaaacctcagtttggtccaggaactgcac

SEQ ID NO: 692803 - DNA, 514 bp, Homo sapiens
ggccataaagaaattcatctgcttcctctttttgtttatatgtcctgagccgtgaagaaaagcgtatttatacattatttgctttatctctttgttttctcctggtcccatcagcctgacttcttttccctaattaggactcacataaatgttacatgaaaaattattaaaaagcaacaaacagagtagagagaaaaaggtagaaaggcttgggtccaggtggctgaatggttcttgatgagcacatagaatgctctttcctctaaatgatgataatgtagtactgtgaataatctaggcagatattagtgtattctcaataatttcctaatgttgctgcagccactactggaagatgtcttaacagctcagcgattaaatctcagtggttatagttcaacagtacttcagtaaagggcctcaaaatgtttcatcatatcattcatgtttctaagcaactatttctatggcaatgtatcacaaacctatgattaaataaattagcactctctat

SEQ ID NO: 692804 - DNA, 409 bp, Homo sapiens
  misc_feature (128)..(128): n is a, c, g, or t
tcccacattttcccctcaccctccaagtcctaacccctccatcctttttaacttttcaagccaatcccttaatgtcattcctctttttggggatttgggccaaaggttttccttttttccttttttangggaaggccctccacatttttccctccttggaagaggactttattaaaagtcacaggtggtggccaggggggatttcccaaatttccatcaggggggttaatagttgtccccattgtttacccacacaaatcctcaggaaaccaccccccgcccagggggccctgaggggggcattcccctttatgggttagaaaaacatgaccagaaatcaaaaatgtcagagccccgaagcaggtaatgtaataagcactcatgttattaaaggttttgccttgtggta

SEQ ID NO: 692805 - DNA, 334 bp, Homo sapiens
tccttgaaacccaaatcgtaatccagaagaagatcctaatcgctttaattctatcaaggctgaaggaggtaaggaagctgtcagaagaacaagcttaagcctagcagaagttcattcatgaagcttaaggaaagaagccatctccacaagataaaagtgcaaggtgaagcagtgaatgctgacgtaggaagcttcagcaagttatccagaagatctagctaaaataattgatgaaggtggctacgataaataacagatcttcaacgtagattaaacagctttaaattgaaagaagacaccatctaaaactttcatagctagagacaagtcaatg

SEQ ID NO: 692806 - DNA, 286 bp, Homo sapiens
atggttatgtgtgatctgtcggagtctggcatcgtgcacattccgtgacccatgtggtcatgctgatctgtctctacgagatctgagagatgaaaagagagcagtgtgtgaaagcgtgacagaggattcaggtgatgactgtccgctctgagtcatgctatcagctgagttgcagatgtctgaggttacggtgcctctgtgctttcagcattcctatgaagatgagcgctcagctgcaggaagatgtctgcagtcccatgtcaggcatgggaggtaggaggtacga

SEQ ID NO: 692807 - DNA, 239 bp, Homo sapiens
gttcagagcgttgggcggcgggcgtccctgagagaattataccttgtatatactactggttgggcatcctactcatcagtgtaacccggtaccagggcacttcggaaatgatggctcttaattgcctgcagaattaaccatggacattttagtttggtttgaaaaacatataggccttctgcctccagccttccatcaggctagtaaaagaccttgcagactcagttgaataaaataat

SEQ ID NO: 692808 - DNA, 281 bp, Homo sapiens
ggagacatgatacgaatcgagctggtacccatcggtttcaaggtttatgggtggagcgtataagaagccaagttcacaatgatggctcgcttatatccggcggctctaagctcatcactccatgcttttacggatgccccccaactttcaagacccaccgccaatcgggtagggtcagctgttaaggtagtgtaaacctgattaccagcaacaccatcttcatggagaccgttttcttttggaaaacttttaagagccagttctaatgggtcatcaaaaat

SEQ ID NO: 692809 - DNA, 233 bp, Homo sapiens
  misc_feature (48)..(48): n is a, c, g, or t
  misc_feature (52)..(52): n is a, c, g, or t
  misc_feature (84)..(84): n is a, c, g, or t
  misc_feature (105)..(106): n is a, c, g, or t
  misc_feature (134)..(134): n is a, c, g, or t
  misc_feature (143)..(143): n is a, c, g, or t
  misc_feature (147)..(147): n is a, c, g, or t
  misc_feature (150)..(150): n is a, c, g, or t
  misc_feature (170)..(170): n is a, c, g, or t
  misc_feature (178)..(178): n is a, c, g, or t
  misc_feature (180)..(180): n is a, c, g, or t
  misc_feature (183)..(183): n is a, c, g, or t
  misc_feature (194)..(194): n is a, c, g, or t
  misc_feature (201)..(201): n is a, c, g, or t
  misc_feature (212)..(213): n is a, c, g, or t
ggggcgagctccaccgagggtccttgtacagaaatggagggcaaagcngggngggggctggtcccccacccccttaccccactnccagctggtccctccactctnnagggccagacccgaagctactgctgagnaccagtggngagnggnccgtgccttccttcccttcnaccctcantnggntcttggcccanccaaatncccttgttttnnattttcttggacccccgccc

SEQ ID NO: 692810 - DNA, 874 bp, Homo sapiens
agcggggggtactcacttgccgattcctccggggtaccgcaacgtgacggtctccgcgctagccggccgcagcgcgcgattcacggatggaagctccttgaggagcctcgttgccagtgcgctggaatggcctctggtagagcgacgcccttgcagagtccgctgggtctgacgctgtcattgccggcttgtccggcgcttcctgagcaagagcttgcgggacgcgtcttgtgcgtccgtggtcatgtggcccgcagtactatgcgttgcgagtctgtcatggtgttccatgatcaggtttcaataacgcgtcctgggtctctgtggcccatcatggatgagaatcttggaagacttgggatgacaagttcgatcggcattgagtcagatcgccggattaatctaaatgctcaatttgggatgtcttcgaaatgcgagatatcgggccattactactttcttggccctgtgtaacataccactcaatctgctcagatcggtacagaggaaggcacaaagaaaccctgaagacagctgtgagagcagatggactgctttgacacgtacggtaggtatgtcgcatcgttaacctgcatcactcgtgcttgactatactcacctttgaacaggggttgccggacttccttattgtccatacaaggacaaccgcccaagtttaactaatcacttagtcgtttgggttcctaaacaaggtggcccatgggaatctcgggcgagggattggattgtttcccaatggagccctttttgacacccaatggaaccctttaatggttacatcgtgattctttttcaagtatacgccagatttacttgctccgtggacttcaccttgttacttttcattacttgt

SEQ ID NO: 692811 - DNA, 414 bp, Homo sapiens
tatcccccgagctgatggggaggcacactccggataactttatggaaattgtaatttctatctgatgtttttgctctttcatttctctaaaaacgtttttgtatggtaccaatctgtcttccactgtttgctttattttcagtgtctgtatcagagaagggtccatgttgtaaaagaagttgaaaggagtcttgaataatcagaaccgttctgccatactgtctaatgtcaatttgtttcctggcactgcttttggtacatcttcttcctcatcatctggtactgttcagaagcactcatgtccatcaagcctcttctgttaattactctgctgtggtgtctattagctcttgaattaatccaagatccatatcttgaaagccttcatacactccccaaccgctcggggtaccg

SEQ ID NO: 692812 - DNA, 190 bp, Homo sapiens
tttcaattgggatcaactctcggtccagtgctgacatcatctcccatgtcatctacaggaccgtcgtgtcactgtccactggtccttcttcaccaccaattcctcatgcagggctcagcaatcttgttcccgcattggagttgtcttcggggagttctgaataaccgtcacctctggccgtgtgcttatc

SEQ ID NO: 692813 - DNA, 104 bp, Homo sapiens
cacccccaccgcccaccacaccctccctagctagtacgaggctgggtggcgggagagcttgtgggagcaaggagcacttggacatctggagtctggcaggagtg

SEQ ID NO: 692814 - DNA, 107 bp, Homo sapiens
agaggaccagcatgtttatttctaggctactgggctaaaaaatcagtgcgaacttagcgctgtgatgagtgtgcctagaaataaacgggctacctttcattccagtt

SEQ ID NO: 692815 - DNA, 377 bp, Homo sapiens
gcttaagtgatgtcgttcatttaaaaaaaagaatcagttgatgtgatcacttccaaaacataaaaatgaatttttaaaaaatatgttaactcttgagttaattagtgctctgtattttcagtctttcggaaaacatactttttgccagataaaatgaaaggaatgaatcttagatacactttgagaataatgatattttacagagtattattgctgaagtaagggaagaatagaggaattattgagttagatttgaaaattggtttaataatctgacaaaatatttccagtgtttcaagtggatgttctatgttaaagaaatagcactggaacatgaccccttttttcttaaattttctttccattttcctccttag

SEQ ID NO: 692816 - DNA, 915 bp, Homo sapiens
ggtcccactccggctggcggtacgcgagggaatgggggaacgccgcgggctcgaagcatgggcggtatctgcagatctaagggggaacagactctgcgtgactgtttcacaggtacagcttactactgacgtatcccgtgatcccgagatcttagccgcgtgcgcgtgaacatgaacgacaccggaaatatgaagagggccagcgccgatcggaaccaaaggctacgtagccacgtcttataggcacgagatagaagtgagtgggcgttgattgacccaagtgcaacatgggcctgcaccttttgaccaaccgatggtgttaaacaagtacaagcctctcattaactgtacacgacctacctctgatgaacacagtttccgagccagttccacaccttaaatagccagacgtgtcatgtggcccagctcgagcgggaactggccccggcaaaattgttaacacattgggaaaaactgagattgtcgcccatgtgttttcggagcattgaaaggacttcctttgttccaggcgtaactaataaggaagccgtataaggataattcctctctctttgaaacttgacgtagaaaaggggttgttgggcggaagccgacggaaaacgcagtgacttttagagtggtagatcggtacaagagttgggcttgtgtgttcgaaggaacaagctttttaacggaaggagttcaggtatatattttgggtaaagttatcttcgtttttaattacattttcaccttctttaaggaacgaagcctaggggggagttggcacacccttggtagtatgtgccacgtatgatgaaaaaaggcgccttttaaatgaaaagccatatgtgcgggagaacaacattgggacttcggcaagtaaaattggaagtcttggcgccgttaagaaaa

SEQ ID NO: 692817 - DNA, 217 bp, Homo sapiens
  misc_feature (16)..(16): n is a, c, g, or t
tgttatagccacatgnggcgcttatgattttcagtctgcgggtgacgaggtaacatggggcctcgcgttgttgtcgccgatgggccaaacactattatttaacagtacgttaacccagccgcgtaacaaacgggcgccggcgacgcagacgcatatctgatgaaaaaaaccagacagcaacagttaacccgttggcttaaaacccagagttcgttag

SEQ ID NO: 692818 - DNA, 1698 bp, Homo sapiens
actttttgcttcaaaggacactagcaataaagcgaaaaggcaattaaaagagctggaaaaatatttgtaaaccatatatcaggtaacagtctagtattcagaatagataaggaactcttaaaactgaccaataaaaagataaaccatttaaaaaatgaacaaaaaatttaatagacatttgccttagtctgttggaactgctattacaaactaccatagactaggtagcttgtagtaacagatttatttctcacagttctggagactgggaattcctatatcaaagtgccagcagatttggtgtctggtgagggccttcttccaggttcacagatagtgtcttactaagttctcacatgatagaagaagtaggggtgctatccagagtctcttttataacagcactaattccattcataaggactctgccctcatggccttatcacctaccaaagtgcccacttcctaatgccagcacattggagattagtatttcaacatatgaattttgggggatacatattcaatccatagcctgccaccccttgcctcccaaaatttatgtttttctcacaagcaaaagacattgcatcccaacagtcctcaaaatcttgattcattccagcatcaacctaaaatttaaaacccacagtctcacctaaatatcatctaaatcagatatgggtgagactcaagatatgattcatcttgaggcaaattgctccctagctgtgacactgtgaaaccaaataagccatatgcttccaaaatacagtggtgggacagggatagaatagacatatccattccaaaagggagaaatagcaaagaagaaaagggtaacaaatcccatgtaagtccaggctacaagccaaactccatgagatcttaaggcttgagaaaaatcttttttggcttgatgctccttccaggcccactacagtgggactcctgccttcaagaactgctaggttagaggttctgctcccatggctctgtcaggcagggcttaggctccaagccttttggcagtcctgctgtcactattttgggtggaggagatctggctgattgtgcaatgatggtcttcccttttgaaaccaaggaaggcagccctgatgatctctggaatcatctttggggtcattcttccattgtcttagaggatcatacctggcttctgttgagatggctgatccatacaaatttcattagcaaatggttgcttggtcacatctttactgttatcttgttttgcaatatggatagtctaagaattttctaaatctttacgttctgcttccttttttacctaacaatttcatatttaagtcatttctctcttctgttattttactataagcagtcggaaggagccaagcctcactttcaacacttctcttagaaatagttttggggccgggcatggtggctcatgcctgtaatcccagcactttgggagactgaggtgggtggatcatgaggtcaggagttcaagaccagcctggccaagatggtgaaaccccatctctattaaagatacaaaaattagctgggcacggtggtgggtgcctgtaatcccagctactcgggaggctgaggcaggaaaatcgcttgaaacctgggaggcagaggttgcagtgagccgagatcatgccattgtactccagcctgggggacacagcgagactccgtctc

SEQ ID NO: 692819 - DNA, 1441 bp, Homo sapiens
actttttgcttcaaaggacactagcaataaagcgaaaaggcaattaaaagagctggaaaaatatttgtaaaccatatatcaggtaacagtctagtattcagaatagataaggaactcttaaaactgaccaataaaaagataaaccatttaaaaaatgaacaaaaaatttaatagacatttgccttagtctgttggaactgctattacaaactaccatagactaggtagcttgtagtaacagatttatttctcacagttctggagactgggaattcctatatcaaagtgccagcagatttggtgtctggtgagggccttcttccaggttcacagatagtgtcttactaagttctcacatgatagaagaagtaggggtgctatccagagtctcttttataacagcactaattccattcataaggactctgccctcatggccttatcacctaccaaagtgcccacttcctaatgccagcacattggagattagtatttcaacatatgaattttgggggatacatattcaatccatagcctgccaccccttgcctcccaaaatttatgtttttctcacaagcaaaagacattgcatcccaacagtcctcaaaatcttgattcattccagcatcaacctaaaatttaaaacccacagtctcacctaaatatcatctaaatcagatatgggtgagactcaagatatgattcatcttgaggcaaattgctccctagctgtgacactgtgaaaccaaataagccatatgcttccaaaatacagtggtgggacagggatagaatagacatatccattccaaaagggagaaatagcaaagaagaaaagggtaacaaatcccatgtaagtccaggctacaagccaaactccatgagatcttaaggcttgagaaaaatcttttttggcttgatgctccttccaggcccactacagtgggactcctgccttcaagaactgctaggttagaggttctgctcccatggctctgtcaggcagggcttaggctccaagccttttggcagtcctgctgtcactattttgggtggaggagatctggctgattgtgcaatgatggtcttcccttttgaaaccaaggaaggcagccctgatgatctctggaatcatctttggggtcattcttccattgtcttagaggatcatacctggcttctgttgagatggctgatccatacaaatttcattagcaaatggttgcttggtcacatctttactgttatcttgttttgcaatatggatagtctaagaattttctaaatctttacgttctgcttccttttttacctaacaatttcatatttaagtcatttctctcttctgttattttactataagcagtcggaaggagccaccatgcccgcccacatatatttttcttaaaactttaatattgctaccatagtctatcccata

SEQ ID NO: 692820 - DNA, 283 bp, Homo sapiens
gtctgagcacagagcgagaccctgtttaaaaaaaagaaaagaaagaaaaaaagaaaaaccgggattttctttactggactacaattccccaactaatatggatgggtggttggtttccaacgagccctggtttccggtgaattctatttgggttcagccgttacctgattaagcggtcaagcggggccttaaatggttttacctagaggcggcggtatactccggaaaggcagggcttaagcgacagtacgtggtccccagctggctcagaggggtaccgagc

SEQ ID NO: 692821 - DNA, 144 bp, Homo sapiens
agtattgatgggcagtgagggcgcatatgcatctaggctataatatccggagtatacgtagcggatacgtaacaaccggtactctagaatatagctagcatgcgcaatttacggcgctgatatcgatcgcgcgcagatcgtgtc

SEQ ID NO: 692822 - DNA, 512 bp, Homo sapiens
gctcgatctagaggatcccgaacgtagcccacctgtgtccgcagccagtcccatgtatagaatattacaacctttaactatcacacttgtacatgcctacaccctttagacttcatagctgtcaagggccctcttagacccaaggtgagcattgccactggtataagaattttcaagaatttagtgagtctccggtacatcactgaaattcacaacattagaaaagaggttacgctgattattcctcctagggaatcccctatctatatgtggggctttagctgagatgagtgatagtttacacttcttataagttgtgagtatcgaggggatctacaagtcacatttaatctcttcaaagagcttaccgtgtgacagtgtcctgatgtatgtattgatcccggtatcagcaaacgtcctgggctatctctctaaaacatctctctctctgaaacatctatctttcctaacaatgaatctcttaatttcaatggtaagttcgggaatcccag

SEQ ID NO: 692823 - DNA, 438 bp, Homo sapiens
gccccgtgtatgcccagcagtcaggtctgtcagcaagatttgtcctgttgagacactggtggaagaagccatccccgtgtgcggaaaaaattggcagctattctaaaattgtaatatcgatggtccacggatcagtgaatgcagctgttgaaatgacattgacagaatgaagtaagttggcgaagaaactcttttattcaacctttgccactgatgaccggaaagaagggattaccgcgtttgtggtaatagagaaaggccctcttcctagaccagtgagaatctgctgtccctgcttcacatctctgcttggagaggacgatgtgcagcctgtcagtttttgaagctagttcattatcctcttttccagagcactgttcgtggtgtgcatttcctctccaattgctgtgtggtcgttgtccgacctctcacggcctt

SEQ ID NO: 692824 - DNA, 575 bp, Homo sapiens
ttaaaagcacccgcaacacaagtcagatccgtaccttgagcaactcccgaggagacagggaagctttcctccctagaactggttgacgaaagttgtgaaatccgagcgacagctttcaatgagcaagtggacaagttctttcctctgattgaagtgacccaggtgtattatttctcgaaaggcccctgaagatagctacgcagcggttcacagctgttcaaaattgacgacgagatgaccttcaataacgagacttccgtcatgccctgtgaggcacgaccatcatttacctacggttcagctttgatttcaccggggatggatgaccttctagaacgaaggtcgaaagactcacttgtggacatcatcgggatctgccagagctatgaagacgccacttaaatcacagtgaggtctaacgacagagaagttgccaagcaggaatatctacttgatgggcacctccgggaaggtggtgactgctacactgtggggggaccgatgctgatcaatttgatggttctagacaggccgtgttgggtatcaaaggagcccgagtctctgatttcggtgga

SEQ ID NO: 692825 - DNA, 196 bp, Homo sapiens
atgagtatgttgggacgagcgcgtcgtttcctaatgtatcggctgggcagtgctcaggatgtactcctgagtgttcgccgtcgggctgagccgcttaggcctggggtgagagacttccgtcaccctgggtgagagtttatttttttgatggctaagatactgctgatgctgaaatagactagggtttcggcctgcc

SEQ ID NO: 692826 - DNA, 257 bp, Homo sapiens
  misc_feature (11)..(11): n is a, c, g, or t
atggcgctgangactccgttccgtcgctcctcattgagcgaggcgtacatcaacccacattcaacatcatcttcaagctcccccctgcgctgggctgtaggccgcccgatcttgtggcagatgttgagagctttatcgcaagacagccctagccggctttgtcctgttgcaagccgccaaaccactagcctgcccaacacgcctcctaagcccttacaaggaacaagtaatgaggcgccttgtcctttccgtttgcc

SEQ ID NO: 692827 - DNA, 384 bp, Homo sapiens
cccggtttttttaaaaaggttgaaggggggttttccccccaggggatatatagggttttgcagatttttttggggacagcccactatcccggggaacccttaattttttttttttagagaaaaacccagttttaaaggctttttttttaatttggggtgtttgtcccccgggccattgccaagggttggaacaaccccatatggatttcggtttccccccgggttacaaaggtgaattttttttttttttctttaattggggaacccggtccaaccccaatttgaatatttaattttccctggggaaagccattttgtaaaccccctaattgggatttggttaataattttcattaaataaaccccaaatgggaatttggtcca

SEQ ID NO: 692828 - DNA, 647 bp, Homo sapiens
gcattattataagcagcgctccagtctgcctacgacaaagagacctaaaatcgctcattgcatactcttcaatcagccacatagccctcgtagatatacagccattctcatccagaacccccatgtacagcttctaccggacgacagatcatgtctcaatagagtctgcccatcggtactttactatcgctcaattatctattctcgcgctatggcagaactcaagagctagcgaacgcacgtcacagtcgcatcataatcctcgtctcaaggacttcaaactctactcccagctaagtagctttttgatgacttctagcaagcctcgcttaacctcgaccttaccccccactattaacctactggtgcagaactctctgtgctagtaaccactgttctcctgatcacaatatcactctcctacttacaggactcaacatactagtcacagccctatactccctctacatatttaccacaacacaatgggtctcactcaaccaccacattaacaacataaaaccctcattcacacgagaaaacaccctcatgttcatacacctatcccccattctcctcctatcccgtcaacccgacatcattaccgggttttcctcttaaaaacaatgttatacaaagtcatacag

SEQ ID NO: 692829 - DNA, 1628 bp, Homo sapiens
aaatattatactagcatataaccatactacactatactagagaatactacgtatatacgctcacacctcatataactcccgtactatagcctagcaaggaataatactatcgctagtatcatatataagactactctctataaccctacaacacccactaccctacttgagccaatatatgtgcctatatagccataactaagtacttaagaccgcactagacgacagcaacggtaaaggccataaagccctgaactaagtctacaatactaccaaacacataataggcactaaagactaaccgtaaacataaaacctaaaaacacatgactacccaaatagactaaaagacactaaataacagtaccccaacaaattaataaataaactaacacactagatcatagaactgctaccagaagaaatccacgataaatatatagcaaatcaaacaacaacgcaaccacaacaagacctaaatctcatattagccatacatgaccaccctaactaagtataacataatagacactaaaggtcaaatctataacagaccattagttataacaccctgatattcactcacgaaaacatatatacacatacccgataccagcacacataaaccaacagacacgcacccgtcgcctcaagtcacttaaatcataaccatagagactgtaccataacaccctatccacaaagtcaaatgagacacagatccataacaacacatcatataatcccaaagatggatacccaaatactcctaagcaaaaaaaataataagacataagcatcatacgtaatacatatatactaccactaaacaaaaaattactccctatataaatataataaatcagtagataaaaagaaacaaaagacacaataaacacataaataacaaagctaaaacacaatacgtagggcaaaaagaccacaaacaaaacaataacaagaaacacgtgaggacgcaagtcaaatcggacgccccgagacaaaacgaggcaaaagacagcggcggagagaaaaggcactcgaacgccgcaaggaggagaggacaagatgaggcgagaagacatcagcgccccagaggaaggggatacataagatagcatcaaaaccgccaaaatagagcacgagagcattaatgacaaggcacaagtaccgctaagagggcacaaaggagaactgaagaagagtatagtcaggaaagaaaagggacgaagaaacatgcagaaaagtacgtagcggacagagaagaaaagagtgagaagagaagaggacatagagccagaggaggtacagctacgactgtctggcggacacacaagacaagtaagcacaaagagtctggaagacaagcacgcagagacgggactcaaaataaggcgcagagaagactgaacaagagcggcagataggaaaagagaactgaaatacagaagacggcagagaaacagaccgactcacgaagacacataggaacaagcagaggatagtacacgaacaagcagtatgtagctgtacgagaagaacaatcacgacgaatagcaagagtgttcagagcatgagtgagcgaacggcggacggaagtggagtcaagaaggaacggacggaccgga

SEQ ID NO: 692830 - DNA, 251 bp, Homo sapiens
ttcccgcttctgcttctgccccacttgcacatcatttcacattcctgatctatacatgatgtcattctttggactggtttgaacatctaaccagtttcctcattaaggagttaaagaaaatctttttttttttttttttttttttttttggattctcgctctgtgccccaggggggagtgcaggggggcaacctcattccatggcaccctctggcctccggggtgttcaattagatccccctggcctcacc

SEQ ID NO: 692831 - DNA, 113 bp, Homo sapiens
gaccctgccaaaggcggagatgctgcaacgtcttgatattggcaacccagaacctgaggccctaaccctatagttaagttttgtaagcggacccagcatctccgctttggaaa

SEQ ID NO: 692832 - DNA, 177 bp, Homo sapiens
cgtcattatgaagatatggtgtgtagttattaaaatggagaagctctttactaatgtaccataacaagccatcaaagaagtgtttatactgggcgttcacatagtgataggaataaaacacagcatccatgaataaataaaggctgagcatggtggctcatgactgtaatcctagca

SEQ ID NO: 692833 - DNA, 271 bp, Homo sapiens
ttttttttttaaggaaccagcccgggtttgtcctccggagcccctgcctaagccccatgtgttcctacagggggtggggttgttgttgggggggggctttatgtttcccataaccctggtggaggagggggttttgcccgtgacccttaagggttgatggggccagtggaaaggggttgggttgcccttccttccccccaaccacaggaatgggggggggacacagggccagtaggggcaataggtttttaataaacagaacccctcccca

SEQ ID NO: 692834 - DNA, 170 bp, Homo sapiens
  misc_feature (19)..(19): n is a, c, g, or t
  misc_feature (118)..(119): n is a, c, g, or t
  misc_feature (125)..(126): n is a, c, g, or t
  misc_feature (137)..(137): n is a, c, g, or t
  misc_feature (140)..(140): n is a, c, g, or t
  misc_feature (147)..(148): n is a, c, g, or t
  misc_feature (155)..(156): n is a, c, g, or t
cagacctaaccccaacatnacccacaccgcctcacgtgaagctgggctgagagccctttctcccatccattggaggtcccaggagtgtcacccatggagaggctatgcgacatggctnngggctnngttcttgccanctngagtttnngtttccnnggacatgaacaagg

SEQ ID NO: 692835 - DNA, 528 bp, Homo sapiens
  misc_feature (10)..(10): n is a, c, g, or t
  misc_feature (83)..(83): n is a, c, g, or t
  misc_feature (87)..(87): n is a, c, g, or t
  misc_feature (92)..(92): n is a, c, g, or t
  misc_feature (100)..(100): n is a, c, g, or t
  misc_feature (106)..(106): n is a, c, g, or t
  misc_feature (162)..(162): n is a, c, g, or t
  misc_feature (187)..(187): n is a, c, g, or t
  misc_feature (189)..(190): n is a, c, g, or t
  misc_feature (194)..(194): n is a, c, g, or t
  misc_feature (202)..(202): n is a, c, g, or t
  misc_feature (217)..(217): n is a, c, g, or t
  misc_feature (220)..(220): n is a, c, g, or t
  misc_feature (230)..(230): n is a, c, g, or t
  misc_feature (238)..(238): n is a, c, g, or t
  misc_feature (244)..(244): n is a, c, g, or t
  misc_feature (256)..(256): n is a, c, g, or t
  misc_feature (258)..(258): n is a, c, g, or t
  misc_feature (261)..(261): n is a, c, g, or t
  misc_feature (263)..(263): n is a, c, g, or t
  misc_feature (271)..(271): n is a, c, g, or t
  misc_feature (279)..(279): n is a, c, g, or t
  misc_feature (281)..(281): n is a, c, g, or t
  misc_feature (292)..(292): n is a, c, g, or t
  misc_feature (297)..(297): n is a, c, g, or t
  misc_feature (301)..(301): n is a, c, g, or t
  misc_feature (308)..(308): n is a, c, g, or t
  misc_feature (310)..(310): n is a, c, g, or t
  misc_feature (316)..(316): n is a, c, g, or t
  misc_feature (341)..(341): n is a, c, g, or t
  misc_feature (344)..(344): n is a, c, g, or t
  misc_feature (354)..(354): n is a, c, g, or t
  misc_feature (357)..(357): n is a, c, g, or t
  misc_feature (372)..(373): n is a, c, g, or t
  misc_feature (496)..(496): n is a, c, g, or t
cagccccccncccataagaccatttctcctctgcgtgtggcctagttcttagatatactgtaatttctttcttccccagggcncttnggggncggtttcnttttcntggcgggcaagggcttcaggaagagtcgttccacagggtccctggaaatgaaaccngaatctgttcgtggcgggggggggngnngggnggaggttnggcgaggggggggcnccngggggggacngggggggngggcgnggcggcggggtncnccncngggggggngcccgccncngggcgtaagtngcggngggngggggcncnggggcntcctccaggatggcggggtccgggnttnctccggaccnganggggtggggtcgcannaagcccccgcagcctgcctcttcacaccggggaagtttctcaactgggatgctggcatcttgagttccaggttctggagcaccttttcctgataaagctggacaaattggactcttgtaattntcagccacaactccacaagaggtacatcgagt

SEQ ID NO: 692836 - DNA, 513 bp, Homo sapiens
gtcaaccatgtgcgcctgtgttgtatctattctacatcatttgtttttttttttctgagattagggtctcactctgtcgacccaggctagagtgcaggggtgcgatctcagtttactgcaacttcctcccgggttcgggcgattctcatgcctcagcctcctgagtgtctgggattacaggagtgcttcaccacgcccgagctcattgtagtatttagggtagagatggggttcaccatgttggccaggttggtctcgaactcctgacctcaagtaatcggcctgcctgtggcctcccaaagtgctgggattacaagtgtgagccaccaagcccagcttatatcactgtggtctctggtcagaaaggtctggaaaataccaccttagtacaaacacattacatcaacttttatatgtaagatgtaatttagaacaaatgtcaataagggttttatgacgagactgaaattgcagacttgttcataagcacaatgcttctttactcttactgtg

SEQ ID NO: 692837 - DNA, 403 bp, Homo sapiens
ctggtatgagcacgtgctgtcatggtagtgcgagatttgtgtcagacattgctgtaggtctgcttgaggatctgcccagtacggcgggtgcggtctaccagcctccccatcagcgttaggatgccttccgctaggtcctttatgaggttgatagtcatcgctgtccgaggggtcatacaccaggttggttggcgaacatactcctgaggaaccgcacgggctccagccacgactcgatgagcagcagggagatgcggagcagctctagattggatttctgttgcgtttcctccatgttggagggtgtcggaatagagtctgagaagcagaaggaggtctgggagtcatgcaggaatgaatacttctggtccttagggatataggtttcttcaaactcctcctt

SEQ ID NO: 692838 - DNA, 221 bp, Homo sapiens
cctagaggaccctacaagcagctatcagtacttaggatattcaagtgttcgaactggtaagaatattcttccagctgaatacaatgcagaatggaccatttaggggtaaataacctcacttaatcactctttcctgctaacaaaaataatacaaatatttgtttatattaggctataaattaagacattgaatattagatttggaatagctgctgtagttg

SEQ ID NO: 692839 - DNA, 329 bp, Homo sapiens
actcttgagggtacactctctgcctgccagattcaggctaacaggtagctgggattacaggcacatgccaccacacccggccaatttctgtatttttagtagagacggggcttcaccatgttagtcaggctggtctcgaactcctgacctcgtgatccacccgcctcggcctccccaagtgctgggattacaggcgtgagccaccgcacccgcccaaaatttttaatatttatgtatagaatgtaagcttttcagcatgattttgaatcaaacaaaatgagttagattgaaagctctgctttctgagagcttagatttgtaactcagaa

SEQ ID NO: 692840 - DNA, 591 bp, Homo sapiens
tgaaattaccaacagaactggcagcgtcctgtcttgccttgggcacagggtctgctgctcgcctgcctgccagccctgagagaaactccctgcacatctcctcagtaagagggtgaacctccctttctggtacttcagcgggtgttggacattttggggggacagagcaggggaacatctggctctgttcacagtctctgcaaacgtggtatgttctgcccctgaacagtggctagatgcttggtagacactgagctaatcatgtggtctcaggtcttaggtctgcccacctcagtcagggtttaagctccagccctaggggatgtgggagcagctgttgtgagggaagtcggccatatgccctgcttgcttgggagctcactgagctcaagggccagcttcctccagaatggatcatctgcattctgcagagtggtgtcccagttagggtatgtatgattgttggtcttctgggcaaagctcagagaggccaagggaggcacggggtggcatcaagcgacactgatggttgggccttcagccacttgcccatcagcaaagatgtgcaagtaagtttcaggcaagagctgc

SEQ ID NO: 692841 - DNA, 304 bp, Homo sapiens
ccccgggggggaaaacccaaggcccggggtttggtttaaaaaaaaaatttttcccccccaatttccaacccccggttggggaggggggggaaccccaacgggggggtttttttttttccccaaacggggggggggccccccaaagggttttttttgggggaaaaaggggtttccccttaaacaaaaaaaaaggggccaaaaaaaaggggggcccccaaaaaccaagaaaacccaaaaaaccccccgggggggggttttttttttcccggggggggggggtaaaaaagggggttttttttgggga

SEQ ID NO: 692842 - DNA, 895 bp, Homo sapiens
tggtgtaaggggcccaaacggctgcaaaccagaggggtgatagcgcctaagcatagggttagagttgggattagggggctatttcctggtctagggggtggaagcggttgattaaaaaatatccctgctacaacaatagggcttgaggggagtagggctgaaacggggggggggccttctagggctgagggagagtcaggggtgggaagacctaatggggctgataaggcctagctgcggctagagaggaggcctagatagcggggagtagaggctgggaataaagcgttaaaaagggagctactcagggaggaggaggagtcctacaatagacgttgggaagtggtacaggataaacctcatggcaaaggggcaaagcgatagaaaccagaatatacggccgaataccggtgagtaatagagatagggctcagaaacggagctagaacgagaatgtcggagcatctggctcgaagcgtatcactcacctggaatgacgccagagagggaatcataaatccccacagcgcccttcatcccacccgagtggaaccacgccgggaaacaaggctgcgctacagccgagcaacacaaaggaatacgaatgtgggccaactacgagggcaacaacaagcgcagaacaccaactactctgcggcaacgcaaccactggctacacagtggtagggggggcccggaagcttaccataacatcccacgagccgcagaaaatccctatgtaggcggaccccgaggcaaccggaccataggccaccagggcgactcaaactattcggcgagacgacaccccaacgcagaccccaaggaacaaccaggcgagagaaaggagtgaggagaccacacaccggcgagaaaaacactcgtgacatagacc

SEQ ID NO: 692843 - DNA, 951 bp, Homo sapiens
tgtgattggatatcgatactagctggagcaatgagctgcgttggcaactacctctggcaggcctctgaagtgcaccaccacgtgtcactcgttctcgtcttgccagctgatattcaggtagagaagttcatctgccatgacgaggaagatgaatgacctgctctggcacgaaggcctagaagtcggtcagttcaccacaactgcctccgtgagctccaagagcttccagcgtgctgatgcatgaaacgagtggaccgctcgtgaatactgaccgtttcatcagagctccgggaagtcaagtgcgttcctgcctaccgatgggaacgaatgaactgattactgttctagaacctgcgggagtcatcctgggtgtcaggtatgggtgagacaagctaatcgataccatcgtcgggggaacggatcctactgtaagcgccaaatgtcgcccaagccatggaacaggtgcacattccaggcctatggaagcctggcgtcaagaccgcaggaactagatggtgcgtccatgtccacattctggtttgcctacggagcgggactggctttcgtgcatctagtccgtgaggctggcatctgaagatgacgcccgtgggcccaagggggtcaccttcatgaatacaggatgagcgtgatcacggctgacgtgatgattgcaccaatcggcatacagtcagtggaaaggtacttgccttcgtgttgttgccccctcatgccgtcaagcggcctcttacagttcccctagattgtgagaaaccttgcaggcaggtgcccaaccatcgggatcttcccacctgagcacggtgactcgtctgaggctaccgggtagtgtttggaaaaaccaaagcgcgaactggcccgtcaaccgttgaaagggggccctttctcggtggaagggccgaccccactccaggttccccgtccatcaattggcac

SEQ ID NO: 692844 - DNA, 1149 bp, Homo sapiens
gcgaaaggcggcgaatgagggagccaagaagacaagtggattgatccatgtttactagagaaagattggtatgatgtgagagcacctggtatgttcaatattcaggaacatattggacagacgcgcgtcaccaggtctccaaggtagacgcgaagaattgcatctgatgagtctcaagggtcgtgtgtaagagagtgagtcttgctgagtatagaggaattgattgaaagtttggcccttgaggatcatatgttcataagctggattacctgaacgacgtgttcacgggggtaaataactagtctgatactactcttccattgggcatggagatcattacccgatgaccatacaagtggtgtttaccactgtggtcatagacacaccatgggcacgaacaaatgacttgaatgcctcaacgcttgacttgtacaaggaactaacccgacatgggtctagactctggcagttcgattctggtaacttggatgctacggatctgcgaccgtaagagaagcactgcaagcaaagtcacaggattaatcggtgaaagaacacctcgtgtaattgcatcaagggcgagccaaaaactaggcgttcctgctcgagaaatttcccgggacaggagaaggaatggagttggaaaaaatccaatgggaacgccgaagaaggtgtaggcaggaacaaaagtgacctttgggtatagaagaaacgtgaggtcaaattaaccttggaattatcccaggaagcagggcattagggagaaagaaggagcattaagtaaagacgggttttggcccaaatactaattaatatgcgcttccttcccatgcaatggttcctatcggttcagaacaaggcgggacaaaactttgcctggcaagtaaaggaccccccacgggtaagaacattggggggaagacaggctccatggggcagcctccacattggcgttggaacgggccaaggaaagatacagagggacaaaacagcccaacgagggcgagacacgcacaaaccagggctgattaggagttggacacgagagctgcatgggatcacttgacacgcaacacagtccaacgacacacccgggcgaacaaggtgcgacgacgttaccaacgacgctcgctcacgacacaccagggg

SEQ ID NO: 692845 - DNA, 441 bp, Homo sapiens
  misc_feature (16)..(16): n is a, c, g, or t
gggagaaggtggggtntgcgccaacgaactgccttccttaatattaaagacatggggtagctgccggaacgactagcctgcacagttaaagttggactcgggactgagacgattgcttctcgtactttccggtttgtttgccacagcgatggagttgtgggttgaactgcgtcacaaccttttgtcagccatttttttttcaagttttttaccattaccaattacacttgctttgccttattttgatcagcatagttgtagattaactttgttttgcctcagcttcccgaagcgcttgctttatacgtgtgtgtcgtcactgaagattgaccttgtatgaatactgaggtttcttggtaatgctttgtacaatccaaaatgttaaattggctatctgttgaaagtgtatgcttctaataaaaagcgtttagttttcattca

SEQ ID NO: 692846 - DNA, 151 bp, Homo sapiens
tgaccagatgatgcgcagcgtagatgaatatgcagatctgtactgggtgggggccacgcaaaaggaggtgagaagcacagtaactggcactgacgtggaagctgatgcagcagtggctaaaggagactgtacagtgcgttctctgcatcat

SEQ ID NO: 692847 - DNA, 536 bp, Homo sapiens
  misc_feature (530)..(530): n is a, c, g, or t
tcttaggctatgttattgttacttctcctttttaaaaaaaaaaaagggcagccgggcgcagtggctcacgcctgtagtcccagcactttgggaggccgaggcgggcggatcacaaggtcaagagatcgagaccatcctggccaacatggtggaatcccgtctctactaaaaatataaaaattagctgggcgtagtggtgcgtgcctgtagtcccagttgctcgggaggctgaggcagaagaatcgcttgaacccaggaggcggaggttgcagtgagtcgagatcacaccactgcactccagcctggtgacggagcgagactctgtctgaaaaaaaaaaaaaaaacgggcaaagcaaattttcttgaggtttctttggtggtggtgcaacgcagagggggtgggcaccaacccaagctggctcaaaaatggccgttgggagtaaacgtgagggctctgggtggccttgcctggccagatggcccttggtgccctggcggaacctctgccctttattattgggcatcagccncagtca

SEQ ID NO: 692848 - DNA, 184 bp, Homo sapiens
aagcggcccaaattaatctgagtggcgatggctttgcgcgagatatgcggcctatacgtgtcttagggttgacgggtctcgcgcagcaccgccacatcgagaactgcatcactccaccaccccattgctccgccaagaggcctaggatctaagcggtgaatgcccgcaacaggggtaggcggtg

SEQ ID NO: 692849 - DNA, 594 bp, Homo sapiens
ctccgggtcgccgccgttggacgtgctgcccatgactgcgcacgcggcgacgacgcggtcaggcgctgctcacgagcacgggtgtgggagccagggcgggagcagagtgggagcgggcgtcgcatccttccacggccatggataggtggagaatctgctgcgtaagtaccatgatcgccaatacatcggagacaaaggtctgacgtcgcctgtgccggtgtacatactctaagcgcctgttgtgcacaggatcaccttggtacgtgtacgatcgagtgctgctgtgtagtagcgatcatgtcgtaagggcgctctagtcagcacgtcgataccgccatactgatgatctggtatcatagtgtgtcactcctgaatagcgtaggtagttatcagtaagtctcgggcaattgacggatcagggtacacaacgcgtcatgtttgggtgaccagcagcgagcgtaagagcgaggttcagagtgattcgcgttctctatgttgctagtaggtggggagagtggggagagggggtgctatccagttcgcctgatgagggctctcgaaccagccgttttgggttgtaaaaaaacggtcgaa

SEQ ID NO: 692850 - DNA, 796 bp, Homo sapiens
  misc_feature (195)..(195): n is a, c, g, or t
aggcgggggcaaggagggggtcccaccccccgcgaagggaaggttcccgcccgctgcccgcagagaggggtccatacccacacgcgttcatcgacatctattggggaaagcagcgacgcgggcgcgcgcccgcggctgacttccaagagactccgctgcgagatacacggattacgagggggagattacttcctncgtctgatggcacaccctcattgcaacacgcaggcgagcgcgtggccacacggcacagggaggagcgccacacactgtggagccgggcgcggatgccattttaggtaaatggggtaagtataacctacgtggcggagtcgctcgcccaggatcgcaagagaagtgttagagaagatagttctcccaccccgtgcccatctatagagactaggcgcgttacgatcatatagcggcgggcttccaccgagaagcaatgtgtctctgtatttctgtctccgcccgcgcgagtatgtatatatgtgggcgcccgctctattctatctatgcgcgctcccgacacgctcaatctccgcaggtataggtgtggacactcttagtgacgcccgcatcgcttcatatttcaagggcagcacacttgtatgcagtgcgagatatgtgagagttcgtccttctggttctattacgtgcgctagcgacgattctcctgagaatagattatgcagtattggtgtcgcgcccaggagtgcaccaacatccatgttgtatgctggagccctccaatcggggcgttcaaaacattaaagggcccagacaataaaca

SEQ ID NO: 692851 - DNA, 732 bp, Homo sapiens
atttgtgccataggagctgtgcatgcatgatgaagtggcacagcctactgaacctatcagcgtaaacccaagacctctgatggcagatcacccacatcagccacacctctccccatatgccagtctctgagaataaacagtggggcaggcctcccttcaagagctctctgtcccacgcagcgttagctaggtccttcaggccagagattagcacaagtagggttacttaaagtgaccagtgatgctgtcaccgaaggcgaatccaagaagctcggtcaatgacaggagcaactccgacgggatcaacgaggtgcttgatgggaaggtggcttgttgtgaatagtctgggtctcaataactgccgaacagaaaaggaaaagaacaacactggagagtctgatctcagcaagctggcagttaaaacagatatgaagaaggaaagattagccatgcaatgatggattctcaatcgtgagtgcgagattctgatcggaagtgctgggagtctcagacgtcacagaatttatagggacatcccgagggcagtgtgtagcgagtgaaccccagataagagcgtccaatgaatgccttcatggtgtgggcgtaaagatgaacggagcaaagatccttcaagccttctcctgacatgcacaactccaagcatcagcaagatataggcgatctcgcgtggaaagcctatgaccaacctagagaaacaggcatattatgagg

SEQ ID NO: 692852 - DNA, 359 bp, Homo sapiens
gtcacgcccagagactccatgatggagggaggcagctgtgatccccaagctcacaggtagatgatgctatacctactcctagacactggaagagccctgtgcttgggaccggacactatggctttgggcctgtggtgggagaaatcggtgccaaaggagttgtcttaagaggacaaggcatgcagggtctgagatcagaggttgtgacgtggccaccccttagcgagtccgtttgggacacatcacactgcacagctttttaaaaaaataattagctgccaatcttttaaaatggtaagatttcatatacaaatctggatttttggcttctctaggagtaaacattgaaactttttttt

SEQ ID NO: 692853 - DNA, 179 bp, Homo sapiens
cgtgtagattatgccaaaactctatgacttctgttccaggatttccaacaagcggggaaaggcatgacttgggcgggtgggaacgacattaggagttgtttctattttttaccttggcagctttagctaccaatccagtaccctcctacctagaatgtatacacatcagcaggacactg

SEQ ID NO: 692854 - DNA, 1145 bp, Homo sapiens
ggtgtgccacttgaagatcctggtgtcgccatgggccagcgccccgcccgatagttaccggtattgtgaagaacaggagcccgtacccataatgtctcgcttctgccgaggatgtccactgtattgccaaacgattcctgcattattatgaccgtggtgagcgcgcacataataggctaacagtgggatggagtttccgcttagtggccaacatggtgtcagatgaatatgagcagctgtcctctgaagccctgtgagcgctgcccgaatttgtagccacataagtacatggttaaacagttgtggcaagagatggcttccagtatccgggtgcggctccaccccttccacgtcatccgcatcaacaagatgttgtcctgtgctggggctgacaggctccaaagaaggcatgcgaggtgcctttggaaagccccaggcactgtggcagggttcacattggcaagttatcattgtccatccgcaccaagctgcagaacaaggaagcctgtgatctggaggcctgcgcagggcccaagttcaagtttcctgagcgccagaagatccacattctcaaagaacgtggggctttcaccagagttcccatgcttgctgaatttcgaccgaccttggtgggtgaaaaggcggtcatcccagatggctgtgcgggtccagtacatcccccagtcgttgacctcttgggacagttggggggccctgcttccttgagggcttccccatggttgttgggccccctcttaaataactccagcagtaactttcttacgttgcttgtcccaacaggattgtccatacggaaaggggaacctcgcgggagcacatcaaattcgcggcggggcgtaacacggctgttttacctgggccgtgtgccgtcattatgagtttccccagcaacaccgaaggtttctggccacacaccaggtggacaacatgttgtgggaagcccccaatagtaaagcggctaccaattaaatgggtaaccaccacgagataaccccttaatatgaaaggagaaaacaaataatgagcgccacgagtgtcttaaggtgcctaccatttataacgaggtacaatagtgagtctgcgccaaatacgggggccacataactccacagcaaagaccacga

SEQ ID NO: 692855 - DNA, 280 bp, Homo sapiens
  misc_feature (136)..(136): n is a, c, g, or t
  misc_feature (144)..(144): n is a, c, g, or t
  misc_feature (170)..(170): n is a, c, g, or t
ggtagtctgtctatcattaggttgttgattcttagcaggtttggtgacaggacacacactcagcattgtagaactactcagtgaagatctgcaatctggacgctctcctcatcttccttactttcttaagtctgtngaaatgtnctatgctggcagttccccacctgtgncccagaatccctggagttcttgaagatgaagcagcagggtctcttggaattcatgtgggcataagaacgctttcaatcaatcagcgggaaaaggcacgtctgccttaagc

SEQ ID NO: 692856 - DNA, 958 bp, Homo sapiens
ccaacatgccatccagactgaggaagaccctggaaacttatggtggccactgtgatgccactggccactggccgcatagggcaatgcaccctggaatgcacccctgtgctgtgccgcgggtaaatgcttggttggtcttgcattcaaccaccgtggaatcaaagcttcggaccagaatacccactctcatgtgctaccttctgcggcacacacgcttggagtattgaacgcatttaaccaacttttaacccgacgcgaacccatgaagccttctggccacaacgttgtcaacccttttgaaccacaacttctgtgggcacttttcgggtccagtggacacaggacaactgagacttgcaattgccttgctaaacaacaccacacgacctgggtgcgcttggctcctcaattcacttgattggttgggtcgcctgaactcccgtgcgcttaacattaaccaaaaacggtttccttgggcgcaccaccgcgcagcacaaacggctttctccccacataatgccaagccctttgctccattcctgttggaatgggtgcccaacaattctcctttccagcccacgcaaaacaaaagccttgaacgggacacgcacacgactttcacacccgcacggcttgcctctagggcgcagcggggcccccctggctgattccccttggggtgtggggtccttgtggcgatcgcccaaccatacttgagcaccgcgtgcatgattatcccacttttcaaacaccctgtcccattaaaccttaaacctttctttttcccccccaccatatcccacatcccactcaaacctacaacacctcaccacttacccacactccaacacctcgttctttcctatacacctacatcactcttcacccacccctccactcacaacccactcctctctcctaccaaccccactattctatacaataaatagcaaccacg

SEQ ID NO: 692857 - DNA, 403 bp, Homo sapiens
gaaagtgtgagttacatctgcttaatttaggctgtaaattcactctaagttcattcatgtatatacatagtgggcagtactgcttctgttatttatatgccattcttttggtcaatagcactcgattagaagacatctcaatggctgtgcataaggtatataccattatcgcactcgtaatggactaagaatttatagataaagtccagtaacatgaaaggattaatatgtttttacattgtgattaggcgtagtacttagtgcacccatatcagattagctgtaaggatgaatgcagttaatgtcactaatgaggagagaggtacttgcatgtcaacgtagaccgttacaaacgaaagtcagagatgcagatggaggtacctctattgtcaagtctaaggct

SEQ ID NO: 692858 - DNA, 177 bp, Homo sapiens
agcaaccaacactcactggaatcccgcaatcaagagctaaaaggacttcttccatctctcagggacacacatccaccgataagaataaaagaaatgcctgaatgactctcactggcacttttaaacacagcaagcccaacatattttctccttttcataaagaagcctatacaccat

SEQ ID NO: 692859 - DNA, 332 bp, Homo sapiens
  misc_feature (242)..(242): n is a, c, g, or t
  misc_feature (247)..(247): n is a, c, g, or t
  misc_feature (269)..(269): n is a, c, g, or t
agggaaagaggatggaattgagatgcaaggtagaaaagcatgactatgttcagtttgggacttgatgaaatagatactggtaggacagttcactaggcactgggccttcaggagaaagagaagaaaggaatggtggcattgggagtagtaaagctgtgggtatgaatgagtatctatgagactcacctccctgtgaggacatagaatgaggagacacagtctacaggtagactaggtcgagntcagnagcctgaagaacaccagtgttnaagggatggtgttgggaaagggagccaggccagccagagaggaatgttccggaactctgaaag

SEQ ID NO: 692860 - DNA, 400 bp, Homo sapiens
gttattttgtagggcccttagatgacgagacatgaggaaacctcaaatctgactccctaagggatttgtggggttagggcgtttaaaggttttgaagtgggccaaagtgtagatatcattcattggttagagtgcagggtgaagtcatgggacaggttgaagaagaagctgtgttcttatgctgattctgttcctctctgggggtaattacactggttagcatgaactgttatggtggaatgggacatcacagggaaagaaccctgtgtaggtcctgtttatacaaggtgtcaggtcgctgttactgaagggtaccgctctgctcccctccctctgctattcttccccgcgcccctgatagcccctccttcctctctcgctcgccgctcccacacatctc

SEQ ID NO: 692861 - DNA, 1097 bp, Homo sapiens
ttctcacaagtgtagagttgaagtggcgcgtccaatatatctgtgcttgggcccaagtctcttttgtgcaaattcatatgcatgtgcgttcttaatcgtcggggttcactacgttttggtggtgctgcttacagttgtctaagtggtccctatgtggcaatggtcgggcttctttgatgttgctgtccgcggcgtttgctactggttgcttggctacggtggtgataacactatggtgcgtacagcctgctgttggtgtgcccccttttagggttctcctgggagggtgcgtatagtgtgcttggggttgttcccgcatgtggcgtctccttgtatctcgccgctactcaatgctttgcacactcatgcttgttcggccttgctcttctcggtttatgtggcttaagtgtgtcgcaagactgtgtcttggatctttggtttgtttggttgcctcccattggtgtcctcaagtccacttgtggttgttctcgtgtgtgctatggattgtgacgctggtgcctctcgcacgtttgcactgtgtatgacggtgactatggaccgagggctttctccatgtatgggactcgtttatatgcttgatacctcgctagtgcttgttcggaacagtattggctacgacacatgtttccaccacataggtgcccacgtggatgacgtgctcatgatctcctcatgatgcatctgatggacatgaggtggtctgtgactgtcatgggtccacgcgttcaaacgctgcgacacagtccactctcgccatctcggtccttttcctgttggggctcgttcaggccagcgctgctgggcgtcactgtcgtgcacttggctgcgctgccctggttctattggccctatggtcgcctgctctgttgggctgggactgggatgaggggtagacgggagcacagggagcacactgggttctccgctgagaacatctgggcacaagagtactggcctcttctatccctggcactgtgcctttgcacttgtccaggtggccccaatgtgagtcgctgtaaaaaatgctgccgttactattttctaagaaatgacttttatacgacccggcagtaaca

SEQ ID NO: 692862 - DNA, 970 bp, Homo sapiens
aattcaggatgatgtttaaattgatccaggtgttgtttctaacttctgtaatacatacaatgcaaaaaaaaaaaaaaaattggcccaagtttgcacgtggcccacccattagtggcgctagttcgcaggatcacgtctcaagtcggaagttctaaaccgtcgggtccctggggacgggttatcttcactttggggcatcatacacttattttcacgggtttaaggaagtctaaacgagggatacatcacctctttttggccgttccctgatatgtaaaagtgctattctccactgtttcctcgattaatgtcccagagtttcttagaaaataaagaaggtgctgcaactccctgaggcaagaatggatagtccctggtgcacttggcgtgcaacgtgtcggagaaccagcaaaatctggcggggtctgcacctcattttggtcctttgtgtttccgcattcacccagtgtgtgcgcttccactggtgtcgggcatggtgtaccttgttgctgtttccacgaacgtacacggtgtggccgcattagaagggatcttgcgcccacttgttcgcaaattcacgcgttgtccaggaactggactggacttacacattccccccttttggtcttttgctcacctttatcaggacagaatgttggagttgactttcacaataggtgaaggctgttgcgcacagggtggacatttgggtgagtttcgcccacagggcatatacgtgccaggttctacagacatatttaattaggtctccctggaaactttattgcgtggcagaggactccttggtttgtgttccaaaattaggggatctgacaacaatggttcaagtgacaaaccgttgtggcaacaaggtgaaccattactagataaggatatccggagagacaaaatcgtgtgctacagagcgccgtcatgtgtaatagtcattgatttattttttttttttggc

SEQ ID NO: 692863 - DNA, 148 bp, Homo sapiens
  misc_feature (141)..(141): n is a, c, g, or t
caccaggctggactgttattcattccttcccaagctctgtgccaccctgaatggtcctggagctgacagagacagaacagcccctggcacttgcatccaggccaagtcaggacctggtttcgtgcaccccgtacggcccangacacgc

SEQ ID NO: 692864 - DNA, 200 bp, Homo sapiens
tacaccctaaattattatggcgataggggtgtaagtgtgcctttgtaagaagtgggctaaggcatttttaatcttagagcgaaagcctattatccctgggcccggtcataaggggattgccctggctaggtttatagattgttgggtggttggtgtcacattagttaggccggagcccgaggaggttagttgtggccatt

SEQ ID NO: 692865 - DNA, 319 bp, Homo sapiens
  misc_feature (76)..(76): n is a, c, g, or t
ggattactggccacaatatatgaagaactcctaaaactcagcaacaaactgattcaaaaatggggaaaggactttnaatagacttttctccaaagaggcacaaatgaccaacagacacattaaaaagatgctcaacatcacaattactagggaaatgcaaatcaaaaccatagtgagatactacttcacagttactaggatggctgttatttaaaagacaaaaacaaaagcagaaaataacgtgttagctagcaagtggagaaattaaaacctttgtaccggctgggtgcggtgcctcacacctgtaatccccggtcga

SEQ ID NO: 692866 - DNA, 210 bp, Homo sapiens
ggggagtatgctcagccctggaagcaggattctgatgccaggcacaccttgtggcaaggggaggtgacagacaagagtctagccctaaggaagggggaggtactgaaagccaagcaaatgctcccacaccctgcaaatccagagcccagcagcctttgctccatggggatagaggccctggcgaggcacttgtcccgttcccgtgtgccc

SEQ ID NO: 692867 - DNA, 126 bp, Homo sapiens
ctacagaaaggagaaaaacatctattccaaaagatggcagaaagaagaaattcatcgtgaaagtatagtttggtgcgattcagtaaagatggctgttccctcagaacgtgatatcatactgaccac

SEQ ID NO: 692868 - DNA, 463 bp, Homo sapiens
ggggttacaaaaaaaaaaaaaaatttaaaaaaaaaaaaaaaaaaaaaaaaaaaaaaaaaggaaaaaaaaaaaaaaaaaaaaaagaaaaaaaaaaaaaaaaaaaaaaaaaaaaaaaaaaaaaaaaaaaaaaaaaaaaaaaaaaaaaatttttggccccctttgccccaatcaattttaaatttgaccaatttttttattggggcccaatttcggcccattttgccaaattccccttatatgggggcttttaaaattaaatggcccgcgttttaaaaacttttaacttggaaaacccttgggtttcccaacttaaatccctttggagaaaatccctttttccccatttggggaaaaagcaaaaaggccccccccaatcgccttttcaaaaagtgtccaaccttaaatgccaaagggaattttaaaccctaaattttttttaaaaaattccgttaaatttttgata

SEQ ID NO: 692869 - DNA, 1116 bp, Homo sapiens
  misc_feature (476)..(476): n is a, c, g, or t
gagcacattccagaagcttcagagccaaggagcgtgcctgtgtggcagaggaggtcagcgcgtctctttgcaatggcggagctgaacccagtggcccccaaggcccaagaagaaggttccaggtccccgtaaggcctggacctggagagccttggatcaatgagccactctcggcacatgcggatgtcagaggacgagatggcccagggtcgtcttccacgaggacgcgagcatgcggtgtcccgaagcaccggcgcgtccggaggcggacgaggaacgagctggcgtcggggccgagaggcccaggaagctaggagtcagtgtccaactaagcccattctatatcgaagagcatcagccatcgccgacaagaagcggtaccagggacagcccggggcgtggaagcacatgcccgtggtgcagattgagctctccgtcccctatgaaggttccatgggcatgcactaatgtcagantcaggtatgtgacatgtctggacagaggaagcgagaggctaaccggtgcagtaagtcatgtgtaggaacggaacaaggtagggatggacaatcagagcgagaggagactggatgaagatggggcttgtgttcgtacaaaatggttcggttgctcaacgtgcgatagcgtcccgagggaacatcggcacacgcatgtggcgaacgatgttaggtaccaatcagggcaacgagccgtggagaatggacctgttacgaactgtctactggcaccggtgcagaactgcaggaatgacaaaaggggcccccataagcggatcccgtacgggggcaatcccgtaattagtggggccccatggtaactaagtgaccttgatacccggactggaggggttccaagaccgtgtgcccttatttcggggtagagaccaccttggtcccctggcggtgccgtaaacttccatggatgtcgcccgttcaatgaaaaggagaagggttttcgcaattgggccggccacaaggggcgtaacgaagacaaagtagggcccccttaaaaacttggggcgttcacaaaagggtacccccggagcgggcgagcgtatttcccgcggacggcttagacgcactacagtggcgacactac

SEQ ID NO: 692870 - DNA, 266 bp, Homo sapiens
ccctgccaaaaagtgaaactggacgcagtgtgagggttacagggaaggcagtgctgtcggtgccgagcaggggagcacgtcgggggtacagcaccatggctggaggaatcggctggcccacaggtgggcgacctggtgaccctctatgtcaggtggtacatgctgtagcccacatgtgtccgtgtagagtcccactggtgcgccacagtgcagcgcggcgcggctggcaaggggccagaggcgaccgtatagcgaggtcacccgcc

SEQ ID NO: 692871 - DNA, 1087 bp, Homo sapiens
  misc_feature (146)..(146): n is a, c, g, or t
ttacacgataattgaaactctctaacttgtatcatatcacacttatctatacctgcgaattgagatgatgtgatacagagatccttggcgcatactattgatattacattcagctacatatatgaacacatagtgtaggtgattangtaacaattgatcgagcacggttctcaagagaagtactagttaacagtagtcagtagggacgtttacatcactaataggagccagatctctgaagtcgtcgtaatgtttctctgtttacctatggacttctcgaatggcgtgcatcagatcatgtgctgacgggaatcgtagaaaatatctggtgtgatagacctgacgtatcaatctccgtggtggttgatctatgagggactgtcgatttgagggctgcccgtcgtctgcaatgtatgaggacctctcgtgtttgcatccaccagagtatccatatagacactgtaggcagagtcacattgatccctgaatccataccaatgctgaacccgcggatcgtgaataagcttgagagcaacggccaagactggttgcgccatccatttgcttcggcaggtccagggtcatggtcgtttatgggctaaccacctgagtatattgaaccctaatggagaggagttgatgtgcttaccgatcccacagacttcttttacctgaaagaaagtcctggaatgtttgccccattctatttggactaggacaagctaattctgaatgtcccaagtggagggcatctaagtggggtgaacttcaagcctcctggggtcttcgtgaacaaccctatttaatggtgaaggccctttcccgatgcttgctcgaaatcgccgattgaagggggacctacgtttggccaccaagtttgatatcctgacattggagaccccggccctttagaaaggaacaacagggcggctgacattcgactgtcccatcggtcccgatgtgagcggcaaaagagaatagacgggcgcaacagcagcacagctcgtgctgcagacctttgcgatgccactaatagacagacagactagacatggagcatatcgcacctccgcgacatcacacataa

SEQ ID NO: 692872 - DNA, 505 bp, Homo sapiens
tgggttgactcaggattataaaaacgggaacggtgaaggtgacagcagtcggttggagcgagcatcccccaaagttcaaatgtggccgaggattgggatggcacttggtggttttttaaatagtcattccaaatatgagatgcgtggtcacaggaagtccctcgccatcctaaaagccaccccacttctctctaaggagaagggcccagtcctctcccaagtccacacaggggaggtgatcagcatggcttccgtgtaacatcatgtactgcaaaatttcttaaatcttcgccttaatacttttccatttggtctaatttggaatgatgagccttcgggccccccttccccctttttggtcccccaatttgagatgtatgaaggctttgggtctcccgtgggagtgtcggtggacggcagccagggctctacctgtacactgactcgagacagtcgaatcaccactgccccccttacaactgcacaacacacaaagcaccccaca

SEQ ID NO: 692873 - DNA, 196 bp, Homo sapiens
ctcctcccttcaccaacactcgcggtcccgttttttgtcttttactctttctcgctccctttccctctctcgctctctctctcgctcccgttctcgttctcgctctcgttctctctctctctctctctcccgctctcgttccctttcacgatctctgcttttttctcttgactcgacccgcgctttcttgacggca

SEQ ID NO: 692874 - DNA, 138 bp, Homo sapiens
ccctgtttgtcggggaagcgctttgtgaagtagctatttctcttgtcctttcgtacaggcaggaatttgaagtagatagaaaccgacctggattactccggtctgagactcaattcacggtccattatatgcaatcga

SEQ ID NO: 692875 - DNA, 593 bp, Homo sapiens
  misc_feature (299)..(302): n is a, c, g, or t
  misc_feature (334)..(334): n is a, c, g, or t
  misc_feature (377)..(377): n is a, c, g, or t
atgggccactcctctgcagcaaataattaacgcccgttgatatgggtatcttacagatattttgcaagaccatattaagacagcccagttagtagaattattaccccggccaaaaagcctgtctataggcaggaggcaagttgtatcccgtagaggattggcccagtagcaaagagtaggaagagccattggtccttcttccaaaagttatgggattccacttttcaggaaaagaggagaaaaaggttgagcaagggaaccaaaggtatttggtgagtttttagatgattgaaaggggnnnnccccccccccctcttctccaaagaaaagtagnagtctccccttcatgccattcagaaaaaaatggaaagtcctcncaattggtccccttccccaacccaatcagctggccatgggctactcccttgtttacatagggtgtacccagtaaccaatgggaaacctctagcgggtatgtaaaccccagaaaattctgtaaccagtgctcttgagctgcttgctggagcctactcccactttgtgaagtgtactttcatttcaataaatttgtgctttcattgcttcaaaaaaaa

SEQ ID NO: 692876 - DNA, 204 bp, Homo sapiens
actcaatgagtaaataaccaacacaacaatataatgggcaaaagacctgaataggaactttactaaagaagatcttaatggcaaataagaacatgaaaagttgctcaaccacaatagccattaaggaaatgccaattaaatctacaatgagatattaccattacattcctattacaatggctgattttttttttttttggagtg

SEQ ID NO: 692877 - DNA, 372 bp, Homo sapiens
  misc_feature (6)..(6): n is a, c, g, or t
  misc_feature (60)..(60): n is a, c, g, or t
  misc_feature (83)..(84): n is a, c, g, or t
  misc_feature (86)..(86): n is a, c, g, or t
  misc_feature (130)..(130): n is a, c, g, or t
  misc_feature (137)..(137): n is a, c, g, or t
  misc_feature (219)..(219): n is a, c, g, or t
  misc_feature (233)..(233): n is a, c, g, or t
  misc_feature (335)..(335): n is a, c, g, or t
gccgcntgctgctgtcgcgcagtccgctcctccgctgcagagtcgtgcccatgagctcgnccgacaaggtgccattcgcacgnngnatcctgccagccgcgaccccagccttcgccgtcgccgcctaggnccccagncgcaccatggtgaaggtgacgttcaactcggcgcatggccagaaggaggcaagaaggacgagccaagagcagcgaggaggcnctcatcgtcctccnggatgccgtgcggtggattcaaggacccgggtgacgtggttccggttggacagaggagagcgtggtgttggtgcatgtgtttcggacttggcttcatgcttnctggcgtcatcctcggaggggcgtactgtacaagtat

SEQ ID NO: 692878 - DNA, 210 bp, Homo sapiens
aggacctgggaaattagcgacgatacaagttttctacatctgttatcttccttggcacgaatttccctgaagagaaacggtcatgttgatgaagaccgtggaattataagcttgggttagtgaggatagtaaactgcgtgggtttaggtgtttctatgatccattcatttctttttttacatagaaccagacatgtttcacatccacagc

SEQ ID NO: 692879 - DNA, 565 bp, Homo sapiens
  misc_feature (359)..(359): n is a, c, g, or t
  misc_feature (525)..(525): n is a, c, g, or t
tctgtgttgtgactttatgtgttatgtccgtctaccttacatgcatgttctgttgtgtgtctctgttgtgtacagtgtgttcccccttgtgtatctatgcctatggctggtgtgtacagtacttctctttgtggtgtgtttgtgtcctgtacatgctgtggtgtgttctgacctgtgtcggaacaacatgcgttgtgcactgtgtgttgtgtatctacattatacttgtgctgtgtctctgtgccgaacgcctgtgctgttagtgcaaggtgttgtgtggcctgtttgggcgtcctgggtctgtgtctgcgccaagggtccgcgccgccctgctgtgtgtctgtgccagggtccgccgntgcctgcgcgcagagctgtgtttcctcaacaagtgtgcgagcggtcgtgtgcgccatgagcgctgcctggcgtctccgtgtgcgccgcggtgtggccgctcctcggcggggggcccgggtcctggctagtggccgcggaggatgcgcgcccgcggggcgggcgggngcgggcgggggctggcggcgctgcggagcccggcggccgc

SEQ ID NO: 692880 - DNA, 317 bp, Homo sapiens
tctagcgcgtaacatattttgtcatcactgccaggatctccatttaacgcccctcacccttaggcagctggagcagcaggaagaaataccaagggtgccttttaggagaaataaagagggtgtcggttggtggaaatatgacttctgctatggccaacatgttcatcaataccatgaggaccaggatagtgggaaaacctctgtggttgtcgggacatggaacccattttttagcatcttgacatgggctaagaagaatactgctagagctatatcatcttcaagacgatggtacccagacagtcagggtggtatca

SEQ ID NO: 692881 - DNA, 92 bp, Homo sapiens
tgggttggggaaaaaaataaaaagggggggaaaggtttttttaaaatttggtttttttgaaatattgtaaaaaaataaagttgtaaactttt

SEQ ID NO: 692882 - DNA, 335 bp, Homo sapiens
  misc_feature (198)..(198): n is a, c, g, or t
ttgcgtcccacgtcgtgcaggtaggcaactaaggtagtgaatgtggatggtgagggctatgatgaatcgtaagacaactgaaagcggagccgttatgggggctagtggtacacacacgtcagagtcattgaatggagctatgtgatacgtagctgatgggtctcaatccagccatggacattgacttcacagacattntgtgatgacctaaagtggttccatatttaacaatattaattctcatggagatatacttatttgatgcttaaatagtaccaaattaaaaaaataatccgatggcaggtgtgagattcatctagaagaaaacacaaaca

SEQ ID NO: 692883 - DNA, 217 bp, Homo sapiens
aaggatcccggctcagtgatctcttctgtcagataattgtcactttacagtattcacaggtgcctgggcccgggggtcatggcagaacgcagagactttatgatgaggacggtgccacgatgatgccactaggccagcacaggccaaggcacagagcacagtctccgtatgtctcaggcatctaggattggctcttgggcctcccatgtgcttgagg

SEQ ID NO: 692884 - DNA, 244 bp, Homo sapiens
  misc_feature (119)..(119): n is a, c, g, or t
  misc_feature (163)..(163): n is a, c, g, or t
  misc_feature (206)..(207): n is a, c, g, or t
cgacctcagtgtaaatcacaaaacgggaagagctgatattggcaaaataattacatggctcatttccttgcatgtcaaaataggatttgattggttgtaaaagatgacaaatacctttncggtttcaatgttcttaagtgggaagtcacttattacagacctnattgggagtaaacaaagctgttagacctttcattatcagtccnnttaatcccttcaataatccccctaaatcagtgaggcg

SEQ ID NO: 692885 - DNA, 1659 bp, Homo sapiens
  misc_feature (537)..(537): n is a, c, g, or t
  misc_feature (775)..(775): n is a, c, g, or t
  misc_feature (834)..(834): n is a, c, g, or t
gagtggcgtggaacgcggtgtggtcgcggacgaatcggtactccgggcctgggtattcaccgtggttccagacgacggtagtggcgacgtggcggataccagacacgcgatgacattccttgtcgggggaaagtacagtgtctgccagtgcatcctaaggagggtagacgtttccaccgtgtactctcgagacaaggagtgcacacggaggagtagtaagggcgatagtgaccacgtgggagcgcatgatccgacatgggccaggaacatgttcacctcatgaagcgtcgcgtcatcgtggtcagcgtacgcctccaagggtctccaagcttggtcaccaggagaaggcagcacggaagctaagctcagggagcctagaagaatagcgctgtggcgacggcgcgcgatagataacgctcgatctgtgcaagccgcttaaaaggggcagaggaaagacgagcatcccttgtgtgcaagccctagaatgtcgacgtcgagaccttgctactggcgctacaagctagagtaggtagaccngactgtaggagaacgtcgacgtcctacactggagcacttctcgatttccgcaataactttagtttgaggcaggcgacccagctaacgggaagaggcgatggagatgtcggatcaacaggccagcttgggcccatacgacacgtacatggtagctcctgcatgagaatgtcgctgacgatacgcttgggagtacgcctggcagcgtagtcgcatagatcggagagtatggtcccactgnaagacacgtgctagcggcggactggcgttggtacaaacgacgccgtagggcaaacccanttgaagagaaacaaaaccccggggggttgcgatagggaacgcttgggaatgcgggactgaaaaggcgttgcgatccatttgcgagccccaaattaccaaagcctaaacctaaaaaaattttcccaaggcctgggaatccaatgttggaacggattccgacagaggaaagcggccttatttgacgctaccgcctaatgggcggcgtgtgcctaatagagccggttggcacttcaaagggggttcaaaaccagagaatttgcggtggttgaggtggctacagccggggcacaccgttcaccaggggcgtaattcgggagccccaggatacccgaagattaggaagggcgccactcacgaagagaatacgtaatttcccttaatgtttgaagaacctcttctggagacacccggagatattctgagaggcgggggaaaacaacaagagaagtaccgcgggtataaagcaccctgtgctgtgaatcacagggcgacagaccttgggaaggactaagcactaaggtgtgcttgtaagacccaacagagggcagggggggggacccaagcgcacaccccgaaatggggggaccccacatgggagcggggggcaccacacccgcgcgatatgtgaacgaaaggaaagggagggcgacgagagaaaaaccaccctgaagccatattcaggcccgggggggttgtccacacaacgggcaacaaaaacacgaagaagcagcgttaccccacagcaagtggcaagaacgaccgacaccacaagaccagagcgcgacactataagagaaggaggaggtactgccaaatgagaacgag

SEQ ID NO: 692886 - DNA, 229 bp, Homo sapiens
aaaaacccccgggggggcctttttttggggcccgggttgtttttccgggggccgggccccccccccccccctttttcttttaggggtttttttccccctttgggggggggtggggggggttccgggacccccccgggggggggcccccctccttttttccccccccgggggggttggggggggttttttccccgggtttgcctggggattaaaacccccttttttttta

SEQ ID NO: 692887 - DNA, 267 bp, Homo sapiens
gcatgttgtcacattacaaccagaaattggcacaaatgctactagtgtcggggttgtagccaattatcttaatgtaagtgctgactacctataacaatttcctacatatctcttctggctgtagggtaggatcagtggaatccattaaagttaacaccagacaattcactagtctcacaccacagtgtgtaagccagcaatggcatgctctcgaggtctgcccattcttggagataccagcttcaaattcaccaacaccagcagcac

SEQ ID NO: 692888 - DNA, 243 bp, Homo sapiens
gagaattgcttgaacctgggaagcggaggttgcagtgagccgagatcgcaccgctgcactccagcctggtgacgaagcaagactccgtctcaaaaaaaaaaaaaggaaaaaaagaatttggtttcggattaagggcctcctctaaaaaaattggcctggaaattttgccttactcgagagggctgctctgaggaggcccataaagaagctggacccggcttctatttcattccggggacagag

SEQ ID NO: 692889 - DNA, 397 bp, Homo sapiens
  misc_feature (167)..(167): n is a, c, g, or t
gccagaccgcgtcacacggtgatagacattgacagtccaggaccagtcgctccatcgtgcccagtcgatgccggtgtagtcccgacggtaggttcggttgccgtaagtggcggccaggcccacgcccacaaaaccccgggccaggggcaggccgctggtcagacccnattcggtttgcaccccattctggctttgcccactgccataggacacggcgctttgcagcaaggcgatgtcacccagcatgccgtttgcaaacagctgtttctgcaatctcggccccagacgcggctgggacgcggacgcatcctgccgatcccgcccgaactgcggccacaagcgcagccctgcctgccagcgctcagatgacgaggcattgaagcccaagcccatttcc

SEQ ID NO: 692890 - DNA, 418 bp, Homo sapiens
acctggctcctttttttcaagaatggtattagataccaagaggtacaagaagatgaaggaaatacaagtgcaatttatttatttatttaaaaaagagacagggtctcactattgcccaggctggtctcagactcctgaactcaggtgattcccttccctcagcactttgggaggccagggtggatggatcacgaggtcagagttcaagaccagcctggccaagatggtgaaaccccgtctctactaaaaatacaaaaattagccaggcatggtggcgggtgcctgtaatcccagctactcagcaggctgaggcagagaattgcttgaacccgggaggcagaggttgtggtgagccgagatcatgccactcgccagaagcctgggcgacagagcaagaatccatctcaaaaaacaaatt

SEQ ID NO: 692891 - DNA, 278 bp, Homo sapiens
ctgcgcctactactacccgcctttacagaggaggaaatggaggcacagggccaaacacaccaccaagccgagatgcaaatccacatggtctgggccacagggtccaggctcttaattactacccacggactcaccaaggcgatccttggtcttaactggcatttccccgattacgggtgagaaggggcatcttttttggatggatgggctatgggacttctgttcaagacctcgattgggagaggtgtataaagggggatccatgaggaacaggttca

SEQ ID NO: 692892 - DNA, 1262 bp, Homo sapiens
gtcgtgggctcggtggccgtgatttgtttgcgcggcatgctcccgggagagggcatatacgatattccggggggtccacccggttgcggtcacaaacggaatgtggggggccgccgcctatacgtgataattgatgtttttccatagtgggtgccgtaatgttggcttgtgttgcaccgggagtgtacaacagggttgccgccgtctccaatcaccgaatgtttacactacaaccttgtggtttccgtgggtgatgtgtaatacctccaccatagaactggttccgcatgttcgtgatcgcgcttatgggcgcgtgatacccatggtatgggtatgacaggcgttccaggggtcgggtataacgccgtgaagacgcccgggctgccgatagcttatgccataaatatggggggcgttattgtgctgctggagcgttgttgccgaagtttcccggcgggggaagcgcactataggcgcatctggtcggccctaagggatgagagaacgttgtgcgcttactgccaatgcggtgagtttaaccgttgaacgatactcggatagtgtagcgtcttccgcgtagggtctctggggagcaaaatgtgcgctaatagggtgctcgagttgcgcttgttatagtacgtctagaggagagttgcaacctcaacgaggtggttagcccgctgttactgcgggggtgtcctgagggcgtggagccgcttgggcatctgagggcaccgttttggcctcaggcctgggccctgagagctggacttgtatacgtatataggttatataagagtgctaagcagttcgcggtcggtggcctagtgatcgcccgtgtgcagcgcatgcagagccactcatggacgagacagaagctcagttgctcagaccagcgccatcggtgccgacccagatggtgcaaggatgcctcgaccagtggacggacacattatctgactgtaacggctggcatttcggtgagcgctgatgtctcacgtgacagtagtgtggcgagcgctggcatcagctgtcacccatcctggtcagttaactcgggtactcaagaagtgggaagccagatgagctgctgaagatgcttggtatcgatcagggatgccattgcacaagtctgtgaggggcctcgatcaccaaggtcctagggcagggtatgaagtgtgggacgggggtctatacattcctgagattctgggaaagtgcttcagcggtactggaggaggaaatgtggggggggcgggtgc

SEQ ID NO: 692893 - DNA, 518 bp, Homo sapiens
acaaagagtaactagaaggtgagactactcggaaacatcaaaagctaagtaaccaagagcactagaagtagcagtgtgtagaaacataacatagaaaacagtgtaccttaaaactgagcatcccttgatttcccccatggacctacaatttccagtgactagcaggcctgaagaggccaacatggtgccagacttaggcgccactagacaggaccaaggaggcatagtgcactactaccagggatagctaagagcagggtacaggaaggatgaggaggaaggctagagtactaccctcccaggagccccaaccaatagtacaggtggagacctgcaccaggagtgctacagggcaagtatccttatacaataagcttaccctcgcaccaagggccactgtctatgtactcaccccataaaaacaaaaatgttactgtaccccttacaagtgactaacacgtacaccacccatgaagggctgtccctttattactggccatgcatccagggctgctact

SEQ ID NO: 692894 - DNA, 142 bp, Homo sapiens
  misc_feature (10)..(10): n is a, c, g, or t
ctcacagacncgcccgtccttgcatgcgtccccgcttggctgtagccccgatgggcagctcctcaccccacagtcctcgtccattgtagccggggttacacagctgctgtgcccattctcacaggcgccccctctcgactgc

SEQ ID NO: 692895 - DNA, 344 bp, Homo sapiens
cctagttaagaacaaaaggaacactctcccctgccatccattgctggtatcctgtgtgtgtttgatacctcagattcagcatctactacagcacgaagtgttatgcgtgtcctgaatcataggagagtcggattcaccaccctgcccagaaacagaagcattccagaggtttcttaatagatcacgaaatgaaatgaccgatccacttcgatgacaggaggcatgaactaagccgtgctctctgataagatttgtgccactgttccgtgcttctaacgtaaaccggtctgggtgttacgagaaaaaccacgaggcccggctactcttaagtagccaatgcaaaa

SEQ ID NO: 692896 - DNA, 229 bp, Homo sapiens
aatgcataatttatccttctatggctgagtagtatccatcatatatatatatcacatatatatgatatatatatataaaagaaacatatcacatatatatgatatatatatcacatctatatgatatatatatcacatctatatgatatatatatcacatatctatcatatatatataaaagaaacatatatgtatatatatatgaaacagcttctttatccatgtgtt

SEQ ID NO: 692897 - DNA, 869 bp, Homo sapiens
gatttacgagtgtgagtaaatcgtttcttctttttatttgattattattacacagccaaatccaacagatcaatacaccgctaatcccccgccatgtcgtgtatacttgtggaattgcaggccctcgctcccacacaaacattacacattaccatcccacctccggaaagcctgaacagccagccaccctcaaggtgtgccagcctgaagctatgtccttgggcccagagatgacctgtctattaacccaccgaatcggttgccactccggacagtatacagaccttcggagaaagttagcttttgaaaaggccacaaccctggtgtgcactgtctaaagcacgcataccgggagatcgagcaaaagaacctacgggaggttttttctacaccccaaagaggtctatagcattaaaaaacaaaatgcctgaatcaaagcactatgtaatttaatctctcaaaaagaattgcacacctaatgtaatttgtataattattcagacgaacagacataaatacacacaaacaggggtgggagggcactctttgtacttcaccactcttgttgattaaatgtggtttaatgctcaattcggcaccatagatacaattgataacagataactagatgattatgaaatgtaaactgtatgtacagtacatgccagataacttgaatacagaactctattacgttatccacaaacaacaacgttcactatactaacagagaatacattgtattttgatgtgggcatggttacatggaacaatataaacaaaagagcgctatacacctacatattgtccaaagacacacgtgataggacaatataaaacagaggaagaagataatgaatgataaccgt

SEQ ID NO: 692898 - DNA, 302 bp, Homo sapiens
ctgcgattttattcgacatatactagaagtgtattatgcgggattgttacaggaggactaacatcactgcgaaattatttgtagtaatccagggggatgattatcctaaagtcacagggtgtgtacaccctgtgatattattcatattattctagggggatgttactcctaatgtcgcagatgtgtatgcgctgtgatattattcacaatatactagctggatattgttactaatgtcacaatgcgtgtacaccttgtgatattatttgtactatcctaaggggatgttactcctattgtca

SEQ ID NO: 692899 - DNA, 144 bp, Homo sapiens
  misc_feature (4)..(4): n is a, c, g, or t
  misc_feature (48)..(48): n is a, c, g, or t
aaanctgatattctaaggtcgcacctcaaggagctagagaaacaaganaaatcccaaacccaaacccagcagaagaaagaaaataaccaagatcagagcagaagtaaatgaacttgaaacaaaacaaaacaaacaaaccaaaaa

SEQ ID NO: 692900 - DNA, 150 bp, Homo sapiens
tcatctgcctttacttctcatttcaaggtttcacagagtgtggctcacccacatcataacttaactaacttgccttccccaacaaacatgaaagacttaaaaataaaaatattcttctcgccaggacacagactgtcacccaaaccagaa

SEQ ID NO: 692901 - DNA, 904 bp, Homo sapiens
  misc_feature (47)..(47): n is a, c, g, or t
  misc_feature (153)..(153): n is a, c, g, or t
  misc_feature (286)..(286): n is a, c, g, or t
  misc_feature (342)..(342): n is a, c, g, or t
  misc_feature (347)..(347): n is a, c, g, or t
  misc_feature (360)..(360): n is a, c, g, or t
  misc_feature (904)..(904): n is a, c, g, or t
gccggacccgttggcagaggtggcggcggcggcatgggtgccccgangttgccccctgcctggcagccctttctcaaggaccaccgcatctctacattcaagaactggcccttcttggagggctgcgcctgcaccccggagcggatggccgangctggcttcatccactgccccactgagaacgagccagacttggaccagtgtttcttctgcttcaaggagctggaaggctgggagccagatgacgaccccatagaggaacataaaaagcattcgtccggttgcngctttcctttctagtacaagaaacagttttgaagaattaacccttggtgaattttngaaantggacagagaaanagccaagaacaaaattgcaaaggaaaccaaccaataagaaagaccgacttgaggaaactgcgaagaaagtgcgccgtgcatcgagcagcctggctgccattggattggaggcctcctgccggagctgcctggtccccaagagtgctgcaccacttccagggttaattccctggtgcaccagcttcctgtgggcccttagcaatgtcttaggaaaggacatcacattttccacataagatgttccaactgtgctctagtcgtcttgaaagtggcaccagaggtgctctgcctgtgcagcgggtgcctgcggtaacagggcggtcttctccaccaccacaacaggggccatatgcgatgatcccggcctacacagtgacaacgtgagagagaaaggaggccttgcaaaaggaccttgtaggggaaccccaggacggtgaccttgtacgtcacactaggaggacgcgaataggctatgaccgcccaaatggggcccgagaccggtcggagaaccccaactttggcaaccaacgcggctgggccgccn

SEQ ID NO: 692902 - DNA, 285 bp, Homo sapiens
caagaattgaataaagagctttctggcatccagcagggttttctggctaaggaattgcaagcggagctctctgcaaacttgataggaaagtaaaagcaacaattgagcaattcatgaagatcttggaggagattgacacaatggtcctaccagaacaatttaaagacagcaggctaaaaaggaggattttgtgaaaaaggttcaggtgttcttagcagagtgtgacacagtggagcaatacatctgccaagagacagagcggctgcagtctacaaacttggccct

SEQ ID NO: 692903 - DNA, 233 bp, Homo sapiens
ggggaaccccccccggtttgggggagaaaatttcccgggccttgggttaaaaaaccggttttgttttaatccgggggttccccgccctttttttccgataaaagccggccccctttttgggccccccttttttaatggtggaggggacgggttggggtaaaccccctttgttttttgtttttaagaactttttgggcccccccccgttttccggtaaatgggtttttttggta

SEQ ID NO: 692904 - DNA, 1339 bp, Homo sapiens
ctctttttatgtgggaacgtaatgtaggggaaagggtctttgagtgtgttcctagtgctccttatgtacaacagtgaaaatgcctcaaagccttgctatcccagcaacctggggctggttccacatgtgcctggtcctgccccttacctggttcttatctcaatggcagagcttctgaatttcagtgccttcattccatgagccctcattgtggccatggccttccttttgcttggcaggcaaggtacacatgtggtgcaatgctagcatgctagtcacttgagagggcatcatccatatggccttgtatccaccaacacgtagcagcagcacaggtcacttactctattgtaaccatccattgtatcagcccaggttgccattctcaacaagacacctcctctcaccagacttgtcagtggacactacactagtcccacagaagctagcagtggccacaggcgtgattctcatcaagtgtccatatttgtcgcaagcacaccacagtagcatcttcagctcagctcacacgttatcacacacgtcagtcacacttgcgtacacttgtcatttcacgttgggcgcgttgggcacatctcccacgcaaacgcacacatctcccgcacacgcacgcaagcatcccactgtgcgctgggatccttgccattggtgcaaaatcgcacacccaaggcacacttgcaagccccaaggcacccaggcgccttgggcccatcgagtccatttaggccatcttcatttccccttccaccccacattaatggtgcaccccatatcactccctggccccatttaaccgaatttaatcacgactggtataatacaccatcccgaagtaccgtacacacaaacggcaatgaccacgataagcaaagataccttaagtctatgcattttgaaaacttttcaacagcacaacacgtactgtgggacgccacgcacttcacacagcgtggcgcaccccgtccattttggcgacgtattggcaattatctctatggcgttatcactttctcccgttccttccccttgcttgcggtacgcggtcacttactttaaccgcgtacaacagagcattgaccagccacgcaactactcatggacacgacgcttataatctttacccgataacattagctcggggcgacacacacatttcccccccttaataacacgcaacgcacagctctatggagaagagacatacaagccataacagtttcaacacgggcgagattatccagacaaggaaactagtcacacgcagctaccccccaaacccattgtcgccttaccaacaggaccaaagggcgccacatcc

SEQ ID NO: 692905 - DNA, 304 bp, Homo sapiens
  misc_feature (45)..(45): n is a, c, g, or t
cccgccgagtacggaatgagacatttgctcttcagagaacaactntttttttattttttcttgagatggagtctcactggtgggatcaggctggagcgctgtgctgccctatcggctcactgcagtctccacttcctgggttcaagcgatcctcctgcctcagcctcccgagtagctgggattacaggcacccaccaccacgcctggctaattttttgtatttttaggagagacgagggttcaccacattggctaggcttgccagacagactctcaggcctctccctgttctagcccctgagat

SEQ ID NO: 692906 - DNA, 833 bp, Homo sapiens
cgcccgggccccggaacccaggtgcttccagctctcctctgtccttgctggcctcagagtcagtcggactgaccctgttatcattgaggtgtcccagtgggaagcaggacgtctggagcttatacgtgttcatatgtggacgagggagaagcagtaggtaaggaggcgttccactcacctcgcgttccttcgttctccctcgcgtacgaggtgcgtgagcaagagagagctcccgcaagtaagagtggctcgaggcacaatacaaaaccaataacaaaacaaaacataaaacataaaaaaagaagaaaaaaacaaaacaaagatacgccacaacacagcacaataggccaaccacaccgagccgagagacgacatatatcgcgcggaggagcggcgcaacagacagggcgcgcgagcgagaagcgcaagcgcgcggcgcgcgcgtcgcaccccaaacagagccgacaaagccgcacacaagaccacaccacaactctgacaaaaaaacaaaaacgcgggagagcacacaccgcagcgcccgggcgacaacgcctcacaacatgggaggtgcgagcggccgcaacccacgaaaccaataacggaagcaaaagaccaaccggagagagtaaccccaccgcaccggatgctcaactcaggagccccgacgcgcaacgaccacaaccgcccgcaccacccacagcagaaacaccacaccacaccagcaacagcaaagcgcacaccacaaccacgccaagcgagcccacacgacacgaacccccccaccgcacccacacaccacacacccacgagccacccacaggaccacggcaacg

SEQ ID NO: 692907 - DNA, 510 bp, Homo sapiens
  misc_feature (500)..(500): n is a, c, g, or t
  misc_feature (507)..(507): n is a, c, g, or t
actcctgggctcaagcatctgcctaccttagcctcataaagtgctggaattgcaggtgtgagccactgcacctggccaagaacttggtgtttcttatttccaagcttatctcctctgttatttgctcccagggagaccccttttccatttatgtttccagggtgctggggggaagtgattgccctcatctcttttgcccagccaccaaacccagtgcagactctgctgaatgcaggccccatctctgtattttacttattccatttcctgtcttgaaggtgggggcactatgtttatctctaaggaccctgactggctcatcattgaaagcttattttgtgcaaagcattgttctgagcactgtgtgtgtatgattctacttcatcctctgtaaccctagcagtccggtcaaatagtaatcattttatagacaaggcaactgaggcacagagcagctcagcagcttgcccagatcaaacagctgggaaagtgggtagagntggaatntgg

SEQ ID NO: 692908 - DNA, 646 bp, Homo sapiens
ttatagtgctcagtggccagaacaagagcacggtaacgtcagcgttcctgcggctgttactgtgaccacatcacaaaggcggtataatgaggccgtcagccgccgctccatcaccgatatggagcatggcgaacaaattagtcattcccggacggtacatcgactaaccgttgcttcaccatgtgccgcggctgtccatcagaccgtgttgcatcccggcaacaaggaattcaccaccggcgaacatatccagcgcccacaaggcggtggcgagggtgaaggtccgggcaaagccggctactctggcgaaggcatggatgaattctgtattccagatcactcaggatagaattcctcgaattcttgttcgaagacctcgaactgaccaacctggtcaaacgcaacctgaccggcaccgataacttcaagaccgtacgcgcagggatcagccacgagggctatcccgtcgcgcatcaacatcatccgcaccctgcgctcagcccattcacggcgtatcgccctgtccggcagcagtcgagccacactcaaacagagcaaggaagagttggaacgcttgaagcgcgaagacccggacaacttcggaggatatccaggaaatagaggcggaaatcgaacaaatcagtcg

SEQ ID NO: 692909 - DNA, 1317 bp, Homo sapiens
gaacactgtcttccgtgtgtctgtaccatcttcgccttttcgttattatatggtccttattttcttgtttttttttgtaatttttccccccaaccatcgtgattggtcttttcagggcagatttagttagaattcactgccaggttatctatctgcccaccaaaatgatccagtctggaataacatttggtcaaaaaaaaatatatatctatatatatatagctagactggaagagattaatttcttcccccaacttctggcatgttgaagcatatttgagctatttttcatctaaaagagtaaggtattaggcccttaggtgggagccccatgtatgggtttttctagagctcgggtgggggaggcgagggcaggggcgagggctagcaataggtaatacgcagcaggcaaacagggcatacagtgctcaaaatttctcatacacggggttcaacaaaacaaagagggagtgccctggcaccaattaactattaagtgcatttataaactgtttcatatcaagtgggcaacagcgtttccatcggagcacatgtattagacatgacattgcatggaagcatgcaattctgaatagtcaacacatatataccttcaatagcggcgagtaagttagatccaccgctactcaaacaacgtcgagaccatccccaacaataagcaccccaccggaaagctatggaaaaactaaccgaatacatccgaagatgtccagggactagcacaatctgaattaggagaacaatcagagcgataacactgtaaacactcaaaacacccacaaggaggacaacaatgagcaacagggaaacacgtggagtggaactcccaacgcaaatctgggatagtcaacccgccgcacaacaatgacttcaccgaggatacaaggggcgaaccaacagtggcacacagtacatagtaccaccaacgacaaacgcattgtgagcacaaggaaccaaaagaaggacgatgacaaatgacactaccagaagtgacaacatggcccggggaaggtgaaaccgagcagaagacgcacaacaaccacaatcaacaggggacacagtaaaaaacacgctcggaaaaaaacaccgccaacgaccacgcgacccaagcaggcacagaaaaacacgccacgagaacgcagaggaacaccacacataacaagcacagcagcgccacaacacaccacatcaaaacaccaacaacaaccacgcccgtacagaagcaaacaacaacaacgaacaagaaagaacacgaaacaacacgaccgcataccacactcggctgcgccccgacac

SEQ ID NO: 692910 - DNA, 754 bp, Homo sapiens
ccaaagtcaagaacgggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatcttttgggggccggctgggccccatttgtttttagtttgggccagttttttttttggggccgattttggggttcttttggccatttccccttttggggggggtttttccatttcctgggccgggtttttccaccgtggggctgggaaaaccctggggtttccccattttattgccttgggagaaattccccttttcgccggtgggggtattaggaaaggggcccccccggttcgcctttccaaaaatttgcccaccctgatggggaatggaaatttttaggctttttttttttgttaaattccgggttaattttttgtaaaaccagtttttttttaacccaatgggccgaattgggaaaattcctttttaattaaaaaaattaccccgggttggggtggggggttttccactttgggaccaggaccccttttttaaggagcggggcctccacgcgaaagggggaaaaacccttctttaggggggtgggccctttccgggacccttcccttttataagtttttgggggccgggggcccaaaaggcttaattgggaaccctaaagggggcccccctttataattttgcggggaaaggccgccaacctgggagaaagggagggacccccccgg

SEQ ID NO: 692911 - DNA, 202 bp, Homo sapiens
gccaccatatctaacctaggtctcccctcctctggcaacccccttgtaaaggggagtgaactaaccacccccatcgcagatgcgctgaggcattacaaacagcatccagtgtacgatggaccagtaggagcagtgtcttgaaggcatgtatcaaggctccaggtgtgtcgtgaccagttgacaatgaggattctcgacatca

SEQ ID NO: 692912 - DNA, 158 bp, Homo sapiens
gtcatgtagagaggaaggtagactcaaccttactacacatgacaagttaaaagtccttacaaatagtagtgaagttagatgggccaaaccatcaaacttattaaaatagaagtaatagagcacatccatctttcttgaacacacatctcatgcacttt

SEQ ID NO: 692913 - DNA, 216 bp, Homo sapiens
aaatcaaaatttcccaaataaaactgatttgggatttgggggggaaaaattttgaaaattaatttatttttaaaaaagcaaaaaaggactttgggcaaaggatttttgtaaaagcttttcaaaaaatctgtctttggtagggcttttgctgctcccccccaattgataaaatgctattaaaaggtttaaaaaaaaagttttaatttttaaaaggga

SEQ ID NO: 692914 - DNA, 946 bp, Homo sapiens
tcttgctgtggtcccacaatttattgaaaataatacagcactacagaaaaaaattcaaacaggtccccgaggcgtttgtgaaattcatcccaactgtaggctgagttgacctgaaggtttggacagacgtgccgaagttccaaagagcttcagcatttctccttaggtgctcaggattcatacttcaattaatctcctgtgatccaagtgttgagaccttcaggaacattaagttgtctctcctttcatctctcctcctccgtgcagcttgatggagattacctcttacgtgggccctcttctgcaattcgctttcattcagaagtgcgtgtgacataaccgtgctatcattgtatgacgcgaggcttcatggcctggggaataagtgggggatcctccatcgacaacatcgcgcattgctcccgtggtggaagttccgttgcccaggccgcgtgtagatactttcctactgatgaccctgggccgccttcttcacggtttgggtgcagaacgcggcccatgtttggccccagagtttgcaacctcagcctcgcctttggctcccagaagcccccggcccgcgctgcccgcactcctggtcctgctcggggcctctgttcccaggaccctggcattgcccagacatctgtgtccccctcaaaagtcatcctgcccggggaggctccgtgctgctgacatgcgcacctcctgtgaccaagcccacagtgctcgggcattagagacccccgttgcctaaaaaggagttgctcctgccttgcgaacaaccggcagggcgctatgcacttgagcactgtgcaacaacgtatagccaccaatgtgctattcaattgccctaatgggcagtcacaaggcaacaactacccacgaggtaaggactcaaaaggtgcactggacccctccctctgcacccatgccaaacttactg

SEQ ID NO: 692915 - DNA, 112 bp, Homo sapiens
caggatccccctgtatccggggagggactgtgccacattcttttaaactaaccacttcttgtagtgagctctgctgagatactcactcttcattctccatcgcagggcacca

SEQ ID NO: 692916 - DNA, 321 bp, Homo sapiens
  misc_feature (148)..(148): n is a, c, g, or t
agtgactcttctatatctacagatctgtagcaatctccccttttacttcccatcgcaggtgcttccttcatagtttttttgtgcagcatcaccacgagatttacgagtttgggggactttcaaagaatcgatagttgacttttttggncctccatggaaggtgtgttctgaaggtttctcctccctgtgtctctagccctccctctaaggacgtttcaaacacctcttctatatcaatcagctcatgtctcctgaggaagaacgctcttgatttctcttgtgtgagtctgtctttatttcacctttatatcttgggtagat

SEQ ID NO: 692917 - DNA, 1059 bp, Homo sapiens
acaggtagtgtaatgtgatgtattttgctcccttcttttttgttgtctgcgtatgtctttcttagtgcctcctatcttgtgttttttgactttttttgcccgtgttgtggtttcaagtatgctcgttcccggggtgaatgtttctcgctcgccccaattggggtttctcgcccctcccacgtcccgtatttggattgaagacccggtttcaccgtggccagcgggttagaatctctgccttcgggggtccccccctcttggcctccccaagtgggggattacagccttgggctcccgggccccgcccttcaaaagcttgttgtattttcgcatatgttgaaaaccgtttgacacattggcaaaaatgatccgttttgaaggccaaatggccaatcttgcgattaagaaggccaaaatagtcaaggagtccaaacttatcaatccagtatttgggaaatgaagactggaagctaatttgccatgaattccccaacttttatactctttccgtaaaaaccatttttttccctttaaaaaccactatggatccagaatagcccccatttagaaccctttttgttatccgtccatatttttagatagttagaacctggtcctaagcctaaaaagtgggcttgatttctccccgtaaatcttttacacacctgcctcgacacaccacttaacctcttttataaaatatgacacctccccgaagtcttttgttcgcactggtcaccacccctgaatgcttagaatgttcccgtaatctaaatatggccccacgtagtcttgatgagcccaagtcccttttttccactctttagagaaactaacactggggacacacacacgagtcgagaccacgttttgaagctatctgtgtgtgtgagatgaacacctcttgctttaattccacgaaatgctggacactctaattttggagttgtaatatttcgtgtcttgtgtactttacgctttgattcatagtaactttttatggaattgatttgccttgaaccaccaactgtaaattaaaagaaatggctgaaagagcca

SEQ ID NO: 692918 - DNA, 368 bp, Homo sapiens
tttttttttgaaggagtctcaaattaatttattaattctttgttcaacacatatggtttattttctttatttttgcttttattgagacagggtctcaatctgtcactcaggccagagtgcagtggtgtgatcacagctccctgcagcctcaacctcccaagctcaaacaatcctcccacctcagtctccagagtagctgggactacaggtgcacaacaccatacccaggtaattttttggagataatgtctcactgttattcccaggctggtgtaaaaactcctgagctcaggcgatcctcccgtctcggcctcccaaagtgctggggatacaggtgtgagccaccatgcctggcttatgtttttttc

SEQ ID NO: 692919 - DNA, 1400 bp, Homo sapiens
acgtctgcacagttcgtcgctctctcgtctagtagcgcgagttattgtgcgccccgcctgccctgtgttggtggagagctgaacatcccccgcgcgagtcgttgttagtacaccggggggtttggacacaaccggggctcttttcgctgagagtgtttctgatgagacgcggctcgtgcccaccgggggctccctccagctgtgtgtgggatcctcgcactgctacgtcagtgggtttcccgtattagccccacacggagttctcgggtactatatcttgggggtgggaggagacttgtctgttgtagtcgtccgcttctgtgggggaacgccctttagtggcgccccccatatattgtttctggggtaaatttgccccacctccgggggccctttttggaggattgtgccctgtcccggtaatttggcccattatattcgtgggccaccaccgtggggccccaccccccccccctgttatacatccgggagcccccgggagtggttcctaactaccccagtcccatatgtttcgtcttcgcctttgcctcgatggtaatacaggagatcttggctttccccacgacacgcgtttgttatgcgtgatatgcccgtggtcggcgggccgtccacaatcaagtcgttcccacagggggcccccgcccgcgtttctaaccccttgaattgaggacccccatttggcgccgccggtttttgcacagtgccggccacccaagcgttgtccgcggtggtctgttgctttgcgcgtctccgatatgagccctttggcccccgagcttgcacgcgcggagccctctggcaccggccatatggcctcccggggctcttgtgactttagcaccacacctctcgcccgcgcgctggcgcgctcagcgcgccccatatttttttggggagacacacttcttgcgcgcccctatgaggacgcccaagtgggaggaagaaagccgatatagccgccaagtcttggaagcgcgccacaaagaatagtaaagtatttgtagcgccaggaggtcccacagttaacacccgcgttagcctttgttcgccacccgttggaggcccccaggacgccagaaaccttggaattgcccagaccgcttggggatagctggtaccaatttgtgggactcgccatagcttacttgttttagagctttgtttccaataggattttagaacttcatgcgccctctgagtcgccgcagtcacccttctgaagagccccccttgctcactaaacccaaatgcccctgttggtcctctgccctggagcctgtgaccacttttctggactatttttctgtgtttaatttgtggccgagtgtaacaaccatataataaatcacctcttccgcctgttttagctgaagaattta

SEQ ID NO: 692920 - DNA, 477 bp, Homo sapiens
gtcgaaggtaaacagtcgcttcctacttccatcctcgtccgcagcctcattcctctttagtagtttaatttctcgtcctgtgacactcgtcccggtgcctgctgactgactgctgactgactgaccgtccgacggacgggggcatgctcgactaacctgtggcggtgacgtgagccccgacaacccggaaacgagcgagtggcggcgagtagcgagaggctcctgaggcgtccgtgctgctccacgcgccggctgctccctcatcgcctcagctcacgtggtcagacatggaagacagaataactgagcggcactaggaactgttgcattaaaactctatatcaataggtctacacctagcgttagatacgacaggagctaacggaacagatatactactctagctactggcttggacagtgttaactcttcacacatgggggcaaatccttcccttaacacgtttggaaacatgca

SEQ ID NO: 692921 - DNA, 503 bp, Homo sapiens
ctttaagttggttgtcagtcagctggataagtagtataatagagctacttagctgtggttttaatactcttctgttatcaatttgcaggccaattaatggccttttctaacatagttcatcccaccacagacctccacaccatcgttaccttaaaaccgattatcgatcatgcccactacgatccaagctactggccgcctttatacagaggggtgaagggtctgtgctagatcaaaaggcacggggtggcgatgtggcagagaagttgcttgtggggagaccttgctcttaacaggcttctggaaaagctagggaaaagtggttgcccgctttccccctttccctccccttcaagcaccgcttgagatttgggctttattattaagagctgctataaaaacagcttgcttaactgttaagagaagcccaggggtacttcaagcattccttcggatgcttcactccagaaagagggagttgaggcaagtcctcattaataata

SEQ ID NO: 692922 - DNA, 391 bp, Homo sapiens
  misc_feature (190)..(190): n is a, c, g, or t
  misc_feature (302)..(302): n is a, c, g, or t
  misc_feature (311)..(311): n is a, c, g, or t
  misc_feature (315)..(315): n is a, c, g, or t
  misc_feature (346)..(346): n is a, c, g, or t
  misc_feature (362)..(362): n is a, c, g, or t
  misc_feature (366)..(366): n is a, c, g, or t
gggccagggccaaaggggaaggccctggattttcactcatgtgagatcttgaatctctttctttgttcggtttgttaagttaggatcatctggtaaaatagttaaaaacccccaaaaaactctgtatctgtttttagcatgtgctgcattgactctattaatcccatttcaaattccccctacattcctntccttttcactagcctctttgaaggtgtcctggccagccctggaaaagcactggtgtttgcagcccccctcagttcctgtgcctcagcccccaggcccctgtgataatggtntgtttagcncttntgtatttattgtaagaatgattataatgaanataccccctgtaactncaanaaattataaatgtttttcccatcaa

SEQ ID NO: 692923 - DNA, 158 bp, Homo sapiens
gaacttcccggtgctggaaacacagaatagaccctaaatgaccactgttttatttattattgtctcagaattgtttagagctaaataatgattcagtatgtgattttctagaaaactcacggaaggagataagacttgcttttcatgaaaattggtac

SEQ ID NO: 692924 - DNA, 228 bp, Homo sapiens
ccccccggggcttttgggggggggggggggttttaaaataagggggggggggtggtttttttttccccccgcccccccccttggggggacaaggggggggggggggggggtttttggggggttttggcccccccccaagggggggggggggggggggggggttttttttttccccccctttttttttttgggggccccctctttttttggtttttttttcccccccca

SEQ ID NO: 692925 - DNA, 896 bp, Homo sapiens
aaagaaggtcatgtgttgggggggtatcttgcatgtgcggattatttgtcccctctcaccgaagcccttgtgagtctagcaaactattgccaggtagtcgtgagggtgctgataggactcttagtatgaagttcaagaagcttgtatagtagtataattggatgctggtcatctgaaatttatgatccatcttaagtttcatagtcagaattttcatgaattggttttagtggtgtgttgaactgtgaagaagacatattaattcatggtttacaaaagatctcattgtatataaagtagtggaaataagctatgtagtgtagagtggctatctagtaatctccgtaggatgaataaagcaaataaatggtgatgaagggaaattgagcatggtgtatagtatgaatctaatcattaagaagtgtctgagagtaaaacagagttcttgtagaaataatgtacaaatggcatgcaagctcgtgaattgatttggggttggagctgttgttgcaggagctgtattttgctaccagaaagtcttaattttaaaattggttcaggtcgaagcctcttggaatgaccaatattttatttacatatttgcatgtatgtcacatgtagagtctgttcccgcattatgcatgctgaggagctctaaagggtagagctagataatatatgcttgatggacagtttaagttggcaatctgggttgggtgtacatactatgattaccggggcatacaataggtcatggtggggggttggggaaaatgttcatgggcacggggaaaaggaaaacgaaaagagggcagaagattatgacaaatgtgggtacattaagacgttaggaaatatacagtgagaagagataatactgttatacgtctagttca

SEQ ID NO: 692926 - DNA, 155 bp, Homo sapiens
ggcagcagcttcactagggacactccctacaccatgaccacctattctgtggactatacagtgaggagcaattagctgtgtcagtcagggttagcatggagaagcagaatgagtaggagaaacagacagaaacatagatagtaggcataattcat

SEQ ID NO: 692927 - DNA, 1157 bp, Homo sapiens
cctaggcccgggcctgcgtgtggtgtggggttgctgcgcgccgggggtcgctcctgctgctgtcttaccgctccagcttcgcccacttccccttgccagcggtggtgggcgcggagaagacctgccggacgccatggtaggacgaacgctggtccgcttttgccaacgaacgatggaccaacgatggtgcacgaacgaagcacgctggctggacgcacttggacctttgctacaacgcgagcttaacgaactacttcctatgaccccgtggaacttacctgcagggtaccaccaacgacactcgcgacactgtcactgtcacttgcctacttcgccaacgcacgcacgtaccacgacttgaccggacacgttaacccctcgtttggccccacagtcctctatcactcaccactccttggaccaaccccactttctttacgcctcggtggccaattcaaccgttgacgaacgccgacccctttgaaccgaccgcatcgaccctgaaacacgacagcctctggccaaccgttacccacttccggcacgaccaccatgaccctcttgactgcgcaccccggactgacatcgcaacaccgtacgcttcccatggcctgtgcaccacacttgatacactgtcgccaccccaggcacacccgggcacttgacgtcaaccaacagttgcctctcgtacgcacttcaccgtctcaattgcgtgtgtccgaccatctccattgttttccccttgcgtggaggccagaccccgagacgtgcccacccccttttcctttggcaacttatccctttgtgtggccgcgcggctctacgcacgcgggcctggctcacggtggcgtccagtgtccattcggctcgcttcttggcccttgtgtctccttgcccttctcgtactcccggcaccacccccacgcgcggtgcggacctctggacaccggtaccccccacagttatggtacaacacacttggtgggccacggcccttgtgcccctggccacgcgggcacaacagcacaccgtttttccaggtggcacctcccgtccccaactccctttgtgcaccgacgcatccacgccccttacacttccatttcctttcgccacgcggacaacccactttcacacgcgcaccacctacccgacgc

SEQ ID NO: 692928 - DNA, 434 bp, Homo sapiens
  misc_feature (395)..(395): n is a, c, g, or t
  misc_feature (421)..(421): n is a, c, g, or t
aacggctgatgcggttggggagagagattggtctcaactccaaaaagggcatgggcagaaggaaatttgtagccaaggagcagagtaaacgggattctggctaagctgacctaacgggattcttgctgaagacaggccaggctgcttagacaccacctgggggatagtagaggatgaagaatctgatcagagatctaggatgatcaaaaatacgaggatcgaggattctagctaaactgacttggcaagattatttgccaaaactgtattttacaagaaagcatacatctgggcctaggagaaggttcagaaatctgactaaagtttggccaggcaaagaatctttgtctgtgtaatttaggaatgtcccttttccttaactatgggatcatccncaccagtcactgaacatgtatgaggngctacagtaacgc

SEQ ID NO: 692929 - DNA, 1281 bp, Homo sapiens
gggaggcggaggacgcgtgagatggatccagtagaacaatcgacagcctcattgagctgtccaccaaactccacctgccagcggacgacgtggtcagcatcatcgaggaggtggaggagaagcgggaagcggaagaagaacgcgcctcccgagacaccgggcaggggagcacaacagaaggaaaagaaacaagggcgaagacggagaaaagagcaaagaggaggagcagacacgacagacgacgacgagcaggaagcgcagaaacaagggaaaaccgaaaaaggagaacaaaaaacaggagacaaacacagagagacgacagacaagacagaaaaaacccaaaaagacaaaacaaaaaccaaaaaaaaacacaaatgagcaataacaaaaaaaaaaaaaacaacaaataccaacaaaatcaaacgaagaaaacaataacataactaaaataaaacaacaaaataaaacaaacacaacgaaacaccaataaatacacataacgacaataaaacacgcagacagagaaggagaacgaaggcacgagccaaacgacagagaagagaacgaggagaagggacgacaaacggaacaggacgagagcgaacgaagagagcgacaagaaggacaaagaagcgggagagagacgaagcaagagaagagccggaaggggaaagacacggagcacaacacagaaagaaacaaaggaagaagaagagagataagtgacaccaataagaagaaagacaaaagaggacaaagaacagagcaagcgacagcaaagccaggaaggaggtcaacacgaagagaaacaaaagagagaggagaaagagtaaggcgacgagccacaaacaggacacgccgaagaagagagacagaaacgagaccacgagcacagagagatcaaggacagagaagaaaaaaacagaaggtagacaaaaacgtaaagagaaaaggaacaagaagggaagaagacgcagaaacgagaaccgaaacacaagaagaagaaaaaggcaaaaagagcgaacgaggagggacaagagaaaggcagaagagaggagaggagacaacaggacggcgagaagagaagagcagacaggagcgcggggagaaagagagaagggcaaggaggagagaggaagaaacaaagggcgcacgacagcagaaaaatgcagaagggaaaagggacgaaggcgaagcaagggaagagaagaggagaagggcgagcgggcggagcgaaagcagagaatgaacagaaaaaagaagagaacagaagaaggaaca

SEQ ID NO: 692930 - DNA, 143 bp, Homo sapiens
gcacatgcctgtagtcccatctacttaggaagctgaggcagaaggatcatttgagactagaatatggagcctgcagttagctgaggtcgtgccgccattgcactctggcctgatgacagtaagaccctgtctcaaaaaaaaaa

SEQ ID NO: 692931 - DNA, 674 bp, Homo sapiens
agggcggcggagtgatcgtcaataacaccgagagcatactacactgtcctatgatcacgtggaactcacattcatatgaccatgtacgaacgtgccagaagccttcaaagggaccaagaaatggcacgtgtctaccttacccctatagcggcgtcatctttcgtgtccaagtgcgcaatggatgccatgcgagtccttcatgatgccagttttatctcatgaaatgactgtgagatcaacgcagcccgtatttggtgcaaactacatcaacgggaacacgtgaaggcggtaagcgggaggtggctgggaaggctcatgcttcctacaagttgagtttcacgtgcagggtgcgccatttgaagttcgcgacagcgtagtgcctccatgctggcagtctcaagcctccagaggtgaacgtccccagtgtgagcctattggctgctcttactatgcccagcggtggcctaatgtcttatcccccgtccagtttgctccctggcgttgtaccccctgtccacttgctggcctaacccataatccagcgggttcgacctgagtaactatgctagtgaaccccccgatgatggacggggccatgggattcgtgcgggactcaactccgccttaacctgggtgccattgaacctgcggtcagaggccccgatgtcccgtcg

SEQ ID NO: 692932 - DNA, 104 bp, Homo sapiens
tagtcttcatggaagaatctcggagaacaggatgatttctcctggtggcttaaactattcttgacgaacctcttctggaattcgttcacatgctctgtggctcc

SEQ ID NO: 692933 - DNA, 166 bp, Homo sapiens
acagattgttctccccttcgtgggtgtatatgtatgtgtatatggtgtatgtatgtgatgtgatattatatgtgtgttgtatgtatctgtgtatatgtatgtatatatgtatgtgtatatattgtatgacgattggtgttatgtatatggtatgagtatgatgtgt

SEQ ID NO: 692934 - DNA, 340 bp, Homo sapiens
tagagtgaaaggcaatgactaaactctatccacagagtatctatcagactttcaggcagactgtatatagttgtattaaccaattttctgtaatagagattatccctttacaaggtggacactaagtcaagcaatattgttatgaaaatcacaggcagtaatcagttcaattgaaccagattgtctgcttcaaaatattatttctgggcacagaaatcatgaatcgcactaagggcaaggtgtccacatgccattcccaaatatgagccctgcaggtcctattcccttatccagccccatcctcccagtatgcagcctgggttggccaaacatctctcca

SEQ ID NO: 692935 - DNA, 128 bp, Homo sapiens
gggcgaggggtggggcctccagcccccaagagctgaccctctctcggccgggagaaaccgggctgggctggcttggagcctctcccagccggtcactgggaaatcaggttcacctgggggctgggggt

SEQ ID NO: 692936 - DNA, 934 bp, Homo sapiens
cgcggtgactcatgcctgtaatcccagcactttgggaggccgaagtgggcagatcaccagagatcaggagtttgagaccagcctggccatgatggagaaatccggtctctactgaaaatccaaaatttagccacgagtggtggcagatgcctgaaatcccagctattcaagaggctgaagcaggagaatcgcttgagcctaggaggctgaggttgcagtgagccagtatcaaatccctgcacgccagcctaggtgactccgtctcaaaacatacaaaaaggttaaaagatacagatagggctcgggggaaattcaaggcaaaataagatagagaatttattggatccctaatcctaacttcaatggacttctgcatataattttaaaagtggatctttgaaatcagttaattggggccaggcgcagcaagtctcatgcctgtaaatttcaggaacttgggaaaccctgacgccgggcaacattcactttgcaggctcacggagcttcacagacaccatgccctggcccacagcattgtgcacaaacccttcgagctcatacgtatacgcaactctacaacaccttccagccaggcattcagtggcccccacgccttgtattccccagccatttttcccgcgaacttcgtctcgaacgcacgtagccgagaacctcctcttaagcgcgtctcaggcagcttcgcagcactctgtcctgtgggccccaacccggcgcgcctacaatcacccacgtgtactccctgacttaaagacaccacaccaaatcatatattggcggccctctgactgactgggtgcacccttcgttacctcaccaggcatcaccacgcaacagggccttaacacacccgcgctgacaccctgcgtcagatgggcagcgtcgccctactcagcctaagcattgcccccgggtt

SEQ ID NO: 692937 - DNA, 190 bp, Homo sapiens
gaataacgatatataggaggtcagcacggtgctcacatatagacagaactagtacagggaggcatgcaccgcagtgagtgaatacacgtcgaccaggctccatcttaacgatctcgggagatcaacacgatactcacagtgtcgacggaactatgtcccagggaggcatgcaccgcagtggtgaatacac

SEQ ID NO: 692938 - DNA, 405 bp, Homo sapiens
tacaatcgagctctgtacctgagcattcgtgtcctctgtcgagtactgtgccccccaggacaggatgctgcagatctcgctccgcattctggtccaactcctctgccttccggttgatgctcctcctgtttcttcagcagtctcagctgtggctgctgcagctgaggcctgtgtgctgtttgagccatagatcttaggttctgtggggctgagctttctcgagggctgcaaggagggagctgagggtggaggcaatggggcaggggctggaggctcataggctggtggtggctcccgggtctcaaaagggttgtagacgtcaagcgtggcatactgccggctgggtcggtgctggatcacagctgggtcctgaaaggggttgggacacgaatgttcaggggatcc

SEQ ID NO: 692939 - DNA, 730 bp, Homo sapiens
gaagataccgacctgtgtgccagtccatcgcttaagagtagtcaccatcagtgcccaaatgacatccagcttgtgctcgccggtagtactgggagaggagagcttaagtgaaggcagttggtatggcgtccagtagtaaatacttgtagatttacttcggtttaatttggggacttctcttctttgtaatgaaaataggtgatagatattgtgtgcgatgtagtcatcttataagtcatgtccatcgtttcagctcgaggatgaatgcagaaaatgtgcactgttcgatcagggacacgtcaagctgagtgtgagcacttagtatgatccatggagttgatccaagtgtggtaaatattgcgtgaaggggataggagtagatatctatacttgctctctcagtagactagcatagttctctcggatgttaacttgacttgaagggtggctattaagggtaactagagttgataaatgtgtacagaggtcctgtttgcgaagtgaaatcggtttatggagtgtgagatgggagtcaaaatcagaaattataagaaagaagtattatcctgtaactatagaaagaattatgtatatatacatgcgagaaatatatatgtgtgtgtgtatctgtggatggatatatgtatatctcgttccgtatagtatatccatagtggacgttattcgagaacatagatatgtattcagctgtggtcttcaaatacgggca

SEQ ID NO: 692940 - DNA, 567 bp, Homo sapiens
  misc_feature (52)..(52): n is a, c, g, or t
  misc_feature (62)..(62): n is a, c, g, or t
  misc_feature (65)..(65): n is a, c, g, or t
  misc_feature (72)..(72): n is a, c, g, or t
  misc_feature (103)..(103): n is a, c, g, or t
  misc_feature (130)..(130): n is a, c, g, or t
  misc_feature (136)..(136): n is a, c, g, or t
  misc_feature (157)..(157): n is a, c, g, or t
  misc_feature (162)..(162): n is a, c, g, or t
  misc_feature (167)..(167): n is a, c, g, or t
  misc_feature (200)..(200): n is a, c, g, or t
  misc_feature (241)..(241): n is a, c, g, or t
  misc_feature (258)..(258): n is a, c, g, or t
  misc_feature (404)..(404): n is a, c, g, or t
  misc_feature (414)..(414): n is a, c, g, or t
aacgacgtggctagagcccgcaatggagctctgtgctgggcacttcaggagntggccaccanctnatgtggntggctccttggggtggtgctccctaagccgnattcgtggacatctcatgccaacatgngccccntccatttcctaccttcctgcnagccngggantagcagcccagaagcccagtaatgcctttcccngcatatgcttctgatggtgtcatctgctccttcctgtggcntcatccaactgtatctncctttactgtttatatcttcacctgtaatggttgggaccaggccatcccttctccacttactatatggttggaactaaacgtcaccaaggtggcttctccttggctgagagatggaaggcgtggtgggatttgctcctgggttccntaggccctantgagggcagaagagaaaccatcctctcccttcttacaccgtgaggccaagatcccctcagaaggcaggagtgctgccctctcccatggtgcccgtgcctctgtgctgtgtatgtgaaccacccatgtgagggaataaacctggcactaggtct

SEQ ID NO: 692941 - DNA, 838 bp, Homo sapiens
taaccacggaaaacagccgttttaatcccacaaacagtaagactccatccatctacacagggactatacactgtgtagcaaaccccatcaccttggccagtgctgccagccgactcttgtctggggtggtgagtggaaattctttcttcttggagctgtgctccaattacagcagccacccgaccacttttgtgcctatatttgagcacgcctcaactatagagggtggccacttacaggttgaggaaatgaatttgctatggttcaatttcaaaatttcacaagtgccacatttgaggcctcagtgtgtgcctcctgtgtctacggtgggacaaaccacagctgtgataagcgccctgtgaccctgtggtctcctagggggccactgttgtgggtttcaaaacacgccccaacttcgtggaatggaaagccaagggtggcaaagaaacgagcccttttgggcctccctctctccccaaggaggaaaaacgcggcaagcttgccagccttgcgtgaaagaggggcaaaactctcagagcgtggcggggaacaccttcggagccgcgccggaataagggttgggccaagcctgttttgtcgcaagggccacctcgtgtggcgggggaccccctccgtattcttgcgacaagggtctcgggggtgaagggctggatttcgtttggaaagcgtaggcccgttgacccatcagctggcggccccctacgtgggggccgcggtcgacgggcaacatttcacgttacgtagggccttgcctggaacccccggttctcggcagggtcccccggacagggggctcccgggttagaaccggacaagt

SEQ ID NO: 692942 - DNA, 650 bp, Homo sapiens
  misc_feature (94)..(94): n is a, c, g, or t
  misc_feature (323)..(323): n is a, c, g, or t
  misc_feature (526)..(526): n is a, c, g, or t
  misc_feature (575)..(575): n is a, c, g, or t
tgagcttctttaaacagctattttgactttgtctgtctgaaaggtcacacatgtctgtcattccaggattggtcactggtgcctcatttagttngtttggtgaggtcatgttttcctgtatggtcttgatgcttgtggatgtttgttgatgtctgggcattgaagagttaggtatttatggtagtcttcacagtctgggcttgtttgtacccatccttctagagctttccaagtattcaaaggtaattgattgttttgatctaagtccttggtctctatagccgtatctacattagggagcaccttaagcccagtaatgctgngactcttgtagacttatagctgtatggccttagtggtcttgggtaatagccagtattccctggattaccaggcacagtctcttgtctctttccttattttcccccaaacaaatggcatcgctctccatgctgagctacctggagttgaggggaggagtgacacaagcacccctgcaaccaccaccactgggactgtgctgggntagacctgaaaccagcacagtactgagtcttatcagtcagtaataatgnctggctaccactgatgtttattcggccaagggctctttaattaacgggttgtgtctagccggcttgtgttttttc

SEQ ID NO: 692943 - DNA, 748 bp, Homo sapiens
  misc_feature (497)..(497): n is a, c, g, or t
gtccttgtcgatgttgtgtgatattaaagtattcagtaataatgccaggaaacgatcattagggagggttgagttggattgctgtttggacctgggagggatgatattacaatttaggtgctacgaaacacaattttagtgactgctacgagtttagcatttgtctagacagaaggtagctataaagctacctctgtaagtcatatcaaagaagtgcagaggaagatgagtaatatatttagtcaatagataaataagacattttgtgttttctagatatgcttaaacagtaatcctccgccgtttaggagcgcaacgaacgatgcgaaaacgctgaggagcgtgagagcgagagtacggggaaggagcaaataagccgaaaaagttgcggtaagtcatcaagccatacatctgggcgaaggaaaggaaggaagacatttggtggaaagaaccaaaggaaaagactcccatgaggacaaggattgaaactagaacanagaacgacagacgtcacggaaacaagaagaaccaaaaaattatcctgggcaaggggaagtccaggccaaaactgtccttctcattaaaaaacccaggattaaattgcaaactctgaactttttacaaagaaacaatggaaaactttgtatggtagcttcatgttgaaaggtgggttttggttggtggggttttaactttggtaacatctgggaaaggttaaggcttggtctaaatagggggggtatgggcg

SEQ ID NO: 692944 - DNA, 793 bp, Homo sapiens
  misc_feature (331)..(331): n is a, c, g, or t
gagaacatgaaacgacctgtggttcttcctcctccgtggttggcgagctcgccagtatgggtccgtgtcccaagcgtgcgaggctagagtcagatggggcagcatggacgtagtctgtaagccattctgtgaagaacctcgtgatcgcgctcaaccttgctgagatagtatgtactggtgtggtcctttcacgatgcttacatatctggtagctgagatccgcactagccccggagggcaaggggctaggagtggattggagggatactcgaaatcacgtagtcgcgaacgccaccagatgtatagagccgcagtcgctcgtcatctgacngtcggacgtacaccattattcaggatatgactaccgtggcacatagacctgcaaccatcatcgccgtgagaggtctgaggcgtcgtgtggaaacggcgcggtgggacaacggtgctgtgcgtgtatttgcatgtgacgtagacacattcagttaacattaggggcgaagcatccatggatgacaagaactgggtgccaggataccggctaatgagaaacgagtcctggaggggcagcgaaccgggaatcccacggggttggaacgcgatacgtcccatcaagcgggcaaagctggggattcgcttggcacacgtcatatccccgtttatgtacccaccccaccgtccggatcctcccataggtgaatgcaaaaattcccccgggtacgggtcaattaccgtaagccaagactggatgggcgctcgccttgggccttggcgttccgtcgaccaggggaccatt

SEQ ID NO: 692945 - DNA, 1025 bp, Homo sapiens
agcgggaattactccgagtggagagagcggacctgactgcgttgagtggtcgcgtctcgtgaatacctggtagacagcttgcagtcgatggcttgaccaactgtactgagattagccagattgcagaatccatgagacgctttttcaacatacttctgacaagagcatggtgatggaactatgacagagcaagagcgaatatggcgaaacgtgtagagtgagatctctatggcgcagcaatcccacacgatacgcaggagttagcatggaccagtgagtgtcaagtagaacgtaggatggctgacttggctagatcggcactacaattgggacgtgtcccttggaaagttgctgacccattgattggctagagcaagagaagtgcgagaccacacaaggacgagtgacatgaagaacattagaggaagccaattccgatgatgttgtgagtaacggatgcgcaaatggcgtcatattagctgctgcgaaaaacttcgtcccatgtgtgacttgacaaaaccctttgggagcaagaagggttgaacaggactgaaggacagggtttgactgaagactgatcaaggggcaccgcggaaactatgcgactgcgctgaatcggctccacaggtcaaacttaactgaaatgagggtaccgtactaacatttgcatggacaagcccattgctgcacaggaccctcggctaacaagcaaaatgttgtttcataactgcgcttcgttccaaatagattgatatgacttttcgcaccgtaaactacctttttgctgttgggtacacacttttagtccttgctagataatcgggttatctcaccacttaacgtaggttacagagataaacaaataattgcacattgtatatagggggaagattgaagcgaatcttccagttccactccccaagtggttataccaattgcacccgttgagtcctctgatcgctggtccacatccggtcacttgttagtacccattccctatttacgaaacaacatgcgattcccac

SEQ ID NO: 692946 - DNA, 172 bp, Homo sapiens
cctcgatcttcaggtgatcacaactctacgattatcacctgccgctggcgcaggcggtggcgcccagcgtgtgcaccatcagctgttgccgaaggacaccctgtactatgacagctttgcgccgctgaccggcaaaccggcggacgagctgaaagcttgggggggggtggta

SEQ ID NO: 692947 - DNA, 309 bp, Homo sapiens
acaacctagggctcagtttgcaggtggtaagccatttaccacgatagttgtaggtaagaagggcagatttattagagaaattgtgaagatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 692948 - DNA, 182 bp, Homo sapiens
cttaggactcggcaaaatacaagcatctatcaccaataacagacaaacagagagcaaatcatgagtgaactcccattcacaattgcttcaaagagaataaaatatctaggaatccaacttacaagggatgtgaaggacctcttcaaggagaactacaaaccactgctcaatagggttaaggg

SEQ ID NO: 692949 - DNA, 136 bp, Homo sapiens
cgatcccgggcatatcagctgcttcccaccaatataatgtaagctctcagagggctgggattcttatcagcttcgttcacaaaaatatacttgaagtctagaacagtgcctggcacatagtatgtggggtaccgag

SEQ ID NO: 692950 - DNA, 152 bp, Homo sapiens
atactttccatgcactaagtctggagaggtaaaggagtaagaatgagccaattgtgttcaaggagctatattataaccaagtagacagtcgttggtagtaaatgagccatggttgaaggtggtaggttcttagccctctaaacctctacact

SEQ ID NO: 692951 - DNA, 796 bp, Homo sapiens
cccacggatggcccagaagcattcaatctgtagcagcaactgctttgctaacaacaaaaaattaaaaaaaataacctttagaggaaacctcattgtgagcatacctcaccagttcagaagtatccttgccgagcgcggtggctcacgcctataatcccagcactttgggaggctgaggcgggtggatcatgaggtcaggagttccggaccagcctggccaagatggtgaaaccccatcgctactaaaaatacaaaaattagccaggcatggtggcgcacgcctgtagtcccagctacttgggaggctggggcaggagaatcgttgaacccaggaggcagaggttgcggtgagccaagatcatgccattgcactccagcctgggcaacaagagcaaaacttcatctaaaaaaaaaaaaagaagtatcctaaggaaacaacaacacggaaggaaggaaaaaaaggggggcacggaattatattgtaaaaggcagtatgatagggaaagcatcctgagaccctattgggcaataaacgcgggtaagtgactggacaaaaaaagaaaaaaacaagaaaaaaaaaataaaagagacgcaaacaaaagaaagaaggagaaagaggaagggggacgaagaaaggaggagagaagagagagaaggggaggcgagaaggcgagggaggaggagagggccagagagagagagagaggggaagaacagaggcacagaggcggagacgagggggaagagacagcggggaaccgagaagggggcgggggagaaagagggggaggaagga

SEQ ID NO: 692952 - DNA, 468 bp, Homo sapiens
  misc_feature (350)..(350): n is a, c, g, or t
gcgtcgacatttagaaggcatcagaaaattcattcttcatagaaattatacacattcatagaatgtggtaagtactgtattgaactgtcacatcttaaaatacattataggatccagactggaaagaaacgactatatggactgtgacaaatcattaaccaatcactcatattttaaaagacatcaaagtgttcatactgaaaagaggccttacagatgtaaggcatgtgacaaatctttttataagtgctttactcctggagaacatcataaaactcatattgggaagaaaaacaccaatttaaataatgtggcatagcatttgtcttatattctctacttacaaatcncaacattatacataatgtaaacataacaataaagaatctgcaaaatccttaaaatagtttaaatcatagaagagtatcgaagagtttatatttaaataaatttctgcaaattctgtga

SEQ ID NO: 692953 - DNA, 514 bp, Homo sapiens
gccctttagggacattcactgcagtgtgaaatgtatgttgagggagaaatcttatttgatcacccatggccacttaaaaccattttcacctgcgcttgaaactacctgcattttgaactccgtggctgaccgaatgatggcctctctgaaaaggagttccttatctgtacaactgtgagccagtagtgaggatgagtgaaatcccaggtgaagggcctactccaggagaaagcagagtggtcacatacggggctgacagtgaatggcaggtctagagccccgtctagggtgggattccataaacacttttgaaatttttttttcctgtggttcttctttgaaaaaacttgacacttcagtggaaaaagattcaattattgtagctcaaatattagaaaaaatgtatattttaaagagatagtagaatgtgttgtctagtttatattgtgtgtgaactttgatgaacttgccaagcttctaaaaataaaaaaattgtttgggcatctcagtgaaa

SEQ ID NO: 692954 - DNA, 197 bp, Homo sapiens
aacgatttagaggatccctcacaagctcagtgtcctgagtaggtctcgccataccgctgccaggtcagtgtgatctccgcaggtagaagcccagggcccagacctcaggtggcctcatggtcagagacggggtggtgggtcacgtgtgtctttggggggtctgcgcgctgaagcgtttccttcccagcttgttcaga

SEQ ID NO: 692955 - DNA, 995 bp, Homo sapiens
gagaccgagtccgacccgtcggagctacgagagcctcgcctttgcctgatccgccggccgtcctacacccgccgccatgctcaccatgggatgatgatatcgccgcgctcgtctgtcgactaacgcgctccggcaatgtgcaaggccggcttcgcgggcgaagatgccacgccgcggtgccgtcttcgccctccactcgtggggctgccccaggcagccgtgggccgtgatggtgggccatgggtcagcaaggattcctatgttgggcgacggaggcccagaagcaagagaggcagtcctcacccgtgaatgtaccgccatcgagcacggcagtcggtgcgaccaaactgaggacgacatggagaacaagtctggcaccacagccttcctacaactgagcatgcgctgctggcatcctcgagagcagtcgaaccccgtgtgcctgacatgaacctgaggtccccacctgtaacccgcaaaggcccaaccggggagaaagcatgacccgcagatcagtggtgggaggaaccgttcaatcgagcctccaagcccaagtgttacctgattagacctaattcgcaagagactagatgccatagtccccttggtacggcgcatcatgaggccggtaacgcaactgggacaatccagctggaattgggagcatacccgaggttgaacagggagagtaccaactccgagcagctaggttgacgcacaatatcttagacggacagagagagtaattggccccgttcaccacacgcaattgacccagttcgccttagccgatacttggaggaacaccctgtgacatgggggcccgaggaaacccctggaaccgtgggaagcttaatcccctgtcccattgtaaaaggaattcccattagacccccgaatgtaggaccgagacacttaccaagtggcatttcaccacgaggccaaccagggcccgatgtcggtgcgaaacaacttcgattgcacggttgaagcca

SEQ ID NO: 692956 - DNA, 84 bp, Homo sapiens
tccctactgcttccagcagctcttggaactcttgtttccaacacctattttttgagtcccaacataaacattagattaagccat

SEQ ID NO: 692957 - DNA, 278 bp, Homo sapiens
tatgaccgtgaatcattatgaatcattattcaaatccccatactgctattcatataatgcaacacggcacattttcaggcttcatcacaataggatgaaaaagactgtttctaactccctcctaattagcagacatgcttgaagcacttaagtggacggtgaagttcattcttgtggcccctcagattctctttcaagctcctcatagtagaaagtctccaatggtgtgagtcttctcgactgggttagaaccgcgcaaattctcttgcatgttttca

SEQ ID NO: 692958 - DNA, 147 bp, Homo sapiens
tacaggactcggagaacttagatggcaactgcttactttcatgtagagtagaggcctgctgtaatatccaacaagcttagattgtcttgctagatagtgaactatactagtgtttcgtcaattgacaagacgtatatcgttgctcaa

SEQ ID NO: 692959 - DNA, 109 bp, Homo sapiens
tcattaacgagcaccaagtatctactaactagcaggccaccaacaatgactaatcaaactaacctcaaaacaaataataaccatacacaacactaaaggacgaacctct

SEQ ID NO: 692960 - DNA, 754 bp, Homo sapiens
  misc_feature (70)..(70): n is a, c, g, or t
  misc_feature (167)..(167): n is a, c, g, or t
  misc_feature (179)..(179): n is a, c, g, or t
  misc_feature (181)..(181): n is a, c, g, or t
  misc_feature (249)..(249): n is a, c, g, or t
  misc_feature (261)..(261): n is a, c, g, or t
  misc_feature (290)..(290): n is a, c, g, or t
  misc_feature (302)..(303): n is a, c, g, or t
  misc_feature (324)..(324): n is a, c, g, or t
  misc_feature (326)..(326): n is a, c, g, or t
  misc_feature (339)..(339): n is a, c, g, or t
  misc_feature (358)..(358): n is a, c, g, or t
  misc_feature (385)..(385): n is a, c, g, or t
  misc_feature (424)..(425): n is a, c, g, or t
  misc_feature (435)..(435): n is a, c, g, or t
  misc_feature (438)..(438): n is a, c, g, or t
  misc_feature (467)..(467): n is a, c, g, or t
  misc_feature (469)..(469): n is a, c, g, or t
  misc_feature (503)..(503): n is a, c, g, or t
  misc_feature (508)..(508): n is a, c, g, or t
  misc_feature (511)..(511): n is a, c, g, or t
  misc_feature (515)..(515): n is a, c, g, or t
  misc_feature (531)..(531): n is a, c, g, or t
  misc_feature (556)..(556): n is a, c, g, or t
  misc_feature (564)..(564): n is a, c, g, or t
  misc_feature (571)..(571): n is a, c, g, or t
  misc_feature (573)..(573): n is a, c, g, or t
  misc_feature (584)..(584): n is a, c, g, or t
  misc_feature (587)..(587): n is a, c, g, or t
  misc_feature (606)..(606): n is a, c, g, or t
  misc_feature (710)..(710): n is a, c, g, or t
ctgtcaactctccaactcagctcagctgatcggttgccgccgccgccgccgccagattctggaggcgaanaacgcaaagatgagaaaatggacgttaatatcgccccactccgcgcatgggaagatttcttcccaggagttcagatcactttgcccggccggacttnagggacatttcnanactggaacaaccgagtagtgagcaacatgatcatattaccagaacaacatacctggtggtggctgccntgatgatttccnttgtggggtttctgagtcccttcaacatnatactgggaggnntcgtggtggtgctggtgttcncngggtttgtgtggncagcccacaataaagacgnccttcgccggaatgaacgaaagcgctnaccccacgacgttcgttatggtggtcatgttggcgcgcnntttccttctntcnatgtttggcggcgtaataggatctttgtntntggccttacttttcctttgctgttgaagattaancatgnatngttnaaacttcggaacctcnagaacaaactaggagaataacatgnaaggaatnggtttgncncagcccccgcnggnccttgtcctggatgccctngaacagcaggaagaaggcatcaacagactcactgactatatcagcaaagtgaaggaataaacataacttacctgagctagggttgcagcagaaattgagttgcngcttgcccttgtccagacctattttctgcttgcgtttttgaaac

SEQ ID NO: 692961 - DNA, 617 bp, Homo sapiens
atcccaatagtggtgcacacttgtagtcccagctactggggtggctgaggcaggagaatggcgtgaatctgggaggcggagcttgcagtgagccgagatcgcgccactacactccagcctgggcgacagagggagggagactccatctcaaaaaaaaaaagaaaaaggaaaaattcaagctttctttagttggatggatgtattcagccacatcaagatatgcattaatggactgggcacggtggctggtgtgtgtaatcccagcactttgagaggctgaggcgggcggatcacttgagcccagaagtttgagaccagcctgggcaacatggtgaaaccctgcaatactgaatacaaaaattagccaggtgtggtggcatgcacctgtagtcccaactgctactggggaagctgaggtgggaggatcacctgagcccaagtcgcaggagtagagatgggccacagagtgagatccctgtttcacaacaacaaaaagcaacaaaaaaaacaaatggtggggcgccgggaccaaaaaaagtttcaacaacaattttgggcgacgggcaaaaagcagacacagggcacacgggggcacaagaaaagcggaccaaaaaggg

SEQ ID NO: 692962 - DNA, 149 bp, Homo sapiens
gattttctttttttgtgtttttgggggggtggtgggtgattttttttctctctctctgtctctctctttctcgggtttctgttttctccttttgtggtctctcttgcagcgctgtgaagttaccgtcggtggcgccccggggccacctc

SEQ ID NO: 692963 - DNA, 897 bp, Homo sapiens
  misc_feature (430)..(430): n is a, c, g, or t
ggtctagtccacgcgcggagccatgccgtccgaaggttccgctgctaagctcgagtgcaggtacttgcaggaacgcagagaagacatgcgacatgcctgtgagccgagaggatgtacagatgcgtggaattggtcgtcactcgacaagggtgacacagggctggacccctatgcgacgagtgagttgcatccatgcgcaccgctgtactagtgtacaatcgcatgcctggcagcctatcggttcctgagtctcttctcggcaaccgtaagcggaattctggcgtgcgtcgtaggacgagtcgcgggttgattccggtgtaatcacgggtggctgtgtcaccgctggtgctcacggactgttacttgcttactcctgctctatgctccattcttccaataggaccgcgtgagtcggtcactagttagccangataactactggtgcgacgtgagggctttcgcaaggaaaagtgaccgatcaagagagcaatccttcaatctcgagggtagtagacccggtggaactgccatgctgtgggttagacgtgtacgctctcgggtcggccatggccgaaagtgtccagagcaaaggcttctgggacgggcccccatgggtgtgcccccgcgtcggtcgcaataacccaggaaaaagtccttaccccgagttaagggccccaagttcgggtggaaaccttcaaaaaaagccttcgagcctatgggttactaaaattaaagaaccaaggtatatttgggaaggggggcactctctgtaaaaaaggttttctccacacacacgatagttacacgatacacacccacacataagaatactcctccgcagagcggacattcccatcatgtagttctccgcgttagtcgcgcgagaacataccgcgg

SEQ ID NO: 692964 - DNA, 255 bp, Homo sapiens
ttgatggtttcagtgggcaaatagcgtcaagcacgagacttggctttatgtattcggcaaacatgtactggtcataccacatgccagagaccgtgctaagtatttggcatctgtgacagtatcaaaagacctcagtcttggaagcaagaaacttgtaacatgagaaaaggaatttccatgatagaagagcatggggtgctttggtgatgaaatggagggtgaaccgtgccacattaaaagagcaagttaaatgca

SEQ ID NO: 692965 - DNA, 340 bp, Homo sapiens
ccccccccttgcctttttggttgccccctgttttcccggggactagactactgttgtcccggggccatttgggggtaaagaaaatgttgcccagggattgccccctttttaattttgcctttgctgcctttatttaaaggcccgttttggccccctttttcccctttttttttggggggttccaaaggccccgttttttggtttcccggggggccccctagccggttcctaaaagtttttgggcccttaattttttccccaaaaaagaaaagttttttagtcccccctttttattggggggggggtgttcccctgaagggataaatgtttttttacctta

SEQ ID NO: 692966 - DNA, 1610 bp, Homo sapiens
  misc_feature (168)..(168): n is a, c, g, or t
  misc_feature (180)..(180): n is a, c, g, or t
  misc_feature (377)..(377): n is a, c, g, or t
  misc_feature (383)..(383): n is a, c, g, or t
  misc_feature (392)..(392): n is a, c, g, or t
  misc_feature (402)..(402): n is a, c, g, or t
  misc_feature (416)..(416): n is a, c, g, or t
ggctgagctgtttagagggcatttatccagcagtgaaccgtcctagcgcaagagttagtaattgctcccctgttccttcacctccccactttggagctcagatttgtttttttgtttgtttgtttgcttgctattcttttgttcctgttttaagagactggagactgngtcttgctctgntacccaggctggagtgcagtggtgtgatcatagctcactacagccttgaactcctgggctcaagaggttgaggctccctcctcagcctcccaagtagctgggactacaggctttcagcaccatgcctggctaattcaaaaaaaccttcagagagatagggtctctctatgttgccctagctcgtctcaaactcctgncctcangtgatcctnctgcttgganctcccaaagcgctnggattacaggctcctggaaccatgggcctcaggccctgaggatacggggctcccggtggccatgacgacgggtgactgctgccacctccccggctccctgtgtgactgctccggcagccctgccttctccaaggtcgtggaggctacgggcctcggaccgccccagtatgtggcacaggtgacttcaagggatggccggctcctctccaccgtcatccgtgccttggacacaccgagtgatggtcctttctgccggatctgccatgagggagcgaacggggagtgcttgctgtccccgtgtggctgcaccggcacgctgggtgccgtgcataagagctgtctggagaagtggcttgcctcatctaacaccagctactgcgagctgtgccacacggagtttgcagtggagaaacggactcgagcccctcacagagtggctgaaggacccggggccgcggacggagaagcggacactgtagctgctgacagtgcgtgtgctatccgtcgtctcaatcgacaacacggatgtgcctgtccatcttcgaggctgggttgtgcctgcagcggggcccaaggaccacctcacgggtccacagcccagtctggcaggccggtgggtcatcattgccctcagcaatcgcccgtcttcaccatctatgtcctctggacgctggtctccttcctgctgtacactgccagctgtaactccgagtggagaaagaaccaagcagaaagttcgctgacgatccgggaggctggacagacccgagggcccccaggatgctccatggcagctggactcctgaagaaggtggcagagggagaaacagatttgaatgctggctctccgggaccatgcagcagataggccagaaggtagctggtgataccctgtccctgtggaaggatttccacttccaagagcgtttccgcttgaaacagggactccggcacgtgaccgtaaacaggctcagtaaggccgaaggcacactaccatggaggaaggctaagatccgtgggaattcctttgttgaaggatatttatgcaagggcgactagatggttaatataagttggcatatagtaagaacagtgtggacgagtggcccgtgacgcgcgggacagtaggccacggcacccatcagtccccaacgagaaggctccactggatacggattggaaccagaagatgct

SEQ ID NO: 692967 - DNA, 300 bp, Homo sapiens
  misc_feature (88)..(88): n is a, c, g, or t
cggccgcatcgggttttattgctgatcaaagtggatttcagagggaaggtgagctaaaaacacgggggtgggacaggccggtatgtantcttcccttgaagtccagctatctccagccagattcgtctcagaagttacgccttaagctgtccctctgaagacaagctgcttctctctgacatccagccatgggcgtcccctcatccagctgcttctcctctctggcagatgagtctggggtctttctaggcacaggatgaggcagggcaaagccatgggtggcttaggaaaaggcgacat

SEQ ID NO: 692968 - DNA, 216 bp, Homo sapiens
ccatgtggggcatcactgcggcaagcagaagcatttagggattggctggcgaatgttttacttctcggctgagtgagggtgcatcggtgtttattggataacacgttctaggggctgggcaagatggctcatgtttgtagtctcagtactttgggaggccaaagatgggacggattgcttgagcccgtgagtaagagaccagcgtgggtgactact

SEQ ID NO: 692969 - DNA, 201 bp, Homo sapiens
acggacctcatcagctttctggtggtctcctacccatagctatttggtcccccttacctcatcagaagaggaccctctccttgctccttttcttgagatgatcccaccacaaagttaaagacttcccaacgatactgagagtatccacccttgcgctattggttcttcacggctttggactcttccacagctcccatttca

SEQ ID NO: 692970 - DNA, 276 bp, Homo sapiens
acaggtaccagagcacagtcacagaaaaacctatcatgtctaataaacactacatcatgtacctgatggcactacttaatgcagttcacacatatggcatttcgatctgtggcgttacaagtatgacatctgtagaaatcatgcatgggatagctggtataacttgatataatatataaacattggcctctactaacagaccgcaaactcaacaccaccttcttcgaccccgccggaggaggagaccccattctataccaccaccacgaattgcgg

SEQ ID NO: 692971 - DNA, 850 bp, Homo sapiens
gcctgttccgagagaatggaaggggttagccacggtgggaacggccacggggggaacggccccgcctagtgaggagcgcaggcacgtcaatggcttagctggatagaggcgtgacccaggcgtaccgcaggggcgtggcccgaacgagctgactttagcccttacgtgaaatggcgtggcgtatgtctcatagggtgtaaacaaagaaattcgaattctgcgggacggtcggcctcaggcggtagtacgggacgtgggcccaagggagggaggtggggtaggcagactagttgtgactggatgatcactgggcgaagcggtggaaaatgtggccacagatggaaaggcgtggcagcggattcagtgaccggccacagggaggtgtgcgcgaacaagggcacagtagggacatgacgtagttgtgaacgcagagacggtgcctcgaacgtggtgggcgcggtccttacgtgtgggcgcggtccttacgtgtgggcgttgccttgttgctctgaggggctgtaacaaaggatggtcgcgagcagtgcgcgatgcggcagaggcgtcggcaagttagcgtgcaggcgccgtggcaacgagcaggagatgtcgtagccggatgctgcagagtcaccgtgtggactccggcgctgggtgaagcgtggccagggcgagatctcagcctgggtcggggacaagaatggggactgataggggcgtatcctggaatgacgaactgacgtaagctgcgtagggaccgtgggtaacgcgtgagggggcgtggccaatatggccgcgtagtggatcctcgggtaccggggagcgaaggaaggaggtctggctcatgcatccc

SEQ ID NO: 692972 - DNA, 694 bp, Homo sapiens
  misc_feature (401)..(401): n is a, c, g, or t
  misc_feature (481)..(481): n is a, c, g, or t
ggttcgagcagttttatcctctagaatttttatggtttcaggtcttatatttcagtttttggtcctcttgagttgatttttgtataagatgagagatgagaatccaggtttattctttaatatgttgcttgatgatgatcccagcactatttgctaaatagggtgtcctttacccactttatgtttgtgtttgctttgtcaaagatcagttgactagatttagctttatttctcagttctctattctgttacattggtctatgtgcctatttttatatcagtaccatgcctgtttgatgactatggccttgtagtatagttgtcaggtaatgtgatgcctccagatttgtggtttttggttggttttgctttggctttccttggctatgcaggctcttttntggttccatatcaacttcagggattttttttttattattctgtgaagaacaatgagagtatttgatgggaatggcatcanatttgtagaattgctttttgcagattgatatttttacaatatggatcttcccatccatgagcttggaatgggttctatccaatggggcatctttgaatctttcaccatggtttgagttttcttggcctttcacctcctggattggattttcctagtatcttaagttttggtttttgaactttggggaattgagtctgagatggcctcttggtt

SEQ ID NO: 692973 - DNA, 466 bp, Homo sapiens
  misc_feature (2)..(2): n is a, c, g, or t
  misc_feature (206)..(206): n is a, c, g, or t
  misc_feature (231)..(231): n is a, c, g, or t
  misc_feature (243)..(243): n is a, c, g, or t
  misc_feature (247)..(247): n is a, c, g, or t
  misc_feature (251)..(251): n is a, c, g, or t
  misc_feature (264)..(264): n is a, c, g, or t
  misc_feature (269)..(269): n is a, c, g, or t
  misc_feature (284)..(285): n is a, c, g, or t
  misc_feature (291)..(291): n is a, c, g, or t
  misc_feature (331)..(334): n is a, c, g, or t
  misc_feature (351)..(351): n is a, c, g, or t
  misc_feature (364)..(364): n is a, c, g, or t
  misc_feature (366)..(366): n is a, c, g, or t
  misc_feature (375)..(375): n is a, c, g, or t
  misc_feature (381)..(381): n is a, c, g, or t
  misc_feature (383)..(383): n is a, c, g, or t
  misc_feature (387)..(387): n is a, c, g, or t
  misc_feature (393)..(393): n is a, c, g, or t
  misc_feature (401)..(401): n is a, c, g, or t
  misc_feature (462)..(462): n is a, c, g, or t
gntccccaagcggggacaccagggaaccgtgggggacccgctctcgcgaaagaagcgctccgttctcaagatggcccctgatagcgtcagcttcttcctcacatgctagcccacacgcgatttagtgagcttggacatgcctctcttcatttccatatatgtgtttgagtttcttgcttcagctgcgaatagaagtatgagaagtnggcaatgctcatagcaccgcagcanagacaatatttnttgntttngcatactattgtntacgngtgcctaggttaaannaataanatgaagttagttgggcgttttttttttttttttttttttnnnngacaaagttcctagggnccggggttgggcntntcaaggttngttttntngggntaaggnttctgtcnaaagattctggtttaggcagatgcccctggcagttcgggtagcctcgcgggggtagccagngcgc

SEQ ID NO: 692974 - DNA, 119 bp, Homo sapiens
ctctgagctgcagtggccccggtgctggcatctggtgggagcggacccactcccctcacattccacgaggcccatggactcacttgttgtaacaaactcctcaccaacactggaccaat

SEQ ID NO: 692975 - DNA, 291 bp, Homo sapiens
cagggaggcagaggttgcagcgagccgagattgcaccactgcactccagcctgggtgaccgagtgagaccccctatctcaaaaaaaaaagagcgaaatgtattccagcaggctataaatatttccccaatcttctgttaataaaaaaagcaagaaatgcctataagtgtaaacatctttttaagcctatttggcttaaggagaggacgggaggaaggacggaagaaggttggaagggagaagacaagaaagtgaggaagcacaattcctaatatgttcatgattatatgag

SEQ ID NO: 692976 - DNA, 1401 bp, Homo sapiens
tgaagctgtgtcttaactctcagcaaagctggcaacagaaataagatggtacacaacaagaaaatctcttatctgacagtgactctgcatgacagccaaatccaacagcaagcaacaagcagatgctgcatgacaacacacccaagcaggcattatgcccagaggctctatgatcctgcagaagaaatacaattgtgtgcccaccagacagccagctgcgcagcacatctgcatagctattcatccatgcacaatggctgcaaacaggcattcccagcatagcagtgcgaacgcacatctggcgtttgctttgggccgcacacagccagggccatacaatcatcgcaaatgattgtcgcctcataataaataagctcaaagttaggcggtatatactaataattgcacacgccagccaggcacattcaaccctaatgcggacgcacttctgcgtatagatctctctcaagtaacacggcagttggcagaagcgtaccaaaaagtaacacttgatggctcaccgagcacagttaaggcttctccgtactcacgtcatcttaagttaacttaatttgtggtgaagttcagttacgcttagagtaaacttaactttaaagcacaaaacaacttctggggaggcgatcccgtagctcacgcacgttatgtccctggaagctcttctaacacgcggctaaagcgagagtgctaggcaaccccagccccacaacatttacagaccacattaagctcagctccgaccgtttacacacgtggttatatacactatagttgccaacacaggatcttccactgggccacctaaacttggaccattctcctgtgttactcttatcgggtaccacacacaggctatacatgcccccggcctcacgtgcagcacaacacagacacacggcttgactggcactcatcgctcgtcaggactgaccttaactcccctcgcctggccaactgttcccccaacactataataggacgaatcccctgttgtgattattcactactcctatttatgggcacatctactatgatcactttatctcacctcttacagaactctaacagtcaccgataatttaacctttggatctacagtcgtatctttggtcttgtgttgtacactattctgcttcaacagttccacaatggcaaacagtacaaatcggtgacagaaccatacactttatgttgtgcatgtttacgcagcatatattgtgaggactgcacctaacaagttatcaacgatcgatctcccgcatgatttacactgttccaaatattatactaaagcatggtgcacagcctcacgtacaggctctcatcagactagccgtcattacactaacatctgctttgattattcgtgggatggatacggtg

SEQ ID NO: 692977 - DNA, 759 bp, Homo sapiens
agagagctaaataaagttaagatacctgtaaaaaaaaaaaaaaaaaaaaaaaaaaaaaaaaaaaaaaaaaggaggggggcccaaaaaaaaaaaagcacaaggggaagcaagggaaacggaacaaggcccgtaacaactaagtggcgccaccaccaacgacggagtcggtcagaataaatgaatagaacaccaacacgagtaagccacggacggctaagctcatacataacaccacagtagaacacacggcggaagcagacgtacgtcaatagcaggcgagcacagctccagctcgaagacacagcaacccacacaaactacgcgtgggagggaagcgaaacaaacaaacaagaggacgaacaaacaccaactcaactcgctgcacaaagaacaaaagttaatatcatattgaccgagcgacgactaagtgagggagagagataaattctatatgaaccatatatctgtatagccagccgagcgttgtcgtttaacatcgtcgcgggtgtcacacaccacacacacggggcgcagtagtatctaatagtgctagtcgagcggtccgtttgataagaacacaagacaaagtgtatcgagtcacatccatccgaggtagggcgtgatgtacggcggatcgatagtcttgcgcgaagcaagcaagatccgtttattgattgttactacctacaaccaccgcgggtgatgcgagcatcacacgtagtgtacgcgagaagataaaaacagtccgtagttatatcg

SEQ ID NO: 692978 - DNA, 258 bp, Homo sapiens
ctagaggatctcttaacaggctgatacaggagaatcactggacccagtagggcagaggttgcagtgagccaagatcacaccactgcactccagcctgggcgatggagtgaaacttcgtctcaaaaaaaaaaaaagttaatggcccatttaataccaaaaatacttgattttttcaaatgatatttaccttgggatggggttggattttatacttggtcctgagtgtggtcaagatagaaaaaacccagtttgggaccc

SEQ ID NO: 692979 - DNA, 854 bp, Homo sapiens
gcagtcgtgttctccgagttccggtctctctgccaagcgcggtccggatgggtatcccaaaaccgggacgcgagccggcactcagcgtcgccggcgcccgtacaggaagcttgacgcgcagagcggaggggcagccgagacggaggtcgcggcgatgcgagcgagtagggctagcagcacaggaggctgatggacgcctcagtgatggtctggatgataagacgggatattctggcgcttctctgacatcacggaacaagcgtggtgcagaatgagtgtagaggacgcattccacttgagtaggcaatcatcgtgaaacagctcactactagagaaagtactcgtggagcgttagtaaagccttctctgccgtagtacgttctccactagctggactaagcccttacatatgcgcccaacacgtggaaaagtatgcgtcatcgtcgcctgcctgtacaagccccaatcggtaggcagcaacacgcaggggttgaacaataatggactcgttgggacaactccctggcatagggaagatgaaggtaggctcgtggccgcgtgatcctggaatcggtcgagggggactcgagtttcctaggaatcctccctactcacaagaaggccacttatctagaggcaggagacaccccacggcatgtgaaatagcttctccctagaaagaccacccactaatggcttgcctgagtgctcgtgaggataaaaacccccccaacgaggctgttctaaaggaaaggtcaccgctggcaagagaggaaagaagcttaacatgccagaaagggcacgggttcaacccaatgctcaggtaagaccccgtggagctccaaggggctggc

SEQ ID NO: 692980 - DNA, 914 bp, Homo sapiens
ctccttgtcccggcgtaattattcatctgctggggcccgcgtctcatttttcgtgtaggccgtgcaacatataccgcggtctctttataagagtagtgtgcttttttgcgggggccgcccattttctccagaagccctgctgagacgtgggccccccctaaatgggggggggccccacccccccccagagggatgtttttaagggggaccacaccgagagaaccacacggtgtcactgcgcgcagagcattttctccgaggcccagaaagaggtgtttctttttttgagtttttcctcggggccctccttctgcccggggtgttggtaacaacgaagcgcctccccaccaccgggtttttggagagaccagcatcgtggtgcgtctctatataggacaccggaggggggagtcacactcgtgctgtggctcccctcttctttgcggttattataatagagtcgccttttattgtcttggcagtcgtggtggggcgaggacccccacaccggcgagagggaacacacgcggtgttggtctctcgtgtagtgtgttgcacccggtgggcctcttgtgggagaggagaacccagtttttttttagatgtgtttctcgtggtggcccatcttctttgggggattcgggcgtttttcgaagagggggtgtttccctctggtgggggtgcacaggtgggctttttagggtccctcgctaatgtgtggaccccagttggcccgccgcctcccctcgccgccctggcgccccactcagtctttcttcccccgttgttgggcgcccgggccaattttttctccccccccccccttttttcccccccccccccttttgggggccccccctggtgaatttgtggccaaatttttcccaaaaaaaactttgtttttgggccccaca

SEQ ID NO: 692981 - DNA, 408 bp, Homo sapiens
  misc_feature (32)..(32): n is a, c, g, or t
  misc_feature (67)..(67): n is a, c, g, or t
  misc_feature (72)..(72): n is a, c, g, or t
  misc_feature (108)..(108): n is a, c, g, or t
  misc_feature (113)..(113): n is a, c, g, or t
  misc_feature (127)..(127): n is a, c, g, or t
  misc_feature (136)..(136): n is a, c, g, or t
  misc_feature (150)..(150): n is a, c, g, or t
  misc_feature (155)..(155): n is a, c, g, or t
  misc_feature (159)..(160): n is a, c, g, or t
  misc_feature (173)..(173): n is a, c, g, or t
  misc_feature (175)..(175): n is a, c, g, or t
  misc_feature (203)..(203): n is a, c, g, or t
  misc_feature (206)..(206): n is a, c, g, or t
  misc_feature (214)..(214): n is a, c, g, or t
  misc_feature (216)..(216): n is a, c, g, or t
  misc_feature (219)..(219): n is a, c, g, or t
  misc_feature (226)..(226): n is a, c, g, or t
  misc_feature (244)..(244): n is a, c, g, or t
  misc_feature (254)..(254): n is a, c, g, or t
  misc_feature (259)..(259): n is a, c, g, or t
  misc_feature (266)..(266): n is a, c, g, or t
  misc_feature (306)..(307): n is a, c, g, or t
  misc_feature (320)..(320): n is a, c, g, or t
  misc_feature (322)..(322): n is a, c, g, or t
  misc_feature (327)..(327): n is a, c, g, or t
  misc_feature (364)..(364): n is a, c, g, or t
taacatgtcctaagagatactcaatggtttanaactcaacagaaccacagaaaatacagatttctanctttntatttctatatttcttctttttgttgcaaaatatcntcctngtattatctctganttccagcanaaccctttttaccnttaantttnnttttattctattntntatcacacttgttcacattattactatntcngactttgntnttnacatganttagttaatgctctgtgngagctatatnttttntaacttnttttacatatttttttttgttttcaggttttttttttttnntattatttttttnanttttnccactttctaatttttatacattaatattctttttcntttttttttttttttttattaatattaatatggagaagtttagt

SEQ ID NO: 692982 - DNA, 326 bp, Homo sapiens
gaccatatcaaacattttgataacctccattattacgtttttgctatagtatcagtattgacttatcaggaaaatattatagtgcatattgtagatctctgaaatagaatcattgctattatagtatcctcttcatgtaattcctgcatatctttttatttaccaggactgttagtgatattaaccacaagttattgcttttagtaaaatatttcttggcagatcttggtgtctaaatgagatgactgggttttttttattgttgtgttcttcccctaactataataattagctataaaattatctcagacatatagttggttaat

SEQ ID NO: 692983 - DNA, 124 bp, Homo sapiens
tgtatctaacgagctctataatcctgcagaaacatacaatacagaacttattgctctgaactttgctcggggagctggcacggatgttgcaggaggctggtcccccgagtctacctacgatacg

SEQ ID NO: 692984 - DNA, 548 bp, Homo sapiens
atcattaagggaggtgaggagcgctctgcccggcgcccgtctaggaagtgagcgtctctgcccggctgccccgtctgggaagtgaggagcgcctctgcccggtcgccccgtctgggaagtgtacccaacagctccgaagagacagcaaccatcaagaacgggccatgatgacgatggcagttttgtcaaaaagaaaaggggcaaatgtggggaaaagagagatcagatgttactgtgtctgtgtagaaagaagtagacataggagactccattttgttctgtactaagaaaaattcttctgccttgggatgctgttaatctataaccttaccccaaacccggtgctctctgaaacatgtgctgtgtcaactcagggttaaatggattaagggtggtgcaagatgtgctttgttaaacagatgcttgaaggcagcatgctcgttaagagtcatcaccactccctaatctcaagtacccagggacacaaacactgcggaaggcctcagggacctctgcctaggaaaaccagagacctttgttcacgtgtt

SEQ ID NO: 692985 - DNA, 396 bp, Homo sapiens
  misc_feature (110)..(110): n is a, c, g, or t
tgcccctcatttacataaatattatactagcatttaccatctcactttctaggtaatactagatatatctgctcacgacactcatatccgtcccttacttatgccttagnaaggcaactaagtacgtatcgcctgtgcgattatgagctacgtcgtcaatatacccttctaacgaccgcacttgccctcgttatgccaataattggtggccgtattggccgatactaggtctttggccgcctgcgaaggccaagggggtgggcctagccctactagtctcaaaattctccaacacatatggcctagactgacgctgacattaacctaaacctactccaatgcttaaccaacgtaatcgtcccaacaattatattacgtagccgagcttggacagtg

SEQ ID NO: 692986 - DNA, 182 bp, Homo sapiens
ctggttgccgccagcagccatgggcagccgtgtgcacgagtcttgcagcttctgggcaggtgggtcttggcactctgatgcaccattcactcccatcttgctcacccccatgctatcctatcagtgctccaccaccctcgtgtgctcagctctgcagcagtgcctggcacgcatggtccctg

SEQ ID NO: 692987 - DNA, 131 bp, Homo sapiens
  misc_feature (2)..(2): n is a, c, g, or t
tntaagcacagttgtggtcaaaagaaaagaaatgtaattacaagagctgaagtacctgctgtggtgcagtgggttaatagatccggcttgtctagtgggggcgccagtttagatccctggccctgatgcag

SEQ ID NO: 692988 - DNA, 439 bp, Homo sapiens
ggtggtggaggcacccggaaaggccccccggaaggcgcccgtggaaaaggcaaaggtgccggcaggaatttaaaacagcagcttttggcaaaggagctggatgcccagctgggcgcctataatgcgagaatgggcccccgtttaacagcccagcaaatccgggtgcggaacaggaccccggggtttccttttgctccctggttggggggcggtggctggggctgtgcggcccaagatggatttgttttttttatgttttaaaatagggtttaaaaactcatggaaagggtttttttttttctttttttttttttttaattttgaaacagacctgttttggaccgagttatttttgggataaatttttctgggtgctgttgtggagaagggggggtttcccccttttccataataaaataaaaatgtgggtagaactgga

SEQ ID NO: 692989 - DNA, 269 bp, Homo sapiens
acaagccaagtttaccaggacaccttccgagggagtgtcttagagggagtcctacaggtacttctgtgatgcaggtgacagccacagatgaggatgatgccatctacccctaccatggggtggttgcttactccatccatagccaagaaccaaaaggacccacacgacctcatgttcacaattcacccggagcacaggcaccatcagggtcatctccaggtggcctggacccgggaaaaagtcccctgagtacacactgacccatccag

SEQ ID NO: 692990 - DNA, 976 bp, Homo sapiens
gctcttcccccgctgactggggtatcagtttatggtgccctgcaggaagaccctcttgttcctcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagatactatgggggagccgaggtggtggactgcacattcgagctgctgtgcccacgccgcggcctctgccaacgcatcttgccctgcctcctgccccgtcggcgccctccatgctccccgccctacctccgggtcccccgcccaacctgcgccccctacaccgccccttctgccaccctccacgatccggactcatgcggcgctcggacctgccccgactcggcgaccactctcaccccagccgcctacactgcctcctcgccccgccacacccgcgatatcaagcaccgcgtccactctccctccacagctctaatgccccactaccctcaaccccccagaacctggcccgtcctcgagctcacaacccagcctggcacctgcacctgcgtcagacactccacacggcacacgcgccctcaatcacaccgctgggccaccaacgcgaccctacgccacgaccctcactcgacaccagcacccgcactggagcagaccgctgctgtcgagcacgaaagggtcccacagacaccccctcggcatcgaccatcgcaccccgcgccccaagcctaccacatcgcgtctgagcggcgctgacacagcgtgcatacccacccggcgcctccacacgcccctcggaaccatccgccaccacccactacgccccaccacggcacccaacacagcagccaacgcgacggcgcacaagcactcccc

SEQ ID NO: 692991 - DNA, 542 bp, Homo sapiens
  misc_feature (397)..(397): n is a, c, g, or t
agtatcctttcatccggcagtgtagcctggacacacccaagacaggtgtgagcctggacagaagccagagcaaggtatgagcctgaaccacactcacggccagctgtgggtctagaccaccatccatggtcaggtgtgagtcaggatcatcctcccaggtccaggtgtaagccagggtcatcctcacatggtcatgtgtgaccctggaccaccatccagttcctggtgtgagcctggaccatcacccatgttcagctgtgaatttgaaccaccatccatggccaggtgtgagcctggaccagcactcacagtccaggtgtgagcctgtgaccacctatccacggccaggtgtgagccaggagcatcctcccagggccaggtgtgagccaggatcatnctcccagggccaggtgtgagccaggagcatcttcgcagggccaggtatgagccaggagcatgcttggcatttggcccattgcaaatgacactctttgtcccttgtcagcattttaaaccaaggtgaagaggtccacttagctttg

SEQ ID NO: 692992 - DNA, 749 bp, Homo sapiens
gatcggcagctgggggccgaggactcttggttctgctggcgacgtgacggtccgcgcgcctggctccagttctctctgttccctgcgttgcgcgcgaggcgactggtcgtgcagcgagcgtggaaggcgcgccacggggcgaagccccgtccgtatcgtcgtgcgaggcgtacccaggagtcactgtgaagagcacacgatggtcgcgtgatgctactggttacgtgagatgcgtatggcaagctgcgtagttgtggaaaggcttcagtgagtggacaagtgattgaatgattgctcgcactgtgagtcatgcaccgaattgaccgttgaggcactgctcagtggagaggagagatatgagaggtagcgtacactcagcggcgagaatcaccccattgcctaccgctcgatttcaggtctctcccagaggctttacttagctgaagcctccagctttccaactagggggaaatgtcatgatgtgtgggctgtattgcttatgtgcagcgaggaggcgacacgtccatgtccgagggctgcgatctctatagtcatatacagaccacacgtgaacaggaccgtacttagccgactggcaatgggaacagtttggcccagggaggttatcggatagcgccaaaggttgtgaagaaggggtcacccgagggtaaaaatgcagagggaaaagatgcaacgaggttgcgtgtgccccaagggggttgaagtcaaaacaggggaagctctggggt

SEQ ID NO: 692993 - DNA, 796 bp, Homo sapiens
  misc_feature (3)..(3): n is a, c, g, or t
  misc_feature (194)..(194): n is a, c, g, or t
  misc_feature (200)..(200): n is a, c, g, or t
  misc_feature (207)..(207): n is a, c, g, or t
  misc_feature (211)..(211): n is a, c, g, or t
  misc_feature (213)..(213): n is a, c, g, or t
  misc_feature (226)..(227): n is a, c, g, or t
  misc_feature (234)..(234): n is a, c, g, or t
  misc_feature (244)..(245): n is a, c, g, or t
  misc_feature (249)..(249): n is a, c, g, or t
  misc_feature (270)..(270): n is a, c, g, or t
  misc_feature (276)..(276): n is a, c, g, or t
  misc_feature (279)..(279): n is a, c, g, or t
  misc_feature (311)..(311): n is a, c, g, or t
  misc_feature (464)..(464): n is a, c, g, or t
  misc_feature (466)..(466): n is a, c, g, or t
  misc_feature (638)..(638): n is a, c, g, or t
  misc_feature (643)..(643): n is a, c, g, or t
  misc_feature (646)..(647): n is a, c, g, or t
  misc_feature (653)..(653): n is a, c, g, or t
  misc_feature (655)..(655): n is a, c, g, or t
  misc_feature (660)..(660): n is a, c, g, or t
  misc_feature (666)..(666): n is a, c, g, or t
  misc_feature (670)..(670): n is a, c, g, or t
  misc_feature (731)..(731): n is a, c, g, or t
  misc_feature (733)..(733): n is a, c, g, or t
  misc_feature (788)..(788): n is a, c, g, or t
gcngtgctgggagaaccaatctttcctttttttttgtctgtttttatttttcctgggatgggttcatcaaagctaattgctatcaatcctagaaaccacctagggactcagacatctgcctacacactagtggcgtaaagggaaggacaggggtacaaactttcaaagtcacggtgtatttacattcccaaggngggggnggggggngggngnggggggcaactgnncagacgntagggggggnngggntgctaaggggtcctggggggngggggnggntggaagaggccggccagtgggcagtgggaggnggtgtgcccgccccgcagccaggtagtgacggaggccacttggatgttgtgtggtgggtaccgaagcagcgtgtgtatggggctcctgaaagccggccatggggtgggctgggcggcgggaagaggcggtgctgccagagtgcgatgctgggngnggggggactctgggctctccagatggcctcccctgcccccgcggccagtttgcccggctcccatcccggttggagcagagatggcaaagaaaagacagcagatggtggggacaccgagttctgttcccagtcccagccaggctggctggggagtggctgggggagggggaangagcnaannaaaaananaaganaaccancatntctgccccagtcagggagcaagaaagacagcatttcggagacctttcgggcaccctacttntntccccaaacacagctctctgccaaatgggctggcaaacagcaccaaaggccctgnatgtggga

SEQ ID NO: 692994 - DNA, 134 bp, Homo sapiens
gactgaggatccctatgatgatgggctttaagtagcatatagttgagtgagaggtagagtcccaagtataatagcggatgcctcagggctccatttaaaaacaaaacaaaaacaaaaccatttctccctcggca

SEQ ID NO: 692995 - DNA, 1169 bp, Homo sapiens
gacattagccccctaataaaattcattacccactcattcatcgaccatccccaccccatccaacatctccgacatgatgaaacttcggactcactccattggcgcctgactgatcctccaaatcaccacaggacatattcctagccatgcactactcaccagacgcctcaaccgcacttaatcatcaatcgacccacatcactcgagcacgtaaattatggctgaatcatccgctaccttcacgacacaagtggacgcctcaaatatactattatcatgcactcattccatacaacatcgggcgaggcactatactatacaggatcatgtatcatctaactcagaaacctgaaaacatcagagagcaataataccgtccatgcttgccaaccaatagaacaaacaagcacatatcactagagcatatgatccatcaccgatgaggacacaaaatatcatctcttgagaggggacaacaggaacttacaaaagctatacaaagtcccgaccaatcacccagtaaaatagaggaacagaacccaggtacccaagaacatctggagagaggacaaacatcaaaagagcaaaagacaccaacaccatacaaacgaaccgacataaaccctgaccaacaacacacgagagaccacaaccagtgagaaggaaaggaacacacaagaagaaaaaacccaaacatcacgcaagaacaaagacgaagacaaacagaggaacaaaaagaaaacccacaaatcagaaaagatgacagccacaagaaacgagaaaaaaaacacacaaaacacaacaagaaaaaaaagcgaaaggacaggagggagagaaccaagcggacgaaacgacaaggcagcgccagacagccgcgcgacacaggaagcaatcaggaagacaataacaacaacagaaaacaccagagggacggaaccagcaaaaagaaaaacaaagacgcgcgcacccacaaaaacaccgacaaacaggaaaaaacagaacacaacgaccacaggagaccgaaaaaacacaccagcggaggaaaggaaaaaacaacacgagaacggaaagacaaagagaaaagagcagaaagaagacagaaagaagcagaaaaaagacgccagagaggaaagcaacgagaaaagacgcaaaaaccaccagaccaaaga

SEQ ID NO: 692996 - DNA, 436 bp, Homo sapiens
agggtatggaattacctcctaatgctgttacttactattggacttttaaaatagacgggcaaaacaaagtgactgaaactaaagacccttctttccctaaaatagcgggtgagtacgtgagtcttacttctaaaaccgaaatgcctcctatccacgatttctacattcaggataaggatagaaccaccgattatttagaggaattcatcaacaaagacaaacttttgatggtgatttcctaccgtcttgaccgcgctaaccaagaggcgtttaaagctattaaacccgttaccgataaagcaatgaaaaacggctatacagtaataggtctcacttcacaaatggaaaaagcgccttatatcgtaaaaaaatacgaactcaacttcaacttctactacaacgatgccaccacgctgtcgacgcggccgcgaattta

SEQ ID NO: 692997 - DNA, 465 bp, Homo sapiens
tagcaggaggaaacacaattttttttctcttcctggtgtatagattacccaattaaatccagaaccattacattgtaaattatatccataggttttagtttctggttttacatttgagaccctgtcaaaaaaaaaaaaaaaaaaattccagggcggtagtgtaatggcttctcggtttggttccttgggtgggtttttgtggaccgggatttcttggcccaaccaaactcaccggacaggatatatcccagaaacagagatgatataatagctcaaattattacagtgtaaccaatataaaatcacagtgtttcggccctatataaaattaaggttaaaatctttctccaaaaggaggtcactctcgggatctcgcaaaataacattccgtggataaataatttctattttttcttccagagaaaaaagtgttataaggggggcttatcggggggatcctctaag

SEQ ID NO: 692998 - DNA, 336 bp, Homo sapiens
tttcacacgctaacctgaatatactagttcaggctatgatagcgcacaggtgtgaggttcagacaagcctcattattataccctcagctctgaaggaattaatgatagaacagctctataagtctgataagaaacatctacaacatattctctctgaagcctgctacctggtctttacctgtacgttatcttaacccagacatgcctaagtctttaggcagtaacttaactctttcaaccattgccaatcagaaaatctttgaatccacctataacttgggagcccctgttttcagatgtcccacctttctggaccaaaccaatgtacatcttcta

SEQ ID NO: 692999 - DNA, 583 bp, Homo sapiens
  misc_feature (369)..(369): n is a, c, g, or t
aacgatagtggcattctcaacatatcaaggaacacgatgcgaatcaagtatcgagtaacgcaagtagaccagcgatggctcagcaaatgtaaatagactcaatgatagaatatgactcgttgggccggtgcacctgccgtgccctcattgtcagagtaaactgagtatcgatgaatcggcatatttaagaccaagaagacacaatggctatgctatctcgctacatgagatgagatattgcaatgagatctaaacggctatatggtcttgtcaccgcaacagcagaagacgtggctgatggaggcttgatgctgattccaagtgaggcatatctagaggagctttcaactggcatgcattgtgatgatnttaagctggtggctgaatgaaaagtacagtacagctgctactatcctccggagagaagatgattctctcacgagaggcctcctgcattcgctgtgcaagagaattcaatggccccacttgcatgtctaattagcacgtaggcacgggaatgattcaccataacgtgtgtagcccataggcccatgccaatcattcctcgatatcatctatgcat

SEQ ID NO: 693000 - DNA, 781 bp, Homo sapiens
gtcgtggtggctgtggaacactgggccggaggaaggcaggcaagaggaagtgggcgggtgtgctggtccagacacctgtggctacaagccagaagagtacacagatggtgcaggagcaagatcttcatccgcttccccagagaccctgttggccacagaggatgccctggaggtccggcggtgagagccttggccacaaagatccaagctgccgtgggaggggctttcacgtgtgcaggcaagaaattcctctcgggtgaagagatcagccatctgctatctcggctggctgcataccgagtgcattctatcactgcgccgactgccccccgactgccccgtagaacgccttcttccatggtacctatgtgcggcagcctcgttttttgcataatagcctgaggccggcagctggtctcccgtgaatgtccgtgggacacctcgtggccccacgacttccccgagcctgccctgcgtgaggcctcagagcttctgcgggagttgtgcataaagaacatggtgtggaaatactgacggagtatcaggcctgagtggaagcatcagctggggcagtaaagcctgtgggaatagtagagatcttcgtgggcaagaaggataattagcctcagagtgtacccaggctcttcatcagccactcggcttggtacagatgagatcagccccgagtgctgcacggcttgggctctgagacccattcagtatgcggtgcctggttgtgacatacgaacgcaaggggtaaaaacctcggtcccgtgagctg

SEQ ID NO: 693001 - DNA, 236 bp, Homo sapiens
ctagataaaattgatgttgataacttgtgtgactcgttcctgtgcaaagcagaaagtgctagagtgcaacagcatgcattctctccaagtcacttccctgggtatttggggggccagtcaggctgtgatctcacctccaatagagaatcctcaattcttccagcccaagggaggtccagtcatgtagaaagagcaggagatatagtcatagctgattacttatttgtactccacat

SEQ ID NO: 693002 - DNA, 421 bp, Homo sapiens
  misc_feature (39)..(39): n is a, c, g, or t
caggtctggtaaaaaggaggttttaatcccttccctctnctcaagatggtgctgaggactgggaaaagcagtcagcctggagtgtgtatgatgctaacaccggaatggttcttgtgtttctctgcctagtggttgaactgcaattctaggtatgaaggagaaaggaacgagatacagcaccacagtcaggatgctgctgctttcttgtctctaaaggccatccctacatcttccaaagggaacaagttagcaggagaatttacttcggaggaaggttctaatgtcttgtttgttcatttccacatctgcatcattctgatttcaccttgggggaaaaaaagtagaattcaaagctgttcaaaaatcaaaatatcattttagtatgtgattaataaatttctgaaactgtatgagcaaaaaa

SEQ ID NO: 693003 - DNA, 131 bp, Homo sapiens
actcgtgccggtgcctctcccgttactcctctagtcctactacctcgcttttctgactgtgtccggtactcggactcctgcccgtctacggacgcgtacctcggggactcctctacgacgtcgaccctgca

SEQ ID NO: 693004 - DNA, 940 bp, Homo sapiens
ggacgaatagactctattatggccagtgcgtgttggcagacatcgacgaagacactaagtgacattgtcggacagtgacagcgtatgtctgaggatcgaggaacgttgtctgctgagcatgactgtcgtgcccacattctggatggaggcgagatgggctccattcaccaaggtaagactgcaatcatggaatggcgacgtgacgcgggaggagaccgaagtcccggaaagagctgatttgccgagctcattgccaatgttcaatacacagagagtaacgagggacgagacaacgcgtcaacgagagagatgccctcgagctcacggagaagctagaccaagactggaaagagattcagactctcctgtcccagcaatgaactcccaagtcagagaacagagacgaaaacggaaaaaccctagagcccgatgcatattgacatgatggttcgcgagcttggctttgaaatgaaggcgcagccctctaacaggatgacagacggacggcagaattgggcacaaggaaagagcagcgagcacctcaggaaagactgcagcgcctgcagaggacgtcacgcaacgaaatgccttgggacaagcgatgccggcatcgacacctgctatggcaaccgcccacaccatatgtacaagccacggcttgctcctacacagtcactgcgccctcccgtgaaatgaaactacaactaatcccacaaaaacatctcgaccctccccctacccacagcacactccaaacaggaactgcacaatggatcaaacagcgaacaaaaccagctaccaacgagagacacgacacgacaatgcacaaacgcgcaaacgcccccacctatacacacccgcgacagccatcccaacaccgcacgacaccagccagcagccttaacccagcccccctccatcctaccccccaaccggccac

SEQ ID NO: 693005 - DNA, 337 bp, Homo sapiens
aaaaaaaaaaaaaaaaaaaatgtggggggcgctggggcccgaaaaattttaaaacaattccggtgggggccgcggcgcccaaggataggggaaggtgagaacatgtggccaatacgtgggttcccaaaggagagaacccggcgcaaggagacatagtgtgcgggggttttcctcacacaatttaaaaagcccccgggggaggaacaccggaggcgtttcgtgagaacaaccctccagaagaggaggttccagggaggggacattacagggagcctactacacaccgaggcgatgccaagaggagagccgagaaaaaaaataaccccgcgccagaggt

SEQ ID NO: 693006 - DNA, 451 bp, Homo sapiens
gagcgatccccggctgtaaaccgtgatcatgtttcaaatgtacggatctatgccagttaacctcaagagccaaggcagcgggagacatggaagctgcatgataacgttgtttaagacaatgggtgatgggcagggcaccatactgggcaagttgttaggggccaaagcactaagtgccctacacattcatggtgtgtgaaatgaaaaaattaatgggaactcatatcaagttgtcccatcaatgctctaagaaggatgagtctcctccagcctaacagattgctcattctggtttacatggggttgaggatgtagaggcgtgctgtcctgcctagaactccagaatatcatgaactaattaaagaatcactggccgggcacagtggctcatgcctgatattcccagcactttgtgacgccaaggcgggtggatcacttgaagtcaggagtg

SEQ ID NO: 693007 - DNA, 275 bp, Homo sapiens
gtttgctttttttaaaattttttctcttttcccgtaaaaaacaactcctttgtaacccgattgggggaaaatgaatgtgggaaggggggtgtgtttttttgggggcccgggaaagggggggaattttttcaagtgaatttaaaagcttttgctttccccttgtttttttgaggaaaaaaaccctttttttttggaagtgttaacttagcttgaaggatttgtttttaaaaccttaaactttggccgggcccaataaaatcttgtccctttttgga

SEQ ID NO: 693008 - DNA, 309 bp, Homo sapiens
cgtcctagataaccgtataagccctcgaagaatctccctactccaagaaacttgtgtcacttttaaatttaatcattgaaaaaacgttcgtcaaataactgacaataacgattcttcttcattctttctttttcggacaaccgttagaaccaataaagaaattctaaagaccgtcacaccctacctacttacttcaccttacacttgaaacccgttcaatttaccctgtcggaaggtacaagtaaacagatggagaattgacttattttttcggatgtcaaaaatcttttttttttttttttttttttt

SEQ ID NO: 693009 - DNA, 490 bp, Homo sapiens
gatattaatgcttaataaaccattttatttactcaacaaatattcactgaggacttataatcaataataccaagccctattgaatacagtaatctaatatacacatagaattgaaaagacaaaatgaacaaaagaaacagacagtatatcatttctgtttcctccactgttttcattactaaagaaacaagctgcagtacacagccggctgagagctgcttccgggggagcaggagaagcagcactcatttcactgagacctgggtttgagttctctgtttttgaatgtgacctagagctcatcgcttaaatgcgactgataattcgtgcctggccaccctcatagcagcgctctgaaagaaacataaaggagtggatacacgtgtgagcaggagcctagacatgtgtcaggtacttacctaaacatggatgtttaggtcactgacatactgacaccatcaagctaattcttctctattggtctctatgt

SEQ ID NO: 693010 - DNA, 192 bp, Homo sapiens
gtgagccatcgcacgtgtgccgcttcttcgtcttagtcaatcctatgccagcgtcttcttcctccagtcccctcacctgatggtcccgacacttcatcatccaccacctcctggcagggggtaccctgaaggtgctccgctggggagctctgtctcttcctggggtctggcggttgatgagctcaccggcaa

SEQ ID NO: 693011 - DNA, 159 bp, Homo sapiens
  misc_feature (4)..(4): n is a, c, g, or t
  misc_feature (17)..(17): n is a, c, g, or t
  misc_feature (141)..(141): n is a, c, g, or t
cctngaagcgtcatggncaagggacctgcttctattagcccttctccatggccctgcatgcttctccaaaccactttttgcagctttctctagtgcctgaggagccgaagcagccccggccccgcccgccgcctgcccagnctgacaaagccgagagcc

SEQ ID NO: 693012 - DNA, 210 bp, Homo sapiens
tttcggattggtcaggcaccacgtgagtgctaccgcaggcttcggagtgtgcagtggttcacggatttaggtctgactagggcggacaaggcgctcctgggaagagtctgagcttgggcatacaatctttggcctctctctcaagaactaggttgtgttagaaagtgcaatttgatggctgtgggccggagtgtcagttggccatgcatc

SEQ ID NO: 693013 - DNA, 528 bp, Homo sapiens
  misc_feature (237)..(237): n is a, c, g, or t
gtatcaacgcagagtcgccattacggccgggtaggcaacatagcaagaccctgtctgtacacaaaatttaaaaattagttcatcggggtggcaccacatcagtagtcccagctactctgcaggctgaggggggaggatggctgggaacccaggaggtcgaggctgcagtgagctgtgatctcaccactgcattccagcctgggtgacagagttagattccaccctctcccaccccgngaaaaaaaaaaaaaaaaaaaaaaaaaatttgtggggccggctggcgccctgggaaaaagggtttttataacaccaaactcggttggggcgggccggggcggcccaggtatggggtaggggtgaccgcgggccataacagggctcccaaagggagaccccgggcgccaggcacatgcggcgcgggatctcttccacaaataaaaaacgcggcggggggaacaccggagcggttctgggacaaactccagagggggtccgggacggccaaggggccctatcaacgacgggagg

SEQ ID NO: 693014 - DNA, 341 bp, Homo sapiens
  misc_feature (116)..(116): n is a, c, g, or t
  misc_feature (122)..(122): n is a, c, g, or t
gctaaaacaagtagtcacccgcacctacagctccaggcaccgtctgcgctttcagttccacataaccaatacggcatgctctttcgctctcttcacaacaggtatatttattacancactanctatatccgggggcttactatttccggcaccccatcgcttagtccggggcccgcaagctatctgccccgcggtataacatcgtttcacgtggccgccctcctcctatcagtacccgtagtgcgcgcttttcgtatcgtttggcccatgcttcgtcccttatacatccctgcttgttaccgttcacatctatccctatcctcccttgggatcaggacaac

SEQ ID NO: 693015 - DNA, 227 bp, Homo sapiens
agcaaccagcacccgtggttcgccatgtagcaggactataccctcatggggacagaggggcattcctttaggtggccattccaacggtttcccagggccccagggaccatattactgtggtgcgcgagcagacagagcctatggcagggacatcgagaaggcctattaccgggcctgcttgtatgctgatgtcaagattgcggggactaatgccgaggtcatgccta

SEQ ID NO: 693016 - DNA, 239 bp, Homo sapiens
gctaccatcgtcttttacaataactataaaacttcaaaactcaagaaacttaatttagcaattggctgaaatttacatttatcattcatcccataaagcaaacatttcactcaagcaacatgaacggtgcaaattcacagagtatcacatttaaaccagcttcagcaaaattatttcaaaccatcaaaatttgcatatgctcaaaagtggtcaggcatgaagcattcgtggagggtacc

SEQ ID NO: 693017 - DNA, 459 bp, Homo sapiens
ctagggtcaccccaaacttcagaggcctgaaacggcaggagccactcgtggttctgcctcatggttctgagggttgacagggctcagcgtgggcagtcctcccctggggtctcctggcgtagctgtactcacatagtggtgtgcgctggtgacctgggggaggcgcccattcactatgtctgggagttggtgctggctgtggcttggggttgtgcccaagatgtgtgttgggctctacggggcagtgtcccctgagacgtgagagccacgcagaaactgagtgatgttttctcgtgcctcgcctcagaagtcacacggtgtctttactggtagggtctgtctgttagaagcatgtcaccaggccagactgtatacagcgtggagaggaatgagactcatctgcctgtgtgaggggggctcaggaactggcagactgattgaagcagagcttaacgtggg

SEQ ID NO: 693018 - DNA, 265 bp, Homo sapiens
ggtacagccagccagcagtgagaacccattctcttaagatagtgtcattcataaatttttgttcatgcaagtgaaactttaccattaaaacaagacacaaactttttgggctgggaatggtggctcaagcctgtaatcccagctctttgggaggatgaggcaggaggatcacttgagctctggaattcaagaccagcctggacaacatgatgaaactccatctctacaaaaaatacaaaaaattagccaggtacggtgtcgctat

SEQ ID NO: 693019 - DNA, 1075 bp, Homo sapiens
  misc_feature (1075)..(1075): n is a, c, g, or t
tgatccagattcctgaacctctattgatcagcccgtcgcggcttcgcaaccatctccgctaagtgcagcacgagttctaaaccagctaggcgcccagacctggctcagtgccatattgctgaatatatactgtggtttcaatccttgtatgcaaccgactatagcctcatgtagtgtttcgcctgggcacgttactgtcaacacagactccacgtatcgctgaaatgcaggctacatgtttccctgagcatcggcctgctgtctccggtggcagctatgaacgtatgtgcatgagccgcaattgcgcgaagatacaaccgaacgtgtatgtctttatatgtctagtgttcatctatcctccatctatctcgtccagtaatgccgtggtggatcttggtcaatcaataggtatttcttgttccactactccatgtggtgagcacgtgacttgtcgtgcctcgtcgcatatgtaggaatctcggtgttacctggtgattcccgtgttccattcgtgtcggttcgcagatctagtgggcgctatagatgacgcggatgtggctgggtgcctccctaggatccacacgtggcatcagggtccctgtgcatctttctgtacattggccgccaatgtcgttcagatagccacttccttcctcgttggcaagggtttcttagtagcttccccccattgcgctttgggaggggactgctttcgaacgtggtgttttgcatttctttcccttgctagcttctcgggtccgtgctagcagcggtggttgcggattgtatattctcggtacgatcctagtgacgggctgcttacgctgtttccagcgctcctgtgcaggcgcaggtccctggtggggccctccggcaggtagtaaagctcccttttgagtgtgtttcgcctttgttcacgtgggcgctttcgtgttccctggacgattggccgtgtcctttgtgttacacccctctcctgtgtgtcttccacgttgggccctgcgttttcccacggggctcgttgcccccttgggtgggcacatactcgggtgtttccgccacttcgtgccccttn

SEQ ID NO: 693020 - DNA, 123 bp, Homo sapiens
gaacaggttagcgagagttcaagaggctctagtgctcaaacacaaaggagtgaagttagcccagaaagctgacagcatgatgcggggaggctgagagtgcttggtgtttgacagatgagtgtt

SEQ ID NO: 693021 - DNA, 983 bp, Homo sapiens
tcccgacagctgtaaattggatatggcgacatgttgtccatgcttcgtgcaattcacccatgagtgtcactcaacatggaaatgttggaaaccacgatgcctttcatgggtgcgcagacatgggtcttcgtgcgacccattatcgatacgtgcccgaaatgaaaggttggttcccttcatgggcatggaccactctctgggtcgccctttggcatatctgctgtaatcacgggacaaggcttttgttattctggctcccgcatggctacaagtggaaagttcgatggacgcatcaaggtcttttcctgatcaccagctctggtcggcgaaacacctgttgaaggacatagcacactttactctgaagagtatgtatgccaggctcaggtctccagttgggcttagcacctctaggatgccactgtcacgctttgggacagtccgacagagcggattcgattcattgaggttcaggagttccagagccagccgggccaataatgatgtaatccccatcttctagctgataaataccacgaatataataaagaaagattggtccaggccttggtacgtgcacaccttgtaatcccatctattcgggaggactgagacaggagaatcacttgaacccaagaggtggaggttacaatgagccaagatcatgccactgcactccagcctaggcgagcaacggcaagagctcgcatgctcagaagaatgacgagagcagaggagactgtaactctagcactaagagacttcagcaccgtcttgaaagtgcacaatccatggtgttattaatcgtgttcacaaatagtgtgattatcaccacagactggttttagaacattttcatcaccctaagaagaaagcttttacccttcagtcaatcgctcatttctccccaacccccagccctggcaaacaccattctactttctgtctttatgataagtcgattctgacggttgatataagtg

SEQ ID NO: 693022 - DNA, 373 bp, Homo sapiens
aagcagaatggacatcatggaatttcatcaaatggagtcatcatcatatggaatcgagtggaagcattgaatgggctcaaaagaaatcatcggagaatggaattgaatggaaacatcaaagggactcgaatggaatcatcatcaaatggaatcaaatggaatcatcgaatggacacgaatcaaatcatcgttgaatggaatcgaatggaatcatcgaatggacttgaagggaatcattatcgaatggaattgaatgaaatcataatcgaatggattcgaatggaatcatcatcgaaaggagttgaatggaaacatcactgaatggaatcaaatgaaatcaccgaattgaatcagatggaacgatcatcaaagg

SEQ ID NO: 693023 - DNA, 175 bp, Homo sapiens
accccctcagcctcccaagtgctggggtcacaggcgtgagccactgtgcctggacttcattgctttagatacccaccaccaaattgcccttcagaagagatggtaacaatttgccttcttgccagaaagtgtctgtctgcagaacacttcactgggctgagcattttaattattt

SEQ ID NO: 693024 - DNA, 903 bp, Homo sapiens
  misc_feature (2)..(2): n is a, c, g, or t
  misc_feature (102)..(103): n is a, c, g, or t
  misc_feature (143)..(143): n is a, c, g, or t
  misc_feature (150)..(150): n is a, c, g, or t
  misc_feature (207)..(207): n is a, c, g, or t
  misc_feature (211)..(211): n is a, c, g, or t
  misc_feature (357)..(357): n is a, c, g, or t
  misc_feature (445)..(445): n is a, c, g, or t
  misc_feature (463)..(463): n is a, c, g, or t
  misc_feature (465)..(467): n is a, c, g, or t
  misc_feature (479)..(479): n is a, c, g, or t
  misc_feature (492)..(492): n is a, c, g, or t
  misc_feature (585)..(585): n is a, c, g, or t
  misc_feature (621)..(621): n is a, c, g, or t
  misc_feature (685)..(685): n is a, c, g, or t
  misc_feature (688)..(688): n is a, c, g, or t
  misc_feature (690)..(691): n is a, c, g, or t
  misc_feature (765)..(765): n is a, c, g, or t
  misc_feature (773)..(774): n is a, c, g, or t
  misc_feature (779)..(782): n is a, c, g, or t
  misc_feature (826)..(826): n is a, c, g, or t
  misc_feature (864)..(864): n is a, c, g, or t
ancacggcttcttgggggtagctacggctgggtgtgtagaacaggggccggggctggggctgggtcccctaatggaaacaccaaatgcaaaagacaaaaacnntacaacttcctgccttctgggtcaattccttattcaaatntgcagcnggctcccaaggagatctcggtggaacttcagaaaactgggcaatctgcctttcaacnatanacctgtccctgggagccgaaatgtgggggcctgaagcctggctgctgctgctgctactgctggcatcatttacaggccggtgccccgcgggtgagctggagacctcagacgtggtaactgtggtgctgggccaggacgcaaaactnccctgcttctaccgaggggactccggcgagcaagtggggcaagtggcatgggctcgggtggacgcgggcgaaggcgcccaggaactancgctactgcactccaaanannngcttcatgtgancccggcttacganggccgcgtggagcagccgccgcccccacgcaaccccctggacggctcagtgctcctgcgcaacgcatgcaaggcggatgagggcgagtacgantgccgggtcagcaccttccccgccggcagcttccangcgcggctgcggctccgagtgctggtgcctcccctgccctcactgaatcctggtccagcactanaananngccagggcctgaccctggcagcctcctgcacagctgagggcagcccagcccccagcgtgacctgggacacggangtcaaaannaaaannnncaaccgttccttcaagcactcccgctctgctgccgtcacctcanagttccacttggtgcctagccgcagcatgaatgggcanccactgacttgtgtggtgtccatcctggcctgctccaga

SEQ ID NO: 693025 - DNA, 265 bp, Homo sapiens
atgttgttggtcgtctctctcggtccccctctgatctgggtctgtactccttggcttccctgggttgcttggtctctccgatttgtgtgtccttttgccacactggacatatctgcgcggtccagtcttccggcgaggtccagtcttccggcgaggtccaatcttccggagaggtccaatcttccggagaggtccaatcttccggagaggtccaatcttccggagaggtccaatcttccggagagtccaatcttccgggccgtct

SEQ ID NO: 693026 - DNA, 263 bp, Homo sapiens
ggcaaaaccccatctctactaaaatacaaaaattagctgggcatgatggtgcactcctgtaatcccagctacttggtaggctgaagcatgagaattgcttaaacctgggaggcagaggttgcagtaagccaggatcatgccactgcactccagcctgggcaacagagtaggactctgtcttaataaatagataggagaataaaccggaactgcagtgctaacagtattttatacatatttaaatgttctgagtatgttttgac

SEQ ID NO: 693027 - DNA, 1210 bp, Homo sapiens
cacagtctttgcgggaaggccttccaaagggtgcccagtttagatgactacttccctgattccgagaaccctgaagtggtgggcctcatgtgctggtcctggctgtggttggaggcatcgatggtcgcaactgtgcctgtgcgtgcaagtatgtgcactgatgactttgtgagacgtcaccatgactcgcatcatccctgaagggcaagaatcaccagttgcatgttcatctgacatgcagtgacgtgtcgcgtttgcccgagtatgaagtcagcatgaaacgcagttagtctccctgccgttgtggctttacatagtgacagcaagccttgcccttacacagagtccccagtgctggtctcgtcatgtgtgctcagctatgggctgaatccgtcaggctggtaaggcataggttatgcaacaaagtccacaaaagtaacagaacatcggagcttaaacacggcgctgtgccaggaacagagtggagccgtggagcctgacatgcgagcgccaggcaaggtatgaacgctagtacagtccatgcaagaggcagcgacggagcgacgtgttcgtcgccgagccagggagtagatagctgaaggccaagatcactgatcgtcagggcaggctgttacgaggaagagctaggaaactggttcaaacgctaggagaccacagttggcattacgggaagggtgctaagcctggtagtatggtacgtagtaaggctgggtggcacaatcgatggacgagccacagtgaattgggacgcagggtgcgataatccacccatggaccatttcggggaacactgtcctccctgcacaggggcgcgtaaggcccccacacactagattccatcaatatgcgagacaaggcaggctaggggccctcgggagcacccacaagaccaggacgcccttgatgacatggcgcaacacttaggcatcaacaaacaaagcgacacgtctgaaacaacgttgggagtggcccctggggacagggtagggaaggggaaggatcagcagcaccaagcccactgttatacggaacgccgccccaagggaacgtcactggcagagagacgcaagggcaggcttccccagggtggagaggggccaacacaaacaggccacatacgcacgaacacaggttagcgcagcacacaatataccgggaacccattcgcgcagcaagcgtgcaaacgaag

SEQ ID NO: 693028 - DNA, 649 bp, Homo sapiens
caggcgtgccaactgccccgcccatggttggggcctcctggtgtctcatctgttcgggggagactgagataccttcatctgctgccctggttctggggctgtgccctgggccagatccagactggtgcccccttgcccgatcttgagccgcttggcccagtaccacccagctctctccagaattgaagaggaactgggccaacaaggcataaagtttccccggccaggaacttctcagaaaccccccttggcgccagtaaactgttgggccaaggccagccccttcaggtcaccctgttggctaccaccagaccccctccccctccgtgtctagctcaggcagcttcgaggcccccgaccacacacttgcacggggtcccctgctagttatgcgccccccccgccgtgggagttctgtacccggttcccttagaacttcttaccagaagctccagctccctggagcccctgttggccagctcctagctttgccagtctgtgtaattggccccaaatcattgtttttctcgcctcactttccccccagtgtttagagtcaagctgagcctcgtgtcatctccggggtggcccccggctagatccccggtggttttgtgctccaaattaaagcctccgtgacccctgagga

SEQ ID NO: 693029 - DNA, 760 bp, Homo sapiens
  misc_feature (344)..(344): n is a, c, g, or t
cgtgggtctcgggccgcattgtgtcgtgaagaagcgaggtaggggtatggagaagtggtgaatcccctgtttgagacgaggattaagagttatggcatggcgatctacggacatcctacggctcatcaatcgaagactcgtcgagcaacgcgcgtgtgggtcgagaaagtggccccggcatagtctcgaggttgcgacgcggcatgagaggcgcatcgcgtcgtagtaaggcgggttgaataggctcggctcgcttgcggatctatagcgatgtcaggccaggcgcgctggggactcgcactggacgcagtccttacatcagaggcgtgcctctaacgcttggnctcctcaccagagcttaccagcacctcaggaagaacgcccatgccagagagaagaaaaagcagagccagcaagtactttgctctgagtgcccttgggtgcgcacgagcgacagtcatcgggccgtggcggtagagccttcaatggggggtgcggacacgagcttcgcgccgtaaatggtgataaggtgaggaaaccccccaccaccaatgagggtcccacaatttttcctggaccaatagccccaatgtggccaagagttctataaggaacccaaaaacgccccagggcgttcaaaaagccccaaaaaccgctctgtttttgtgagggcttgtggcgtgtcccaatgtttaaaaaaacccaaaaaacgcgccaaaatatagggcccgttcccaaaagacacgttggggcccttggg

SEQ ID NO: 693030 - DNA, 839 bp, Homo sapiens
gctctggtgccgctggaagacggccagagatggttgagctcatgttcccgctgttgctcctccttctgcccttccttctgtatatggctgcgcccaaatcaggaaaatgctgtccagtggggtgtgtacatcaagtgttcagcttcctgggaaagtagttgtggtcacagagagctaatacaaggtatcgggaagggagacatgcaaagatgctgagtcagcagaggagcctcgagtatatttagcttgccgggatgtggaaaagggggaacttggtggccaaagagatccagaccaagaagggaaccaagcaggtgttggtgcggaaacgtggacctgtctgatactaatgtctatatcgagcttttgcataagggcttcttagctgagggaaaaaggcacctccacgttttgtgatcaacaattgcaggagtgatgatgttgtccgtacttcgaagacagcagatggtttgacgatgcacatagggagtaaacaattgggtcattacctcataaccatttggctgattagagaacattaaagggaatcaagcccgatcagggataggtaaattgtgtcttccctcgacaatactggaaggtcaagtccataacttgagggtgagatattttacaatgcatgggtgggcatagtgtaaagcaaggtaagaagatacttttaccaggagtggactgggcataaaaaggctgaggtaagcagtattctgaaacctggatagcaattgatggtggaccatttcagcaagggtgggggtgaccaagtaaaaaatatagggcgacagagagaagagtctcaaagaggaggagacagggaactg

SEQ ID NO: 693031 - DNA, 330 bp, Homo sapiens
aatggcttgatcatggctcactgtagctcgactcccagactcccatcccggctcccatccggcttctgaatagttgggcatacaggtgcatgcaccacgcctggtaatttttttaagtagagacagggtttcactgtgttgcccaggctggtctcaaactcctgagctcaggcagtccacccgtctcggtctcccaaagtgctaggattacaggcatgagccaccacacccggccacctggctacttttttaaattttttgaacagatggggtcttgctgtgttgctcaggctggtctaactcctgagctcaagtaattctcttgcctca

SEQ ID NO: 693032 - DNA, 299 bp, Homo sapiens
cctgagaccctttaaaataccaggatgtttccccttaagggggcccgggccctgaccttaaagcctcaatttttccctaaaggcccgtggccccaaaatgaagagaaaattttttccccttgccccgtttttgaaaggggtttttcgggaaaaaaaaaaaaaaaaagaagggccaaaaaagttatcatgtagttgaagtctgtggagccccctgttatgaaaagggttaaccttgaaccccccaattttaaaaattatttggtttgaaaaggttttcctttaaataaatgttttttgta

SEQ ID NO: 693033 - DNA, 1001 bp, Homo sapiens
  misc_feature (998)..(998): n is a, c, g, or t
ggtctgtccgtgttgttggaaagacaggggtgatcatagatgaggtgagtaaagaaactggacatgaatctgaatgaggacatcagtaccctgtccactgaagagcttcgtcagcgtgtccatgcagcagtggctcagatcgtcaacccaggccgagtcaaagaacagttggtaagagcaactgaacactcagatccgagatcttgagatgtttatcaccttcatcccagagatgaagtgggaagccccttgcagacaggtggtggagcgagcggtgagctgcaaggcggtgggaagacaggaaatggctgcctaagcagaacaggcagaggacagaacgcctccaggaaacagcaaaacaacaaggcagaggatgtgaagaaagtccgggagacgtgtggctgcacctgatgcggcgagcgctggcgtgctccagatctatgcgtgtagccagtgttggtggtgccacagggacagatcccctccaaccctgtggcatgagggtccaggcttgacagagactactctcccttgctgaagaggctggaggtgtcagtggacagagtgaagcgagctaagccttgagggagcaggcacatgaccatgtcatcagctctgggcaacctccaggactctctctgggacggcagatgagctgactatgggtgtgcggaaggagctaacggtggttgtgagggactggtggcccatggagtgtatgctcctcccaggggataagctggtatggcccgtatgtgtctgtgcaggctttcagtgggccagatgcatgcgccgtggagccttgaaagtcaacagcagacggggccacgtggatcccaccggagctcaggctcctcggaggagacggggaccacactggtgcacccgtgtggaaaccttagggagccaaagctgggtaaacagggtggaacacaggcatacaacgaaaaggagacatcgctacttggcttctcttttggtgtgtgtgttgtgtgtgnagc

SEQ ID NO: 693034 - DNA, 106 bp, Homo sapiens
ctcgctgtcgctgggtcacactatatggactcgggggacacaaagatgcctgtgacactttggtgtagccgagttagtcaacaattattctgggaaaaagcagaat

SEQ ID NO: 693035 - DNA, 419 bp, Homo sapiens
ttcccagatatcactctagtttttacaatctttgtttatgacaattagggctgtaacattggctgtagacatttgttgcatcaaggaactcagcttccactgaagttctgaagttaatcagtttctgatcttgttctgcaactctctgcaagaagaaaaatcaccaggaaatagtgcatcctgaaaggagtcaaagtttccttatccagctggagcagtgtgatctcggaccagagtcaattccttgcccaacagacttcacattgagccatgagaagcagcctacttacccttacctggacacttctccaaaacctgtgaaatggcctctgtcactgcctcaaagcctcatccttggtgggcaactcacctggatcctgagaccaaaatatagagcttaatgaactgctaaaaaaaaa

SEQ ID NO: 693036 - DNA, 121 bp, Homo sapiens
cattgaaacattatggactcaggtacttggaactgtcatttgccagtgccgaagaaagataagccgtagcacctagggcagtatctggcccgataacggctccatcaataggaaacggaat

SEQ ID NO: 693037 - DNA, 775 bp, Homo sapiens
cgtaaacatcgatgttgaagtaggccacctgggtgtgcacgtagtcattctgcttcacttgcaggcagaacggggaggtgaaggtcaggtcttccaccttgacggtgtagatgtctacctcctttatgaggcaggcgttggtaaccagctgtttgaggtccaccacatccactagggtttccttgatggccacatctttgatgcaagatatatcgaagccataaacgttctcccaccagtggatcttgtagtctttgtactgccggtcctcggtggccgtcacatacagtgtggcccgttctgggaagatgaggctattgggcgccagccacttgtccgggcatagagcacagtgttgagcatggactcgtagaagaggcagttagcccatccacttgctgatgatgatgttcaccttttccaccgggagctctatctcctccaccttccccttggtgatggtcaccaagtggtctaacttgttggctttgacaatcttcaccgcataatcagagctactggaacactcgatgccgatgaccttgcgggcccggccttggcggcgaacatgcagaggatgcttgtgtccgagcccacatccagcaccaccttgtctttaaagaggtggcggttgtgaaacatggagttgccgaagtgggcgtaggagtcaaagtagtaatctttggacgtcatgccctcgacgttcggcttctcgctgctttccgcctggccacaggacacctccatgatgcagttcacgacctcggcggccgca

SEQ ID NO: 693038 - DNA, 760 bp, Homo sapiens
cgggttctcctgggatctgtggtctctgggactgtggttgctctgtggatattgaggaaaaggagctcaggtgggaaaaggagggaactactctaaagctgagtggagcgaccagtgcccaggggtttgagtctcaacagcttgtaaagcctgagaccagctgccttgtgtgcgactgagatgcaccgctgccttgtgtgcgactgagatgccaggatttcctcacgcctcccctatagtggtcttaggggactctggcttctctttttgcaagggcctctgaatctgtctgtgtccccgttagcaccatagtgaggaggtagagaaaccagtccacctctgtgtgtacccatagaccccccttctctcacacatgacaccgtgtgtccctccccggtgttttttttttatttaaaaaataggaaaccctgggcagagtctggcagctcatgcctgtaatccccgcacttagggaggccgaggagggcagatcacgaggtcaggagatcgaaaccatcctggctaaacaccggtgaaaccccgtctcttactaaaaaataccaaaaattagctgggcgcagaggcacgggcctgtagtcccagctactcaggaggcggaggcaggagaatggcgtcaacccgggaggcggaggttgcagtgagcccggattgtgcgactgcactccagcctgggtgacagggtgaaacgccatttccaaaaaattaaaatttaaaaattaaaaaagaacctggatttcca

SEQ ID NO: 693039 - DNA, 460 bp, Homo sapiens
tatttaaccttaagagactaccagtccattacacaattgacctagtctattcccctgaaacctaaaagatccccggtgatttggtaataaaataacatatttaaggtattttaatatacttaattgtgtacaaaatgtcccctggccatagtagcgtattttggtgattccatgattgtttcctagattggttaccttccaagatattcaaggcacgagggctctggatggcgtgataaattattcttttctcaaaccgggaggatgagaccggctttccgagtggtatcactgggtacgcaatattggcaatcggtgtgcggtaatcccggggtttctccactctaggtgcttctgatggatactagcataccaaaggaggtgatggcggtagtgttttcctttacctccatttgttaaccggggcagaattccaaatacttaatggtgctaacctaat

SEQ ID NO: 693040 - DNA, 1511 bp, Homo sapiens
  misc_feature (227)..(227): n is a, c, g, or t
cgcattgactcgcgagattgacctactgccgcgatacgagacgtgtccctatatgacaccgtcatagtcatgattctattgatgtcacgtactacacgggagagttagctcagtcaatgccctagtcgacagaggaggaaagaatcgtggctcgatgagaccctcggcctcgtggtaccagaggcgacttgtcggcgcgcatccgaacgagcgcccatgaatgcgtngactcggatcggtacattcctacgacatcgactctgtctccgagtgccttggacacaggcgatgtaccgatacggggtgcctcggcacagaagcatctggcactagcatatgaccgtcgcaacgtacgatgtgttgtctcacgcttgcgcgtgcaaagttcccgcgcataagacaccgtggatatcgaagtttgacatcgatagggtccaggaaagtatctacaatcgtttagtacccattcacttgcaaggccaattgtgcttgggcacgagacccgttcgtgtggtagattggagagagacacccgagatgatctgccgccgcgtttgagcattgaacgaacatggaaagcgctaggtccactttggccccgggtgcttagggaactccctgatagggagcccctttattagacgacgcgcctattccagtttgtggacatcctcccttagcatccctaactagtcccgaggcctatgccctcgcgaagttggggcttaaaacgtaagacgtgcgacgtgctactgcagtgtcaaaagtgggaagcaccacgtgcgttggcgcccgcaactcgatacaatgggtgacgggggaggctttggggtttgagcgttcccaccataccttacgggtggaaacccgcgaaagaatagaaggttcactgttgattcgatcgcctaggttgggtgggtaataagcgcaagttcaatgccgcaaagacttcgcagatttgcccttcgcaatattcgccattggtcaagggaccccgggggcggacttgttccatctggctggtgcacccgcaggcagatcggtgccaaacggtcccacttctggttcctcacctaatttgaccttcagcatacgtacatctgtgacgaagaacaattctagcgccacacacacacggtgagcaaacttatgataggagggccccgaaaagttagggggccttaaaaagcgcgcgtgggcttttccccccaaagaacgtggccgctgaacactctatatcttattcgagaccatcaaacgtttgctgggaccccgtgaaggaaggtaaagggccgatagtctcctatctgccccagtgatataaaaacacacccagagacaacattatggggcgaacggccaccacaagtcacagaggaaacggaacactagactgtagagaagacacacaaaactaagagaattcacagcaaccacaggaccagagagcaccacaagctgtagaacggaggcggcacccacgtagtactattcgaacacacacaacacac

SEQ ID NO: 693041 - DNA, 180 bp, Homo sapiens
ggttacgccactgctgcagtgttacgcggcaggatgaggtgctgcatgcactgggcccagtgagctgcagaaatgtgcagtcagctacagcagcgagagctgcccgcgtaagttggggagctccagggccgtagtggcacagactgtgaagtcggagctgcgcccagcctggaaagagca

SEQ ID NO: 693042 - DNA, 695 bp, Homo sapiens
  misc_feature (4)..(4): n is a, c, g, or t
  misc_feature (89)..(89): n is a, c, g, or t
  misc_feature (108)..(108): n is a, c, g, or t
  misc_feature (111)..(111): n is a, c, g, or t
  misc_feature (114)..(114): n is a, c, g, or t
  misc_feature (116)..(117): n is a, c, g, or t
  misc_feature (119)..(119): n is a, c, g, or t
  misc_feature (126)..(126): n is a, c, g, or t
  misc_feature (164)..(164): n is a, c, g, or t
  misc_feature (179)..(179): n is a, c, g, or t
  misc_feature (281)..(281): n is a, c, g, or t
  misc_feature (318)..(318): n is a, c, g, or t
  misc_feature (331)..(331): n is a, c, g, or t
  misc_feature (336)..(336): n is a, c, g, or t
  misc_feature (338)..(338): n is a, c, g, or t
  misc_feature (342)..(343): n is a, c, g, or t
  misc_feature (390)..(390): n is a, c, g, or t
  misc_feature (447)..(447): n is a, c, g, or t
  misc_feature (451)..(451): n is a, c, g, or t
  misc_feature (533)..(533): n is a, c, g, or t
  misc_feature (579)..(579): n is a, c, g, or t
  misc_feature (606)..(606): n is a, c, g, or t
  misc_feature (611)..(611): n is a, c, g, or t
  misc_feature (620)..(620): n is a, c, g, or t
  misc_feature (622)..(622): n is a, c, g, or t
  misc_feature (683)..(683): n is a, c, g, or t
agcnctgtgtggtttttacaaagcgaggtggtgttttctacccacagttgaggggtccagggtagacagcaaacacaaaacttgtttcntttttgaaacaaaacagtnttngtngnngngaaacanacaaccacaatctaaacgagcggggggggaccctttcntaggtgggaaggggngtgtgtggggaggggttgggggtgaaaagggtgggggggtgggtgtgggagacccttgaatgtggtggacagattgaccaggtcgaagggggggtgtgtttncaaaggacctggggggggggggtgtgtgggggaaganagtgactggtggnagagngnatgnnccgcgggggggggggatcgaaatgggtccatggacagctggggcctngcgcttctgaactgtggctgatgtggctttgttagagtgttgggggtgaaaggtgtnaganacaggagggagcgtggctcaagtggggccattcagtcgggcggccgggtgtcgggggccttctcctggacttcatcatactncggtggaggagtcaaaggctctatcgagggaggagggacgtttttntctgggaggttgatcctaaagtctttnaggtnttttttttnanatttaatccttcgaactttcagtggtttcagtcgtttggccaacttagagttctgcctgtnaggggggttccc

SEQ ID NO: 693043 - DNA, 166 bp, Homo sapiens
cgtcggagccttcacctctcactcgcatgctgctgtgcccatgctctggggctgtcgggtgctgtacacagcagtgctcatggtctcaacacacactgcgcatggcattctgcactaaacaagcctctgtgaacggcaccgtggagactatggcagcatgagccac

SEQ ID NO: 693044 - DNA, 191 bp, Homo sapiens
  misc_feature (111)..(111): n is a, c, g, or t
gaggggcaggccaccatgtcaccggtcagtgcctttgggaactgtccttccctcaaagaggcttagagcgagcagagcagtctgttatgagtgtgtgtgtgtgtgtgtgtngttttttttttttttttttttttttttttttttttttttttttttttttttttttttttttttttttttttttttttttt

SEQ ID NO: 693045 - DNA, 467 bp, Homo sapiens
gaggatccccggcctgcatgcaccagggtcatgatgtgaacgtgttcctgagggtttcctgagctgcgctttgcctccgaggcgtccggcagcgtatgccagaactgcagctgcagggttcaggctgtccagatcgtgggggatctgtgaagactaaggagggatctaccagtgagtccacagagctttgaaagtgatgttaggaaattctgaatcaggccgggcgcggtggctcacacctagaatcccaacactttgggaggccgaggcgagtggatttcctaaggtcaggagtttgagaccagcctgagcaatgtggtgaaaccccatctctactaaaaatacaaaaattatctgggcttggtggcgggcacctgtaatcccagccacttgggaggctgaggcaggagaatttgcttgaacccggagggtgaggctgcggtgagccaagatcatgccattgcact

SEQ ID NO: 693046 - DNA, 270 bp, Homo sapiens
  misc_feature (75)..(75): n is a, c, g, or t
gccctgtgtagttggagcaggaatcaattctcaacacaaagtggctgccaaccatccacccccggggcgagggtncagattttttcccaaaaaaaaattaagaaggttctcgcagaaaacaccacaaaaaacgtgtacacccaacaatcttgatttttgctgtttttttgcttaaaacgttaacttgatgcatcattggaaaggtgtttctctcatctctgtcctaaggcttgataaagtcattaaaattgtgttcttaagactaaaaaa

SEQ ID NO: 693047 - DNA, 445 bp, Homo sapiens
ccggttccttcctggaggcctcctgtcctcggggacccagcacctcattcatcagcattgctggagccaagggcctctgagcccaagctaagccatcatgtcctctgtaacctgcacgtacacatccagatggccggttcctgccttaactgatgacattccaccacaaaagaagtgaaaatggcctgttcctgccttaactgatgacactatcttgtgaaattccttctcctggctcatcctggctcaaaagctcccctactgagcaccttgtgacctccactcctgtctgccagagaacaacccccctttgactgtaattttcctttacctacccaaatcttataaaacggccccacccctatctcctttcgctgactcttttcagactcagcccgcctgcacccaggtgaaataaacagccttgttgctcaaaaaaaaaaaa

SEQ ID NO: 693048 - DNA, 841 bp, Homo sapiens
gggtacctgcgtgcttaggatttttgtcttagtgattaactgactttttaacattatgaaatgtccttctttgatgtttatagtattctttgttttgggaaattaatactttgatattatatgtaaacattctgcttttttatgattagtgtctgtgtggtgtatcttactatattcttttacttttaatatgcctgtgtctttatatttaaaagtgaatttctcatattcagcatatagttgggccatgttattttttggtgttatattttttcttaatccagccttgaccatctctgccttggtcatgttatagaccatttagtgtaattatggtatgttgggatttaaagtctatcagtggatggcataattaacttttcgcatattttgggcttagaggtcggattaccatccgtggtttacagtgccctctttctaagcttaccatctatgaatctcacaggtttagactccatattaagggggtacatacagaaataatccacactaaactcggggcagaagcgcagggaaccttagggggttccacacaacacagtccacactcctacattaaataggcagctccacttatccgcatcgcacatgggcaccaatcacggggtcataaacgtcaggcaacacttacaacagcacccaattgtggtacagtgtgacaaagcccctgacgcgagacagaggcccaacaggaaggccaacagagcaaagcaccccacaaaactggctaaacacgcccaccagagcacaggggaacaaccgagagtaaccaagaatacaacaactagagcgcgacatcacgggccggaccacaggaaac

SEQ ID NO: 693049 - DNA, 352 bp, Homo sapiens
  misc_feature (68)..(68): n is a, c, g, or t
  misc_feature (105)..(106): n is a, c, g, or t
cccccacagttaaggctggacagtgtgggatggtgttgcaatctctcctgcagagctgtcagtcgccngtggctcgggtgcgtgactcaggctcccggtcctggnntctgcgctccgccggcgtactcctccacctgtctgcagcagggccgaccgctccagttctaaggtaagcatggcctgcttcagtttgctctcactgctcaggagcttctcaatggtggcctcaaggctttggatcctaccattttgccacctgcaactgttcaagggaggtcaaggttctgtttgcgcgtaaagggctgctgttgggtttctctaatttatccattcttgggttgtacactgaaag

SEQ ID NO: 693050 - DNA, 106 bp, Homo sapiens
taccgattctcgagtgaatcatgacgtgtcttgacgttcgcaatgtgcagtgccggatcggtgatcgcgtcatcgtcgacgacgtgagcttcacggcgggagcggg

SEQ ID NO: 693051 - DNA, 677 bp, Homo sapiens
  misc_feature (61)..(61): n is a, c, g, or t
  misc_feature (98)..(98): n is a, c, g, or t
  misc_feature (108)..(108): n is a, c, g, or t
  misc_feature (132)..(133): n is a, c, g, or t
  misc_feature (141)..(141): n is a, c, g, or t
  misc_feature (159)..(159): n is a, c, g, or t
  misc_feature (166)..(166): n is a, c, g, or t
  misc_feature (170)..(170): n is a, c, g, or t
  misc_feature (263)..(263): n is a, c, g, or t
  misc_feature (266)..(266): n is a, c, g, or t
gctcctgttcgacagtcagccgcatcttcttttgcgtcgccagccgagccacatcgctcangacaccatggggacaggtgacaggttcggagtcaacnggatttggtncgtattttgggcggccttggttcnnaccagggncttggcagttttaactanctgggtnaaanaggttggggaactttaactttttgggtttttggcccccaatttcccaaatttggatcccacccctttacgaattttgggaccccctcaacttnacnagtttggttttaaccaatttggtttccccaaagttattgaaatttcccaacaccccattggtggccaaaaaaaatttttccccccaaaaatttgtgggggggcggcgcccaaaaataccccacgcggggggtttttcccaaaaaaaggcgggggcctctttggggaacggggaaaaaacccgggggggggaacaaaagggccattatttggggttccaattttcccaagaacgctgggcgggaacaagagattccctccaatgtttcgaaccccaattttccttttcccccaaagggggaccggcccggaaccggaatttcccccccgtttccccaaataaaaaaaagtttcccaaaaagggtctttggggggggcggcccgggaaatggcttggggcagcctgaagttac

SEQ ID NO: 693052 - DNA, 187 bp, Homo sapiens
ctagaggagcctcccaagatccaggaaacctcatttgtttgtccagcctgggtaacaagagcaaaactccatctcacaaaaaaaaagaaaattaaaaattaagtggtttttcggggggtgtaccattttgatgcccttcttcttcccttctcaatatgtgaaggttttttccttagtggatatttcc

SEQ ID NO: 693053 - DNA, 104 bp, Homo sapiens
tgttccgaccagtcctcctgcctaagtctcctccctgaccagtcctcctgccctaactcctcgcgaacgtgttatccccccactgtcgggctagtcgggggggt

SEQ ID NO: 693054 - DNA, 101 bp, Homo sapiens
atgattatagtctcctgactttcaatgaggcttccataggacaagattgattcaatgttgtcccagacaattgcaccttgctatcgattatgtcttagcag

SEQ ID NO: 693055 - DNA, 465 bp, Homo sapiens
  misc_feature (14)..(14): n is a, c, g, or t
  misc_feature (164)..(164): n is a, c, g, or t
atctagaggatccntttgcggtgcctttcccattccccctaaaaagagaatctcttagggaaaaaaaaaaatccaagattggaatgaacaaaagactccaatatcgctctctacggctggggttcccttttctccaactggatgctggggggatgccgctgggngctgcagtcactgtgaggcaagatggagaaattcacgggttggatgggtgaggctggtagagccactgggagaatgtggggcagtgaggggagggacatcttcctagcatcaccagcatcctgagcttggtctggtgtggggagtcccacaagggtgggggcaagggtaagcagctggtactggaaccctaaatcccggggtgggatgtggtctctggtaccttaagagcaaatggtcggggatgccatgcacgggtggccagaggttgaaaggaacaggggtctacggaggcgccaggcc

SEQ ID NO: 693056 - DNA, 423 bp, Homo sapiens
  misc_feature (342)..(342): n is a, c, g, or t
atttatcagctagtaccccgctggcgatcacatggtcgtgcggcggaggaagtccctgtgtgggaaggtgctcacacagctgcacatcaacctcagtggacagaaagacagtggcatcagtctggagaatggagtgtatgctgccgctgtgctgcctggaagccctgccgctaaagaagggtcccttgctgtgggagacaggatcgttgcgatcaatggcattgcactggacaacaagtctctgaatgaatgtgaatctctgctgcggagctgccaggactccctgaccctgtccctcctgaaggtatccctcagagctcctcgtggagtggccagaacatntttgaaaatatcaaagactctgataagatgctgagttttcgagcccatggcccggaggtccaggctcataacaaacggaac

SEQ ID NO: 693057 - DNA, 222 bp, Homo sapiens
  misc_feature (218)..(218): n is a, c, g, or t
gctttttccttttttccccccccatttccccaaaattgcccattattaattaacctctttttttggttggaaccctggcagttttgctcccttcctaggatttgcccctgcattgtagcttgcttaacggagcacttttcctttttccaaaggtttacattttagggggtgggctgagtttttttgtaaaaaaatgaacgcaatgccaataaaattgnccca

SEQ ID NO: 693058 - DNA, 1601 bp, Homo sapiens
gacccgacgcgtccgctgcacgcagtggcgcataaatattatactagcatcgacgcagtgctcgacttgctagtgaatactagatatagtcagcatcacgcgcatcagtatccatcccttgactagtgccgtagaaagtgaaagtaattgactagtcgtcgtgatctgcatgtattaggcgtagcatcgtgcaataagcacccatcaaagtaacgcacatcctctcatgaggccaatttgattggtggcctatgggtccggtactaggtccttatgggcggcctggcgaacggcgagacggatggggaccttagctccatatgtgagatctcagagtactcacaagaggactagtaatgggacctacgaggtacggtaccaataaatgctgtagaaccttgagtccaagtgcttaatggagctaaattcgttccgcggagcaagtataatagtttgacataaacccaacgtgggacgagtggaagcttttccccgagataaaaccaacagttagaatcttgggaataccgaagattcaaacaccagtcccacgaggcgcgtagaaattcacttgaaggcaatcgaatccgccccgtaacgttactcctcggagaaaaccgatacaatcaagcacacaaagcggtaaattttggaaagcctgttccgccccaagagggcttgtgcccctccggagaccgcgctagaacacaacgcgcagcctcgcttaggtagcaataagcttgaggccttgagcttccctacccccgtcccccggaaccctgggccggaagcccggggaggcagcgataataccggggtgaaaagcagttggtaagcggcagcagaaaccccggaaaacccccagggatgaacaaggaacccgccgcggaacacggggccgcgccaaagtgacacattcccacgcgccccaggccaactcccgcattcccgcgggccgtctgccccaaccccccaggtcaccaccccgggggggacaacacacccgagggacaccaggcagacccacgccaaacaagcggggccaccccccgcgcaccacaagagggcgcacccccgcaggaaacaaccccgaggggagcccacgcaatagcaaaaagagcggggcgaaacgggcggcccggcaggtaccataagcacgagtgacagacaggcaagagactggacctagcgcacggaacagcggaccgcggggaaccaagaaacagtccagaggtaatgaggtataatttgcgctctattacttcttgtgcacttctggatcgagacacgaccaagaccacgaccccaccacaccaccccaagcaacaaccaccagcgcaccacacacaaccgaccgcccgacacacacccccgcacccacacacgcgacacgccgaacaccggaggagcaggccgccggaacggagcgcacgggagaacggaggcaacgcggcgagagccgaaccagcaggagggaacgacagaacacgcggggagaactacgacagggaagaggaaaagacacggagaaaagcagggacgagacgcaggagacggccccacgacagaggacggggacgagaagacaggggacgaggcgc

SEQ ID NO: 693059 - DNA, 311 bp, Homo sapiens
caacttctacatgtcatcctgtacctcatggtgatgattggaatgttctctttcatcatcttaggcttggagggcctctcgctcagctgtcgtgttctcggcgcccgattgtccatatgagtgataaaaatccttcggaagacgtcttccagcgtctgtgtgaaattggataaagtagacatgcttccctcctgctatgcagtgtgtgggcaggatgaaattcctttccaaagccaggctgttctgaaccttcttgctggctgttagcgagctctcttctgggttgcacaccagcctcagcctgctgggca

SEQ ID NO: 693060 - DNA, 220 bp, Homo sapiens
agacggcgaggacccggaaacggcttagcagtaggaggactaggctcattataagagttcttacagcaagaaagacggttaaaaaaaataaaaagactcatggtacctgtgagaagaattctgggatgcccaggctgggtgaagaaggggatggacaatgggaccagtcttcctaaggaactcccaaagtaaacatatttcacggacatggtatctggct

SEQ ID NO: 693061 - DNA, 128 bp, Homo sapiens
ctgtgaagcatctcattagaacacatgagcgagtattggcccttcctgagacattacgccatctatctaatctcgttcatccgaatgtcttaagaagcagagaacatcatttatcattctagtatcat

SEQ ID NO: 693062 - DNA, 475 bp, Homo sapiens
agcggtcgcttatttggcctggatggttcaggataatcaccgtgagcagtgaagccagctgctccattggtgggtcattagctgtcaccagaaggttgcacgacgaacatccttgacagacacattcttgacattgaagcccacattgtccccaggaagagcttcactcaaagcttcatggtgcatttcgacagattttacttccgttgtaacgttgactggagcaaaggtaaccaccataccgggtctgagaacaccagtctccactcggccaacaggaacagtaccaataccaccaattttgtagacatcctggagaggcaggcgcaagggcttgtcagttggacgagttggtggtaggatgcagtccagagcctcaagcagcgtggttccactggcattgccatccttacgggtgactttccatcccttgaaccaaggcatgttagcacttggatccagcatgttgtcacca

SEQ ID NO: 693063 - DNA, 222 bp, Homo sapiens
gggaggaatttcacctcaggtggcggcagatgtgtcctggtcggtggcatctctgctgcacttgagaagggttgttagtgcgggtggtttagagctggtgggcaatgtaggactacctaacctagtaggtgttctgtgggctgggtgagggcgcagttgtcggccacctgatgtgtatactacttggccacctgaggtgtatactacttggggatccgtgcg

SEQ ID NO: 693064 - DNA, 462 bp, Homo sapiens
  misc_feature (17)..(17): n is a, c, g, or t
  misc_feature (27)..(27): n is a, c, g, or t
  misc_feature (34)..(34): n is a, c, g, or t
  misc_feature (56)..(56): n is a, c, g, or t
  misc_feature (65)..(65): n is a, c, g, or t
  misc_feature (76)..(76): n is a, c, g, or t
  misc_feature (78)..(78): n is a, c, g, or t
  misc_feature (103)..(103): n is a, c, g, or t
  misc_feature (107)..(107): n is a, c, g, or t
  misc_feature (139)..(139): n is a, c, g, or t
  misc_feature (142)..(142): n is a, c, g, or t
  misc_feature (154)..(154): n is a, c, g, or t
  misc_feature (165)..(165): n is a, c, g, or t
  misc_feature (183)..(184): n is a, c, g, or t
  misc_feature (189)..(190): n is a, c, g, or t
  misc_feature (200)..(200): n is a, c, g, or t
  misc_feature (220)..(220): n is a, c, g, or t
  misc_feature (253)..(253): n is a, c, g, or t
  misc_feature (257)..(257): n is a, c, g, or t
  misc_feature (260)..(260): n is a, c, g, or t
  misc_feature (270)..(270): n is a, c, g, or t
  misc_feature (272)..(272): n is a, c, g, or t
  misc_feature (292)..(292): n is a, c, g, or t
  misc_feature (294)..(294): n is a, c, g, or t
  misc_feature (297)..(297): n is a, c, g, or t
  misc_feature (307)..(307): n is a, c, g, or t
  misc_feature (315)..(315): n is a, c, g, or t
  misc_feature (318)..(318): n is a, c, g, or t
  misc_feature (337)..(337): n is a, c, g, or t
  misc_feature (339)..(339): n is a, c, g, or t
  misc_feature (341)..(341): n is a, c, g, or t
  misc_feature (349)..(349): n is a, c, g, or t
  misc_feature (369)..(369): n is a, c, g, or t
  misc_feature (379)..(379): n is a, c, g, or t
  misc_feature (394)..(394): n is a, c, g, or t
  misc_feature (401)..(401): n is a, c, g, or t
  misc_feature (457)..(457): n is a, c, g, or t
tcagggggaaaaaaatntttatttttnattaatnttttgaaaaaaaaaaaaaaaantttaaaggnttagtttagtngngaacttcaaaaaaaaaatttccaanagtncaaaatttcaagggtaagcttctgattaaagnatnagggttaaaaangtaaaaaaaanggggtttttaaaaaaggnnaaaannactttagccnctaaaaaaaaaaaaaaaaanggaaaagggccagggattaaacttagtaaaaanaagnacnctttagtacnanagcgggaaaagagatccccncnagngaacagaaanaagccccnctnttttcttctatgaggggtntntntggggcangggcctgccagtttgaatangggaatgggngaagcccgggcaaanaaatgcngccaaaggggcgggggggggggggggggggggggcggggccccagcggggggcccnccccc

SEQ ID NO: 693065 - DNA, 572 bp, Homo sapiens
gtcccaccatttatgcaggtttgatgtgtatactatttatataaaactaataaaaatcaagataatgatcatgtgtcacccctgtaaagtttatcttatgccagctttaaagtccttctctcctctctctgcccctaatcctatccctataaaagcactaagctgctttctgtcattaaggattggtttgtattttctagactttgaatataaatggaatcacatgatgtattctctcttgctctctcactctcttttggaaaaactctaaaaccatgtttttcctctgctctcacaccactacaacaacaatcatcaccacagaagacttctagtgaccaaatgtgtggagatatctccccaccaccaagcgaccaattaattctgcagtaggtatcagctaggtgtcctccaaatcaattctaacactatctacctggaaattatgtcagatagtgtcagatccatttaagtgctcattcacaagactgacccccgacgcacaccagttgataggcttcatgtcggggtacccatgaagccctctacgggttcaatgacttggctggaac

SEQ ID NO: 693066 - DNA, 168 bp, Homo sapiens
gacccttgtgaccaggtttcacacttggccaaggtcatctatgtccatccgcagcaagctgcagaacaaggagcatgtcattgaggccctcgcctagggccagggtccaagtttcctggccgccagaagatccacatctcaaagaagtggggcttcaccaagttcaat

SEQ ID NO: 693067 - DNA, 176 bp, Homo sapiens
tccaagtgcctttaaacgtcttagaggcctatcgctggacatcgggatttgtacatactaaccaggacagtaaaaattctcagtaaacttctagattgttatgtgtgcattctactcacagagttttaaccttactttgcatagagcagttatctaacactctttttgtaatatgc

SEQ ID NO: 693068 - DNA, 390 bp, Homo sapiens
taattgggagcacacgtatatcagtaggaactgggtagggataggaagtactaggcagggcagcagcaatcttgcggtgtttgatataacatgcatccttgggcaggttgcccttacatcttcacactggggtgcacgggcatgtatgttttggtcatgctgccagtcagagtaggcagtccttagtcctctggtggtccagtatatctaataagtgtcttccatattcattccacgtcaagggaaatacggtagtacttttctttttatatttctatgcttacaattctctttcctagtcacaaatggcccaaatctgtgttggcttacggctggctacattggtctcccttacttttcttgagctaaagacaggctttttccaccggc

SEQ ID NO: 693069 - DNA, 337 bp, Homo sapiens
caacacactccagctctcaataacacactccagccctccaacaaccaccatgaccacccctacaccaaacaccacccccagctctccaagtaaccaccacaaccaccccttcctcaactaccactcccagccctccaccaaacaccatgaccaccccttcaccaaccgagcactcccagccctcccacaagcagcaggaccagccttccaccaaccaccacttccagccctctaacaactactcctctacctccatcaataagtcctcctacattttcaccattctcaacgacaacccctactaccccatgcgtgccatctctgcaattggactggc

SEQ ID NO: 693070 - DNA, 333 bp, Homo sapiens
  misc_feature (139)..(139): n is a, c, g, or t
  misc_feature (329)..(329): n is a, c, g, or t
acccatcggtggcatgatcactaacgccgcatcggaagaaatgtggctgaaaaaagcaataaacagcaccatataactggcgtaggggcattaacatgcgatgccattttaaccattagtgctggcagtaagccgacgncgtccgccagaccggcacctaaaaccagcgccaggatcgcaccaagtggagcaaaaccgctaaagtttttaataacattggggtaaaaaccagtgtaatccttccacactgagcaggtttttcaccacgaccggcgtaccatcgggtcgggtttttcgcactgacgccaaaggccgacaaaattgccgtngtca

SEQ ID NO: 693071 - DNA, 355 bp, Homo sapiens
cgacttttttttttttgagacaggtctcactctgtcacccaggctggagtacagtggcctgatcaagctcactgcagcctctacctcccaggatcaagcaatcctcccacatcagcctcctgagtaggactataggcatgtgcaccatgcctagctgatttttaaaaatttttagtagagaagggggtctgactacattgcccaggctagtttcgaactcctgagctcaaacaagcctcccacctcagtctcccaaagtgctgggattacaggcatgagccaccaggcccagctagggccactactcagtgccaggccccagccactagggatacacacagaactgatgggcggg

SEQ ID NO: 693072 - DNA, 135 bp, Homo sapiens
  misc_feature (53)..(54): n is a, c, g, or t
cgcagtggctcatgcctgtaatcccaaagtgctgggattaggggcgtgcgctnncgcccagcttgaattttctttaaagttgaaaaaagcatcatacaacaataatatgagagtttggaattgctcccttatttg

SEQ ID NO: 693073 - DNA, 388 bp, Homo sapiens
gcaactaccagtatgtaaaagtcccgggaagacccttatcccagcaaattcgcttacaacagcagcaagcccagcagccataacagcagcagcagcaacgcaatgcctacacacggttttaaccagggaatgaatgcacggcagactctcaagagatcaatcaaatggccagaaacggttgggtttttcatatggaataagtattaaagttacagggtagttcatttatgcatggatttgggtaatgtaatatgcggcaaaaagtttggtttcctaaaaaattgggtctgacagcggggcgtgtttgctcacgctggtaatcccagcactgtgggaggctgaggggggcggctcaggaggagatcaagaccatcggggctaacagagg

SEQ ID NO: 693074 - DNA, 431 bp, Homo sapiens
agttaattcgactcgcgtactggaggatctctaaatgaccagggtccagtgcttaacgatatttggaggtcagcacggatgctcacgtgtcgagggaacttgtacggggaggcatgcaccgtagtggtgaatacacgtcgaccaggctccatgtttgcgatctttggaagtgatcgaaggtgctcatctgtgtcgagcgtgaacttgtcctatgaaggcatgcaccgcagatggtgaatacacgtcgatgcctgcgtggctatcttgcgtgctcgggatatctgaacgatccgctagagtcgatgcaggctccagcttagcgatatttggaggtcagcacggtgtcacacgtgtcgacggaacttggtctgggtgacttgcaccgccagggtgactacaggtcaagcatgagatccatctattctgagttt

SEQ ID NO: 693075 - DNA, 293 bp, Homo sapiens
cccccctgggggcaaaggttttaaaacccaccccccccccccccccccaaattgggccgaggggggtttgggcaaatttcccccccccttttttaagaaacaacgggaaaggagttttgggccccccccactaaaagtggtggggcccccggatttgggttttggggcccttgggcccccctttttaggaacccccggctcgggggcccctggaaaccaaacgggttttagactgaaatttttttcccccccccccgggggggctcccgtgggggtttttgtgtaaatgggta

SEQ ID NO: 693076 - DNA, 224 bp, Homo sapiens
cattccattgagaaagctgacaacggggatagggaggggataagataatagagggggtcaaattctggtgggaatgtgaacttgcctagtaagcacttggtctctgttcactacggcgatagaggaaatctatctccctatctggggtccttgaactacagccggcggtcttacaccaggggagctaccctttaaatgtacaaattactggtatgctcagcgcg

SEQ ID NO: 693077 - DNA, 447 bp, Homo sapiens
  misc_feature (111)..(111): n is a, c, g, or t
ttccgacacctccaaattatggaaaatactgtgtgagacctaaaaagccagcacaggaggccctgataaactacagtcgacgagggaaaggtgtcctaaagcatcttcatngacggtgcaattctgaaagcaaggtttgctcatctgaggattcagaagctgatcgatactccgattatggctggggaggaccctcatcgccatttaactgagttggaaaatgaagccacaaggctggaggcgtggagtttgcttaataaacaactttgaggtatggggccctcccaacaccctccccccacccgccccgcccaggaacgtctggaccctggcaggttggctttctgggacaattccatgggcttcatttatcagttttttccctttttaattggtggagagagacaaaagtttttataatctttattaaattttcctttttaaata

SEQ ID NO: 693078 - DNA, 817 bp, Homo sapiens
  misc_feature (24)..(24): n is a, c, g, or t
  misc_feature (35)..(35): n is a, c, g, or t
  misc_feature (64)..(64): n is a, c, g, or t
  misc_feature (67)..(67): n is a, c, g, or t
  misc_feature (619)..(619): n is a, c, g, or t
  misc_feature (728)..(728): n is a, c, g, or t
tttgaaacacccacctcagcctcntgagtagctgnaataaccaggcatgcgccacaacgcctgnctntttttgtgtttcagtagagatggggtttcaccatgttggccaggctggtctcaaactcttggactcaggtgatctgcctgcctcggcctcccaaagtgctcagattacagacatgagccaccgcgcctggcctacattgtattttttaaagcaaaaaattttaaaacagttagggagcatggataaactaaatgtccatgaacttcagaaaaaacacattatcaatattgttgaaactcccaaagaagtttacttttcataaacaaaaataatgaatttttgtttaatgtataggttaagtacagccatcgagtaaatttataatatgaaagaaggatgtcaccatttttactcctggccaaatatacatatactagatccttgctttgaaattttctcttgaagtaaaagaagtttacagttgcttaccaagtttgtcccctaccacagtcacctccgttgcctctgagggctcaccaactcctgcagaattagaacagcggacacggaaacagtaggatttcccctcggccaagtcaaacagagcaaagnggggagacttcacagggagctccgtgttcactcgctgccagttttctgttcctgcctcacacttttccacaaagtacataatgccctcatgaccacgctggccaggggncttccagctgagcaccacatagctccgggtggcctcagtgacagagagtttgtcggggggccaggcacatacctctgagggtctctcag

SEQ ID NO: 693079 - DNA, 87 bp, Homo sapiens
acggccgtgtattactgtgcaaagagacactatggttcgtcgcattctttcagtcttgactactggggccggggaaccctggtcacc

SEQ ID NO: 693080 - DNA, 407 bp, Homo sapiens
tggaccagcatcttggaactggataagggcagagatggaagagttggagcgttcagaagttgatagcaagatgaaagaaagttggaatttctggagactaattaaatgcttgagacaaaaatgctggtagaaatatgggatgccaaggtgggtggatcacttaagatcaggagtttgagaccagcctcaccaacatggagaaatctcatctctactaaaaatacaaaaattagctgggcatggtggtgggtgcctgtaatcctagctactcaggaagctgaggcaggagaatcacttgaaccagggaggtggaggttgcagtgagctgagattgcaccattgcactccagcctgggtgaaaaagcgagactccccaaaaacaaaacaaagcaaaaagaaataaaagt

SEQ ID NO: 693081 - DNA, 707 bp, Homo sapiens
ccgggcctggggcacggagagagcctgagcgccgcagcctgtgagccgaatagagcctgtgagagacccgatgtatgacctggagaagcccagtgcctggcctggaagatgtgatgcctgagctgcggccggaaggaacctgagccctgtcctgaatgtggatgctggagctgcatgcctggcctgtgtggccctggtctgatgccctgctgccatggctgtgcctgagtgcgacatgcttgtgtgccgtgaagctggtggctgttgtgctgtgctgcctgtgccaaatgacgtgcttgcatgcagtctaagtgcccgtgacactaccccaaaacggctgtgcgcgcctcgtcgctgtcgctgtgacgccgatgcgcctgagcctaccaatggttgccgggagtacttgggctggggcctggctgccgagtgcagcccgaggagctgagggtttaccccgtgatgcggaggcctcagcaacctgctcttcctgctgctctgctcccggaccacctgcccagcgtttggcgaggagccccgggaggtgcttcttgcggctgtacggagccatcttgcagtgttgttggactccctggtgctagaaagcgtgatgttcgccatacttgcggagcggtcgctggggccccagctgtacggagtcttcccaggagggccggctggaacagtacatcccagtcgtgcattga

SEQ ID NO: 693082 - DNA, 930 bp, Homo sapiens
  misc_feature (145)..(145): n is a, c, g, or t
  misc_feature (229)..(229): n is a, c, g, or t
  misc_feature (250)..(250): n is a, c, g, or t
  misc_feature (258)..(258): n is a, c, g, or t
  misc_feature (337)..(337): n is a, c, g, or t
  misc_feature (349)..(349): n is a, c, g, or t
  misc_feature (435)..(435): n is a, c, g, or t
  misc_feature (657)..(657): n is a, c, g, or t
  misc_feature (659)..(659): n is a, c, g, or t
  misc_feature (662)..(662): n is a, c, g, or t
  misc_feature (697)..(697): n is a, c, g, or t
  misc_feature (700)..(700): n is a, c, g, or t
  misc_feature (705)..(706): n is a, c, g, or t
  misc_feature (709)..(709): n is a, c, g, or t
  misc_feature (726)..(726): n is a, c, g, or t
  misc_feature (729)..(729): n is a, c, g, or t
agcggagtatggcatcgaggagaatggagaccaaacctgtgataacctgtctcaaaaccctcctcatcatctactccttcgtcttctggatcactggggtgatcctgctggctgttggagtctggggcaaacttactctgggtcnacctatatctcccttattgccgagaactccacagaatgctccctatgtgctcatcggaactggcaccactattgttgtctttgngcctgttatggatgctttgcntacatgtncgtggtagacccatggtatgctgaaactgtatgccatgtttctgtccctggatgttcctggctgagctcgtagctggcnatttcaggggtntcgtgtatcgtcatggagatcaagggactaccttcctgaggacttacacggacgctatgcagacttacaatggcaatgatgagagngagccgggcgagttggaccagtgtgcagcgcagcctgagctgctgtggtgtgcagaactatcaccaatctggagcaccagcccacttacttcctgggagcatggcatccccccccagctgctgcatgaactgaaactgattgtaatccccaggatctacaagaatctgactgtggccgccaccaaagttaaccagaacggctgtcatagatctggtaacaantntcntggagactaacatgggaatcatcgctggagtgcgngtnggaanncgnattctcccagttaattnggnatgctgctggcctgctgtctgttccccggttcactcacgggccaatcaagtatgaaatggcgctaaggaagaagatctgtcagcaatgacgggacttaggagcaccgtttctacaaggcgactggcaggacaccttggacaggaccttccgagaatgttaagccagacgtttacactggcctctcccttaccctataccca

SEQ ID NO: 693083 - DNA, 865 bp, Homo sapiens
agcaagaacggctcgtgagggcggggcgtggggggggtgtagtggggggaagagttgtcgcatgggcgccggagtggagaggggatggagacgtgaggaggggacggggcgcacgcagggcatgcctaaagggacacggccagtcaaagcccttcccgaaaaggtgataagtgacaggccgaaaaagggctaaaatccgggaagcagagtcccaaaggctcggattgcatcagacaaatctattgcctccagagacgaataggataccagagggcaaccggctagggatcgtaaggcagcccagcagaatgaggacccaagcttttaaaggttgggggtaagaatgcacggagctgaaagtaaccgagggtcaaaaccgggtggacgtatctgcctgtgggggttagggatccttatgagagcccacgaataagatggaaatactcttccctctgaatctcttagatctcaggaacaattagccagaatatacatgactcttccttgtgagggccctattccttaatcaatttaggataagtgtggacactttaagtaataaaactcaattatgttcttaaggccttgtaaaccacgttacattcgaaggggacagaaatcattctaagcaggaaaaaacagtccacttttagttttttcaagtctctctctaataactaaatgccacttatttgcattctccttgtggatttctttgtcacctaaggtaatgcagtttgatgagtgctggaaagcttcttaagtgcttacagtatgttttcattgtttgcacggatcactggacatcaaagatcattgcacttatgacaagaccttcttttcattctgtactccagctgacaac

SEQ ID NO: 693084 - DNA, 469 bp, Homo sapiens
agcggagtatggcatcgaggagaatggagaccaaacctgtgataacctgtccaaccatcatatctctcgatacggtgcggcggatcggcatccggcctttctatgcgaactcacaatgctctattgtgccatcgactgcacactatgtgtctggctgtgatgctgctactgtcggtactgatgctgactgtatgcagtctgtcggtgtctggtgactcgtactgatcagtggtcgctgagatagacaccttcctgaattacacggacgctatgcagacttacaagcatgatgagaggagccgcagggaccatgtgccgcactgagctggtggtgtgcaaactaccaactgagcacgcctatctgactgctccccacttgatgacaatgatgtatccgataaatcgagtgccacaagtacaagtgtatacgtactatctgaatactggatctctgatggtgatcatctca

SEQ ID NO: 693085 - DNA, 411 bp, Homo sapiens
tgatgtggtgctgctggggtgggcccggtgatgtgatcgaggacccgttgcgatgcctgcgcctcgggcaccaatcgagtgtgtgaagcatcttgctgtcctacggggccaaggtcaaccctcccctgtacaacagcgtcccccctgcacgaggccttgccatgagcgggcagtcccgaatgtgtgaggcttctcatcgaccatcgcgggccaatcttggaatccgcaccgatctgccatttcgggaacccctctgcacgttgcctgtgcccggggagcatctggactgtgtcaacagtgctgctcaatgcaggggcgcaccgtgaactgcggcaagcttcatgagaactgccttcaacacgcggccaggttccagaatgtatgacctccatcggaacgcttatcgagatt

SEQ ID NO: 693086 - DNA, 106 bp, Homo sapiens
tccactgctccacgccagctaggcaatcatggcaataggcacgcggtctcattttgttggttttcggcaactgcaggcccatgcattcaagcaggcagctggtggc

SEQ ID NO: 693087 - DNA, 100 bp, Homo sapiens
ttgtcgatcagcaggatccttttatgtttgcctggctgtctgacaccctttatcctcactgccccgaacctcagtgagatgcggtggagtgccttgtggc

SEQ ID NO: 693088 - DNA, 150 bp, Homo sapiens
cagattcgctcacttccaccctcagcgtccaccctcagtcatattataatatcgagacacctggccgcagcgtctgacggcgggccgcttccaccctacagtgtattataatctcgagacaccttccgagcgaaaggaaatgcacctgtc

SEQ ID NO: 693089 - DNA, 1650 bp, Homo sapiens
gaggcctgcgacacacgaccacttctcctgtccaggacttgcgcccgactggtgcagggtcgcggtgccgtccgtggatagagtccacatgaacctcttccatcttccgagcggagagaagtttcctattcctcttcttcttcctcctcctcttccacctcctcctcggcctcccgtgccctctccggtcctatggaccctgctccatggagaaggccctgagcatgtttctctcgactgactttggtcagctcttcatgcggtccccatctcggagcccctggtccttcccatgtcagctctcatcccacagtcccgctccggtcggggtcagcgtaatatctaagtacccttacgcgtatgactgccctatcgatgtttgccggttggaccgttgagatgacctttctttccatcctcgtacatgaccatcatccgtcatcctatctctctcatacctaatcccatcacttcgacgtgctcgctgcgtgctcgacgaacgcttcggctgcgctttgacctgggtcatcctgcgttcattggacaccacccttctctcgcttcaactatatcgttgcgcaatcgcaatgcctgtgataggatccgttggtgaaccacaggagccgctcggggatagaactccctcagagcgatcatagctgggagaagcgaacgaggaaaatcgcgtcgagcatcattacgcgggggggccacctggtctgttcgagcccctgtccattagacacggaaaaccaaggtgtccatgaaaggaagcacctgtacccggaagcgggggagggaatgcgttagaattcctctgattgtttggccctcctttctccctttggcctccttgtctcccctttagtccacccgcatggcttggaaaaaaggccgagggacaaaagggagacgggcgtacatgtataaattcgccccacctctaacgaagaaagggcgtcccacggggagcaattctttgtcatggccccaggaggtgttcataaaagggacgcccgaagagggaagggcccgaaggagatcccccaattgggtctggggttcgcagaacacccccactcggagagacacactacaggtgagagccaccaacctggagagggggagaaaccacaagaggggtctctccgccgtgatgaagaacacacgcagcggtggtaccgcaggaaagaggagagaaaaaaccccccaggaggactacgcaaagggggggagggaccctggctggacacattcgtgtcccacccaacagctaacatcgtggcgtgcctcgagcgagcgatccgaaagcaaaaaggcaagacacgtaagacacaaggaacaagagagataagttcacaccgcgggagagaaaaaaacaacccgcgagaatagaagagagcaccccccgggtgagaaaaaagtagaacagaaacaaagacagacaaaaaaggcctgcaagtgcgccgagcacacatcagagagaggaccgacaacagaggggagagcaaaacagaagtaagcggaaagtagaatagacagccaaccaggtgagagcaggcgagaacacacacgcaagacagcgaatgcacgagcggacggccaacacataccgaacatagaagaaaaacgcgatgactggtacgaacg

SEQ ID NO: 693090 - DNA, 182 bp, Homo sapiens
acaccttcttagaaacttgatagttggatgtgtttttcatttggcaaaaattcaatgtggcttagccgtgggatgtctgaagtgtcagaaacagcactgtagatgtactggtttcgcagagggaaaatatatatagagatgcactacaccccctagaagaacacactgtaacaacgactgaa

SEQ ID NO: 693091 - DNA, 881 bp, Homo sapiens
tctttaaacaaactttttttgagtgctttctaggttgccaggccccaacccaggcctgttaatacaaaatcttccaacaaaactccgttgcccctcaaggaccttacagtctctatacgtggggagaactgcccatttaggcaggcaatgtgtgaccccagagtgtgtttcttgtgttagttagtgccagggtgtgggggtctcgggaggagagattttacccaaagcctcctttgggaggaagctcaagtctcataagtttgagattttgacaagagaaagtacccttttcttctgtggtgcccacaaacagaaaagagaggagaactccaagatggtggacaatgtgagaagaacgcccacggtggcattcttccttgagatctacaggggacgcgctttggagcccccaaagatatgtgcaaaaaaaggcgcaattgttgattgatagacccagaagagggtgacgcagggaccaaagggaccaaccattgaatgtctcctcacaaaccccatgtgcgtgagggcggtctccaaaccttttatctccgtgagggccaaggcgggcagtcgtgaacacattgattgaggattgaacgattgtctcgatttccccccaaaagaaatcccaagaaatgaacccggcagcggagggtattgcatcttacgacgagggcaacaaaacggggacacttgttcccaccaatcacaaaaaatcacaaaacatcctcccggcggatcctttttattgtcgggttggcgggaaacaagagtctgttttgtaattgggccatatggtcctaacggtttgttcctcggcacccccttcttctgttgccccaggtgtgctaaatccggccggcccccctaaagggaagcga

SEQ ID NO: 693092 - DNA, 267 bp, Homo sapiens
  misc_feature (1)..(1): n is a, c, g, or t
ntaggcgactcctagtttgcagaataggtgggaaagatgtgacttgtactttggtaaggagatagggaacggaactaaggctattactctgaagaaagttggggggccaggtctcctattctttttgctgaggagatagaagatcaggtcttgtattccataagaatgggatgggcccggggatgcctggcataagccttgcactgtgaggtgcatgtcgaggcttttattctggtgagaggacatggactctctctctcccctcag

SEQ ID NO: 693093 - DNA, 324 bp, Homo sapiens
  misc_feature (164)..(164): n is a, c, g, or t
  misc_feature (219)..(219): n is a, c, g, or t
aaggggtcagtccatacaggccacattggcctcttggatccccagttggggggagggagcccacccagaccttcctgcattcagagcctgagccagccgcccactcccctcaaccaccagccctgaagccatatggtctttgccccacgcacaaagcagagcanccgccaagcacaggggcccccacagggcaacggagtttggaaagtttcaattttncgaattgccagttgtgacccactgatggcccacagaattaatttagtgggttctgattgggaattttaacaaaatgaaatagaataaaaaatatccggtcgggaa

SEQ ID NO: 693094 - DNA, 81 bp, Homo sapiens
  misc_feature (32)..(32): n is a, c, g, or t
  misc_feature (56)..(56): n is a, c, g, or t
gatcttcttcacaccaagctcatggttacatnccgtgaggtgtcatgaagaaagtnctgttcaataaggttttgtaatgtt

SEQ ID NO: 693095 - DNA, 1267 bp, Homo sapiens
gcagaatcctgaccccgcgcttcccagccccatgctctctgcgtggtccctccgcattctgccctcaccaccctgcccaaacccaccaggcaaagccagagcagcggccgtctctgccacagccaggaggcactagcatggacacgatcaccagcactggcaccgtgattgcacagcatacagatctatcacatcatgccatagtccatagcaaaacaccttgagccattccatctgccacttggggaggcacctaggaggagcctctcccaatggccacacctcgagcattaactcaccaaagacagctcattatcctaaataaacaacactattgtgtggcggccaaaacggatagccatagagggcaaacaccagacagcacagctaacgacgaactgggagccccctttgagcatatagtgtgaccacccaaggctagcgccacttgaccttgacacccgtcacaacggcgtggacgcaccccttggagccccttggccattccaaaccatgggcgcgcccattggcttctcgacgcgtatggaccatccaggagttccagttaacccattcatgcgcataaggcccaatactacacttgccctcgtctcgggagtctccgattaaagactgttgtactcggacaagggtacacacccgaaaggagtatcaaagccataacacggcggacaccccccagcgaaggaaatttcaaatgaggggcacacactgcaagatacatcaggccatgtgccctttaacgcgttacatccagttggatagaaacggcgtgtcaacaatttcccggaagcccatacacgtgaatcccacaggtgggcaccattggatcaaacaccccatttggagggccaaaggcactctgtttggaggcactcacaccaccgcgacggagtggaggattcatcgaacaaacagcaattattaaaggagaacacccacacaatgagagtgcccactttggaagcccaaatccgaaggagcgcaaaacgacaacatttggcaacatgaacggtacacattttgaaggagacccagcacaccatttgttccctcaggcacgagatggaccctccacaagcaccattctgacggcagatgtcacaccaacaggaaagcaacaacaacacacaatacgactgtgtcagtgacacacccaacagaaaacaccacacatttcaacacccaccaaactacgccccgttgtagagagaaaaacagacatcataggatgggaacaacatct

SEQ ID NO: 693096 - DNA, 388 bp, Homo sapiens
  misc_feature (91)..(91): n is a, c, g, or t
  misc_feature (104)..(104): n is a, c, g, or t
attcatcctgctgcacttgggcaggttgggctctcacaggatctggaggagacgggatatctgtggagcacattggcagtcacctgcagtncattgcgacagtnctccccactccccagctttcagaaacagggttcatggctccagacgagagagcttgagatacaaggatgcaacaactcacagtcagagcccatctggggacaccaggaccgaactctgaagcaggcccatacagtggacagcgttctggagtcttgcagagctccttctgaatcccggcactgcgcctcctaactgtgatcatgagcaagttgccaaactctctgagcttagtttctcatctatggaatgggctaacactcaccttacaagacactgtgatatt

SEQ ID NO: 693097 - DNA, 123 bp, Homo sapiens
ctcacctccgagagctagactttggccaggcatggctaaaaccactggttaacgatgtgacagttatgatcttggagattggaaatctttcttccacattagagtcttacctcattcctatct

SEQ ID NO: 693098 - DNA, 139 bp, Homo sapiens
agaatatgacagaagcgccctggacgccccttgaatattacatctataagtataggtaatcttcagctgtgccaaaccaaatttccatattcttgggcatcagacaaaagggaagaattactctatgtctagtatatct

SEQ ID NO: 693099 - DNA, 692 bp, Homo sapiens
  misc_feature (15)..(15): n is a, c, g, or t
  misc_feature (155)..(155): n is a, c, g, or t
  misc_feature (212)..(212): n is a, c, g, or t
  misc_feature (354)..(354): n is a, c, g, or t
  misc_feature (395)..(395): n is a, c, g, or t
  misc_feature (418)..(418): n is a, c, g, or t
  misc_feature (528)..(528): n is a, c, g, or t
agcggggaactggcngtggggctgcggcggtggggacgggcacggcgttctgtgacatccccccgctcccctcgtcttctcccggctggcggcgacggctcagctgcagcgggccggggcgtggggcctgggttttgtgacatcgtaaacatganccccaacagtgggacttccctgtggaatatgtgccggcctatggccttgttactctnacgggcctggatgtagtttataatgcagtccatcgagctgtctgggacgccttctgtgcaaatcggagagctgatcgagtaccaatttctttcaaggtgctcccaggtgaccatgagtatcccaaatgtagacccaagagancttcatatgagtggtacattcctaaagggatcttaaagacnggctggatgaataagcatctgantctggtgccagccctggtggttgtgttctatgaactggactgggatgagcctcagtggaaagaaaagcagtctgagtgcgccaccagagtggaaatagtcaggcaaagtntacaaggaagaaacacaaaagttgcagtggttctgattcagaagaaaacccctttggccccagggagaagatgtcattgcttcaggacagggctgcagctttatgcacatgcatgtgaactctcaggaaagtctaagtaagaccttgccgcacactgaccaacc

SEQ ID NO: 693100 - DNA, 1272 bp, Homo sapiens
agcgtgggggtgtgctgctctggccggcatctggcgaacggccggcgagacgcggaggctcccccgagattcatgctcgagaaccgagggcgggggccgtgcgggtgcccgtatcgcggctcgcgagggacttgaggcagccgggaggtctccggtgacaccccgggtgctctatacagaacgactgaatgggctaccctcgtggtacccacgcactaggaccacacctagaatcttgaatgctagtcaagcatgctcctgtgaggctcacggatttgcacgtgaaccatgggctcgtggaacataggggacgtctgcggtgcgtacaacttcctttccgaaaccaagtcattgcgctagcgtgttgctactcgaaagatgtcacccggtcactcatatggggagtgaaggaggaccgaagaaaccctcggaacctcaaagcaggcctgagagggggttgggcatgctctctcagctggattgagtgtttctaagcaaaccaccgtcagatatggctcgcctagtataaaggacatggcgtccacgagaatgacgtacttgtccgatgacagcgagtggcagataggctccacctccgcgcaagggtcacttgtccactacgactctcgtagttacctaggagtgcaccaaccctattggtttgcacctagtctgtacgaaaggacaaccatagtggaatctcgatacgtacatttgccacagggcactacaatttgggcggtgcgcgaagcgcctcgaattggggtcgcgtcgaaggaccactgcaagcgctctcgctcgacgagtttttggttggaaaccgtctctttcagcctaaacgcatagggtacgacagctattcggcgagcaaccaagggaacctgggccttaccctcgcagaaagaggccaagacttggctaagcgcaccaagggcgaaccgacggcaagccctaacttgggaaacggcgtggtttggtctgctgatgcccacccccttagtgagattggggtttacatacaattgtgggggcgtaggttaattcacagacaagtgaggaggggaagcgacacagagacatcaaggataaaggcacggtacaatggcggcaccccaaagacaaaggcgttcccgtaggcaaggcaacaggtattggccatgtcggccaaatcttagggggcggtaggcaaatttctcggttgattgggcgggtaaaaccccttttggagttggggtactacaaaaatggggtatcctctgtggaaaagccccg

SEQ ID NO: 693101 - DNA, 1015 bp, Homo sapiens
tcgttgacatttaaactctggggcaggtcctcgcgtagaacccggttgtcagatctgctacttccccccgagaagcggctttgagaagtgtgggaaccagcgccaccagactcacctgacaccccaccctcggctcacagggatctgagaattgctctcacacaccaacccagcagcgtccgtggagaaaactctcacgagcaactccgtttaaaataccgtcatttcaaaccgttgtggtctttaagcaacaacaggggggggggacccaaacaacaaaaaccaaaaaaaaaaaactgaaaagaaaaaaaaaacgcgcccttcaaaaatcttcttgggcagggggcccttgtgtaacaagggaccgaaaaagagagagggaggcgcctctcttataagggggggaagaggttttaaccccgcgggggggggggagccaccagtttgggttgaaactcttctcatattcctcaaacggggcgcgggtatattccccaagttatctatcaaaacccccggttattagaaacccccgggggatctaccgggaggcgcgtgcacagccaatgctcccagaattgcagacattggtccaccgcgggaggctaaaacacagctggggggtgctttggtccccacggaggggccccatggcaggacttccacccgcgggagagaaacattcggacaagactaaccacacaaggggagccccggacggggcgaatattccccgacatcgggcggggttcaccacggcgggggtcgaaacaaactccggggcagggtatctacgaagggggctccatcacacagggcaaccggggagtagcccaacggtggcgccccaaagttgtagcaaaatggccaaataagaggagaggcccccactttggtgggaaccacacgattctaccgggcggctgcccacgaacacacacgggtgctaacacagttctagccggctgcaaaacatagtcgctgctgtatatcttctttagaccaaggacacccg

SEQ ID NO: 693102 - DNA, 215 bp, Homo sapiens
ccggacgctatgcactgtcacaagcagtccacctgtacttcgtacctactagtgattatgtcactcttaaagcacagcggtttctcacaagctatatacagcagcttaaaacctcagtgtatcttttacacttgatacacaattaaaattaatttacgacaaatacttgtcacagaaatgtatgtaggcacatagaaactctacagctttactgg

SEQ ID NO: 693103 - DNA, 153 bp, Homo sapiens
agattgatttagagactaagggaatttacaactaaagaattagtcatctggtgaaaaggagacttaagaatgtttagggctggctgggtgactcacatctgatatccagcactttggaggccaagcaggcagaacacttgaaggagttcaaga

SEQ ID NO: 693104 - DNA, 106 bp, Homo sapiens
tcagagtgaatggttttcatgcttacttatactgacattagtttcttctatagggtgataaattggtccaattggcgtgtgaggagttcagtttatatgtttagtg

SEQ ID NO: 693105 - DNA, 337 bp, Homo sapiens
taaggatcccagtaagcgtagggacatgccctgcagctaacatctcatctgaggctggccaacaggagctcctgcactctcccgggcacctgggatgcgggcagctggcagaggacagggccagtgcgcccagcaggtacacacacgccctgtgatcacaaacaagcatgctgtgggcaccagcgggtacacagcggcctcttcaaaggacaaaaacacaccagaggcctccagagatgggaaagggctgagcaaaacagcctggctcaggtgttccgtggcagggccacagagcagttggacaagaaacacaacaggctcagggccccagatagac

SEQ ID NO: 693106 - DNA, 123 bp, Homo sapiens
caggcaggtttttataaacatgctctgaagtgggaggtatgggctgacagcctccctatgtatttctaaaaacctccatggaccgagatcataggatgaagccagtaaagtcatggttcagct

SEQ ID NO: 693107 - DNA, 526 bp, Homo sapiens
cgactctactctacaagagcagagtgccaggctgggcacagtggctcacacctgtaatcccagccgcttggggaggccgaggtgggtggatcagtgtgaggtcaggagttggagacgagccgggccaacatggtgaaactccgtctctactaaaaatacaaaaatgagctgggcgtggtgtgtgcgcctgtatgcccagttactcaggaggctgaggcaggagaatggcttgagcctggtaggtgaaggttgcggtgagccaagatcgcgccagtgcactccaggctgggtgacagaatgagaccctgtctcaagaagaaggaaaagaaaacatatctttaagttcctttcatgtaagaacgaggcttataagtttatctttccccatactcttgatcctcaccagagaatcttgtccaggccaaagaagagagggggggcttacatcagaccgcgggatcggacactaaacgaacttaagtgtatataagcaaaacagaagagtcgtgtacgagcagaaactctg

SEQ ID NO: 693108 - DNA, 217 bp, Homo sapiens
  misc_feature (85)..(85): n is a, c, g, or t
agttctcaacgggtgctgcaggtccaggccacgtgctgactccagagaacctaaacgcaatcgtcactgggagctcgatcccttnatcaggaatgccgcacgcctgtggcgtgaccacaggataccagccaggcagctggggaaccaaacgcctgtatctgtcttgtgctcttatcaagtcaactcaacactccacactttccgttcagagcaccca

SEQ ID NO: 693109 - DNA, 516 bp, Homo sapiens
acaccatcgttaagtttagttgtgattatgtggctctaccatacagaagagtttgttaaaagtcaaagtgctgggattacaggtgtgagccaccgcgcctcgccaatatttttattatataaaaatgtgactgtaggctgggcacagtggctcttgcctataatcccagcgttttgtaaggccaacgcgggaggatcgcttgaggccgggagtttgaaaccagcctgagcaacatagtaaaaccctgtttatacaaaaaataaaattaggtatgggggtggcatatgcctgtggtcccagttactcgggaggctgaggcaggaggatctgttgagctcaggagttggaagctgcagtgggccatgatcatgtttttatatctcagactgggtgacagagtgatactatgtctcagtactccatagtcttttagactggttacaaattctttttccttttggtagacgtgagtgtcactatgttacccaggctggtttggaactcctggttttgaat

SEQ ID NO: 693110 - DNA, 439 bp, Homo sapiens
  misc_feature (6)..(6): n is a, c, g, or t
tgcggnagagagaatgaatcaatttatatttttttggggggggagtctcactctgtcccccaggctggagtacaggggcgctatttccggtcatgggaacctttggctcccgggttcaagtgattctcgggcctcaacctcccaagtagctgggactacaggggtgcgccaggatgccggcaaatggtgttttggaaatgcagtctcgttctgtggtccaggctggagtgcagtgatgcaatctgggttcaccgaaacctcgtgcctctggggttcaagggatttctccgtgcctcaaactccgtgagatagcagggaatcacagggcgcccgtccaccaaggcccaggttaaattttgggtatttttaagttagaagacggggttttcaccacgttgtggccagagcgggctctcgaaacctccgtgaatttcagggt

SEQ ID NO: 693111 - DNA, 310 bp, Homo sapiens
gctcgacgatatgcagatcaataaatgtgattcaagatgtaaggaatcctaaagacaaaagccatatgattatctcaatagatgcagaaaagacttttgataaaattcaacattgtttcatgccaaaaaccctcaataaactaggcattgaaggaacatacctcaaaataataagagctacctatgacaaacccacagccaaaatcatattgaatgagcaaaagctggaagtattccaattgaaaaatcgtacaagataaggataccctctttcaccactcctattcagcatactgtggaatgtcctggc

SEQ ID NO: 693112 - DNA, 149 bp, Homo sapiens
agtcggacctcagagctcctgatgacctccggcctagccatgtgatttcacttccactccataacgctcctcatactagagcaggctgaggcgggagaagccacaggaacatcaggaaggtggtttcacatctgtgtgaaacctgccaa

SEQ ID NO: 693113 - DNA, 1068 bp, Homo sapiens
agtgatacgttattgtacgtacactctggactatcgtgtggggtactactatctcatctgctagtcgtgcttctagaatgtgtgtccaggtgtgtatgctacagacactggaagacgttgaaaatccacagactgacaggagttagaacctgaggtctcattcagctcctatatggtttttgggctcgccagttgaccgcagttctctgaattactatgacggtatccaaactctaaagtagcagattggacatgtgttatctacctttacgatgccatagtgctcacaatcaacgccatctactgtgtgtacttttccttgtgcctatgcttgtacgggctttcaatcgatccttattcagctcttaatctccggttggctcaaggttgctcagactcggtcatcactagagcgtacaatgagtaatgataacgcgactatcagccgtttgtgtgtatcatagggttgctcggcaatggtgagcgagtgaggacttgatctctttgagtggaactcgctttgcctcttgaggcgtaacactcgcagtcgaccaaaagtatatttaaggcctcttgagtaggaactgtagaaatgttccgtacaaagtaccaccgacaattcagggtctggatgtcagtggagtcggcgttagggattgtccgataaccagtcccgaactgaaagctcgttgcagctctgctcacgtccgggaatacaaagcagcccgtcaaccgcaactcctggcaatggggggcggttaccccaagttgcgacctacgtgccttggaagatacctcaggcgggctttgcatgaagctgttgacgatcgtcgacctgcgtactggcaaaggggccatgtctcacgggtgtaagaacaataacgtttctacaggtctcctgttgaaactctctggacaggcatcccatgattccaccacccgtcgaaagtggttctgacgaaggtcaatttcccagccacagaacttctccgaattgacacaaccccactgggatgtacacccaccacccttgcacatctcataaatcttcaagacaaggacactaca

SEQ ID NO: 693114 - DNA, 110 bp, Homo sapiens
aggtcagaagagatagaggggctcagcagtgcagtatctgtaaaactgactgatcccacaaaacacaaaccagcagacagcaccctccccctcccctccccccctggatg

SEQ ID NO: 693115 - DNA, 1261 bp, Homo sapiens
  misc_feature (1178)..(1178): n is a, c, g, or t
aaagcgtctgttcccgctgttcctttgctttgatagttcaataatggataagacaagtaatgccattccagcggttgctaaaccaattcctgccccaatctctaataccgctagtcccatagctaacatacttttagcactttgagcggcattagtcccaactgcttttgtaccagttgcagcagcagttgatgatgttgctaccgctgtgttacctgctgccattccaaacaatctagcaacaaaactaaccattcccttaccagcaccaataactgctgaacccataccttttaccagtccagtaatcttcccagcgttggtaataaatccacccaaagcagtaacaactggcccgatagctggtgctaaaccaagcatttgacgtgaaaactgtgccattgaactattactagaaccagcccaacttaatgcgctatttgtcatgtcaaggaacgcaccagtgacaccagaagatccagccatagccttgttgcttaatgcttcccagttaccaccgacttgttcgatcttagaacccaagtttttctgcatttcgtttgcttgatcttttaggaagtttgtagctgtttgcgtacttcctgacgctttatccatttctttggtgaaagcttcccaacttgtggtagcattaccagtcttatccttgacactatccatcaaaggaagaatagcagccataccagcagtaccaaacatagccttcaacgctgctgctttatcagaactagtcatcccagctgtcgcgtcaccaatttcattcaaaatttttggtaacggcttcatgtttccttgtgcgtctgtcatagacaaaccgagattgtgcatcacaccagctcctttttcacttggagcttgcatgagcaacaaagcatggttcaagtcttgtgacgcttgtgcagcactgaaaccacggttagtaagtaaaccgatagcggtagacgttgtttgcatgtcgataccagcgttgtgtgccgtaccaccgatagtagctaaagcctgttgcatatcttcgattgagccgttggataggttagcagtttgcgttaatacagcagcagcacgttgtgggctttgaatactatcaccccagatgttcatcgattgttgaacaactgacgctgtttgctgcaaatcagcaccagcagccgttgcanttgcgcaatagctgggaactctgatttaattgtcttgatagacgctccgtcacgagccatggctaccattactttcgcagccc

SEQ ID NO: 693116 - DNA, 242 bp, Homo sapiens
aattcaggatggtgcagattagatggggcgaaaggagtcaggttaggggtttatgccgtgacattagcggagagcattcagcgatgagtgatgtatgcgcggagatcgagttgatgtagagatctagtgtctaaggtgtcatcagcacgaaatgggcgcgagcttcggcagccttatattgggggaggagggttcgcgatatgccgcaccttttgaatttcccacccctatcgttattcatg

SEQ ID NO: 693117 - DNA, 1580 bp, Homo sapiens
  misc_feature (102)..(102): n is a, c, g, or t
  misc_feature (575)..(575): n is a, c, g, or t
  misc_feature (933)..(933): n is a, c, g, or t
ccccgagtgggttataatatatttcgttatacctatccaccacacgaggcggctccggctgaaataattctcttcccccccccataagtggttttgacaccnttatatctattctttcctcccgcgtgatgatattgagcgaccccctcctttgggtgggagaaaacaaaaatagaggactaattggtcttctttagacgcatatatggaagaagccccaagaatggccgctttcctcctatatagggtgtttatatattctgcggtggggcaccaccccccccgcgaaagataagtgttgccacacgtttgggggatatattatgatcccgtgatgacacctcctctccggggcgccaataatatgctttttcaccgcccccctccgtcgtttgttcccaacttaacttttctctttcgccgtttattttcccccgcacacccgggccggttccaaaaaaaggttaatttttttatgtccgttggaccctttctgccccaccaacccaccctgtcccaccccgggggtaggccgacatattatttgggaagaagttgagtttcttcgaccgtgngcccaagagtggcctttcttgggaggcgcccccttaatgggggagttttccaactccgttttgtgcgttgtgttttcacacccccgctaatggggtgggggcccccttcgtagacctcggcacaactcttgtgaatatttagcggccacaaagccttccacttcccacactagtggagcacacttcgccggtgatgctatatcacgcggagacaccccgcgtgatacattataacgcctttggtaatggcccgcacacctctggcccacacgtagatgggtgtcgcgtaggatgcacaataaggggagaggctcgttatatttttggccacacctctcaatataggaagagggtcttntacacatgttcacgctcgagattttttcgccgctcatattttctctcacaggggttatacacacgcctatggagtccccacaactctatacgcccccacagaagtcgcactctgtcacactaatacactaatttcacattcgcggcgctataaaatttctaaaaactctttcttctgcgccacacacacacacactctttcttcgcgcgcctcatattcccgcgagaatgtgccccgcagcacgctttatatctctcgcgagactatatccctcgcagatggcactatacacccacacactgtgaacacactccctcattacacattctcgttatgggctcacattgcactgtgttcttctataccacgccacgctataatatattataataacatgttttactgagatttgaggaagccctttgcgctttcgagaagcgcagaaaggtccctaaatagtagagagaaccctcccactaaaacctcggaggtgagactatatgggagtgccccccacccctcaccaccaccacttcgagagaaacccgtataacactataaattctagagccacaaaaaggagaagggattcgaaccccccacaagctggtttcaagcccaccccctggcctccatgactttttcca

SEQ ID NO: 693118 - DNA, 423 bp, Homo sapiens
agtatttttacaagatacccaccgagatcagagcgtaccccatgccggcattttcgctgacgacgtacatcgtagctgggtgcgacggattgttcagctgatcgacgatcgatctggccgagaacacatcggtgagtacccactcgtactcatgatcttcggaatagatagaaacttccatcccgagattttggtaaaccatctcgaacttgggtgaacgatccctcagttcgtcttcccgtacagttactacccgcttgatgtcgtcttgagttccggacttacgggatttaagtccgctgtcgtcatgcggagaggtgggtcgaacttccaagctacctaggtacctctccctgtattcgaacgtcccgatcttcagggggtcgcgatcattgaccgcctgtagcttcttactcatcactc

SEQ ID NO: 693119 - DNA, 205 bp, Homo sapiens
ggtataagcatctaaatagagcacttgagtactcatctccctattaggtatttgttattgttttactcaaaagaacattttccatcatatggtaactgtgtttatcatttggaggaaatgccaaactgtttcccaaagtggctgcaccattttacattcctactagcaatgcccgaaagttcctttgtcgtatttttactttcca

SEQ ID NO: 693120 - DNA, 567 bp, Homo sapiens
tggattgggagtcggtttctgtcccccaggtgggagtgcaggggcccgattctcggctcactgtgcaaggctcagcctccggggtttcattgccatttctcctgtgcttcagccccccgagtgtggtggggactacgggcgcccgccaccattgcccagctaatttttttggtatttttgggtagagagggggtctcgccattgttgggccaggagtggtctcaaattccgtgacctcgtgatccgcccacctgggcctcccaagggggctggggataacagggcttgagccagggccgccgggcccaccagtcctagtggtctaaatggtgctggaagagaaatgctgggagaaaagaaaactgaaacctagagttgggatagtctatcaactaagtggagataaaaaccaatttccgggcggggcaggggggctcacgccttataatcccagcacctggagaggccgagggggggggactcacctgaggctcaggagtgcgagaccagcgctggccagcggtgtgaaccccggctctctactaaaattcgcacaaaaaaaccggg

SEQ ID NO: 693121 - DNA, 1229 bp, Homo sapiens
  misc_feature (339)..(339): n is a, c, g, or t
  misc_feature (496)..(496): n is a, c, g, or t
gagagcgtagaaccagaccaagaggcacgaggtccttgtaggaactgtgtgatggatgatgaactaattatactgtattataagaaaagcataatgataccatagtcctgtgagtgtagatggtatgatgtaggcattgggtgtcaggagtttcatgggaaagttgactagtgattgagtgtgtagggctgtgggtataaaggaggggtgacatgctatctgggggcatgatatgctacaatcaaggtagattaggatcgggatggtagctggtcatttagtgcgttaggctggagttgtagtagataagtgccttgagaagaaattcaggatctgaanagcatgatgcaaactattgtgtcgccaaaaggttgagaatgggattgaatgtatggcccatgacgaatgtaatgaagggctacagatcgaaagtactgatgtgaccatcagtatctgcaggataacggaaaagatactatgaccataggggtgggancaggaatgtatcatgaaagcgctgaattctctacagtggatgactcggcagatgtgcataacttccattggatatgaacacgttgtgggtaagctggggcagtattttagatcatttcacgtagtaggaccaagcgttgataaggaacgagggtagatggaatgagttagataggagatgtgggtgggaccaagaatttttaggtggaaagtgttggaggggggaatggcttgaaaagtgtacgcccattgaacgaaatggcctcctatcaactaggggacccaagggaaaaatgggccctcgtacggaagattaagtcgggacatttggctccttatcttcatttaggggaaaggggatttattgtaaactacactccaatgtggccaaggaaaacgcgcaagaatcattgcatgtaatggggcctaatgggagtgcaacgataggttaagaagaaataaattcgtgacgacaacttgtcccaagagtgtgaaagttaacctcttttgtcaaaatgtggggaaccgaacgaaaggtggcgacactgggggaagatcgaggtgaaagtttgtctgtatgagccttgggtaaaaacttgctagaataaatatgtggagtcaaaagaggcagttagggtacgcgctggattggaattcggactgtgagacgcgattaaggtgtaggtacgggagaaggccaggtgcgtgtattcgcgagaaaatataggttggga

SEQ ID NO: 693122 - DNA, 1040 bp, Homo sapiens
ggagagagaactagtctcgagtttgtgttttttttttttaacaaacccggttctgtgggtgggtgtgggtataatactaagttgaaatgatatcatttacgggggaaggcgcttggtgaagttaggcctatattatctcgttggtcctttcgatacagggacggaaactttgaagatagactagaaaccgaccgtggcatttactccggtctgaactcagaatcacgataggacttaaatcgatagaacacacgaacctcttaaatagtcaggactgacaccatggggatgtcctgatccaacatacgaggttcgtaaaccctcatggtccgatcatggactctaaaataggatcgcgctgtaatccctagggtaactcgccccgattggtcacgtaacgggatcaaagagtcatagacagagacgacatcaaacacgtggcgcaaatctaaaacacatgctacgtgactacgaaagtgtaagagctcacagaatcacgaggataaaaccaaacactagaaaatcaacacaagacgagaccagagcacgcacaaaggcacagcagcgacacagccaggcaccagcaagaaactaaataaactgagcgaacaaaaagagaatacatgaacagatacgacacaagacccagacatataccaggaaaggaacacgtaacagaatacacagatggcaaacagaaaacaacaggacacaatacatacaggaaaacacaaagagaaggtcactatataacaatgtaaagggaatgaaagaatcagaatcaaacgtaatacaaaaacaagtaagtactactaagaattcatttcatcactactgtctctcacaaacaataatgaatgccaaacactaacaacaaaatcaaaaaacaaaaaaacaatatacaccataaaatatcacacatcctaatacgattttgttgttctctctctctctctcttcatactcaaactcataacaactatctaaaaaaaccaatcaacaatcaacaaaaaaacaacaaaaataaaaataaaaaacaa

SEQ ID NO: 693123 - DNA, 237 bp, Homo sapiens
  misc_feature (205)..(205): n is a, c, g, or t
  misc_feature (220)..(220): n is a, c, g, or t
agtggagctcctgggtgcgtgtccagatgggaaaggcagggttgtatctgtggggacctgacaagggcaggggaagcggagaccagggtgcaggcaccgcccccacccaaggccgggcccagccagagaaagggcaggccagggcagcaggtttctgtatgtttgataggtttggctaggctctcttttgttttgttcataattnaaaacaccttaatcncccgtcttacaaaaaaa

SEQ ID NO: 693124 - DNA, 394 bp, Homo sapiens
taaaaccctagcccaggggctggagcaggaaagggaccttcaaagtgaagactgccctgtcccccagctccttttgggttagattgaaacatgggcttcctaatgggtttaatcctttaaaacaaggagttgtgggggaagggtgtcgtgccctcctaaagaaaggtacacagttgcccggttgggaatgtgcttggccctgaccctgcgggcatttgactggttttccagctcaggaaaaagaattttaaaaaggcttagcgtgaaggggaatcaaaaaggaggttgtgatttggtccaaggggcctggtttagtgccggaaatgtcttattattttttttatataaatattttttggagtaaacattttaaataaacaacattgtttactga

SEQ ID NO: 693125 - DNA, 115 bp, Homo sapiens
aaatctgcggttcgagggcggatcctctctggcgtgtgaccaagatgaagatgcagagtaccattgtcatccgccgagactatctgcactacaaccgcagttgaaagacgcaggc

SEQ ID NO: 693126 - DNA, 358 bp, Homo sapiens
ccggtcgttctagaggatcccgaaaccctaatatacggatgactatggccctaccttgtctagcaagacacaaagaagtccctgctttccaaatttccaaatcccattcattcatgacatttagtgtggcttgtgagaagcctccctgccagctgtcgccattacctggaacaattaggtggaagtgtagggcagcatatcagcatcctgagcatacatatgtggtggcagcaggagacaggggacaggaaaggaagtagggggagggtgtcaattactcaggcagtttcttcttcatttttgaatagtcagctaggctgtggttccaagatgggactgtgctgcgtaattagggtta

SEQ ID NO: 693127 - DNA, 123 bp, Homo sapiens
acctccagttaggagacaggccatgcctttcaagatgcatgcagctgactgattatcatcctcaagatttccgcactgctgcccaccacaagtatgtccgacaagcctggcagaaggcagact

SEQ ID NO: 693128 - DNA, 595 bp, Homo sapiens
agcgggcgaggccttgcatccagagtcagtgtggtcagtattcgcaaactctccagactcatctcttctacgctgctctaacactgaaggtcgacacaggaaagtcgataatgattcaaacacacagtttgagaccctaagcctatggagtgcaatccctatcttgtggacatttgaaaagtcaaatagcctgaacatggcgggggttgtcctggacagttctccgtgatctgcagattcacggtgcacacctttctatatctttgcctcttgtgcctagttaagtgggaatgtgtgtggagataggggaaatcacataagctggtacgaagtatggagtaattgcttacccagtgcctggtggaagtctgatagcgtctctgcacgtgacctctgactaagcccatcccaggagacggggtgaagctattccccacactctcctgtgaacactggagtcttgcagagaccagggagaacccacgtgctatttcccaggaggctccaggacttaggaaatgtgtgtattgtagtgaaacaataggatcgtagtgacatatagttactatttcatgacaagtagatctttctagaa

SEQ ID NO: 693129 - DNA, 95 bp, Homo sapiens
tcgatacgactttctttctttctttctttctttctttctttctgtctgtctttctcttcctcccttcccttcccttcccttctgtcgtcttctcg

SEQ ID NO: 693130 - DNA, 306 bp, Homo sapiens
cgttgatgcctggcgcactatactatagttccgcaggggaaatgatgaaaaattataaccaagcacaatatagcaaggactaatacccctataccttctgcatcatgaatttaatctagaattaactttgcaaggatagccaaagcttataccccctaatccagacgagctacctaagaactgcttagagagcacacccgtctattttgcacaatagctgggaagattcataggtagaggcgacgaacctaccgagcctggtcatagcttgttctctctgctattaatttctaagttcaactttaa

SEQ ID NO: 693131 - DNA, 180 bp, Homo sapiens
atgctgaatctgatagtgaccgaagcggcagtgcaggtggcagattcagagcggcgtatctcaagctccgggccataggccctcttccccattacttttgctattcaggctccgagataagatatcatgacgatcaaagataatggtaggagactgtgtgttgaactgtaaaatcttgga

SEQ ID NO: 693132 - DNA, 182 bp, Homo sapiens
cacgtagggcttcttctgtgtggacgaggggaggctgccccacacccagaggctgctggaggtcatctccgtgtgtgatatgccccagagtgccgtttctatggccgccactccgccaacgactgctgaccgcaggaccgctgcccagtggacctgcatcgtatgggaggaccgggacacca

SEQ ID NO: 693133 - DNA, 200 bp, Homo sapiens
tatctctcaggatcccccattcatggggcctggagttcagcagtacgagagacaggccactagtatacgctatattacagtgcaaaactccgagtccctagagtaaggcagtcatgctgtttgccttatgatgtgatcttgcttgggcttcatggaacgtggttggtctcttgcctttcagctagaaactgaatagatca

SEQ ID NO: 693134 - DNA, 791 bp, Homo sapiens
aatatgcataggttgggctggggtataaatgaaaggagtgtgtctctctgctaccaggagatcatggcaggctcactggtaagcgatgcacgtgcctcctgagagaagcatgctcgtctggcccctgcacatggtccagttggccgagctgatgacttgcctgggtatgcccataagactctgagcttcctcagcacacctcacccatttcccagctcccaggttccttgatggagcctggtggagaagtgaactgagcatctactccctacatagagaatgcaggtggaccacctcatcaatgaaggccacaatggccagaggagctcctggagctacgttggtggcagtcactgacttgggcagcaatcaatgcagcaagtggtacttatccggctctctcacttgctgtctgaagaagccagaagatagaggcttgctcatacaggatgcccactttcatcaacttctctgtcatgctcaacagtcagatagcctcggtctggcatgtgtaccctctcgaagctgcttggagaagcctgtatgctcttgggcatccccaaggactccaatggagctgcagtcaggtggacgcaggaggtccgctggcgcatgcggaaagatcaatgtacaagcacctgggccttcctggcagaagtcctgtgccaacctactcacaggagcacgactcgcaggaagctgatggatgagatgtcaaaaactggcaaggctgtggacgaattgaggatccacacattagtggcggtcttgttacggtggcacctcttcgg

SEQ ID NO: 693135 - DNA, 943 bp, Homo sapiens
aatggatagataagatagtattctaaattcaaattcgtggctaggcacagtggcccacacctgtaatcccagcacttgggattccaagacagaagactcacttgagtacagtatgagaccagcctgggcaacatagatcttgcctctacaaaaaaaaaaaaaaaatagccaggtgtggcaatgcctgtagtctcagctgctgggaaggctgaaatgagaggatctcttgagcccaggaggtctaggccagagtgagctggtgatcgtgccattggcactccagactggagtgacagagtgagactggtgtctaacaaaaaaagttggatttacaacaaaaaaaaaaaaatgtcgcttgtgcaggggggctcatgcctgtggaccccagcacttccggagggccaacagggggtgggataacctgttgaggctcagggagtttggaaaccagcctgttgaccacacgtgggctgaacgcctccgttccctaagtaacaactatcaaaatattttacccctgtggactatagcgggcgcatgctgtgataaaccccggctaactgggagaggcttgaggcaggagaatccctttggaccccgggaagggccaagggtttgacgtgacgctgagattgtgccactgcatacagctggggcacacattgagcacaatctctccatctctaagataccccacagaccaaaacacaaactccaatttgcattgtaagatcgggcacctaggattcagttcctgaaacgtctttgtcacaattaagggcaaatacttataacgccaaatgtacctcggcgtctgcacacttttaccacttgtctttggccaaagggtatgctttaccaccggggaggtcgtcagccaccaatgtgctcttaacttagcaaccatgacctcgccggtctagaaaacgcattgtttcccacc

SEQ ID NO: 693136 - DNA, 601 bp, Homo sapiens
  misc_feature (179)..(179): n is a, c, g, or t
  misc_feature (192)..(192): n is a, c, g, or t
gagatcccggcagatacactcaaacgggaagttcagccacgtaacatagtgcacatgtatgatggcgcgtggctgcattcctctgtgtccagactatctctcccacttggctgtccaccctcggctggtcaagttaccggcagtgctgcgaggagtgggtctgtgacgaggatagtatncaggaccccatgnaggaccaggacggcctccttggcaaggagctgggattcggtgcctccgaggtggagttgacgagaaacaatgaattgattgcagttggaaaaggcagctcactgaagcggctccctgtttttggaatggagcctcgcatcctatacaaccctttacaaggccagaaatgtattgttcaaacaacttcatggtcccagtgctcaaagacctgtggaactggtatctccacacgagttaccagtgacaaccctgagtgccgccttgtgaaagaaacccggatttgtgaggtgcggccttgtggacagccagtgtacagcagcctgaaaaagggcagaaatgcagcaagaccaagaaatccccgaaccagtcaggtttacttacgctggatgtttgagtgtgatactgggcg

SEQ ID NO: 693137 - DNA, 853 bp, Homo sapiens
gtttctggtgactgcgggtgcacaccccccaaggtggtgcgcgcgccacaggtagcaccgtcgagctcaaccattcgcagtgtgctcacagcacttgtgatagtagcgtcattacgtcccggacgccgcgtgccttggtcgagcgttgaaagccaggtgcacgtggactctcgggcccgagggttcagcatcggaccccgaactctcctagccatgcgattgcctcgaccttcgtcgggctcgcgacgacgcattgcaggatcgctactccggtgctatgcgtcgcagttcgctccagcggtcgtggagtccctcggtagtaaccctggaacctcggagctggttagctagttggggtcagagcttaggtgcgcgcgcccctctagtgccgaggcttctctacgttgtgtgcccagaaggggctctgtgaggcgcccgctcggcttccgggccgtcctgaggttgcgtaggagcttgagcagtgagtgccgaggtctgcgtccacgacctatcgggctggtgtgcgtccccgctggcgtagcggccacgggcctgcggagcgggccggaatgcctgggccggatgggttggaggctgggctgggggctgggtgaccacccctgtgtggccccatgagacgagatcacccacccattgaccttcgtagcattgggtagaagaacatgggcggctctacaatcgtaacgacgctgcgagacaagggtcggtcgcaccacggggcgcagaattaggttggagcttgggctacatgtgtaatctacattgtacgccacgaagggtgtaggatcttggggggcgttggtccgcctttagaggttgctaggtacctagg

SEQ ID NO: 693138 - DNA, 110 bp, Homo sapiens
tcgcgcagtcaggcggccagtggtctacatcatcttctcatacacagttaatagacatgtccacttttttgacagtttctaaattacatatttaaaaatgtgtcttttcc

SEQ ID NO: 693139 - DNA, 231 bp, Homo sapiens
cttaaaacaagcctgacgataatgatgcccatggtgcacagcagcccagcgcagataagcccgccaaactgaaggctgtgccagtcatagtagacaggactgataaaatcatccaggtcatataggcgtccaggacaggaaagcctgccaggaacacaagcaggcccagggtcaacttctgcatgtcagagcgctggcctgtgtggtacaccaggctggagcagaggtacc

SEQ ID NO: 693140 - DNA, 489 bp, Homo sapiens
  misc_feature (41)..(41): n is a, c, g, or t
  misc_feature (72)..(72): n is a, c, g, or t
  misc_feature (103)..(103): n is a, c, g, or t
  misc_feature (111)..(111): n is a, c, g, or t
  misc_feature (135)..(135): n is a, c, g, or t
  misc_feature (173)..(173): n is a, c, g, or t
  misc_feature (187)..(187): n is a, c, g, or t
  misc_feature (247)..(247): n is a, c, g, or t
  misc_feature (305)..(305): n is a, c, g, or t
gggcatctcacccccccagttcaccccataccccatgcctnctatcatattcctatagtcccaccaccaaantggtcttgtatgattctccctttctgtttcngattatangttccagttcagacctctctgccngattttaagtaaactccgatttctcccttagtgaaggntatggtgctggtcntcttgttctgtgttcttccaaatctggtgcttccagtgccctcaacatggccttagatgntgggggacctgggagggggagaccactgatatggtggaacatcatggaataccaggantgcgttgaattaaatcatgtgaactcatattttattaatgcaacatgattaaattataagaaacgaggccaggtgcagtgccttacgcctgtaatcccagcactttgggaggccaaggtgggcggatcacgaggtcaggagatcgagaccatcctggctaacacggtgaaaccccgtctctact

SEQ ID NO: 693141 - DNA, 221 bp, Homo sapiens
cttagtcatcagataccgtgcgtagattagcgctcattccagtcactcagcatcaagagaatcaagctgcaggacagtcacaatgcgtgtcttggtctctaacgatagtgggcactgcggctgtctccttcaagtgttctccctattggttctgattagaattcgtgctcttgggacattgctgttaccatcatttatggggcgccatcttcctgatgcta

SEQ ID NO: 693142 - DNA, 187 bp, Homo sapiens
cctctgtgggaatgcagcccgctctgctgactgctgctagagccagcaactccactaaggtggataaaacatcaaggtgcctgcatgggcccataccacatatagcccatatgttccttgcgctgaaaaaatggcagggccccaaggaattcgtgactaaacgttatgctcctttgactccaaggaa

SEQ ID NO: 693143 - DNA, 865 bp, Homo sapiens
  misc_feature (574)..(574): n is a, c, g, or t
ctggccgacacgtgggggccccgcggtgggagtgttgctccacaagataggtagatggtgggccgatctgaccgaggtgccttcttggttatgaagcccgagtgagtgcacgcagtgaggggctatgtatcctgcgttctcatgggttgcgaaccgtctgatttcacccgccgtgggccctcttctgacaagaaatgctcgtggcttcacacccaccgggctcgtggttcacgcacagtaattctggggtcggaaaccaccgctctccgtttggtcctagagcactaatttgcaaccattctaatcccgcgcgcgccaagagcgggaggcgaggacaacccgcccgttggcaaactcgccgccgccgagcttggagggcgagcgacctgagcgcgagcgcgcgagggaggactctcgctcgctggacaccacggggcgtcgcgcgcgcgggggcttgacctcgataggcgatggcagaagtcacgcgccccgcctcgagatgtagctcgccgcggcacgcgcggggccacaccccatgggggagacctccccacgacatcggtctcacaaaaangaaaacaaaagcgcgacagagcgtttctaccacacgcagagtatgatcccgcgggcgtgtattatattaatccagtagactggtcccagacgtgcgtagaataaaaaagagatggaggccttctaacaactgtggcagcaaaatccttctttctgttagtaacaatggcgaggaatacaaaatacatattaggtttaggtgtttacgatacaacacgacccgagagagaatcctgttttccgccgacaggatgatagtctaacaaaaaagcaacccccggccacacatgac

SEQ ID NO: 693144 - DNA, 536 bp, Homo sapiens
aagtcccttccacctgtgagcctgtaaaaccaaaagcaagttagttattttctagatacacagggatacaagctttgggtaaatacactcgtttcaaatgggagaaattggccaaagcgaaagagctacaggccccatgcaagtccaaaacccagcaggcaaatcttagagctccaaaatgacctcctttgactccatgtgtcacatctaggtgatgcaagaagtgggttcccagggtcttgggcagccccgcccctgtggctttgcagggtacggcccccccttctggctgcattgagtgtctgcagcttttccaggcacacagtgcaagctgtcagtggatctaccattctggggtctggaggatggtggcccctttgtgacagatctgctttgcagtaccccagtggggactctgtgtgggggctccaaccccatatatccctttgacactgcccctacagaggtattcatgagggccccccgcttccgtgcacaacaaacttttgcctggattccaaggcatttcatacatt

SEQ ID NO: 693145 - DNA, 912 bp, Homo sapiens
agcggaagtcgaggccgccgccgcggggcctggttatcgccggttcagcgcagcccggagtcgcccaggcctgaactcctacccagcctagactcaagtctgggtttcagctgccgccagccctattgctgctgttgctgttctctgtccttggcccaggggctgcgaccgagctcttccacttccactgttcctgaggagcacattcctggcgtgtgttgggaacctcatcatcttcacagggggccgcggggggagactctttggggaccccctgtgcccagaaccacaagtgttgagctgtgtgatttccgcgtgccggggggcgaccccccctgtgtcatctcatcccccctgtgatatcacactttcccacggggacacacgcgtgttgtccctgggggtgtttctctacctgtagcacctctagacgtgtgagcactggtgccaaaccgcgacctctaggcgactcttttaaccgtctagcgagcgcccctttacctgtggggactggtgtctttgtgcgtggtgccacacttctcccaggcgccacggcgcacaatctctggtcacagggtgctcccggagtgagtgtctacgtatcctctcttcaagccgcgagctgagttgtgccgcgcgtgtgcgtggacgtctgctgtgcgtggttcctggccgggcctcagagcaaaacctcttcccacacaatcgcgtcagccctgtacacagggtctttgtgcccagcttcacttacacgggtttcagcacagctggtgtgtgtgggggggcggggggggtatctgccttgggcccctgtcactgcggtctgcgtccccaaagccccaaccctgtacaactcaaagctctgtggctgtggaggtgctcaggatgccagctggagctggcactgtcccc

SEQ ID NO: 693146 - DNA, 901 bp, Homo sapiens
tcccttaaagatccaaagatggtgaaaggaaaagactcatatcaacattgtcgtcattggacacgtagattcgcggcaagtccaccacatactggccatctgatctataacatgcggtgtgcatcggatcaacatgaaccattgaaacactttgagcaaggaggctgcctgagactgggcaaagggctccttcacagtatgcctgggctcttggactaaactgaaatcctgacgcgtgaacgtgggtatcatccatttgactatctcctttggtggagaatttgatgaccagtaaaggtacctatgctgacgtatcagttgattgcctccagtgacacgagagacttctatcgaagaacatgatttacagcggcacactctcacgggcctgcactgctgcatgctcgctgaatcagcttgcctgcctgcgctgctccggctgacactactagcacagcctgtgctaatcataccaacgcaactggcgcacgcaccccgagcagcattgccgcattcctggcgttacgacacctggcgctgttggacaacaacgtacactgtgctcagcggtgccttcacccacacaatgggacttcgcaccgtgacgcgcacacccctagcaggcccagaacaggacgacttactcgcgcggaacatgtgctctacagggcaacgcctcacagcagcttatagccacttgacacgaaagcaacttgcgcctcaccagaacccccgccggaaacaaacctaggataatgcgaatttgatggtggccccacaaccacaatccgtaggggctcgcagtaacattgcgctgaacccaaccaacctggccttgcagaaccccccacaaggttgcataaacacacatataccctttggggatcttcaaccgagggaa

SEQ ID NO: 693147 - DNA, 318 bp, Homo sapiens
ctgcctcataattaaggggaaaggcaaaattgaaagaccccctgtctttatctatcctgggggatgttggccccctagctactttttttttttcccttttgcccaaggggctttcctgatatgttccacatgccctctttgggtgataatggatatgccgtgatggggctcaggccccttaggggagggtctataagaactgcctatttatgctcctttacctccaggctgtcctctctaccctaatctagttgtcatccctccctcttttgggctgctggtggcccttaccaattaaagataaattttgttttatga

SEQ ID NO: 693148 - DNA, 909 bp, Homo sapiens
ataagcagtaaggctagtttaatcgacacgaggggtggatgacgccgtatgcaggggggggcccgggggccctggtgtggccctgggattgggaaccgcggtggcttccgcggaggttacggcagtggcatcggggccggggtcgcggcgtggacggtggccggggccgaggccagggagctcgcggaggcaaggccgaggataaggagtggatgcccgaacaccaagatagggacaattggtcaaaggacatgaagatcaagtccctggaggagatctatactcttctccctgcccattaaggaatcagagatcattgatttcttcctgggggcctctctcaaggatagaggttagaagataatgccagtgcagaagcagacccgtgacctggcagccgcacgcaggttcaaggcattagtatgctatcggggactacaatggccaagtcaggtctgggttgtaaaagttgctccaagtgatgtgtggccacacgcaatccgtgggggccatcatcctggccaagctctccatcgtccccgtgcgcagagagctactggtgtggaacacaagatcaggaaagcccccaaacttgtgccttgcaaggtgacaggcccgtgcggatctagtggctggtacagcctcatccctgtacccaggggcactggacatcggtaaacgcaccttgtgctaagaagatgctcatgatggctggtcatcgaatgactgtaacactcagcccgggggttgattgacacctgggaaatttcgacaaaggcaacctttgattgcatatatcaagactacagtaactgaacccccgactctaggaagagatgattacacagtttcctataaagagtcatggccactggaaagaccaacgagaattcgatggaaggaatcagg

SEQ ID NO: 693149 - DNA, 619 bp, Homo sapiens
  misc_feature (225)..(225): n is a, c, g, or t
aacgggattcttaaggaaaagccattaatgaggtaaaggaataaatagcatttcgggttggagagtctaagaaccgaatgttcataaatttaacgaagttatagtctaattaaaaactttgtttatgtaatggcacctcgtgccgaattcggcacgagctcgtgccgaattcggcacgaggagagagaactagtctcgagttttttttttttttgtttgtcaagncagtgtctcaaaagaaagaaaagaaaattcccataacaaactatttgtacagcaaaggccatgcttaagatgcagtggctccacaggaatgccatttacctgcaatgcttcgtatttctcatgtacatgacatacactaagtatcacaggatgaatggttttgaattgaaaatttcttggattaaagatatcttttacgaatgataatctccattgttgatttaattacttagtttctggtttggctaaagtaaaaacatcctctgaactatgtaactaaggcactctacaggctgtattcggttacattgcaataagttaccagtaaaatgcattaaaactcaagattaattttttcagataaattcaatattatctttcatttttatagttt

SEQ ID NO: 693150 - DNA, 673 bp, Homo sapiens
  misc_feature (225)..(225): n is a, c, g, or t
aacgggattcttaaggaaaagccattaatgaggtaaaggaataaatagcatttcgggttggagagtctaagaaccgaatgttcataaatttaacgaagttatagtctaattaaaaactttgtttatgtaatggcacctcgtgccgaattcggcacgagctcgtgccgaattcggcacgaggagagagaactagtctcgagttttttttttttttgtttgtcaagncagtgtctcaaaagaaagaaaagaaaattcccataacaaactatttgtacagcaaaggccatgcttaagatgcagtggctccacaggaatggtacagtctagttctttggtcagctgggggcatgcaggttaggtcaggagttttccatttacctgcaatgcttcgtatttctcatgtacatgacatacactaagtatcacaggatgaatggttttgaattgaaaatttcttggattaaagatatcttttacgaatgataatctccattgttgatttaattacttagtttctggtttggctaaagtaaaaacatcctctgaactatgtaactaaggcactctacaggctgtattcggttacattgcaataagttaccagtaaaatgcattaaaactcaagattaattttttcagataaattcaatattatctttcatttttatagttt

SEQ ID NO: 693151 - DNA, 265 bp, Homo sapiens
ccacgcggcgcctcacctctgccggcgcctagcagactacttataactggtgcagaccaagggaatccaacggcttaattaaaacaaaacatcatgaaagccctgcgcaggtgtctacacgatgtgattactaaccagagctctgcatgtcaaaacgaagaaagtcactgaaacgctgttaaacggcgggagtgactatgactctattaagggacccacatgcctggttgtataatatttgacgcgcatgaatgtatgatcgaga

SEQ ID NO: 693152 - DNA, 441 bp, Homo sapiens
cttttggagtctttgcggaatggatacgcacactgatccctgactatggccctaaggctgggactctagaaatctaattggaaggcggtagacagtttcagagactgagcaaagtgtgggtggagaataggtactgactggattctgtttctcagggatggggaacgtactctgcggacaatgaaccacaaccaacgccaccaaccaatactcataattaataattacaacagccctggtgcagaagacattgcaccatgaatgcactaagcatgcccgaaacctcatgcaaaaagtttaaaactgaggcgtctgcaggagctgacagggcagggaaaggcacacacaccaagatcaggtgaagtcagcactgagctaatgtcctgttccaggataagcttagttgggctgggtctgaaaggaggaaaccagcacttggaa

SEQ ID NO: 693153 - DNA, 414 bp, Homo sapiens
  misc_feature (168)..(169): n is a, c, g, or t
  misc_feature (318)..(318): n is a, c, g, or t
  misc_feature (363)..(363): n is a, c, g, or t
  misc_feature (387)..(387): n is a, c, g, or t
ttagaaatgcacacaaatattcacaagtgaaatgatatgacattgtggaggtatttcaattaatctggtggggagtgtagataaaacaaaagtagctgtgagtttattgttttggctgggttatgggcacgtgggggttaattatactattttcttaaaattttgtgnnaatttttaaatttatctttacaatttctaaagcaagagattcatagagtgagtaatcattatgcttcgggtataaataatggtagacctttgaaagcaaataaacaagtgggaaaatccactaagcacggatcactcatcccaaaatgnatctttttctttagtcactttgggcagcctcacttttgccagggncagatttagctattaaacatatgncccccctcagagtgtggcacatcaaca

SEQ ID NO: 693154 - DNA, 213 bp, Homo sapiens
ctcacagggacgcaaaaacgaggagtgattgaatttgtgtcttactctgatatgaaaagagctttggaaaagctggacggaactgaagtcaacggcagaaaaatcagattagttgaagacaagccaggttctaggcggcgccggtcttactccagaagccggagtcactcaaggcctcgctctcgaagcagacattcccggaagagcagaaac

SEQ ID NO: 693155 - DNA, 257 bp, Homo sapiens
aaacttgtgtatggactgcctgaccacctgcacagctgccagagcaaacttgccttgggatcagctgtctgggtctggggacccgggccctctatctgcaattcaactgcctcattagatgatctttacttttgtaaaacagtaaatagcaaccctcataattctcacccgagaattagaaaaagcctctgttcccaaaagcacttgggatcttcagggagagtctctggttacttaaatcgacctaacactgaatt

SEQ ID NO: 693156 - DNA, 323 bp, Homo sapiens
ctcccttgtccccggccctttaccctggttctgagtttacaaagtctcttccccattcccgttgagttttttcccacctttgaaattccctccctcccctccccagggctgagattgggggggggggatggctaagggcccctgacagtgaccttcctgtctcgggggggggggacagggccaggtagccccctgccccttatgtttacgtttgcagcccgaagcactttaatttttttttttttgggccgttcctgtaacttattttccaactattgcttccaactgaaataagactattaaatgcctgttcggggggggga

SEQ ID NO: 693157 - DNA, 821 bp, Homo sapiens
gtggagaccggcgagccggggaaccggtcgcgggtggagtccctgatcagagtcgccggtggttgggtgtcggtgcagacctgagggctggtttccttgactgtgggagaaactgcctgtgtgagcctggagtgacccgatggagggactccgcctcctgagctggctgagtgacccctggtgcagaggatgcctggctcgcagaattgcagagtctgtcgccccgtttttaccaacctggtcccgttttattctgccatacccagttttcggattttttgtcttcccgcattcttctctttgctaaactgaccacctccaagataatttttacaaaaaccttctcctttgctcacctttgcttcccagccttcccatccaaacacgcacgaacagcaacacacattcaaagaaccccagacgcatgggaacggtccagagctcgcccgcccacacagcagtcgagagcgtccgcgtccacacccgatactctccactccgatgcgagaagactcaggaaccccgagctcagcgcgctcaccctaacacagcaactcagcgacaacggacgaaggggcgagtctcccatcgaaatcactaacaaaagaaatcaatatagcacagactcccaacacaatcccacttatcatacccactgttcccactgcccccacacgagaccccccccccaccgccccacaccaccatcccctcgaaccacccccaccaacccacccaccaccccaaacccacaccctacagtcagcaccacatgacagcctctccgcaacacccaccacccccaccacctcccacacaaa

SEQ ID NO: 693158 - DNA, 1868 bp, Homo sapiens
  misc_feature (16)..(16): n is a, c, g, or t
agcgtggccgcctggngcccgcccgagctgccgccttgtcgagctgagtccgcgctcccgcccaggcggcggccgacgcgacgccccgagcgcccggccccgccgccgcggcccggcagactgcctctgtcaccgggtccctccacccttgtctcctgtgcggccagcgtcagagccatggcgacggaggagaagaagcccgagaccgaggccgccagagcacagccaaccccttcgtcatccgccactcagagcaagcctacacctgtgaagccaaactatgctctaaagttcacccttgctggccacaccaaagcagtgtcctccgtgaaattcagcccgaatggagagtggctggcaagttcatctgctgataaacttattaaaatttggggcgcgtatgatgggaaatttgagaaaaccatatctggtcacaagctgggaatatccgatgtagcctggtcgtcagattctaaccttcttgtttctgcctcagatgacaaaaccttgaagatatgggacgtgagctcgggcaagtgtctgaaaaccctgaagggacacagtaattatgtcttttgctgcaacttcaatccccagtccaaccttattgtctcaggatcctttgacgaaagcgtgaggatatgggatgtgaaaacagggaagtgcctcaagactttgccagctcactcggatccagtctcggccgttcattttaatcgtgatggatccttgatagtttcaagtagctatgatggtctctgtcgcatctgggacaccgcctcaggccagtgcctgaagacgctcatcgatgacgacaacccccccgtgtcttttgtgaagttctccccgaacggcaaatacatcctggccgccacgctggacaacactctgaagctctgggactacagcaaggggaagtgcctgaagacgtacactggccacaagaatgagaaatactgcatatttgccaatttctctgttactggtgggaagtggattgtgtctggctcagaggataaccttgtttacatctggaaccttcagacgaaagagattgtacagaaactacaaggccacacagatgtcgtgatctcaacagcttgtcacccaacagaaaacatcatcgcctctgctgcgctagaaaatgacaaaacaattaaactgtggaagagtgactgctaagtccctttgctcctgcccgcgagagactgtcgggaagttgacccggattggcaagaaacagggtgtcttggaggtggtcccccagatctgcgcctgggggtcaggacagggcctgatttgagcctcctctctgaagatgatttggccgagcggaaggtgtggaccaccggaaagttcttaaaagttgctggtgacatttcttgccaattctaacactgtctagggaagagttcctagtctattgtgttcaaacagagtcaacaaaagtttttaattttttattacagaagggtgaagttcaatttaacatgcgttgtgttttttcagtaaacgttctgtatctttttgatattccatgacccagtgcacgctgtggcctgtcaccgccaccgtggccccgccagctggcctcccctttggcccacgccggccgcccccattctctgctgcgtagatgccctggcccagggccctgactcctccattcccgccagtagctgttcctagtgtattttcgtctttctggaaaacagcattgagtggttgttttctgtgtaaagagccgtttgtgtcttgggagtttgtggcccacatgccgatagcacggtcatcgcacatgactctcccgtttgtctcagtgtccctgcaacaagcagcaccgcagactgtaataaaaggtggggttt

SEQ ID NO: 693159 - DNA, 699 bp, Homo sapiens
  misc_feature (295)..(295): n is a, c, g, or t
  misc_feature (506)..(506): n is a, c, g, or t
  misc_feature (538)..(538): n is a, c, g, or t
cagacactttgcttttcttccaggacatactgtcctcatggaacttatgttctggtgagaaaaactgataatggagaactaagcgaatatgtaaattccttatacatcatgagtaaatagtgggaagaaactaaacagggagctgtgatagagaataatgggcatatattgaacttaagtggtcaggaaaggcctctgtaagggaggtgactgagacctaaagaatgagaacaagctatctctctgcactatcaggggaagaatgtttcaggcagaaggaacagtaagggcaaangtaaccttagcaaaatactttgtgtccctactatgtgctaggcattttgcatgataatcttttatcaattaatttttcagttgagaaccttggcttaccatgcaaccagcctaaggtcctagagcatgtcaacttgtggtggaacgtggttggaactcagacatgcttgtgctatatactgccttccaaattgcttgagattgaaatatcnttccttctttctttttttcaatagtaggcctnctaataagcttaggtacacgaaattggagaactctggtatacaaggaattataacagaattagaattactgctgtcatcttagagtttcaaatagtagagaggtagatatttttacagctttatttactttttcaggaacttatatactgcatcttagatc

SEQ ID NO: 693160 - DNA, 1050 bp, Homo sapiens
ccaactccagttctttcccctggagcagagcctggaacctaagcccttcccatctctgtcaccgttctcaagatccctgccggcgacattatagagcctgcagttccagtcttgagagtccttcagagcctcgatgccacgtacggctgcgactgcagtgtgactcaacgtctgagatggccgccaaggaaccgagctcacgtcgttggacagaatttacatctcgaatccagaagctttgttatggactcacattatggatttatgtagatcctgctctagatcaccgatgaaagtagatccgaaggtcttgctacagctgggggtcaccactagtggaactagatgactttggcatgcgtgaaagcagctgcgaatctgtgactacctaagcaccctgactatgctatcctggtagccaggatcgctgtctctaacttgcacaaagaaacaaagaaagtgttcagtgatgtgatggaagacctctataacgtacataaatccacataatggcaaagcactctcccatggtggccaagtcaacattggatattgttctggccaagtaaagatcgcctgaattctgctattatctatgaccgagatttctcttacaattacttcggcttaaagacgctagagcggtcttatatgtagaagatcaagtggaaaaagtggctgagagaccgaaagatatgatgatgagagtatctgtagggatccaaaaagaagacatcgatgcagggattgaaaccatataatctctttctgagaaggtggtatacctaatgcgtacggcacagtctcataaaattgtgggtaccaacggccacaacattataagctgattacttctgagtatgaaccgaactgcacaggagtgacaggacagtaggaccaccataagcaatggtcaatagaattgcaaggacggcggacaacaacggcggatagaccgcgagaagcaaccggcacacgggcaacacacacggcggacccaaggaaagccaaaggccgtgccccgagcaacacaaaacacagcacgaacat

SEQ ID NO: 693161 - DNA, 1777 bp, Homo sapiens
gctccctgttctgcatctcgctcaacagactgcctctgtcaccgggtccctccacccttgtctcctgtgcggccagcgtcagagccatggcgacggaggagaagaagcccgagaccgaggccgccagagcacagccaaccccttcgtcatccgccactcagagcaagcctacacctgtgaagccaaactatgctctaaagttcacccttgctggccacaccaaagcagtgtcctccgtgaaattcagcccgaatggagagtggctggcaagttcatctgctgataaacttattaaaatttggggcgcgtatgatgggaaatttgagaaaaccatatctggtcacaagctgggaatatccgatgtagcctggtcgtcagattctaaccttcttgtttctgcctcagatgacaaaaccttgaagatatgggacgtgagctcgggcaagtgtctgaaaaccctgaagggacacagtaattatgtcttttgctgcaacttcaatccccagtccaaccttattgtctcaggatcctttgacgaaagcgtgaggatatgggatgtgaaaacagggaagtgcctcaagactttgccagctcactcggatccagtctcggccgttcattttaatcgtgatggatccttgatagtttcaagtagctatgatggtctctgtcgcatctgggacaccgcctcaggccagtgcctgaagacgctcatcgatgacgacaacccccccgtgtcttttgtgaagttctccccgaacggcaaatacatcctggccgccacgctggacaacactctgaagctctgggactacagcaaggggaagtgcctgaagacgtacactggccacaagaatgagaaatactgcatatttgccaatttctctgttactggtgggaagtggattgtgtctggctcagaggataaccttgtttacatctggaaccttcagacgaaagagattgtacagaaactacaaggccacacagatgtcgtgatctcaacagcttgtcacccaacagaaaacatcatcgcctctgctgcgctagaaaatgacaaaacaattaaactgtggaagagtgactgctaagtccctttgctcctgcccgcgagagactgtcgggaagttgacccggattggcaagaaacagggtgtcttggaggtggtcccccagatctgcgcctgggggtcaggacagggcctgatttgagcctcctctctgaagatgatttggccgagcggaaggtgtggaccaccggaaagttcttaaaagttgctggtgacatttcttgccaattctaacactgtctagggaagagttcctagtctattgtgttcaaacagagtcaacaaaagtttttaattttttattacagaagggtgaagttcaatttaacatgcgttgtgttttttcagtaaacgttctgtatctttttgatattccatgacccagtgcacgctgtggcctgtcaccgccaccgtggccccgccagctggcctcccctttggcccacgccggccgcccccattctctgctgcgtagatgccctggcccagggccctgactcctccattcccgccagtagctgttcctagtgtattttcgtctttctggaaaacagcattgagtggttgttttctgtgtaaagagccgtttgtgtcttgggagtttgtggcccacatgccgatagcacggtcatcgcacatgactctcccgtttgtctcagtgtccctgcaacaagcagcaccgcagactgtaataaaaggtggggttt

SEQ ID NO: 693162 - DNA, 338 bp, Homo sapiens
tagctggcaactccatatctgtccagagcctgagctgattgatctgatctactagtggtcaggaagctaaaagatgaccagacactatgacttctatgagcattcaaactgggtccactgtccatgttctgcgaaagtactggcctgaacctgatcagaaaccggaacctgtggacaaagtggctgccatgagatatgtaccgggtgtaagcacactgacctgcacaagcagctcctcttacacggaggacggactttacgatagctcagcaataaaggagtcctctggctccgatccaagtggccaacccaggcctacagcagtgaccctaattgct

SEQ ID NO: 693163 - DNA, 475 bp, Homo sapiens
  misc_feature (157)..(157): n is a, c, g, or t
  misc_feature (180)..(180): n is a, c, g, or t
  misc_feature (375)..(375): n is a, c, g, or t
tcattagcagattggttttatttgataaacatctttccagtccttacttgagtcctatgttaaaaaacatacaggagtttgtgcctatgacagacgtgatgcacggggacacacaggccaggcgaatgctctcatcacgcttgccattctcactctntggggtgcctttctggtggtttncatctatgggaaaccatgcacaggtggggtctatctgtgtcatttaggaaaacaagctgtgtggcacatcctggcacatcctgctcttcagcccatgaaggaagctctcaaaacactgcggtggggtaaggtgttggcagtgtggattcaccgtcccagcaaggagctaccttagggtcaaggatgagttctganaaataggagaaaagaaagactcagtgaagaggagaatcaggtatggttacccagaggaagggcagaggatgctgaatcccagtagagtgatgcccgctcc

SEQ ID NO: 693164 - DNA, 5583 bp, Homo sapiens
  misc_feature (16)..(16): n is a, c, g, or t
agcgtggccgcctggngcccgcccgagctgccgccttgtcgagctgagtccgcgctcccgcccaggcggcggccgacgcgacgccccgagcgcccggccccgccgccgcggcccggcagactgcctctgtcaccgggtccctccacccttgtctcctgtgcggccagcgtcagagccatggcgacggaggagaagaagcccgagaccgaggccgccagagcacagccaaccccttcgtcatccgccactcagagcaagcctacacctgtgaagccaaactatgctctaaagttcacccttgctggccacaccaaagcagtgtcctccgtgaaattcagcccgaatggagagtggctggcaagttcatctgctgataaacttattaaaatttggggcgcgtatgatgggaaatttgagaaaaccatatctggtcacaagctgggaatatccgatgtagcctggtcgtcagattctaaccttcttgtttctgcctcagatgacaaaaccttgaagatatgggacgtgagctcgggcaagtgtctgaaaaccctgaagggacacagtaattatgtcttttgctgcaacttcaatccccagtccaaccttattgtctcaggatcctttgacgaaagcgtgaggatatgggatgtgaaaacagggaagtgcctcaagactttgccagctcactcggatccagtctcggccgttcattttaatcgtgatggatccttgatagtttcaagtagctatgatggtctctgtcgcatctgggacaccgcctcaggccagtgcctgaagacgctcatcgatgacgacaacccccccgtgtcttttgtgaagttctccccgaacggcaaatacatcctggccgccacgctggacaagtgagtactgcgtgggactgtgggggcgggcatgtggcctccccagccagagacacctgcgtgccagcgtgagcctttggagagcgtgttgtgggcttggcacgggatccaggctcctggtggagcttcggcttctgggcagtggcctgttaggtcggagggcaggcccccgtccatcccttcccgaggctgaacctcaggtccgactataggaggatttagggtccgttttctggttgagcaactgtggccagggcaggcctagccatcccgcatgaaggagtcggcggtccgggggcctccaaggccctttctggttctgacctctgagcatcttgattttacctctcacaaagccactgccctcctgggctgttctctaagctccagctttcccatgcgtgcaccctcagccctgtgggtccgagcctgggccctgatcctctgagggctgtgtggttgggtggtaaaacctgttctggatgtttccagaaccaagaggacttcctcacccttttgaggatgacccgagtcagggacgataacacccatcagcttcctgttaaagtctctcttggaactacaaatacttgcggctgtcacactgtgctctcagacgccaagtcactggactttgagcctgaggggctccttaccctgatggggaagggggttccagccccgctggcttttgcacctggcgctgatggtggctgtgacgtagtggctgcagagttgggtgtggggacagaaggatgcctccagacatgccgcctcacccctctctctgtcttgcagcactctgaagctctgggactacagcaaggggaaggtgagcccccgcaggcttgggcccccatggtgcaccatccctgggtcatggcctctggtggggacagagctggccccggtgatgacaaaggagaggagctcagagagccatctccgctgggtttggtgcgaattcctgaaagacctgggtatttgtagggtggcagtctgcaagttaaatcttcgattgtgtgggtttggtacttgtacttttcagaaataagtgaagtgagtagtgaaacgccttgcttagaacgtagaattacacaaaatcaaggggaaccatgactctgtgaccagcctgtcccctcctgtttcagtgcctgaagacgtacactggccacaagaatgagaaatactgcatatttgccaatttctctgttactggtgggaagtggattgtgtctggctcagaggataaccttgtttacatctggaaccttcagacgaaagagattgtacagaaactacaaggccacacaggtgagggcctgcgctcctgcagtcactggctgcctgttgatgtgaggacagttcctgcaggtgaagcgtggtgtgcccgtagggtgctgtcgtcttccccttcccacctcagccctccgctggccccgctgaggaaccgctgctaagagctcttgcccaaggcatggagctggtcactgtgctgccgactcagacccgggctcctggcttgaaccctgtttctccctgttctgccaggcatgctggtccggaaggtgtgtgtggctgtgggactttaggtgggtgcagcccgtcccacgtcacggcgagctctgtttcctgggctggggacagtgaggtcatcgctgccccatcctggaggctctggctcctttcgggtacctgttccctctcccagagagaccccccagctgcatgcaggcctagtgggctccacggcggagctggttcccaggctacctggggttgccacctctgtgggtcccggctgccctctgcagccgccgctacttcctcaccctctggccctgcatttccacgtctcatggagccaacgagagcagggggttcgagcccttgtggaaatctggggaggcactgcttctccctccatgtgagcagcttcacccagcctggggtcagtgcttacgctccacggcgggcctgggccttcccctgggtcctcgccggcgttctggggttctttggtttacgtagaagctgtaaacactttgatgtggccgaccttgcaccaccagtctgttagttctgacctccctgcttgggtggtggacttgtccttgctgtgacagagccagccctgtggggtgctctggggcttagcattggggggaggcggtgggagtgggcggctcagggtccgaggagaagagggacattgtcgataaaggactgaggactgtgaggggtctgactgcagtccttgtgcgcgccagcctctgagccagtcctgctgccgcgctcctccttgtgggcgccgagctgctgttggtgggggcgtgtggggctcctggtctgcaggcagggctggcactccctgtggcctcctgcccctgtcccccaaccggctgtgtcgccctggtaccggctgctgtcccctcgctcccctcccctgggctccctgtgtcgaaggtgggcagtgggtgcttgtcctgtgacctcccaggtggcgggcaggcgctacccgcgtttctggagaaaggtggagctcagtctgggatggcgtccccgacccaggcgcagggatggctctggttctgactgtgtctttgttttcagatgtcgtgatctcaacagcttgtcacccaacagaaaacatcatcgcctctgctgcgctagaaaatgacaaaacaattaaactgtggaagagtgactgctaagtccctttgctcctgcccgcgagagactgtcgggaagttgacccggattggcaagaaacagggtgtcttggaggtggtcccccagatctgcgcctgggggtcaggacagggcctgatttgagcctcctctctgaagatgatttggccgagcggaaggtgtggaccaccggaaagttcttaaaagttgctggtgacatttcttgccaattctaacactgtctagggaagagttcctagtctattgtgttcaaacagagtcaacaaaagtttttaattttttattacagaagggtgaagttcaatttaacatgcgttgtgttttttcagtaaacgttctgtatctttttgatattccatgacccagtgcacgctgtggcctgtcaccgccaccgtggccccgccagctggcctcccctttggcccacgccggccgcccccattctctgctgcgtagatgccctggcccagggccctgactcctccattcccgccagtagctgttcctagtgtattttcgtctttctggaaaacagcattgagtggttgttttctgtgtaaagagccgtttgtgtcttgggagtttgtggcccacatgccgatagcacggtcatcgcacatgactctcccgtttgtctcagtgtccctgcaacaagcagcaccgcagactgtaataaaaggtggggttttgtgaatggttgtggcaagtgcgtccttgtgaagctcgtctccatgtggctttcttggagaaaggctcccctggggcaagagggtggaaggtttctttggacaggaggtgctgaggctggctgcacctgctctctgaagacgccttcctctctaggttcattgttcagtgttgctggaggcggggaacgggggtggggaggttcttagttgcgaaggagccaagctcctgatggacttgcgttgggatgtgggggacacctgtggcatggtaaggctccctgagtcccttactccaggtcagatgccagtgggactcatgcgccctatgagggctgcagggccagtgctgcccctcggactcctcgaggggttgggtgctaagcgcgagcctcgccgtccctgctggagccctcgcctgcctgcccctctgcctgtgctcctggcactgtggcttcccggtgctcacctgcacagcagttaacagcagaggccgagcgggagcctctggggagcgaggctgaaacctgaacctgcccatggagacagttgtggtgagggttgccacacacagtgagggcggagcagggtggctgagggcacaggtgcctgggtctgtcccacggggcagggctttggggctgtgatgctctgggaagccagcttgggtcctgggtctacagagggccctggccccggagcccagccagctctgcctctctcagggcctggagtcctgggggagctcagccagctctgcctttctcagggcctggagtcctggatgaatcctgcaggtttttggttgcaccggcccagggaggaagcggggggtttgtcaggtgggctctcctggaggtcctcgagtggcaggggtgaggaggggattatctgaggcatctggagatgtatatcctgtggtttcccctgcccctctgtttccgatgaggtgtacggatgagtgacctgcactaagaagtgagttgccacagtgaaaatgggttggtttttgtcttcgacgctcagggtctgggcgcctcgcatttgcagtctgttgtgacagacacggggagctccgcgtgccagcctgtggctgccctgctgtgggggtcctggggccggcgaggccccttcagtcttgttctggggggacggcccactccggggagggggtgtgctgtgctgagcgctgtatccctgaatatagtttattttttctacatttgaattctgttgtagatttatgtaaaaatacattctttttgaaaataaaaattttcatgtcttctaaaaaaaaaaaa

SEQ ID NO: 693165 - DNA, 6363 bp, Homo sapiens
cggaatgcggtcaccagctccggtaaccgttggttcctgggcattgccccggccaattcggctgcctccacgtttcccgaatcaactgccatcggaattccgctgcccccaaagctctggactggccatgaaggggccaagtgctttccgggctgcctgcttcgaggacaccagcactcctgccacgggccattcgtccatcgcatgccagtggccctccctcctcagggttcggcagtccactccaaggctctaagaagtgaagcaggcggcgagaatgtgcagtcgttgaggccagaggaccgggcctcagcttctccttaagcccctgagtcctcctctggggaccacccccttgtacctggaggtgaaaatgcccgcccaggagggaagggctggcccccggagagcccgctgcgaagtgagtttgcgcactgcggagcgggcgcgggtgactccagagcggccctgccagtccgcggggctggcggggagcaggttcgtgcaccgcgggctctgtgcatgcagaggcgggaagagcccccagcccggcagccggccccgcgggaaggcgcagcccgggcttccgaaccctgtgaacgcgcaggttcctggtcttccagatgggcaggaatcgtcctgcccgcccggggtgggaggccacatgggggcactgcgcccgggcgcggccccaggtgctttccaaatgcccactgccgctctcatccgtaccagcgatgatcaagaaggggcctggtcgcccggggaggtgccccggcccgaatcgactccggagacaacgccgggcgacgccacctgcgcaggtcccggaggccgctggtgtctgtgtacagggcgtgctgtctgtggaaacgcgagggcacactagcactttccagactgcctctgtcaccgggtccctccacccttgtctcctgtgcggccagcgtcagagccatggcgacggaggagaagaagcccgagaccgaggccgccagagcacagccaaccccttcgtcatccgccactcagagcaagcctacacctgtgaagccaaactatgctctaaagttcacccttgctggccacaccaaagcagtgtcctccgtgaaattcagcccgaatggagagtggctggcaagttcatctgctgataaacttattaaaatttggggcgcgtatgatgggaaatttgagaaaaccatatctggtcacaagctgggaatatccgatgtagcctggtcgtcagattctaaccttcttgtttctgcctcagatgacaaaaccttgaagatatgggacgtgagctcgggcaagtgtctgaaaaccctgaagggacacagtaattatgtcttttgctgcaacttcaatccccagtccaaccttattgtctcaggatcctttgacgaaagcgtgaggatatgggatgtgaaaacagggaagtgcctcaagactttgccagctcactcggatccagtctcggccgttcattttaatcgtgatggatccttgatagtttcaagtagctatgatggtctctgtcgcatctgggacaccgcctcaggccagtgcctgaagacgctcatcgatgacgacaacccccccgtgtcttttgtgaagttctccccgaacggcaaatacatcctggccgccacgctggacaagtgagtactgcgtgggactgtgggggcgggcatgtggcctccccagccagagacacctgcgtgccagcgtgagcctttggagagcgtgttgtgggcttggcacgggatccaggctcctggtggagcttcggcttctgggcagtggcctgttaggtcggagggcaggcccccgtccatcccttcccgaggctgaacctcaggtccgactataggaggatttagggtccgttttctggttgagcaactgtggccagggcaggcctagccatcccgcatgaaggagtcggcggtccgggggcctccaaggccctttctggttctgacctctgagcatcttgattttacctctcacaaagccactgccctcctgggctgttctctaagctccagctttcccatgcgtgcaccctcagccctgtgggtccgagcctgggccctgatcctctgagggctgtgtggttgggtggtaaaacctgttctggatgtttccagaaccaagaggacttcctcacccttttgaggatgacccgagtcagggacgataacacccatcagcttcctgttaaagtctctcttggaactacaaatacttgcggctgtcacactgtgctctcagacgccaagtcactggactttgagcctgaggggctccttaccctgatggggaagggggttccagccccgctggcttttgcacctggcgctgatggtggctgtgacgtagtggctgcagagttgggtgtggggacagaaggatgcctccagacatgccgcctcacccctctctctgtcttgcagcactctgaagctctgggactacagcaaggggaaggtgagcccccgcaggcttgggcccccatggtgcaccatccctgggtcatggcctctggtggggacagagctggccccggtgatgacaaaggagaggagctcagagagccatctccgctgggtttggtgcgaattcctgaaagacctgggtatttgtagggtggcagtctgcaagttaaatcttcgattgtgtgggtttggtacttgtacttttcagaaataagtgaagtgagtagtgaaacgccttgcttagaacgtagaattacacaaaatcaaggggaaccatgactctgtgaccagcctgtcccctcctgtttcagtgcctgaagacgtacactggccacaagaatgagaaatactgcatatttgccaatttctctgttactggtgggaagtggattgtgtctggctcagaggataaccttgtttacatctggaaccttcagacgaaagagattgtacagaaactacaaggccacacaggtgagggcctgcgctcctgcagtcactggctgcctgttgatgtgaggacagttcctgcaggtgaagcgtggtgtgcccgtagggtgctgtcgtcttccccttcccacctcagccctccgctggccccgctgaggaaccgctgctaagagctcttgcccaaggcatggagctggtcactgtgctgccgactcagacccgggctcctggcttgaaccctgtttctccctgttctgccaggcatgctggtccggaaggtgtgtgtggctgtgggactttaggtgggtgcagcccgtcccacgtcacggcgagctctgtttcctgggctggggacagtgaggtcatcgctgccccatcctggaggctctggctcctttcgggtacctgttccctctcccagagagaccccccagctgcatgcaggcctagtgggctccacggcggagctggttcccaggctacctggggttgccacctctgtgggtcccggctgccctctgcagccgccgctacttcctcaccctctggccctgcatttccacgtctcatggagccaacgagagcagggggttcgagcccttgtggaaatctggggaggcactgcttctccctccatgtgagcagcttcacccagcctggggtcagtgcttacgctccacggcgggcctgggccttcccctgggtcctcgccggcgttctggggttctttggtttacgtagaagctgtaaacactttgatgtggccgaccttgcaccaccagtctgttagttctgacctccctgcttgggtggtggacttgtccttgctgtgacagagccagccctgtggggtgctctggggcttagcattggggggaggcggtgggagtgggcggctcagggtccgaggagaagagggacattgtcgataaaggactgaggactgtgaggggtctgactgcagtccttgtgcgcgccagcctctgagccagtcctgctgccgcgctcctccttgtgggcgccgagctgctgttggtgggggcgtgtggggctcctggtctgcaggcagggctggcactccctgtggcctcctgcccctgtcccccaaccggctgtgtcgccctggtaccggctgctgtcccctcgctcccctcccctgggctccctgtgtcgaaggtgggcagtgggtgcttgtcctgtgacctcccaggtggcgggcaggcgctacccgcgtttctggagaaaggtggagctcagtctgggatggcgtccccgacccaggcgcagggatggctctggttctgactgtgtctttgttttcagatgtcgtgatctcaacagcttgtcacccaacagaaaacatcatcgcctctgctgcgctagaaaatgacaaaacaattaaactgtggaagagtgactgctaagtccctttgctcctgcccgcgagagactgtcgggaagttgacccggattggcaagaaacagggtgtcttggaggtggtcccccagatctgcgcctgggggtcaggacagggcctgatttgagcctcctctctgaagatgatttggccgagcggaaggtgtggaccaccggaaagttcttaaaagttgctggtgacatttcttgccaattctaacactgtctagggaagagttcctagtctattgtgttcaaacagagtcaacaaaagtttttaattttttattacagaagggtgaagttcaatttaacatgcgttgtgttttttcagtaaacgttctgtatctttttgatattccatgacccagtgcacgctgtggcctgtcaccgccaccgtggccccgccagctggcctcccctttggcccacgccggccgcccccattctctgctgcgtagatgccctggcccagggccctgactcctccattcccgccagtagctgttcctagtgtattttcgtctttctggaaaacagcattgagtggttgttttctgtgtaaagagccgtttgtgtcttgggagtttgtggcccacatgccgatagcacggtcatcgcacatgactctcccgtttgtctcagtgtccctgcaacaagcagcaccgcagactgtaataaaaggtggggttttgtgaatggttgtggcaagtgcgtccttgtgaagctcgtctccatgtggctttcttggagaaaggctcccctggggcaagagggtggaaggtttctttggacaggaggtgctgaggctggctgcacctgctctctgaagacgccttcctctctaggttcattgttcagtgttgctggaggcggggaacgggggtggggaggttcttagttgcgaaggagccaagctcctgatggacttgcgttgggatgtgggggacacctgtggcatggtaaggctccctgagtcccttactccaggtcagatgccagtgggactcatgcgccctatgagggctgcagggccagtgctgcccctcggactcctcgaggggttgggtgctaagcgcgagcctcgccgtccctgctggagccctcgcctgcctgcccctctgcctgtgctcctggcactgtggcttcccggtgctcacctgcacagcagttaacagcagaggccgagcgggagcctctggggagcgaggctgaaacctgaacctgcccatggagacagttgtggtgagggttgccacacacagtgagggcggagcagggtggctgagggcacaggtgcctgggtctgtcccacggggcagggctttggggctgtgatgctctgggaagccagcttgggtcctgggtctacagagggccctggccccggagcccagccagctctgcctctctcagggcctggagtcctgggggagctcagccagctctgcctttctcagggcctggagtcctggatgaatcctgcaggtttttggttgcaccggcccagggaggaagcggggggtttgtcaggtgggctctcctggaggtcctcgagtggcaggggtgaggaggggattatctgaggcatctggagatgtatatcctgtggtttcccctgcccctctgtttccgatgaggtgtacggatgagtgacctgcactaagaagtgagttgccacagtgaaaatgggttggtttttgtcttcgacgctcagggtctgggcgcctcgcatttgcagtctgttgtgacagacacggggagctccgcgtgccagcctgtggctgccctgctgtgggggtcctggggccggcgaggccccttcagtcttgttctggggggacggcccactccggggagggggtgtgctgtgctgagcgctgtatccctgaatatagtttattttttctacatttgaattctgttgtagatttatgtaaaaatacattctttttgaaaataaaaattttcatgtcttctaaaaaaaaaaaa

SEQ ID NO: 693166 - DNA, 391 bp, Homo sapiens
cagaaggatcacttgagaccaggagttcaagatgagtctggacaacatattgagaccctgtctctacaaaaataattagccaggtgtggtggcacatgcctgtagtcctaactactcaggaggctgagacaagaggatctcttgagcccaggtgtttgaagtagcagtgagccatgattgtgccactttgctccacctgggtgacagagtcagaccctgtctccaaaaagaagaaaaaaaatttcttaaatttaaatggaaaaaacataccaaaacctatgggatacagcaaaagcagtgctaagagggaagtttagagcaataaacacctacatcaacaaaagtagacagatttcaaataacctagtgatggaccttaaggaactagaaa

SEQ ID NO: 693167 - DNA, 277 bp, Homo sapiens
tgcgatatacaatagtaataaatgcgatgaccaaatgaaaatgcaaaccagtgtaagatcaataaggatcggggaggggagaaccagatctttaatacaatgttcagagtagatatcattgaaaaggtgaaacccatgtcttctgctgtctaattactgtattcacattcaaccatcagaccttgatttcgattttcttcctgatcattctgtatcccagctaatgagatcaatcacatctaagccagtttgtcacttaaatcaacatgtagggcca

SEQ ID NO: 693168 - DNA, 914 bp, Homo sapiens
  misc_feature (809)..(809): n is a, c, g, or t
ggaggcagaggttgcagtgagtcgagatgtgccatgcactccagcctgggggacaagagcaagacttcgtctcaaaaaaaaaaaaaaaagggaggtaccatcaatccgtggtggccgggggtaactcttccttaaaaaaagggttttcactcattggctcatggtcgtggcttaaaactccattaacatttacacgtccaaatttcttttggggcctttgggtcaaacaccattttacaccaaaatttcttaattggggcaaagggcacttccatagcactacgtggtcgtggcgctaacacgtggcgctcctggaccacattggtccttttggaactgacccaacttattaacgaggcgatacatgcatggtactggggattgggatggacccggggctcattccaaaaatttccccaagaattcctcttctttaaccttaccagggctacgcacctggtggttttaacccaaaaggtcccggggcgccttacacagtggaacgccaattatcaatattgcggcggggaggaccccttatcctgtggccccttcaccttcaatcctaaagacccaattcttcaagggtggccacttctgggtccctttcaacttataccacgcaatattaacctctaaacttttcccgggttttacacgctaaaatttaatttccagtccccatttctaagtttacacaagtccaattgcgtccctaaacgtggtaaggtgcgacacctttttctctccctttttaaacttatactttggaaaggcccatgggaaggagcagacaacacgggtttgtnagcatccctgcgccatgggtgtggtttcaccaattattttacaattttccttacgaccctatgggttttacataactgaacggcttatggtcacaaaaaggcggt

SEQ ID NO: 693169 - DNA, 6276 bp, Homo sapiens
gcctcaggtgatcccgacctcaggtgatccactcgcctcagcctcccagagtgctgggattacaggcgtgagccgccgcgcccggccggattttctcatttttactagaaggttctatctcctgggggtggggtgaggtggtgagaccaattcacctccaaggctctaagaagtgaagcaggcggcgagaatgtgcagtcgttgaggccagaggaccgggcctcagcttctccttaagcccctgagtcctcctctggggaccacccccttgtacctggaggtgaaaatgcccgcccaggagggaagggctggcccccggagagcccgctgcgaagtgagtttgcgcactgcggagcgggcgcgggtgactccagagcggccctgccagtccgcggggctggcggggagcaggttcgtgcaccgcgggctctgtgcatgcagaggcgggaagagcccccagcccggcagccggccccgcgggaaggcgcagcccgggcttccgaaccctgtgaacgcgcaggttcctggtcttccagatgggcaggaatcgtcctgcccgcccggggtgggaggccacatgggggcactgcgcccgggcgcggccccaggtgctttccaaatgcccactgccgctctcatccgtaccagcgatgatcaagaaggggcctggtcgcccggggaggtgccccggcccgaatcgactccggagacaacgccgggcgacgccacctgcgcaggtcccggaggccgctggtgtctgtgtacagggcgtgctgtctgtggaaacgcgagggcacactagcactttccagactgcctctgtcaccgggtccctccacccttgtctcctgtgcggccagcgtcagagccatggcgacggaggagaagaagcccgagaccgaggccgccagagcacagccaaccccttcgtcatccgccactcagagcaagcctacacctgtgaagccaaactatgctctaaagttcacccttgctggccacaccaaagcagtgtcctccgtgaaattcagcccgaatggagagtggctggcaagttcatctgctgataaacttattaaaatttggggcgcgtatgatgggaaatttgagaaaaccatatctggtcacaagctgggaatatccgatgtagcctggtcgtcagattctaaccttcttgtttctgcctcagatgacaaaaccttgaagatatgggacgtgagctcgggcaagtgtctgaaaaccctgaagggacacagtaattatgtcttttgctgcaacttcaatccccagtccaaccttattgtctcaggatcctttgacgaaagcgtgaggatatgggatgtgaaaacagggaagtgcctcaagactttgccagctcactcggatccagtctcggccgttcattttaatcgtgatggatccttgatagtttcaagtagctatgatggtctctgtcgcatctgggacaccgcctcaggccagtgcctgaagacgctcatcgatgacgacaacccccccgtgtcttttgtgaagttctccccgaacggcaaatacatcctggccgccacgctggacaagtgagtactgcgtgggactgtgggggcgggcatgtggcctccccagccagagacacctgcgtgccagcgtgagcctttggagagcgtgttgtgggcttggcacgggatccaggctcctggtggagcttcggcttctgggcagtggcctgttaggtcggagggcaggcccccgtccatcccttcccgaggctgaacctcaggtccgactataggaggatttagggtccgttttctggttgagcaactgtggccagggcaggcctagccatcccgcatgaaggagtcggcggtccgggggcctccaaggccctttctggttctgacctctgagcatcttgattttacctctcacaaagccactgccctcctgggctgttctctaagctccagctttcccatgcgtgcaccctcagccctgtgggtccgagcctgggccctgatcctctgagggctgtgtggttgggtggtaaaacctgttctggatgtttccagaaccaagaggacttcctcacccttttgaggatgacccgagtcagggacgataacacccatcagcttcctgttaaagtctctcttggaactacaaatacttgcggctgtcacactgtgctctcagacgccaagtcactggactttgagcctgaggggctccttaccctgatggggaagggggttccagccccgctggcttttgcacctggcgctgatggtggctgtgacgtagtggctgcagagttgggtgtggggacagaaggatgcctccagacatgccgcctcacccctctctctgtcttgcagcactctgaagctctgggactacagcaaggggaaggtgagcccccgcaggcttgggcccccatggtgcaccatccctgggtcatggcctctggtggggacagagctggccccggtgatgacaaaggagaggagctcagagagccatctccgctgggtttggtgcgaattcctgaaagacctgggtatttgtagggtggcagtctgcaagttaaatcttcgattgtgtgggtttggtacttgtacttttcagaaataagtgaagtgagtagtgaaacgccttgcttagaacgtagaattacacaaaatcaaggggaaccatgactctgtgaccagcctgtcccctcctgtttcagtgcctgaagacgtacactggccacaagaatgagaaatactgcatatttgccaatttctctgttactggtgggaagtggattgtgtctggctcagaggataaccttgtttacatctggaaccttcagacgaaagagattgtacagaaactacaaggccacacaggtgagggcctgcgctcctgcagtcactggctgcctgttgatgtgaggacagttcctgcaggtgaagcgtggtgtgcccgtagggtgctgtcgtcttccccttcccacctcagccctccgctggccccgctgaggaaccgctgctaagagctcttgcccaaggcatggagctggtcactgtgctgccgactcagacccgggctcctggcttgaaccctgtttctccctgttctgccaggcatgctggtccggaaggtgtgtgtggctgtgggactttaggtgggtgcagcccgtcccacgtcacggcgagctctgtttcctgggctggggacagtgaggtcatcgctgccccatcctggaggctctggctcctttcgggtacctgttccctctcccagagagaccccccagctgcatgcaggcctagtgggctccacggcggagctggttcccaggctacctggggttgccacctctgtgggtcccggctgccctctgcagccgccgctacttcctcaccctctggccctgcatttccacgtctcatggagccaacgagagcagggggttcgagcccttgtggaaatctggggaggcactgcttctccctccatgtgagcagcttcacccagcctggggtcagtgcttacgctccacggcgggcctgggccttcccctgggtcctcgccggcgttctggggttctttggtttacgtagaagctgtaaacactttgatgtggccgaccttgcaccaccagtctgttagttctgacctccctgcttgggtggtggacttgtccttgctgtgacagagccagccctgtggggtgctctggggcttagcattggggggaggcggtgggagtgggcggctcagggtccgaggagaagagggacattgtcgataaaggactgaggactgtgaggggtctgactgcagtccttgtgcgcgccagcctctgagccagtcctgctgccgcgctcctccttgtgggcgccgagctgctgttggtgggggcgtgtggggctcctggtctgcaggcagggctggcactccctgtggcctcctgcccctgtcccccaaccggctgtgtcgccctggtaccggctgctgtcccctcgctcccctcccctgggctccctgtgtcgaaggtgggcagtgggtgcttgtcctgtgacctcccaggtggcgggcaggcgctacccgcgtttctggagaaaggtggagctcagtctgggatggcgtccccgacccaggcgcagggatggctctggttctgactgtgtctttgttttcagatgtcgtgatctcaacagcttgtcacccaacagaaaacatcatcgcctctgctgcgctagaaaatgacaaaacaattaaactgtggaagagtgactgctaagtccctttgctcctgcccgcgagagactgtcgggaagttgacccggattggcaagaaacagggtgtcttggaggtggtcccccagatctgcgcctgggggtcaggacagggcctgatttgagcctcctctctgaagatgatttggccgagcggaaggtgtggaccaccggaaagttcttaaaagttgctggtgacatttcttgccaattctaacactgtctagggaagagttcctagtctattgtgttcaaacagagtcaacaaaagtttttaattttttattacagaagggtgaagttcaatttaacatgcgttgtgttttttcagtaaacgttctgtatctttttgatattccatgacccagtgcacgctgtggcctgtcaccgccaccgtggccccgccagctggcctcccctttggcccacgccggccgcccccattctctgctgcgtagatgccctggcccagggccctgactcctccattcccgccagtagctgttcctagtgtattttcgtctttctggaaaacagcattgagtggttgttttctgtgtaaagagccgtttgtgtcttgggagtttgtggcccacatgccgatagcacggtcatcgcacatgactctcccgtttgtctcagtgtccctgcaacaagcagcaccgcagactgtaataaaaggtggggttttgtgaatggttgtggcaagtgcgtccttgtgaagctcgtctccatgtggctttcttggagaaaggctcccctggggcaagagggtggaaggtttctttggacaggaggtgctgaggctggctgcacctgctctctgaagacgccttcctctctaggttcattgttcagtgttgctggaggcggggaacgggggtggggaggttcttagttgcgaaggagccaagctcctgatggacttgcgttgggatgtgggggacacctgtggcatggtaaggctccctgagtcccttactccaggtcagatgccagtgggactcatgcgccctatgagggctgcagggccagtgctgcccctcggactcctcgaggggttgggtgctaagcgcgagcctcgccgtccctgctggagccctcgcctgcctgcccctctgcctgtgctcctggcactgtggcttcccggtgctcacctgcacagcagttaacagcagaggccgagcgggagcctctggggagcgaggctgaaacctgaacctgcccatggagacagttgtggtgagggttgccacacacagtgagggcggagcagggtggctgagggcacaggtgcctgggtctgtcccacggggcagggctttggggctgtgatgctctgggaagccagcttgggtcctgggtctacagagggccctggccccggagcccagccagctctgcctctctcagggcctggagtcctgggggagctcagccagctctgcctttctcagggcctggagtcctggatgaatcctgcaggtttttggttgcaccggcccagggaggaagcggggggtttgtcaggtgggctctcctggaggtcctcgagtggcaggggtgaggaggggattatctgaggcatctggagatgtatatcctgtggtttcccctgcccctctgtttccgatgaggtgtacggatgagtgacctgcactaagaagtgagttgccacagtgaaaatgggttggtttttgtcttcgacgctcagggtctgggcgcctcgcatttgcagtctgttgtgacagacacggggagctccgcgtgccagcctgtggctgccctgctgtgggggtcctggggccggcgaggccccttcagtcttgttctggggggacggcccactccggggagggggtgtgctgtgctgagcgctgtatccctgaatatagtttattttttctacatttgaattctgttgtagatttatgtaaaaatacattctttttgaaaataaaaattttcatgtcttctaaaaaaaaaaaa

SEQ ID NO: 693170 - DNA, 956 bp, Homo sapiens
  misc_feature (956)..(956): n is a, c, g, or t
tgggcatccaaaatgtgaactttaataacgggtcaaatggggggttccccaggaacaaaaatgacggaacgggtgctggaggcctcagggtgcccacttcccgtgctccaagttcgggaggcgaggaggcaagggaccctgttgaggcagggacagggcccagctccagctaagtccatcggtcggggtcccgtgagacccaagatgcagcagttgtgtggagcagggggccgccctgcctgacccgggaggctcctgcagggaatgcggcccaggctggccgggtgagcaggccaaaggctgtggggacagatccggaagcttcctcacgggccacttcgatgtggcggagccgcaggtagacgtccgtgccaagtgccctgcagggcactgcagctgaagagacccaccgaggatactccgcgtaggcccgtgagtggggcaacccgaagccaaagcgggggtcggggcagggcggccaggacaggaggcatccaaaggattgacagtaccattggcagcctaccccaagacacatcacacactcgaacgggaccagcgttcaaaccgagacatgatccacagacagacaacaacaacctatagcatgtccaaatggccacaaggggccttgaaccggaggaccagagattagagaccacacaaaaaaacacagcgaacaccagcacgggcacaacactctgctcagcacacccacaaaggaacgcaaccagcgaaactgcaaacaaggtgccacggaacaacccatggccctagcagacaggtaggaccacagaggaaccagcaacacgacccaccggaacccaccaggacaagaagacaacaacgcaaacaggcggactagactacagcaacacacgaatagaacataaacaccaacaacaaccgagacacgcacaaacaacccacacacaacacacagcactagtaagacn

SEQ ID NO: 693171 - DNA, 5610 bp, Homo sapiens
cccggcggaccgctgacaaggccagagcgccggcactgggtcctctttcccgcaggcagcgtgcccggcctcacatcgcccctctccctccactgccccttcagggaaggaccccagacccaccaagccactcagtccctggacagactgcctctgtcaccgggtccctccacccttgtctcctgtgcggccagcgtcagagccatggcgacggaggagaagaagcccgagaccgaggccgccagagcacagccaaccccttcgtcatccgccactcagagcaagcctacacctgtgaagccaaactatgctctaaagttcacccttgctggccacaccaaagcagtgtcctccgtgaaattcagcccgaatggagagtggctggcaagttcatctgctgataaacttattaaaatttggggcgcgtatgatgggaaatttgagaaaaccatatctggtcacaagctgggaatatccgatgtagcctggtcgtcagattctaaccttcttgtttctgcctcagatgacaaaaccttgaagatatgggacgtgagctcgggcaagtgtctgaaaaccctgaagggacacagtaattatgtcttttgctgcaacttcaatccccagtccaaccttattgtctcaggatcctttgacgaaagcgtgaggatatgggatgtgaaaacagggaagtgcctcaagactttgccagctcactcggatccagtctcggccgttcattttaatcgtgatggatccttgatagtttcaagtagctatgatggtctctgtcgcatctgggacaccgcctcaggccagtgcctgaagacgctcatcgatgacgacaacccccccgtgtcttttgtgaagttctccccgaacggcaaatacatcctggccgccacgctggacaagtgagtactgcgtgggactgtgggggcgggcatgtggcctccccagccagagacacctgcgtgccagcgtgagcctttggagagcgtgttgtgggcttggcacgggatccaggctcctggtggagcttcggcttctgggcagtggcctgttaggtcggagggcaggcccccgtccatcccttcccgaggctgaacctcaggtccgactataggaggatttagggtccgttttctggttgagcaactgtggccagggcaggcctagccatcccgcatgaaggagtcggcggtccgggggcctccaaggccctttctggttctgacctctgagcatcttgattttacctctcacaaagccactgccctcctgggctgttctctaagctccagctttcccatgcgtgcaccctcagccctgtgggtccgagcctgggccctgatcctctgagggctgtgtggttgggtggtaaaacctgttctggatgtttccagaaccaagaggacttcctcacccttttgaggatgacccgagtcagggacgataacacccatcagcttcctgttaaagtctctcttggaactacaaatacttgcggctgtcacactgtgctctcagacgccaagtcactggactttgagcctgaggggctccttaccctgatggggaagggggttccagccccgctggcttttgcacctggcgctgatggtggctgtgacgtagtggctgcagagttgggtgtggggacagaaggatgcctccagacatgccgcctcacccctctctctgtcttgcagcactctgaagctctgggactacagcaaggggaaggtgagcccccgcaggcttgggcccccatggtgcaccatccctgggtcatggcctctggtggggacagagctggccccggtgatgacaaaggagaggagctcagagagccatctccgctgggtttggtgcgaattcctgaaagacctgggtatttgtagggtggcagtctgcaagttaaatcttcgattgtgtgggtttggtacttgtacttttcagaaataagtgaagtgagtagtgaaacgccttgcttagaacgtagaattacacaaaatcaaggggaaccatgactctgtgaccagcctgtcccctcctgtttcagtgcctgaagacgtacactggccacaagaatgagaaatactgcatatttgccaatttctctgttactggtgggaagtggattgtgtctggctcagaggataaccttgtttacatctggaaccttcagacgaaagagattgtacagaaactacaaggccacacaggtgagggcctgcgctcctgcagtcactggctgcctgttgatgtgaggacagttcctgcaggtgaagcgtggtgtgcccgtagggtgctgtcgtcttccccttcccacctcagccctccgctggccccgctgaggaaccgctgctaagagctcttgcccaaggcatggagctggtcactgtgctgccgactcagacccgggctcctggcttgaaccctgtttctccctgttctgccaggcatgctggtccggaaggtgtgtgtggctgtgggactttaggtgggtgcagcccgtcccacgtcacggcgagctctgtttcctgggctggggacagtgaggtcatcgctgccccatcctggaggctctggctcctttcgggtacctgttccctctcccagagagaccccccagctgcatgcaggcctagtgggctccacggcggagctggttcccaggctacctggggttgccacctctgtgggtcccggctgccctctgcagccgccgctacttcctcaccctctggccctgcatttccacgtctcatggagccaacgagagcagggggttcgagcccttgtggaaatctggggaggcactgcttctccctccatgtgagcagcttcacccagcctggggtcagtgcttacgctccacggcgggcctgggccttcccctgggtcctcgccggcgttctggggttctttggtttacgtagaagctgtaaacactttgatgtggccgaccttgcaccaccagtctgttagttctgacctccctgcttgggtggtggacttgtccttgctgtgacagagccagccctgtggggtgctctggggcttagcattggggggaggcggtgggagtgggcggctcagggtccgaggagaagagggacattgtcgataaaggactgaggactgtgaggggtctgactgcagtccttgtgcgcgccagcctctgagccagtcctgctgccgcgctcctccttgtgggcgccgagctgctgttggtgggggcgtgtggggctcctggtctgcaggcagggctggcactccctgtggcctcctgcccctgtcccccaaccggctgtgtcgccctggtaccggctgctgtcccctcgctcccctcccctgggctccctgtgtcgaaggtgggcagtgggtgcttgtcctgtgacctcccaggtggcgggcaggcgctacccgcgtttctggagaaaggtggagctcagtctgggatggcgtccccgacccaggcgcagggatggctctggttctgactgtgtctttgttttcagatgtcgtgatctcaacagcttgtcacccaacagaaaacatcatcgcctctgctgcgctagaaaatgacaaaacaattaaactgtggaagagtgactgctaagtccctttgctcctgcccgcgagagactgtcgggaagttgacccggattggcaagaaacagggtgtcttggaggtggtcccccagatctgcgcctgggggtcaggacagggcctgatttgagcctcctctctgaagatgatttggccgagcggaaggtgtggaccaccggaaagttcttaaaagttgctggtgacatttcttgccaattctaacactgtctagggaagagttcctagtctattgtgttcaaacagagtcaacaaaagtttttaattttttattacagaagggtgaagttcaatttaacatgcgttgtgttttttcagtaaacgttctgtatctttttgatattccatgacccagtgcacgctgtggcctgtcaccgccaccgtggccccgccagctggcctcccctttggcccacgccggccgcccccattctctgctgcgtagatgccctggcccagggccctgactcctccattcccgccagtagctgttcctagtgtattttcgtctttctggaaaacagcattgagtggttgttttctgtgtaaagagccgtttgtgtcttgggagtttgtggcccacatgccgatagcacggtcatcgcacatgactctcccgtttgtctcagtgtccctgcaacaagcagcaccgcagactgtaataaaaggtggggttttgtgaatggttgtggcaagtgcgtccttgtgaagctcgtctccatgtggctttcttggagaaaggctcccctggggcaagagggtggaaggtttctttggacaggaggtgctgaggctggctgcacctgctctctgaagacgccttcctctctaggttcattgttcagtgttgctggaggcggggaacgggggtggggaggttcttagttgcgaaggagccaagctcctgatggacttgcgttgggatgtgggggacacctgtggcatggtaaggctccctgagtcccttactccaggtcagatgccagtgggactcatgcgccctatgagggctgcagggccagtgctgcccctcggactcctcgaggggttgggtgctaagcgcgagcctcgccgtccctgctggagccctcgcctgcctgcccctctgcctgtgctcctggcactgtggcttcccggtgctcacctgcacagcagttaacagcagaggccgagcgggagcctctggggagcgaggctgaaacctgaacctgcccatggagacagttgtggtgagggttgccacacacagtgagggcggagcagggtggctgagggcacaggtgcctgggtctgtcccacggggcagggctttggggctgtgatgctctgggaagccagcttgggtcctgggtctacagagggccctggccccggagcccagccagctctgcctctctcagggcctggagtcctgggggagctcagccagctctgcctttctcagggcctggagtcctggatgaatcctgcaggtttttggttgcaccggcccagggaggaagcggggggtttgtcaggtgggctctcctggaggtcctcgagtggcaggggtgaggaggggattatctgaggcatctggagatgtatatcctgtggtttcccctgcccctctgtttccgatgaggtgtacggatgagtgacctgcactaagaagtgagttgccacagtgaaaatgggttggtttttgtcttcgacgctcagggtctgggcgcctcgcatttgcagtctgttgtgacagacacggggagctccgcgtgccagcctgtggctgccctgctgtgggggtcctggggccggcgaggccccttcagtcttgttctggggggacggcccactccggggagggggtgtgctgtgctgagcgctgtatccctgaatatagtttattttttctacatttgaattctgttgtagatttatgtaaaaatacattctttttgaaaataaaaattttcatgtcttctaaaaaaaaaaaa

SEQ ID NO: 693172 - DNA, 990 bp, Homo sapiens
tcgtgaagactacccctagaagccacacgatggagaataggaagatacgactcatatcaacattgtcgtcataggacacggtagattcgcggcagagtccaccactactggccatctgatctataaatgcggatggcatcgaccataaagaaccagttgaaaacatttgacgaagcgagcgctgctgacgattggtgaaagggctccttcaacgatatgcctgggtcttggataaactgaaagctgaccgtgacgcgtggtatctagccatatgagtatctccttgctggaaacttagagaacagctagatactatgtgcactaatcattgatgcacaccaggagcgacagaagacatttaatcacacacaacattgagttagcacgtggacagtcgtcaaggactgtactgttgcttgtccttgactggttggactagctggattggtaagagtgacaagttgagaacaacatagtgctcattcatgcgccaaggacactgcgccgtcatgtaccctccgcaagtaaggccgtgtccaccattccttgcgtgccttaccaacatacttggggttggtgaacaaccacaaacataaccactttgcgtaccggggatggactattagacccaacacacgtagtgggaatatcctcaagccatggaaaggcacccaggccccttaatcacggcgcgacggacaacagcgcacgcaagtcatttggcaaggttgggaaagaactatgggtattacagacagccggtagacagcactcccaaaaggacaaagcgctattttacccaacctttttcaaaaccccgacaactaaatccttgtagcagcgacgcttaagtcgaaagacccgtccccaaccggaaagacgtaggcgtaggatttcaacgaccacactggtataggggttgtggccccacaaaacgttacatagccataggggcgatctctagtgtggacaacactggcaggtcacgga

SEQ ID NO: 693173 - DNA, 5492 bp, Homo sapiens
gctccctgttctgcatctcgctcaacagactgcctctgtcaccgggtccctccacccttgtctcctgtgcggccagcgtcagagccatggcgacggaggagaagaagcccgagaccgaggccgccagagcacagccaaccccttcgtcatccgccactcagagcaagcctacacctgtgaagccaaactatgctctaaagttcacccttgctggccacaccaaagcagtgtcctccgtgaaattcagcccgaatggagagtggctggcaagttcatctgctgataaacttattaaaatttggggcgcgtatgatgggaaatttgagaaaaccatatctggtcacaagctgggaatatccgatgtagcctggtcgtcagattctaaccttcttgtttctgcctcagatgacaaaaccttgaagatatgggacgtgagctcgggcaagtgtctgaaaaccctgaagggacacagtaattatgtcttttgctgcaacttcaatccccagtccaaccttattgtctcaggatcctttgacgaaagcgtgaggatatgggatgtgaaaacagggaagtgcctcaagactttgccagctcactcggatccagtctcggccgttcattttaatcgtgatggatccttgatagtttcaagtagctatgatggtctctgtcgcatctgggacaccgcctcaggccagtgcctgaagacgctcatcgatgacgacaacccccccgtgtcttttgtgaagttctccccgaacggcaaatacatcctggccgccacgctggacaagtgagtactgcgtgggactgtgggggcgggcatgtggcctccccagccagagacacctgcgtgccagcgtgagcctttggagagcgtgttgtgggcttggcacgggatccaggctcctggtggagcttcggcttctgggcagtggcctgttaggtcggagggcaggcccccgtccatcccttcccgaggctgaacctcaggtccgactataggaggatttagggtccgttttctggttgagcaactgtggccagggcaggcctagccatcccgcatgaaggagtcggcggtccgggggcctccaaggccctttctggttctgacctctgagcatcttgattttacctctcacaaagccactgccctcctgggctgttctctaagctccagctttcccatgcgtgcaccctcagccctgtgggtccgagcctgggccctgatcctctgagggctgtgtggttgggtggtaaaacctgttctggatgtttccagaaccaagaggacttcctcacccttttgaggatgacccgagtcagggacgataacacccatcagcttcctgttaaagtctctcttggaactacaaatacttgcggctgtcacactgtgctctcagacgccaagtcactggactttgagcctgaggggctccttaccctgatggggaagggggttccagccccgctggcttttgcacctggcgctgatggtggctgtgacgtagtggctgcagagttgggtgtggggacagaaggatgcctccagacatgccgcctcacccctctctctgtcttgcagcactctgaagctctgggactacagcaaggggaaggtgagcccccgcaggcttgggcccccatggtgcaccatccctgggtcatggcctctggtggggacagagctggccccggtgatgacaaaggagaggagctcagagagccatctccgctgggtttggtgcgaattcctgaaagacctgggtatttgtagggtggcagtctgcaagttaaatcttcgattgtgtgggtttggtacttgtacttttcagaaataagtgaagtgagtagtgaaacgccttgcttagaacgtagaattacacaaaatcaaggggaaccatgactctgtgaccagcctgtcccctcctgtttcagtgcctgaagacgtacactggccacaagaatgagaaatactgcatatttgccaatttctctgttactggtgggaagtggattgtgtctggctcagaggataaccttgtttacatctggaaccttcagacgaaagagattgtacagaaactacaaggccacacaggtgagggcctgcgctcctgcagtcactggctgcctgttgatgtgaggacagttcctgcaggtgaagcgtggtgtgcccgtagggtgctgtcgtcttccccttcccacctcagccctccgctggccccgctgaggaaccgctgctaagagctcttgcccaaggcatggagctggtcactgtgctgccgactcagacccgggctcctggcttgaaccctgtttctccctgttctgccaggcatgctggtccggaaggtgtgtgtggctgtgggactttaggtgggtgcagcccgtcccacgtcacggcgagctctgtttcctgggctggggacagtgaggtcatcgctgccccatcctggaggctctggctcctttcgggtacctgttccctctcccagagagaccccccagctgcatgcaggcctagtgggctccacggcggagctggttcccaggctacctggggttgccacctctgtgggtcccggctgccctctgcagccgccgctacttcctcaccctctggccctgcatttccacgtctcatggagccaacgagagcagggggttcgagcccttgtggaaatctggggaggcactgcttctccctccatgtgagcagcttcacccagcctggggtcagtgcttacgctccacggcgggcctgggccttcccctgggtcctcgccggcgttctggggttctttggtttacgtagaagctgtaaacactttgatgtggccgaccttgcaccaccagtctgttagttctgacctccctgcttgggtggtggacttgtccttgctgtgacagagccagccctgtggggtgctctggggcttagcattggggggaggcggtgggagtgggcggctcagggtccgaggagaagagggacattgtcgataaaggactgaggactgtgaggggtctgactgcagtccttgtgcgcgccagcctctgagccagtcctgctgccgcgctcctccttgtgggcgccgagctgctgttggtgggggcgtgtggggctcctggtctgcaggcagggctggcactccctgtggcctcctgcccctgtcccccaaccggctgtgtcgccctggtaccggctgctgtcccctcgctcccctcccctgggctccctgtgtcgaaggtgggcagtgggtgcttgtcctgtgacctcccaggtggcgggcaggcgctacccgcgtttctggagaaaggtggagctcagtctgggatggcgtccccgacccaggcgcagggatggctctggttctgactgtgtctttgttttcagatgtcgtgatctcaacagcttgtcacccaacagaaaacatcatcgcctctgctgcgctagaaaatgacaaaacaattaaactgtggaagagtgactgctaagtccctttgctcctgcccgcgagagactgtcgggaagttgacccggattggcaagaaacagggtgtcttggaggtggtcccccagatctgcgcctgggggtcaggacagggcctgatttgagcctcctctctgaagatgatttggccgagcggaaggtgtggaccaccggaaagttcttaaaagttgctggtgacatttcttgccaattctaacactgtctagggaagagttcctagtctattgtgttcaaacagagtcaacaaaagtttttaattttttattacagaagggtgaagttcaatttaacatgcgttgtgttttttcagtaaacgttctgtatctttttgatattccatgacccagtgcacgctgtggcctgtcaccgccaccgtggccccgccagctggcctcccctttggcccacgccggccgcccccattctctgctgcgtagatgccctggcccagggccctgactcctccattcccgccagtagctgttcctagtgtattttcgtctttctggaaaacagcattgagtggttgttttctgtgtaaagagccgtttgtgtcttgggagtttgtggcccacatgccgatagcacggtcatcgcacatgactctcccgtttgtctcagtgtccctgcaacaagcagcaccgcagactgtaataaaaggtggggttttgtgaatggttgtggcaagtgcgtccttgtgaagctcgtctccatgtggctttcttggagaaaggctcccctggggcaagagggtggaaggtttctttggacaggaggtgctgaggctggctgcacctgctctctgaagacgccttcctctctaggttcattgttcagtgttgctggaggcggggaacgggggtggggaggttcttagttgcgaaggagccaagctcctgatggacttgcgttgggatgtgggggacacctgtggcatggtaaggctccctgagtcccttactccaggtcagatgccagtgggactcatgcgccctatgagggctgcagggccagtgctgcccctcggactcctcgaggggttgggtgctaagcgcgagcctcgccgtccctgctggagccctcgcctgcctgcccctctgcctgtgctcctggcactgtggcttcccggtgctcacctgcacagcagttaacagcagaggccgagcgggagcctctggggagcgaggctgaaacctgaacctgcccatggagacagttgtggtgagggttgccacacacagtgagggcggagcagggtggctgagggcacaggtgcctgggtctgtcccacggggcagggctttggggctgtgatgctctgggaagccagcttgggtcctgggtctacagagggccctggccccggagcccagccagctctgcctctctcagggcctggagtcctgggggagctcagccagctctgcctttctcagggcctggagtcctggatgaatcctgcaggtttttggttgcaccggcccagggaggaagcggggggtttgtcaggtgggctctcctggaggtcctcgagtggcaggggtgaggaggggattatctgaggcatctggagatgtatatcctgtggtttcccctgcccctctgtttccgatgaggtgtacggatgagtgacctgcactaagaagtgagttgccacagtgaaaatgggttggtttttgtcttcgacgctcagggtctgggcgcctcgcatttgcagtctgttgtgacagacacggggagctccgcgtgccagcctgtggctgccctgctgtgggggtcctggggccggcgaggccccttcagtcttgttctggggggacggcccactccggggagggggtgtgctgtgctgagcgctgtatccctgaatatagtttattttttctacatttgaattctgttgtagatttatgtaaaaatacattctttttgaaaataaaaattttcatgtcttctaaaaaaaaaaaa

SEQ ID NO: 693174 - DNA, 3167 bp, Homo sapiens; identical to SEQ ID NO: 557735
  misc_feature (16)..(16): n is a, c, g, or t

SEQ ID NO: 693175 - DNA, 418 bp, Homo sapiens
tgaacatggagagacgtgacggccatatatgcaagcgcaggaacacagcatcattcacattcgttcgcatcctatgcctccatcagtgtgatgccgggcgctcataagagatcggcatcactagtaagcctggcctgtcctccaacatcagttccatgatgtaaagctctctctgttaccagttgaggatcatgtattctttgagctcctgacaatattatcttctacctctcatgaacatatcgtaagagttggactgtttgggatttcttgggtcaggcatggtatagaccaggtcttacagccaatggatatttatcaagaatataacaaatctgtatcatactatttcctttaccaaatgacccaacagctatacatttggtgtgctcagatcgtcttcatactacccatttcg

SEQ ID NO: 693176 - DNA, 5399 bp, Homo sapiens
tgtttatcgattgccacagagaccatcatagctacttgaaactatcaaggatccatcacgattaaaatggacggccgagactggatccgagtgagctggcaaagtcttgaggcacttccctgttttcacatcccatatcctcacgctttcgtcaaaggatcctgagacaatggggatgtttgagattttgaccttttgccgatggtcctattttgtcctgtcaagttactgaccctgttttatctggtcacaagctgggaatatccgatgtagcctggtcgtcagattctaaccttcttgtttctgcctcagatgacaaaaccttgaagatatgggacgtgagctcgggcaagtgtctgaaaaccctgaagggacacagtaattatgtcttttgctgcaacttcaatccccagtccaaccttattgtctcaggatcctttgacgaaagcgtgaggatatgggatgtgaaaacagggaagtgcctcaagactttgccagctcactcggatccagtctcggccgttcattttaatcgtgatggatccttgatagtttcaagtagctatgatggtctctgtcgcatctgggacaccgcctcaggccagtgcctgaagacgctcatcgatgacgacaacccccccgtgtcttttgtgaagttctccccgaacggcaaatacatcctggccgccacgctggacaagtgagtactgcgtgggactgtgggggcgggcatgtggcctccccagccagagacacctgcgtgccagcgtgagcctttggagagcgtgttgtgggcttggcacgggatccaggctcctggtggagcttcggcttctgggcagtggcctgttaggtcggagggcaggcccccgtccatcccttcccgaggctgaacctcaggtccgactataggaggatttagggtccgttttctggttgagcaactgtggccagggcaggcctagccatcccgcatgaaggagtcggcggtccgggggcctccaaggccctttctggttctgacctctgagcatcttgattttacctctcacaaagccactgccctcctgggctgttctctaagctccagctttcccatgcgtgcaccctcagccctgtgggtccgagcctgggccctgatcctctgagggctgtgtggttgggtggtaaaacctgttctggatgtttccagaaccaagaggacttcctcacccttttgaggatgacccgagtcagggacgataacacccatcagcttcctgttaaagtctctcttggaactacaaatacttgcggctgtcacactgtgctctcagacgccaagtcactggactttgagcctgaggggctccttaccctgatggggaagggggttccagccccgctggcttttgcacctggcgctgatggtggctgtgacgtagtggctgcagagttgggtgtggggacagaaggatgcctccagacatgccgcctcacccctctctctgtcttgcagcactctgaagctctgggactacagcaaggggaaggtgagcccccgcaggcttgggcccccatggtgcaccatccctgggtcatggcctctggtggggacagagctggccccggtgatgacaaaggagaggagctcagagagccatctccgctgggtttggtgcgaattcctgaaagacctgggtatttgtagggtggcagtctgcaagttaaatcttcgattgtgtgggtttggtacttgtacttttcagaaataagtgaagtgagtagtgaaacgccttgcttagaacgtagaattacacaaaatcaaggggaaccatgactctgtgaccagcctgtcccctcctgtttcagtgcctgaagacgtacactggccacaagaatgagaaatactgcatatttgccaatttctctgttactggtgggaagtggattgtgtctggctcagaggataaccttgtttacatctggaaccttcagacgaaagagattgtacagaaactacaaggccacacaggtgagggcctgcgctcctgcagtcactggctgcctgttgatgtgaggacagttcctgcaggtgaagcgtggtgtgcccgtagggtgctgtcgtcttccccttcccacctcagccctccgctggccccgctgaggaaccgctgctaagagctcttgcccaaggcatggagctggtcactgtgctgccgactcagacccgggctcctggcttgaaccctgtttctccctgttctgccaggcatgctggtccggaaggtgtgtgtggctgtgggactttaggtgggtgcagcccgtcccacgtcacggcgagctctgtttcctgggctggggacagtgaggtcatcgctgccccatcctggaggctctggctcctttcgggtacctgttccctctcccagagagaccccccagctgcatgcaggcctagtgggctccacggcggagctggttcccaggctacctggggttgccacctctgtgggtcccggctgccctctgcagccgccgctacttcctcaccctctggccctgcatttccacgtctcatggagccaacgagagcagggggttcgagcccttgtggaaatctggggaggcactgcttctccctccatgtgagcagcttcacccagcctggggtcagtgcttacgctccacggcgggcctgggccttcccctgggtcctcgccggcgttctggggttctttggtttacgtagaagctgtaaacactttgatgtggccgaccttgcaccaccagtctgttagttctgacctccctgcttgggtggtggacttgtccttgctgtgacagagccagccctgtggggtgctctggggcttagcattggggggaggcggtgggagtgggcggctcagggtccgaggagaagagggacattgtcgataaaggactgaggactgtgaggggtctgactgcagtccttgtgcgcgccagcctctgagccagtcctgctgccgcgctcctccttgtgggcgccgagctgctgttggtgggggcgtgtggggctcctggtctgcaggcagggctggcactccctgtggcctcctgcccctgtcccccaaccggctgtgtcgccctggtaccggctgctgtcccctcgctcccctcccctgggctccctgtgtcgaaggtgggcagtgggtgcttgtcctgtgacctcccaggtggcgggcaggcgctacccgcgtttctggagaaaggtggagctcagtctgggatggcgtccccgacccaggcgcagggatggctctggttctgactgtgtctttgttttcagatgtcgtgatctcaacagcttgtcacccaacagaaaacatcatcgcctctgctgcgctagaaaatgacaaaacaattaaactgtggaagagtgactgctaagtccctttgctcctgcccgcgagagactgtcgggaagttgacccggattggcaagaaacagggtgtcttggaggtggtcccccagatctgcgcctgggggtcaggacagggcctgatttgagcctcctctctgaagatgatttggccgagcggaaggtgtggaccaccggaaagttcttaaaagttgctggtgacatttcttgccaattctaacactgtctagggaagagttcctagtctattgtgttcaaacagagtcaacaaaagtttttaattttttattacagaagggtgaagttcaatttaacatgcgttgtgttttttcagtaaacgttctgtatctttttgatattccatgacccagtgcacgctgtggcctgtcaccgccaccgtggccccgccagctggcctcccctttggcccacgccggccgcccccattctctgctgcgtagatgccctggcccagggccctgactcctccattcccgccagtagctgttcctagtgtattttcgtctttctggaaaacagcattgagtggttgttttctgtgtaaagagccgtttgtgtcttgggagtttgtggcccacatgccgatagcacggtcatcgcacatgactctcccgtttgtctcagtgtccctgcaacaagcagcaccgcagactgtaataaaaggtggggttttgtgaatggttgtggcaagtgcgtccttgtgaagctcgtctccatgtggctttcttggagaaaggctcccctggggcaagagggtggaaggtttctttggacaggaggtgctgaggctggctgcacctgctctctgaagacgccttcctctctaggttcattgttcagtgttgctggaggcggggaacgggggtggggaggttcttagttgcgaaggagccaagctcctgatggacttgcgttgggatgtgggggacacctgtggcatggtaaggctccctgagtcccttactccaggtcagatgccagtgggactcatgcgccctatgagggctgcagggccagtgctgcccctcggactcctcgaggggttgggtgctaagcgcgagcctcgccgtccctgctggagccctcgcctgcctgcccctctgcctgtgctcctggcactgtggcttcccggtgctcacctgcacagcagttaacagcagaggccgagcgggagcctctggggagcgaggctgaaacctgaacctgcccatggagacagttgtggtgagggttgccacacacagtgagggcggagcagggtggctgagggcacaggtgcctgggtctgtcccacggggcagggctttggggctgtgatgctctgggaagccagcttgggtcctgggtctacagagggccctggccccggagcccagccagctctgcctctctcagggcctggagtcctgggggagctcagccagctctgcctttctcagggcctggagtcctggatgaatcctgcaggtttttggttgcaccggcccagggaggaagcggggggtttgtcaggtgggctctcctggaggtcctcgagtggcaggggtgaggaggggattatctgaggcatctggagatgtatatcctgtggtttcccctgcccctctgtttccgatgaggtgtacggatgagtgacctgcactaagaagtgagttgccacagtgaaaatgggttggtttttgtcttcgacgctcagggtctgggcgcctcgcatttgcagtctgttgtgacagacacggggagctccgcgtgccagcctgtggctgccctgctgtgggggtcctggggccggcgaggccccttcagtcttgttctggggggacggcccactccggggagggggtgtgctgtgctgagcgctgtatccctgaatatagtttattttttctacatttgaattctgttgtagatttatgtaaaaatacattctttttgaaaataaaaattttcatgtcttctaaaaaaaaaaaa

SEQ ID NO: 693177 - DNA, 82 bp, Homo sapiens
gccctgaagatagaagtgtaatagataggcatgacaaacaggataataaaaaagttaatataaataaaaaataaaataatat

SEQ ID NO: 693178 - DNA, 185 bp, Homo sapiens
gtggcgcacgcctgtagtccctactcaaggggctgaggtgggaagactgcttgggcccagaagctcaaggctgcagtgggccatgatcgcaccactgtactccagcctgctgggcagagcaatgtactgtcttataacaaaaccaaaaagggcagaacacgtatggtttctaaaagtgccacaga

SEQ ID NO: 693179 - DNA, 285 bp, Homo sapiens
ttttaaggggggggggggggggccccccccaaaaatttcgggggttttccccccaaaatttccatttttttccggggaaaaaccccgaattcccccccctttttagggaaagggtttttccccccgtaacccccaaaaaacaaaggggtaaggggggcccttttcccttttttccttttctttggggttttccaaaacccccccccttcccccccccccaaaaaccccttttaggggggtttttcccccccccaaaattttattaaaaattttggccccccccca

SEQ ID NO: 693180 - DNA, 342 bp, Homo sapiens
gatcacctctctttcctgaaaaagcattgaaccgctgttgttttccggtcgcgaaacacctgcttcctgccggtgccgttgtcgacgatgcaggggtgaatgcaacaagcgtgcacaaaccggtaaccgaatgtgattttttcgtgaaaattgtcaacggcctgtaaaaaccgcataagcacgggctttttacgccgtttggtttggccttgtggcacctgccgcacgcccctgcggtagtgcataaaacctgcaccagaacaaaacgttaccggttcacccctttctgtgagtagtcggtggatccctttgaagcacaaatgggtcattttggtgcaggtg

SEQ ID NO: 693181 - DNA, 367 bp, Homo sapiens
  misc_feature (124)..(124): n is a, c, g, or t
tttttttaaaaaaagggggccccccttttctccctaaaaaagaaaaaaatttttttcccccccccaaaagggaggggcccccccccccccccccaaaggggggggccccctttgggaaaccttnctttttttccccccaaaaaggggggacccaaaaaaaaaccaattcccccccaacccccccccccccccaagttttaagccccccccccccaaaaaggggttcccccggccccccccagaaaggaaaaaaaatttttcccccccccggggcaaacttttttttttaccccggaaattttttttccctttttttttttccccccggggccaaaaaaccccccttttaaaggggtggtttttttta

SEQ ID NO: 693182 - DNA, 235 bp, Homo sapiens
cttgcttaccgagcacggttcactctaaaagtatccccatacgtatctgatagtaaacggcgtacgtgtaaaggccatttcacctggcagactctcatcacattgtcgtgacttgtacacacccctgcggcttcctccagtgctcgtgataggaggcagattcgttctcgccttctcaacataacgagtttcactggagttcatagtccgcatatcacgtgcgccacgtggacta

SEQ ID NO: 693183 - DNA, 107 bp, Homo sapiens
cactgaaatggtcaacattgtccaggtgcttggctgaatttataggggcatgtttctaggcatatcctctttcttttctcatcttcagctatagtcactgccaacaa

SEQ ID NO: 693184 - DNA, 1060 bp, Homo sapiens
agatgtatatcattctatgattgacccagggactggaagatgcagatggcaatgaatcatcagactcacatgacaaaccatccacccccacagagattcaagacagatatcattccatcagaccatccgagagataactagagagaattaacaaggcgatgcagccaaccacagcccagctaagttgtgtgtgtatttttggtagagacggggtttcaccagtgttggccaggctggtctcgaactcctgacctcaggtgatccacccacctcggcctcccaaagtgctgggattacaggcatgaaccaccgtgcccggccgtgatgcgcaactttctaataacatacttttgaaagtgcccagacatacatccctcctctggtaccacagtggccatcagttgccagagaacatgaaattatccagccctcagctctgcagcaggattctgaggagtaaagcaggcctgtaaagtactctaaagtacttcagagaggtaatgccacaaagcgaagaacaaccttcttgggaggcggagcccctcagccctatccaggccagcagtgtccacttgaaatctgaaagcagctccctcacaaaacagcaagatggaaaactccctgggttggcaagtggcctgggaagtacatggcccatctctgtcaggatagcagtggagaggttcgtgccagtgcaggtccaccaaccagaatggtctccagaatccaagctgtcatggggtggcaactcctgggtttctggtcaaaggggagttagactgaacattctggtctttcacgggaaagccattcttccgaattgtgcgggggtgaacccactgttccaccctttttgtgccgaggagggcaaacacggggaagccgacacgggggaaaaaaactcaaacacccaaaaccctgtcgacactcttataccacaagaggactatcacaaatatggcgcgccattaacaagaaacaccggcggttaatcccaacaagacaaaacaaccaaaccggagtccgcgcaccgcaagccaagcgaaaccaagacgtatgt

SEQ ID NO: 693185 - DNA, 694 bp, Homo sapiens
  misc_feature (21)..(21): n is a, c, g, or t
  misc_feature (62)..(62): n is a, c, g, or t
  misc_feature (105)..(105): n is a, c, g, or t
  misc_feature (125)..(125): n is a, c, g, or t
  misc_feature (143)..(143): n is a, c, g, or t
  misc_feature (167)..(167): n is a, c, g, or t
  misc_feature (172)..(172): n is a, c, g, or t
  misc_feature (179)..(179): n is a, c, g, or t
  misc_feature (185)..(185): n is a, c, g, or t
  misc_feature (192)..(192): n is a, c, g, or t
  misc_feature (196)..(197): n is a, c, g, or t
  misc_feature (200)..(200): n is a, c, g, or t
  misc_feature (202)..(202): n is a, c, g, or t
  misc_feature (246)..(247): n is a, c, g, or t
  misc_feature (284)..(284): n is a, c, g, or t
  misc_feature (290)..(290): n is a, c, g, or t
  misc_feature (371)..(371): n is a, c, g, or t
  misc_feature (399)..(399): n is a, c, g, or t
  misc_feature (437)..(437): n is a, c, g, or t
  misc_feature (487)..(487): n is a, c, g, or t
  misc_feature (494)..(494): n is a, c, g, or t
  misc_feature (510)..(510): n is a, c, g, or t
  misc_feature (518)..(518): n is a, c, g, or t
  misc_feature (536)..(536): n is a, c, g, or t
  misc_feature (548)..(548): n is a, c, g, or t
  misc_feature (575)..(575): n is a, c, g, or t
  misc_feature (600)..(600): n is a, c, g, or t
  misc_feature (609)..(609): n is a, c, g, or t
  misc_feature (620)..(620): n is a, c, g, or t
  misc_feature (688)..(688): n is a, c, g, or t
gggacttggcccttaccagcnagcgggtctagctcgcattggctcttggtgcgccaccagcncctgttacgcatgcgaggcccacggagagcctccagaggcacnatggaggcaagatgtgggcnggtggtgagggagcaggnctgtggagcttcctcaccagggtngctgnctctggncccggnctccccntccnnacngnggtccatgcgccactggcaaaggacagccagtccagccccttcnngcgcagtgaggcccccagccaggggggatgtggcggntgcttngctgttctgctttcttccctagttagcaaactgttacctagttatggtgtgaaggggagggggcagggacttaggaccaanggggggaggtaagctccgttgtttctanccgtggtaaatagccccagccttcgttgggggtacacngattaagaaatgggatcactcaggaggattgcgtgagcccaggagggcgnggcggcngtgagccatgatcgcnccactgcnctccagcttggggaatancaggaccctgtntctaaaaacaaagaaaaaagacaaggngatggaatcaaagcccagaggtccnccccttctnagagccaccantagttctctgtgaccatggaaaactacccccagccccactgccttttgcctccgggcagtggggtttngcgggg

SEQ ID NO: 693186 - DNA, 216 bp, Homo sapiens
cctcacgcagagcgctctgcgggtacgccagaggaggaagaaaaggtttagggggaactgactcatgctttgttcttaaactgacagagatgtccttggtattagtgacacactgattcgactttctgtgggcttagaggatgaggatgacctactggaagatctagatcaagctttgaaggcagcaccccctccaagtggaattcacagctagta

SEQ ID NO: 693187 - DNA, 193 bp, Homo sapiens
tggacccacggaggtgtctgttcatgggtgaaggtctaacacggcctgtacaaactgggtaaggagatgtaagagacatgggccaagtgctatatggaggaagagggtaatggcagggctctaggaagggcagtagccatggctgcccagtgagttacgtaaatcacctggtgtcggggaatctggaaatggc

SEQ ID NO: 693188 - DNA, 182 bp, Homo sapiens
ttgtggtgctaaactatgatgtagcctctcaagtactgataaaaatctgccttggtttgggaggccgaggcaggtggatcacctgtggtcaggaattccagaccagcctggccgacatggtgaaacgtcgtctctactaaaaatacaaaaattagctgggcgtggtggtgcacacctgcagt

SEQ ID NO: 693189 - DNA, 1066 bp, Homo sapiens
  misc_feature (327)..(327): n is a, c, g, or t
  misc_feature (335)..(335): n is a, c, g, or t
  misc_feature (343)..(343): n is a, c, g, or t
  misc_feature (355)..(355): n is a, c, g, or t
  misc_feature (386)..(386): n is a, c, g, or t
  misc_feature (546)..(546): n is a, c, g, or t
  misc_feature (570)..(570): n is a, c, g, or t
  misc_feature (573)..(573): n is a, c, g, or t
  misc_feature (578)..(578): n is a, c, g, or t
  misc_feature (584)..(584): n is a, c, g, or t
  misc_feature (592)..(592): n is a, c, g, or t
  misc_feature (595)..(595): n is a, c, g, or t
  misc_feature (1066)..(1066): n is a, c, g, or t
cacgggcgtcgggaagacgctgctggtgaaacggctgcaggatatccttccgcgcggggacgggaccggggcgcggggggcacccggactggggcggggactcaccctttagctgctcgggtccttgaccgcttcgcacaggtgagctcccgggatgggaaaggcgacctgggggagccgcccccgacacggcccacggtaggtgtccgcccccgcgggtggagttgcggggggtcagttctgcgcttggcgaagagctccgggctcctctaagtgcacgccgaggcgcagcgggtcaggtcgtgacttaaggccagccttcgggancggggganggcccganctgaggataatnggcgcgggatgagggggcctgcgccctccangggcacttcctctcccctcgcaacggcttcctgtggctggtcgcccccacagcgagtccagctactgatgggcgtcggtccctgctcgccgttcctgcgttagggagaatgggtctgcggggttcaggccaccgtgtaaggtgtgggcacggtgctcttnaggagttcacaacgggacagcggntgnattgntctctntgcatcgnggnttttcctataggtgggcaccaatcttactgacatcgtggccacagagaaagatcaccatccgggagcttggggggtgcatgggcccatctgtccagttacctatggaaccggcgcggccaaccggggggtgggaaccaaatagggacccataggaaagggccacattcgggacggcaagcccaacctggcgcgggtaaaagggcagggaaaaagggagaaaaccaccacggaaagaataaaaaggaggcccggggggcccggatggggatagaggagagcccaaggaccaagagagaacaaaagaaaggaaaacgaagacgaggcgccaaaaaaaaggcccgaagaaaccgagaaggaatggaaaagaaaagagggaaaaaaagagggagcagaaaaacaaagaagaaagaagagaaaacacacagagagaagaggataagacagaagagaaaagagtagacgacgaacgn

SEQ ID NO: 693190 - DNA, 134 bp, Homo sapiens
tccatagaagcagggaacactgggaacatgtataagatcgaaccggtcctacgcatcatcaccatttgcacgaaccagacatacgacgaaggtcagtttgtgctatccatcaaagtcacagatcagaggatccc

SEQ ID NO: 693191 - DNA, 851 bp, Homo sapiens
agcgggctgggcatggtgatgcgtgcctatagttccagctactaaggagacagaggcaggaggactcctttagtctatctctaaaaaaaaaaaaaaaaaaaaaaaaattaagttaaaccaaaaaacaatatgggtttggatgtcctattgggtataggacccaaccatatgttaaaggtggtgacttcttttagcttcaggtggtattgtagaaataaattcccaagtgtttcagtgtttcagaaaagtgggcataattgggcagaactagaaagaaaagaaaggcaataacctagtgttctaggccagaaaatacttgttcaactagttaagtatgagacaaagaggcaaaggatcaccattaagtggacggcaactaatgtgaactgcagtggtatgaaacacaagttacgaaccccaggaaaaagaattcacgtcgaaggccattaatgcttagagaacataaggggagcttaagtcagtggaaccagaaaaaaccgaacaaaaagccgagtcgaaacaaagaaaatattaaaagacggctactggggaagaatccccgattttgttcacaagtatcaaagaacgagggaccgcccagaaatatttgtaattcgccagagacttagccccgtaaaagagagaaaaagagcgcacagtgtgtgttattgtctgtgaataaaatagccgtaagtcgtgtgtaatgtacgcaaggagccaaacaggcttgctggagcaaccattgtagcggacagacaaagtgtagtgtaagtaaaaatctcccaggaaaaaaaaatcgccttctattacccccacacccaaaatatattttcacgtcgtgacagcaaccg

SEQ ID NO: 693192 - DNA, 761 bp, Homo sapiens
agccgcagggccgtatgcaggtgcatgtgacgccctagccggaatggcatgtgtcttgaagccccacttccacaagagactggtcaggcggccgcgatggaccacggtggttcaaccaggccggggccggacagggagtccgcatgacgtaaggcccggacaagccaaggcgcgccgtcatcgctccgcgccccgcggtcggggtcccactccggcccatcgtgcgctgcactccacgagttcggtactcactactgaagcgtgcgcgaccggccgtcggcttcagcctggcaggatgctcagaggatggcgcggtcgattcacgagagcaagcgtggacccgtgaccattcggacattatcttgtgtgactccgagcgcagagcggaatctaacgctccacgcgcatgtccctgacaggcccaagcggtgcaggcgtgtctgaacgtgagtacccgatcccaaaactcaatcctccttcccgcgaggaagccgcctctgggccgccaagcaagtggagacgagttcgtgctgaaagaagcgtgaaacgtaggacacccagatagaccaggacaaggtcatgccctgtcctggaacgtctatacggacggacgacagctcagagtcgatcactgattgaagagacagagtttccaaagccttcgctaagtctccgtcatggaccgtggcaaacgcccggctcttcggaatacggggcacaaagagccacagggaagccaggagaacaggaattgtttcgac

SEQ ID NO: 693193 - DNA, 392 bp, Homo sapiens
gtcacactagcaggatcccccctgtttccccctaaaatcaccacgatcaagagggacaagcatcaggcacgcagcattgcagctcaaaacgcttagcctagccacacccccacggtgaaacagcagtgattaacctttagacaataaacgaaagtgtaactaagctatactaaccccagggttggtccatttcgcgccagccaccgcgtgtcacactgatttaacccaagtcaagtacacgccggcgtacagagtgttttatgatcaccccctccccaataaagcttaaactcacctgagttgtaaaaaagctccagttgagcacaaaatatactacgacagtggctttaagcatatcttaacacacgatagctaagacccaaactgggatt

SEQ ID NO: 693194 - DNA, 121 bp, Homo sapiens
cttcagccactacaacagaattttaaatgacagtgcagaatgtggagtgtttttacattgatctttgctaatgcaattagcattatgtttgcatgtatgacttaataaatccttgaatcat

SEQ ID NO: 693195 - DNA, 140 bp, Homo sapiens
ggcatgtggtggtgcatctaagaagaatatcctctcacctcagcctccccagtagcccgctaagtcacagctacttgggaggctgaggtagaagcatcacttgagccaaggagtttgaggtaatacaggagctataatca

SEQ ID NO: 693196 - DNA, 638 bp, Homo sapiens
gtgtgctctcagaggaaattaaacaaaatcaaaaacagaaacgtagatgggaaatctcaaaataactggagattaaacaaaacacttctagataccagatgggtcaaacgaagaagtctgaacagaaactttctcaccaatgttttgaactacataaaaatgaaaatacaatgtatcaaaatttataggaagcagtgaaagtagtggttggagataaattataactattgaatgcctatattagaacgagattaaacaagatttaaaattcataatctaagtttccatcttaggaaactacgagacagacacagatcagtgctaagcctaaagcaagcaacccggcatagaacatcacacattatagtagaaatcaataaacatagcaacaaccaagaaaccaatagaaacaattcagtgaagtacacaatgtgctaatctgtgcagcagcaactagaaacacagacaataaaaacagtacttttcacaggtcagtaaaatgtataaacctcttagctaagcttactaagcaaaacataaaacacagatttgctgataaccagaaattgagaaccggggtcatcactactgatccccaaggaccttcacaaccgactaccaacacagacatctcactc

SEQ ID NO: 693197 - DNA, 221 bp, Homo sapiens
cgttgtctctaacagagacatagaagctctttgtttttgagagggagtttggctctggtggtccaggctggagtgcaatgatgcaatatcggctcactacaacctccgcctccggggttcaagagattctcctgcctcatcctcccgagtaactggaattacctgtacctgccagcatacccagctatttttggcatttttagtagagacaaagggaaaca

SEQ ID NO: 693198 - DNA, 1236 bp, Homo sapiens
  misc_feature (181)..(181): n is a, c, g, or t
  misc_feature (593)..(593): n is a, c, g, or t
gaagactgcctgggggtccaggagtactccaagctctgcctgaccagcatcttcctcctcttcctgctgtctgctgtctacctggtgccctggagttgccagggcccgtgttggagtgcagcgaaggtgtccacacgtcaatctagttggcaatgggtgaaggcgcatggagtggaatgancgcctccgactttccttaatgtcccgacacgaaatatgtcagggcaactaatctgccaactgtcaaactggttggccgacgttctaccatgcgtcaattatcctgtggcctcctgagattcttgaggccccgaggcgaggacgcctcaattggctacgtctgcttccgttccagacatggttgaaccacgacatgtccttgcgggcgctttatcgctggttggtgcgcggtgctccagtagagtcgcgaacgatctcatcaccactagttcgctggcaggcctccttaccctcgcgcgtgctgcctcagttcgtgctccacgcgaggcgcctatcgcttggaaccacttcggggggaggcgtgccggcagagatagccgcacagtcgatcgacagctgcgaggggcatcatncctcgctgcttctgcgctgatggtgcccttgggagcgctgtctttctggttccagagaaacgaagtgagcagaactcgtaggaaaggctcgtgggtaaggagagtgcgcgcggtgactgcatctcatgcacacgatgcttccttcaaagtaaccacgtgatcgagccgtcaatccctgctgctgacgcacctcgtgtctgaaagcgtttgacgttggaacccttttatctggacaccaacggccgcacttttccccaggtgagcctatctgggaagaaccatgtggggacgtatagggcgacacactttccctacgcgacaacatttggtggaaacgacactaggtcgcacagggcatagacgatagtaccattcctggttgaaacacgacccacgggtcgcgtgcttctttgcgagcacagcgacgttgcccctttcccgcgctttcgtctccggccgcggtgccccgtgatgttcccttttggtaggtcttcttccagcttctcccctttcccaatgtggtaaccgtgtcctctccttcttcttgtactctttcctcgcgccgtgccgtttttacctgagggacttccttatggtcctctgcagctgtgtgagactcgggacccgctcaggcattcggccg

SEQ ID NO: 693199 - DNA, 475 bp, Homo sapiens
ctcgcggagccgctcctgccgtcgccgccgcctttctcctaattcatcctggcgcaccataggcggcacaggcacaaatttgttcaaccgagtggtttgcccaaaagccagtcacgccgggagctggtacacagctctatgaccgcatctgaatgcacagttagaaggttggtttttacaagtccagcttacagacctgctagagccattattgtcccccatgcacgatatacgcactgcgggccttgtgctgcccatgcttataaacaaatgcgatccgtttattacccggagaattttcatccttgggccttttcattatgcgcccctctttcaatgtgcactttccagtgcggatatatataggcctctgtttgaccttcgtattgaccaacagatttaccgataactgtcgaagacaggatttgttgcgcttgcttttcctacagatccattcggatgttttccttttttc

SEQ ID NO: 693200 - DNA, 479 bp, Homo sapiens
  misc_feature (14)..(14): n is a, c, g, or t
  misc_feature (25)..(25): n is a, c, g, or t
  misc_feature (56)..(56): n is a, c, g, or t
  misc_feature (68)..(68): n is a, c, g, or t
  misc_feature (193)..(193): n is a, c, g, or t
  misc_feature (264)..(264): n is a, c, g, or t
  misc_feature (291)..(291): n is a, c, g, or t
  misc_feature (293)..(293): n is a, c, g, or t
  misc_feature (473)..(474): n is a, c, g, or t
aaaaaaaaaactgnaagctaagctnaagtgtcttccccaaaaatggccaacccaanatttgtgccttnaaaacccaagatcccctggtggcaataaggcaaccggagggaatctccctggtctgctggttgcgaaagacttggggggaaaagcatagtatctgggcccagggtgcactgttccctcatggcanagtccctcatggcttcccttggctaggggagggagttcccagaccccttgtgcttccccaggtgaggtganaccctaccctgcttcagctcgctgtcntngggctgcacccactgtctatccagtcccagtgaggtgaaccgggtacctctgttggaaatgcagaaatcacccgccttctgtgttgatctctctgtgagctgcagaccggagctgttccttttttggccatcttgccctggttcctagtcaagcattttttaagagaggattttcaccanngtaaa

SEQ ID NO: 693201 - DNA, 1014 bp, Homo sapiens
gccagctctgggtacccggctctgcgtcgcggtcccagtgatgtgggccactcgtccaggtgctcgtgctcagccagaacacaaagcgtgaatccagaagaaaagtacacctctggaaaccgtcaagtgctgtcaagactattgcagatatcatccgaacatgtttgtggaccctagagtccagtgatgaagatgctttgtggacgccaatgggatcgcattgtgagtgatgcaactgatggcaatgcctgttcttcgagagcttcaagtccaggcatccagctggtccaatgtccatgatctgacattagcctggacccaggatgaacgaggttggacgactgggaccagcatcagaaattattcttgcgaagggaaatgctgtctgtagctgagcagcttcctggagcagcgagatgcacccaacagtggtgatcatgtgcttagccgcgaaggcatcggatgactatgatcagcaccctaaagaaaataagtatcccagtctgacatcagtgacagtgatatgactgctgaacatcatcaagcagctctattactaccaaagccatcagtcggtggtcatctttgcgcttgcaacattgccctggatgctgtcaagcatggtacagccttgaggagaatggtcgcgcacagcagattgacataggaccactagtgcgcaagaagtgggaacagtgacttacactgacgagagcactcatatgaaggacctctctagttgactagcgtagcaagtctgtgacctaacagggattgtgatctcaatccacagctatcctggggctaataatcaagaagccttacggacattcgaagcgtgcgtggactcacattcttttggagcttaccgtgaaaagacgaaaagcaggatggcccttgcagcattacaccgacgatgagggaagcacacccgaaattccacaactgggggacgaggtcatccaaccgtacgcggcaagaaataacccaactgagcccgtgtgaccttaaata

SEQ ID NO: 693202 - DNA, 202 bp, Homo sapiens
tctacagttcatgcatcctttttaaaaatatgttttagaggacagaggtttaatcattctttatgaggctgagtgcagtggcttacgcctgtaatcccagcactttggtaggccaagtcaggcagatcaattgaggtcatgttgaaaccctgtctctactaaaaatatagaaatttagccaggtgtggtggtgcgtgcctat

SEQ ID NO: 693203 - DNA, 450 bp, Homo sapiens
actgatgctttccaatgttctctagcttaacgaggacctgctccatggagccgcgcggaacggggctcagatcacccagcgcaagttggaggcggcgcgtgatggcgtagcagtgcgagagactacctggagggcgagtgcgtgcagtggctccgcagatacctggagaacgggaaggacaagctggagcgcgctgaccccccaaagacacacgtgacccaccaccccatctctgaccatgaggccaccctgaggtgctgggccctgggtttctaccctgcggagatcacactgacctggacagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgcc

SEQ ID NO: 693204 - DNA, 130 bp, Homo sapiens
  misc_feature (91)..(91): n is a, c, g, or t
  misc_feature (126)..(126): n is a, c, g, or t
ggccctgcaggaattcggcacgagagcaggtggtaataccatgggtgctgtgacactaacagtcattgagaggtgggaggaagtccctccntccttggactggtatctcaggcaactattgtttcntcct

SEQ ID NO: 693205 - DNA, 800 bp, Homo sapiens
cggtttctgagcgttggtctttgtgactacgcgctacccccttttgctttggttctgccatgccgatgtaccaggtaaagccctatcacgggggcggcgcgcctctccgtgtggaggcttcccacctgccagtgtaccggtctccccaagtgcacggaggagctacggcccaggccgtgcgcgctgctcatcgtgcaggaaggagtctaacctgtctctgcaagctcttgagtcccggcgcaaggatcgatgttctaagagcagcgtctgtatgagttgaacaggctgccagtttgataggcctctcgcaagatgattcagacaccagatgccgacttggatgtaaccaacataatccaagcggatgagcccacgattttagtccacgcaatgcgctgggccttgacatcccaggtgccttgggaaggataacgggggcgcttgaacggactgtcgtgatcaaggcaaaagctccggactccccttcccctctcccggtggttgttgttgcaccagggctggctcttgtgatgccactccgaggggtcctgtccaccgtgtgcaccacgcgaattctcttcgggaccaaagagcgttgccttgaaaaaacctatctacaaggtgctttggggaagaaaacaggagttaaacaaaaacaaggccacggccaagaacatatcagctgggaactccactttaaaattggggaagaatggtgccgaaggactgcagattgaagtcagcatcccagaggatgtgccccatcgaagggcacagggcacttttgacgttcctgtact

SEQ ID NO: 693206 - DNA, 144 bp, Homo sapiens
atggatgtgtacctgtatcttcttcagcatcacccaaggtgacgacgaatcacctgtcgctaattacaacaccgcccaccatgagtccactgattgcacctttgtttgaacaacaaaggtttatcgccaaagcccgccaataca

SEQ ID NO: 693207 - DNA, 190 bp, Homo sapiens
gctgggattatatggacccgccacacacctgggcgatttttgtagttttagtagaggcaggtttcaccatgttggccaggctggtcttgaactcctgacctcaggtgagccacctgccttgtgctcccaaagtgctgagccactgctcccagctgatagtagctctttagcagcagacttgcatttcact

SEQ ID NO: 693208 - DNA, 1044 bp, Homo sapiens
gagtgggagcgggatgtgcgccttgtgcttgcaggatgtaatcgcggctgttcgcctggtgtggtgagtgagaggacggagagtgcctagtggtgagacatagggggaaggattgcagtgtgggcatcgggaagaggctaagttgacattatgaaataggaagtctgatgcgggggtacagtgtattcctgggatccggcggacgtgacctgtccgtgactagtgcatcgtgtgaaactagtttacgctgttgagaggtttaataatccgaactgtggagtagaggagctcaatgaacatcaggtccaagaaagaatttctctgtaagaagtgcctattacatgtcatctctagcttccagttttaccaagcgtgaaaaccaacggtgaagaactcaaaaggtttgcacagggagattttaatcgatctgtggtggaaaggtatacgaggaaggaaaagggttatggcaatttcattgattggaaggtgaacttggaacattgtttagcggtacatgccaagcttgataatctaatacgcatggactcattctgggacgcatgaactcctacaaaaggtgccaggaacgagtggcttctgcccaaggtggggacccaacgagaggattcttactgggaagtccctcagatgtgttgtaccactccgaaatttgtggcccgaatttgagcggttggttaatttcccctttgggggtgttgcggacgacacacggtcctttttaagcgccccttttgggattgcacttcgccaaagaaatttgggggcagctcgggaaaacgtcctcatcttttctcagggaccaccggttccaagagcctctttgggggagaaacctgtcccacattcggaagcggggaccaaacgggcgcgtcacaggaattcaatgtgtgtcacacctctgcgagaagggcgcgattcataacattttgatcacacttctttggttatggcacaccacttcgtggagcgtgcacaccagtaaaaataactatcccacacggggtccataagtgtcggcggcag

SEQ ID NO: 693209 - DNA, 1058 bp, Homo sapiens
  misc_feature (32)..(32): n is a, c, g, or t
agacgtacttgtagcagcaatccggtctgcgngcgcggggccggtgttgagtagagtgcacatatgtagtacctagcatgtgctccatatcgaaatatactgtggatcaatggacatcatgtgcagttgcaatactcgagacatttaaacaatcagctgcagtatcgtccactcgcatgcgatcctagggcatagatcctgtagtggacctactggacgagttcatgtgttgtcggcatcgtagtcaaagctagcccgagtctcgaaagcagatctttgcgggacttctcgaaattgagctcgttctccagtgctcttcgtgcagtgaacatgccttggtggctctggggctttcacatgaacaaggaagaccaacccgtggacttggggttgttctggttaggttgaccccctagtcccgggggattgtgccccctgttggggacacgttgtttgaacgagggacactgacacaccccatatgccaacgtttacaagtcaagcatcccctcctagccctgtgccaagcatgaagactcaatcattcctgtgaactcttcagagctattcaagcaattcaacacttttggcatttgcttcccgtacgccctcttgtgcacattgaacacgttcatgcccttgaaggcacctgcccttaacatggccaagttgtgtacagttggctcttaacaccagtcaagacgttggtgctgtgtgaacccggacattgtttcaccctgttgctgggacttggctcgcctctttcccaggacacccctttccttacaactgcagtcccttatccaagtgctcctttccgttgaaccactgtcacacttgcaggcgcttctcctcctaccgattggggcagccactgttcggcactggtagtggcgaaccctgttcccccgacatttggcaccttgctccattgagccaaacttggctattgccgaaacccaggtaagcaatggccacggaacccccttgtaatttacttccattcatcacagggacacagattggcccacacacatctagaagacttcaagtattca

SEQ ID NO: 693210 - DNA, 353 bp, Homo sapiens
caccactgcatatttattaaaatagctaaaataaaaaagacttaataaaatagactgacaatgtcaagtgtttctcaagtggcagaaaaactggaaatttcatacaccacttgtagatgtaaaattgtacaaccactttgaaaagcatgcatctaacatgtgatctaaccattctacttgtaggtatctggtcaagagaaaaggaaatatgtatgtctatacggacttgaatacaatgttcatagcagcattatttgtaaaggccaaaacctaaaaacaaccaaaatatccatcaacagatgagagcataatcatactctagtaaactaatccaatataataatatttcacaa

SEQ ID NO: 693211 - DNA, 980 bp, Homo sapiens
  misc_feature (35)..(35): n is a, c, g, or t
  misc_feature (48)..(48): n is a, c, g, or t
agttcttcaggcgcgacgtggttcacacacaaganggggcatctctcncaccacactataactgcggtagcccgtggtgaatacgttccccatgatgaggggtgcccgaggtctacagcgcctatatcactgtggcgagaatcatccgccgcctttgcttgtttcgaggcctctaatgaggagctcttttataactttttaggggcttgtacccacttttgcgagcaatgagtcagccatggtgcgcccaacctgcccccacattattagggagtacggtccaaactggctgacaccataaaacagtgttgcttgagggctcctcttcatgaagggggctccccaccagggctccccccaacatggggggctgccccccccccgcccgtcttcgttggaagtacaacacatacgttcaatgtcggggtgggtagaaatattgacagccccctgcacgaattaatttcttggtgagacgtcatagaaaatactgtctcgggccgcaccagactataacactgcatgtttctaccaagatgttgggcccacaacacacattccactcctcctcgcgctatcatttggttacaagcgcggtgcgtctcttcgggtgagaagatagtttcgtgaatatagtttgcgataggacagactcgagaataaaagatggggtagcaggttgccctgcctcatcatacaggagggaggacatcatcaattggaagcatcgatatacagtcgggggccccacacacgttgttgaaagaaggagttatgattcacctaggggcccgcctgccatagattatcgctcactcatagtgcagcactggagaaatacattgtgcggcagtttactggtcaccaccattgttgtggatctttgttcccaacatggccgcggccaaacaacaatacagtctgccacgctctgttgcccgccccccaaatggccccaaacttccattttcgcccacatc

SEQ ID NO: 693212 - DNA, 366 bp, Homo sapiens
gggtaacccatgaggaaggtgcttccgggtgtgactggtgggctaggcgtccctccggactgtcaggaccgcatctatgggcactttaccaaagcgggtgaacaatggtggaacgttggtccccggaagagtggtactacgagagaagtgagaaagaatatcgtatctattccagtgaaggtcagagctgatagaggtggtttctgatagctaggactctctgtgtgatagaatagcgagcagcgttcgtgtctccttaagtgggtgccccagatgggtgagcacactgaagtcttgaaagggtcatgcagaagtttcctggcatcgactatcccagtacctgagccccaaattttgatagatggc

SEQ ID NO: 693213 - DNA, 324 bp, Homo sapiens
tctagaggatgctctctctccacactggacggaaaccgtacgagttgtgctatcctgtcgagagaagcgttcagtgaatcagagatagcgcgtgtctgtacacaggcgagttcacgagggtgagaagcgctatggatgtgatcagtgaggaaaagccttcagtcagaaaggaagcttaattgttcacatcagagtccacacaggcctgaagccctatgcctgtacccagtgtggagagagtttccacaccagggggaattgtattctgcatggcaaaatccacacaggagagacaccctatctgtgcggccagtgtggagagag

SEQ ID NO: 693214 - DNA, 264 bp, Homo sapiens
cccccctaatgatagaattgagctggtaccgagtgaacttgacagtggtactggcaggcatttatagcagtgaccgggcgccattaaacgagtatatggaggtcagcactggtgctcacgtgtcgacggaacttgtacagggaggcatgcaccgcacgtggtgaatacacgtcgaccaggctccatctttgcgtcattgggtggtgcaccacggagctcacgtgttcacggagctggtacagggcaggcatgcacggcagcggc

SEQ ID NO: 693215 - DNA, 388 bp, Homo sapiens
cttactctgcatagactcatgagcactggccacgaggctataaactgtgatttatgcctctctgccatttattagcactatagccattaagcatagcattactctggactttattggcctgtttatatcaaattggactaacaaaaattgacataatacattcataacagaattgataggagatttaaatgaattaatgaatgtaagatactttacaaagcatgtgaagcactagaaacaatgaggtggcttcaattattgctcattctgagagctaaatttaaagggtcaggcgttagaaacgtgctccttcatatctaggagatggggaaattctgaactaaggtcttataagaacgatatgagcgtggtcattgtagatacttgg

SEQ ID NO: 693216 - DNA, 221 bp, Homo sapiens
aagtgaggaggaagtcactggccagtttgaggtgcttccattggtctgggtaactagccatttacttcctgattgtgcctagtatatcccagacagtttagttatctatgcagaagaatttatatatgaaattttacatttctttagcaacaaacttgattccttacttatcagatatcatagacaatacatccatagctaaaagtactgacgtcatactg

SEQ ID NO: 693217 - DNA, 218 bp, Homo sapiens
  misc_feature (132)..(132): n is a, c, g, or t
cgtatcaatgatccagtgatggtcagctataatccagaggttgggagcgagatcaagacagcaaacgacatggagaaacccgtctcttctaaaaaaacagaattagctgggtgtgtgtgcacatggctgtantccagctactcgggaggctaaggtgggagaatcgcttgaggccggggggtcagccagaggtttgcgggtggagccaatgatccatg

SEQ ID NO: 693218 - DNA, 899 bp, Homo sapiens
ggtgacattaggggcacagaggggccaacgaatggtgtcgaaaaaaccagtggtgcacgaacacgtgggcggcaccccatgttcggcaggtgcacgagggtataagggaacaccgtgcgcaccctgtcaggggcctcctccacacgaatcctgggaagacaccccaaggtgaacgagcaatggcgccttgtgatacacgtggcaacatgaggaagcgctcgcgtcaaatgcggtggtaggccccgctcgtggcaagaagaagatgtgcggagtccacacccatgggtagctaatactataaacagatgtcgataagtcacaccccttcacaacagcgctttcaagagaaaacccctgctttcccaaaaacttccggataaaattgttgtcccccaaccactatctcctttccaataagggtataccccattatgatattattaatacgaaaaatccccacctttggtttccccaggagtgacatatatccctatgtgtcaatcccacccaatccaacaagtctactgtcgcttcatccaagagctttcataccccgacccgggtgaagaaaggactgtggagacacacccccgtgatgttcaaaaggagcatacttgtttaccaaggcattatacatagtgagggaccctccttagaacggtctgtcacaacaagagacactgcgccctgtattctctctgcggatagaagaatgtggatctacttgtcgagaccatcattattataggtagtgctggatgttcctctccgcacacagttgtggaggtacttggagacaaataccgggttggtcggccacccactcacaggccaaataaaaaaggtgtgttgtgtttcccccaaaaaaaaacctcgccaaggacaaccaaacaaaaaca

SEQ ID NO: 693219 - DNA, 666 bp, Homo sapiens
cgagcaagctttctagcaccattctgttattgtgctgctgctgtggcccatgtatggtaatgtgaacattggtcatatgcttgtttccatagtgagcatcctgtgtcattgactatgtagcttgtgcattctcaccgaataaagaaactgccctgtgctggaaaacctgagctgttcttgaagcaaatcgcagattggagtatactgaggtcattcacttggatctcatcacacaggagtccaatgcgagcgtcgatatcgaaattactgcccctggccgatggaaagaacaagaagaagagagaagaagaaagagaaagagaggagagagagagaagggaagaagaagagagagaagaacgagagaagaaggagagagagaaaaaagagagaaaagagagagagaagagaaaaggagaacaaaagagaggggaaagacagaagaggcagaaccggggaggagagaagagaggagaaggaaaggcgacagtaggtaggagaggagagagagaagagagaggaagagagagggagctggagaagcgagggagaagagcggcgagaggaagacgagagccgaggggagggcgcggagagggacgcggaagagagaggagaagaaaagagagggcagagacgagagcagaggaagagaggaagagagaa

SEQ ID NO: 693220 - DNA, 246 bp, Homo sapiens
  misc_feature (5)..(5): n is a, c, g, or t
  misc_feature (11)..(11): n is a, c, g, or t
  misc_feature (18)..(18): n is a, c, g, or t
  misc_feature (22)..(22): n is a, c, g, or t
  misc_feature (27)..(27): n is a, c, g, or t
  misc_feature (45)..(46): n is a, c, g, or t
  misc_feature (53)..(53): n is a, c, g, or t
  misc_feature (65)..(65): n is a, c, g, or t
  misc_feature (76)..(76): n is a, c, g, or t
  misc_feature (82)..(82): n is a, c, g, or t
  misc_feature (102)..(102): n is a, c, g, or t
  misc_feature (107)..(107): n is a, c, g, or t
  misc_feature (123)..(123): n is a, c, g, or t
  misc_feature (126)..(126): n is a, c, g, or t
  misc_feature (134)..(135): n is a, c, g, or t
  misc_feature (141)..(141): n is a, c, g, or t
  misc_feature (155)..(155): n is a, c, g, or t
  misc_feature (158)..(158): n is a, c, g, or t
  misc_feature (201)..(201): n is a, c, g, or t
  misc_feature (205)..(205): n is a, c, g, or t
  misc_feature (217)..(217): n is a, c, g, or t
  misc_feature (244)..(245): n is a, c, g, or t
gaagntaactntaagaangggntgggnagatggatttattttttnnaactgtnaatatgtaaaanaaaacattatnttcccnggagtttttaatacagcganagaanagagatttgtgtgttnatnttaagagnnagagcnatataagcatcccnggnaagcaagtttgaaccagctgctggtgtaatgtacagttatatntgtntataaccggcgntgtttccgggaatttaatacattctcnnc

SEQ ID NO: 693221 - DNA, 123 bp, Homo sapiens
tatgaaacctaccatttttaatgctctgctctatgcataacctccatgaaaccttttctgtaccccctttgtcagagaggcatgcctctttcccctctcctggtttccacatggacatacttt

SEQ ID NO: 693222 - DNA, 1619 bp, Homo sapiens
gcccttgataagagagaggaaaaaaacaacaaaagagaaaacgagacataaaccaaaacagagaaacgaaaaaaaaaaaaaaaacaagagcaaaagaaacaaatagccaaaaaaaaaactagaacgcgcaaccgcaaagacagaggaacagatgaagggagaagaaaggcacgagcgcagagaagacaaagaagagacgcggccgcgcacagacacagacagccaacgcgggagcacaacaaaccaacaagcaagaagaacaaaacaaaagcaacgacgaaagcagagaaagagacagaggcgagcagaagaaagagacgaaaagacaaggaacgaaagaaggagagagaagaaaggagggaagagcaagaagagagaggaaagagagagggcaccagcagagagagaggaggagagaagggagagagaaaagagaggagaaaggcaagcagaggagagagaaggagcaaaggaagaaaagacacaagaagaagaaagaaaaaaaaggcgaaagaagcaggcgggagaagaaagacgaagaggaagcaccagcgacaagaaaaggagggaggcacacagacgaggagagcgcaggagacgacaacgggaacagaacaacgggaaacggcggcagaaggaaacgcgagaaaaggtgaagggacaccaaaaggagcgagggcgcagacggagaacagaagcggcaggaggcaaccgaaggagagacagcgacgagagagagaaaggagagcggggaacagggagagaaagaacggagaagagcaagagaacaaagaggcggacacagacgagagagaagcaccggacagcgaatggggagcgacgagcaacggcaagaaagagaagccaacgcacgcgggccgagagggagccagcgacaaaggacgagaaggaacgagacgaaagagaagagagagacaagaaaaaaaagagaaagaacaacgcagaacagcacaacgcaaacacaccggagaaggaacaaggaaaacgaagagacgaagagacacacgaagacaggagagaaaggacgcgagacaggcacaagcgagagaagagagcagtacggaaagagcgagcgagacgcagaaggcgaggaggaccagaagacaagacagagggaagagacggaaacgcaagagcgagacgcagacgcgacagaagacgacagaagacaagcaaagagaaaaaacggaaggaagagcgaggcagagagcgcgcacagggcgagcggcacgagagcacgaaggacggcagaaaggcaagacacgaagacgggccagacgcgcagaagagacagaagcaggaagagacaggccaacacgaagcagaagagagagaggaagagagccaagagagaaaaagcaacgaaggaaagacaagaacaacaaaagagagagacacagagagaacaacaaccagacggaagagtgaacggaagacaacgagagaaggaatggaagacagcgaaagcacaccgaagaacaagccagagcaggagggaacagacgacgagacagagaagcgagaacgagcggacgaacaacacggacgagaacagacagaacgcgcgacacagaaagagcagacacacggacagcgca

SEQ ID NO: 693223 - DNA, 235 bp, Homo sapiens
atcgaagtacaggggggacgccgagccacaaggacaatcatcttgacgagctggacatcactcgtgggtcgtggttccatgtaaatgagtgcatctccagcgtcaatcatctatttctgaatagtcttctttacactcttgaaccttctgtcctttcaatccatccaccaagatgataccctcataaaatcctttgagatatatctgctcctctgcttctgcaagtatttcccgc

SEQ ID NO: 693224 - DNA, 189 bp, Homo sapiens
aatagaggtggcttttcacctgttagccaggctggtctcgaactcctgacctcaggtgatccacccgccttggcctcccaaagtgctgggattacaggcgtgagccaccgtgctaaaccgccttctattaattctatctgcggccacaagtccttatataatccagacattcccttctgtcgtcttctc

SEQ ID NO: 693225 - DNA, 126 bp, Homo sapiens
  misc_feature (1)..(1): n is a, c, g, or t
ntataatccatatcgagaggctgaggaggagaatacttgaaccacagtgcagaggttgcagtaagctgagatcaggtcactgatctccagcctaggtgacaaagcgaaactcagtctcaaaaaaaa

SEQ ID NO: 693226 - DNA, 998 bp, Homo sapiens
  misc_feature (295)..(295): n is a, c, g, or t
gctccagacgtcgcgtttctctgccggtcgcgatggaagaagagatcgccgcgactggtcattgacaatggctccgagcatgtgcagaagcgtggttttgctggggacgactgctccctcagagcctgtgttgtccttccatcgtccgggcgccccagagactcgaggtcgtcatgtgtgggcatgggccagaaggactccttacgtgggtcgacgaggccacggagcaaggcgtggcacatcctgatcccttgaaagtagccctccattgaagcagtggcactcgatctagcancatggggatcgaacatgtggcatgaacgaatcctgtgcacccaacatctcgtttctaacatacggaagcgttgctctgtaggcctccggcagcggagcaacctcggagttgcattgcattgtacctggagggcctccactcgttgaacctcgcgaagtgtcctagagcacgagcagcacagaatgaccttcgagcattctgatcgttttattgacgaacgcattatccagagcgaacacaccatgggtccacatagttaccgagttgagcgccaattcgctatgcgcgcatgtttgcattgggtaccccgttccttaaccggcccgttcgttggggatgcttggcaaacccgaatcgtttgtgacacacttatttgcttcgaacttggggcaccagtacggtagcgtacgcacacggaggcggattacaaagcccgcgaatcgaaacaggtggcattaggccccccaagttccattatccggcaaaggaaggtggccgtttaaaccgcggcccgccaccgtatactccatctaggagccaggactaggacacctaaggttcccccttttgccgcggagttcctgtggggggagagatgccattatggtgggccatttcgggcgggcactccagggaggcaggcacctcccgatcttggaagtctcccccgaggaaacgcgattaaagtcgccggtttcccaag

SEQ ID NO: 693227 - DNA, 619 bp, Homo sapiens
tctgcagactctagcgccagcgtaactggggagatgaaatacatcaggagccagtataagcttatcaagggtggccccagttcttgagctgggaagagtctttgaggtcgaggcaagaggaggatgaaaacccagaactggaagctgagaccttcattgctttccattagtctgtccccacctctctccattcaataggtgatggtcttctagcaacttgttagccacacagaattcatctgcagtaggccacattctgctgtacaatgctacagacatctcaaagaccacaccatgagaaccactgtggtagacatatggcatgttaaaatgctaactaggctgggcacggtggttcacgcctgtaatcccagcactttgggaggccgaggcgggtggatcaccaggtcaggagttcaagaccagcctgaccaacatggtgaaaacccatctctactaaaaatacaaaaattagccaggtgtggtggcgcacgcctgtaatcccagctactcaggagactgaggcagaaaaatcgcttgaacccaggaggtggaggtcgcagtgagcccagatcatgccactgcccccagcctggcgacagacgagactctgctcaac

SEQ ID NO: 693228 - DNA, 1300 bp, Homo sapiens
  misc_feature (19)..(19): n is a, c, g, or t
  misc_feature (56)..(57): n is a, c, g, or t
  misc_feature (241)..(241): n is a, c, g, or t
  misc_feature (511)..(511): n is a, c, g, or t
  misc_feature (627)..(627): n is a, c, g, or t
  misc_feature (677)..(677): n is a, c, g, or t
  misc_feature (716)..(716): n is a, c, g, or t
  misc_feature (806)..(806): n is a, c, g, or t
  misc_feature (875)..(875): n is a, c, g, or t
  misc_feature (949)..(949): n is a, c, g, or t
  misc_feature (1169)..(1169): n is a, c, g, or t
  misc_feature (1196)..(1196): n is a, c, g, or t
  misc_feature (1212)..(1212): n is a, c, g, or t
  misc_feature (1279)..(1279): n is a, c, g, or t
aaaaaaaagagaaaaaaanaaaaaaaaaaagaaaaactgaaaaaggacacgggaanncctgctagggatactggcaggcaccagttatgatgataatgccatactgagaataccacccatcggccttacgcatgtgatctggtcatccagtcactgactcggagcttgtcgccctcatgcctcatcacctctgtctataccattttctaacatcatccatcgtcctcgtcaaacgtctccnacgtcgcacaatactgtctacgcgagcagctacaatgcagtactcgtctcctctaaccacacgcacgagcaagccatatatgcctcgcctccttgtaaacgctacgtacttgtcgaacacaacatcgccaacacactcactcctactcactcaaaccacacaataagcatctcttcaagaaagtcgcgacgaacacacactctaccaaatcacacatggcatcccaataatagacgcggccagcgacgtcgaataacgtatctttcggcntaaacactacgtctagcacacgctcaccccgtagtacataacacttacacagccgtccaccatacaatacatcgctgccataatatatcaactacacgactactctccacttcttnaccgatcctcctcacagcacatgccaccttcaaatctctttcgtacgatnttactcttacgcctacgtacactaccacgccgcacgtcnctacttcctcgcacgcgcctgcccgacatatgataactgccgaacaccgatccacacctgtattcagcgcaccgagtcctacgtgtacancgtcacccttcacaataataagtagatcacgctcaccaacaacacaacacccacacagtcctcataacncacctacgagtccgcctctaccatacatcatcgaccaacacacgatctcattaatacaatcacaccaatctatncgctacgaccaacacacaacacagtacggctcttcaccgccatctacgaatcgagtcccgccactacaagctcgcacctctacaccagtaccactatactcacttattctacacgcctatcactatccgcacgcgcctcaaacgataaccacatctgcacacactgagactagaaatactctagtcagacactattccacacctctcgccgccgctcgcntcacgagacaccgcgaacggtatcaanttaagtcatacgcacnctctacgacatccctcgcctactcctcaccgaagtagctaacactgactagcgcagacaccagcacnctcacctcgcgacgttccccg

SEQ ID NO: 693229 - DNA, 319 bp, Homo sapiens
ccccccccccaaagttaccctgtgtgtgtgtggggaggtgtaataacttttcagtgttttgagttgattccccaaaggcaaattttggaatgtttttgcgctttgtgcccttggaggggaaaaccccactacatatgcccttttttggttgtgtgtgctataaaaaggttggaaggggtggttggaaggggaaaaaaacttaaatggcccttttttactcgactgctgggatgtatttgcttttgggagccaactgagttttttttgccatttgttttattgtttgggtttactggcgccaataaactttttcccctta

SEQ ID NO: 693230 - DNA, 211 bp, Homo sapiens
  misc_feature (5)..(5): n is a, c, g, or t
gttgntcactgccccatagagaccaagttctgcggttttgggcactggaggaggcttaggagcaccaggagacccagtgctcagagtgcaggggtggtgaggacccccacagcttctacttccctggacagttcgccttctccaagtgcctcgcccgaagttaagccagcactgagatgcgtggtgctccaggaccgctgcgggtggtaac

SEQ ID NO: 693231 - DNA, 207 bp, Homo sapiens
aagtggccagcagatccacgtgggtgtctttggtgttagccatggtaatagtctagcttaactggcgtggctagcccagaattggacttaacgtgcccccagaggtgaggcagtcagactgcttccaggttcttggctatagtaaacagttggtgtgcaaacatacagcactcattttacttcaagaatcagaaaattacccgagac

SEQ ID NO: 693232 - DNA, 1298 bp, Homo sapiens
gtgcagctggaagatggcggcgtccgtggtctggtcgggccagctaccgccggggccacaagtgctattgcgcgcccgccggatcgccggacccgtgctgcggtacgccagccttgcggagtacggcaacgcttcgcctcaggcagctccagcttctgtgccagggagacgcatggttaggcctgactgtgacaacagggctgcgatgtggtcctccgacgcagatcctctcaggccacattgcacgagtgaggacgtgttggatttgactgtccgggacgcgcgttttccgaagaatcgtgcacaaaggcaagtaatctagacggagcgcgagcctgacctactagacgcggcaggcagtactggggcgttagcaatacgcgggccccgtgcacgaactcgggggccctcgggcacggtcgcccgcatgaggagaaaacggacgcgttggccgaacggccattgcctgcgagcgccccactccttcactagccccctacacgggaaaagcctctgcgcgcggagcgcctcctagcgagcctcttctaccgtaactagtccacaaggcggaagggcctggacacccatggggggcaactgcctgggcgcgggacacacacgcctggtgtgcgcaagaacatttccctgggagagtggacgccaccgtctggacgggcgcgaagccaaaaccgttgggtccaacaccttcgtcgccgcacacggtacgcatacccaaccgacaagcaaaccttgtcgcagcgccaacaagggcgcgacaacacagcgggctcgcaacacagcgcccggcacccgtgccccgcatcggacgccggcggcaaacgcaaactgaccgcacccgcggcacagccacgccatgccacgtgggcgacactcactatagcgcgcccccaacaaggcgccgtggcctcggcgccacaaccccacaccacaccccgaccgcccccacagctgccacgcagggcccacgacaccatgacagcggcacggattcagccacacacgggaggcagacacaacaacgcagcgccaccgcgccacacggacacacacccaacaacggaggccccatgccccgacacaacagacagcggcgcgacgacccaacgaccacactgccggacacacatgcgcgaccacgtggacaaaaccaccctgggaccaccgcgcccggcgaccgtcacactacgtccacccagacaagacgacaccccccaaccaccacccgaacccccaccaccgaccccaacaaccccccaccaccccacaccaaccacgcg

SEQ ID NO: 693233 - DNA, 839 bp, Homo sapiens
ggggaccccaggaccagctgtgtcagggagtttccatgtgaccacccatctggcttgctccctcaagcccatggagtgcagcatgtagctattccctttagcaccgagtcgtgtcccacctccagggtcctgacacaggtcagagatgtcccctgctcatgcagagcaggaagcctctagtctgggcctggacgtgtccctgtctccagctcctgccaggggacagggtttctcctctggactagctcttggcccacacgcagagtctgttagccagttcagcaggacggaggacgaacggagccgcctcagtcagacgtgggtgctaggtttctgcgtcatgacgcgttgtctcactttggcgttccagagcgcgccatgacaactgcgctgcctgggcgctgtaagctgttccagggtggccgcgtggcagtggcgggagccccacatgcccgttcagcaccgtccagccaagttaatccacaggctctggcctctgacgtcccgatcatctgcatgcttgaccacccagtctcaggggatccatgactagtcgtcgagtcatctctcacgactcacccagcgaggccgaacccttggtcacaaggtcatgttctgcagtgcccctagatgtgtatctggactatgcatgcaccagtccgtgtggtcgccaatgtctcaccccgtgggcttcccgcttacagtgccggaactgggggttttcgggcccactgagtcggatctgcgctcggagtactccggggatgggctgctggaggaccctttgcttccctacccttactcgtcccatccgctgggctgggccttttcacttccga

SEQ ID NO: 693234 - DNA, 802 bp, Homo sapiens
  misc_feature (396)..(396): n is a, c, g, or t
taaagcatttgggttattttaagttaaagaaaaacagctttctccaggggcgacaaagtgaactgaaggtcaaaaggaagctgggtgcgggctttcctgcaagctctgtgccccaaaaccgggaagtgaggaaagggcgctccggagctcgtggggaaggtgggtgcacacaggggttcccgtggcgcggggggaaaagagccgccagcccacacacggccacgggatggggtgtgaggtgggtccaagcgacggtgccagtgtgctagttccacgtgacagtgattgacattaacatttctgggggggcatcaaattaaggaagtgacacagggagccaagagaggtggctatccggagggatcctcgaatccacaactcaggaaactagccctntatctgggtgcacaccataaatctccatattccctgggggagcgaaactctcgacaggagagggtgaacactcggcccccggggggcttcgactgctcccgcacggcggcccgtgcccttcaggatgaagctgtgcatgaggcgggccaacgggggcgggggggggggttgcccatggtgccctcgagggcgaaatggccttctggtgtcccgaacgatgatccccctgccactccccttcgtggcgtctgacagcccgctccagttgtcctccttcccaccttcttgcccccaggttgtgtgagttcgccagtggcgtggcaggcccagcaggctcacatgtgcatcgcactgtgcaccttcccgtgggcgctccaggcgagaactttctcccaactctgcagcc

SEQ ID NO: 693235 - DNA, 451 bp, Homo sapiens
aaccccattgtggtaataaattcaaccccacagatgaagtaatcattggttgaagtaatcattgaagtaatcattggttgaacagtactttcttgattatccggccctaaacaatgtaatagtactttgatacacttctgaggagtgcctacgccgacaagtcctgtaacagcctttcatttaggccaattttttggccactggtttaaagcaatgatagagacatctgctccagtgtctaccaacccttcaaactgttttccttgaataatggccttacacacaggtctgctctctgagaactgacttgcccaatatgcagcctttcctgccggatcagtgcttccaaaccctcctttctatttatctcactgtttccaaccttaatataaggcaggagtaacaactgagcaatcctgtctcctggactggcactgcaaggaattgagga

SEQ ID NO: 693236 - DNA, 343 bp, Homo sapiens
ggggcagtgagcggggcagggatgaggcccgaggtgggggcggtggccaggacaacgggcctccccgggggtccccggacgctggctcgggactgtcttcaaccctgccctgcaccttgggcacgggagagcgccacccgcccgcccccgccctcgctccgggtgcgtgaccggcccgccaccttgtacagaaccagcactcccagggcccgagcgcgtgccttccccgtgcggcccgtgcgcagccgcgctctgcccctccgtccccagggtgcaggcgcgcaccgcccaacccccacctcccggtgtatgcagtggtgatgcctaaaggaatgtcacgcaa

SEQ ID NO: 693237 - DNA, 156 bp, Homo sapiens
gaatgcgctgatggcaaaggagggagaggtgtgcccccacaaagatacgtgcatccaactcaagagcgtccgcaaagggacaaaggggaaaagtgtggtccacatacgtgggacccacagaaagaggaaacgctactggagcgctgtccagagacc

SEQ ID NO: 693238 - DNA, 1278 bp, Homo sapiens
gggccgcttcagccgcctggagaaccgctacgaggcgctggccaagcaagtagcctccgagatgcgcttctgtgcatggacctctgtgctgctgccctgtgagcatggagaatgcttgcagtggctgtggatgttgctggtgcttgctgcttagtgctgcatgttgtggtgtgtggccatgtgccccatgtgacatgcctggagctctggccttgctgtgtgtgtgtgtgctgcttccttgtgtgactgcttgctgtcctcccatctgccctggtgtgccttgtcccttgcccagctgccaccatggcttggagtgctggatgttgggatggatgccttggagccatgtgccctgtcaaggttctgcagtgcatcgggtgttggcgttgtcgggactgggtggcttgctttctctacacatgcctctaccgctggccttcaaccttcacccctgcattcgtcgtgtgacccttgtggaccctccagtgcatgctgtggcctgtggcaccgtgagggttgggacccaccgatggcgcagagcgcggtgccgaatgcagccctggttcaggccctggagcgagggttttgcgggtagttgcacggaccaattcggcggggtgctgcctgttggctgccattagccccgtgcggcaggtcgtgggacgggcgcaggggtggggactggaccggcgggaccttgggccgtcccccacgctgctgcggtggcgccgcggcttcgggtgggcgtatttacaacaggttgtcgccattcatcgcccgagggccgggtcccccggaggttattgaggtggcacttgctgccggaccatcctacggcgagcccacatcagtcacggccctgtcgacggctaaggcaaggagcgggcctactggagagcatgagaactcaaatactggcttccagcgaaatatccatctatcacgacacacctctgaggacactcaattatgcagggtcggcaacagggagtcacatcctcagtggcacgtgcgacatatggggactcagagcccccaccacggacaacgagaggggagactgccgggacccacaaaagagcgggacgaaactcgacagagcgggtaagttacgaaaagacgagaaaagagcagaagcatacgaccgcacgacagggacgccaacagatcgcacacccgagaggagcccgaatgacgcgaaagcgcacacgatgacacagcaaattcctacgacacacagtagcatgcgacacaacatacagaagaaaaacgacgaat

SEQ ID NO: 693239 - DNA, 313 bp, Homo sapiens
cacacaaagcctgtttggtgagctcttcacacagacgcgcatgaaagggaagacatagggaaaactaggcctctgagggaggtactactgagacagccaggtgggaaggactccttggacaaactccaaccagcctgtacactgggaggaatgtgcactgggatggagccatagaagtttgtgtcgattgcagtggggaggagcctggtccctcctcttcctgtgaggaacctggaattcaatctgcgaggttgttctggagatgttctgtggagactgcattaaacacagcttcgcaccattgaataaactc

SEQ ID NO: 693240 - DNA, 718 bp, Homo sapiens
  misc_feature (16)..(16): n is a, c, g, or t
  misc_feature (20)..(20): n is a, c, g, or t
  misc_feature (40)..(40): n is a, c, g, or t
  misc_feature (73)..(73): n is a, c, g, or t
  misc_feature (76)..(76): n is a, c, g, or t
  misc_feature (90)..(91): n is a, c, g, or t
  misc_feature (96)..(96): n is a, c, g, or t
  misc_feature (121)..(121): n is a, c, g, or t
  misc_feature (129)..(129): n is a, c, g, or t
  misc_feature (133)..(133): n is a, c, g, or t
  misc_feature (139)..(139): n is a, c, g, or t
  misc_feature (155)..(155): n is a, c, g, or t
  misc_feature (161)..(161): n is a, c, g, or t
  misc_feature (172)..(172): n is a, c, g, or t
  misc_feature (177)..(177): n is a, c, g, or t
  misc_feature (190)..(190): n is a, c, g, or t
  misc_feature (192)..(192): n is a, c, g, or t
  misc_feature (209)..(209): n is a, c, g, or t
  misc_feature (226)..(226): n is a, c, g, or t
  misc_feature (228)..(228): n is a, c, g, or t
  misc_feature (232)..(232): n is a, c, g, or t
  misc_feature (259)..(259): n is a, c, g, or t
  misc_feature (272)..(272): n is a, c, g, or t
  misc_feature (275)..(275): n is a, c, g, or t
  misc_feature (290)..(290): n is a, c, g, or t
  misc_feature (293)..(293): n is a, c, g, or t
  misc_feature (299)..(299): n is a, c, g, or t
  misc_feature (323)..(323): n is a, c, g, or t
  misc_feature (328)..(328): n is a, c, g, or t
  misc_feature (342)..(342): n is a, c, g, or t
  misc_feature (359)..(359): n is a, c, g, or t
  misc_feature (366)..(366): n is a, c, g, or t
  misc_feature (376)..(376): n is a, c, g, or t
  misc_feature (384)..(384): n is a, c, g, or t
  misc_feature (388)..(388): n is a, c, g, or t
  misc_feature (406)..(406): n is a, c, g, or t
  misc_feature (420)..(420): n is a, c, g, or t
  misc_feature (428)..(428): n is a, c, g, or t
  misc_feature (430)..(430): n is a, c, g, or t
  misc_feature (446)..(446): n is a, c, g, or t
  misc_feature (482)..(482): n is a, c, g, or t
  misc_feature (493)..(493): n is a, c, g, or t
  misc_feature (543)..(543): n is a, c, g, or t
  misc_feature (569)..(569): n is a, c, g, or t
  misc_feature (619)..(619): n is a, c, g, or t
  misc_feature (628)..(628): n is a, c, g, or t
  misc_feature (642)..(642): n is a, c, g, or t
  misc_feature (690)..(690): n is a, c, g, or t
tccattcctacatatntttntttggttttgatgatggggnaccccgtcaaaaattcctgtgagggggactacnacncggctgtgaggggnnttgcnacatttacatacatgtggcttatcncatacgtnaacntttacncaaatagtacagcggngaaccnccaagttctcnttccncattcctttcccncnctgcgtttacctgcccnttcttgaaactgggtcncngggnagcccattgcatttcaacaggccttgngctgcttctcagnggnagttaactcaatggngcnaaagcncagggcagcgacaaggcattcacnctacncagacatgtgatcncttactgacagcggggnggggagngagatggggntcccgggngggnaagcgacaacatgcatcncaggggccatgtgngaggcggngngggccgctggtacgcngcgtcccttgccaagggatgcctcacagccatccgngaatgacaggnacgaaacatgagggccttcctcgggtcagttaagcatcatgctgggaggnctcccacgtgtcccggtacacaggtnctggcactcatccgaccacagcttgctgtttggtccccaaaatgggcccncacccaggngctgccaacacggnggctccgtctgagtcccttcgggtctccatcccatgggggtgcacgtntcagttttcctctaaccactgcttgagc

SEQ ID NO: 693241 - DNA, 297 bp, Homo sapiens
gcacgctctgagagcagacgagtctgatcgatagtctacagtgtctccttattggcataaagcccgaatgtagcgctagcggtggatgtggggttttccccaggacactgtcaggttttatcgttagatcgctgcccgggaggcacggggcagcccgaatgcctcgatcactcccagagatcgttgccgcgactgttgagattgtagataaggtcctggagattcctcctccccgcccccccattcccttcctcacttccctcttccacaaataaagccgcagctagaagatgaaaa

SEQ ID NO: 693242 - DNA, 488 bp, Homo sapiens
  misc_feature (292)..(292): n is a, c, g, or t
  misc_feature (295)..(295): n is a, c, g, or t
  misc_feature (297)..(297): n is a, c, g, or t
  misc_feature (304)..(304): n is a, c, g, or t
tgtggagaggggctcaccgtgttagccaagatggtcttgatctaggtcaaggagactttcatatcataagtctattgtgaaacaattcctatcttattcttagaaatccatagatacgaaatttctctgtgccttttattgactatgatagagaactcttgtgtcttccatggtttacaacatataagaactttgacgtttcgttcgtgttttctcatcttggtagagaagaaggttataagtctatcaaggccaggattcattgttctttcttggtcaacttttggaaatntangntgaagantctcaactaactgtattaaatctgcagaaagaattaatccttaagacctcatcaacaatcttttgtataaactagacttctctcttttagttaattctagccttagacatgaggatcttcttgtatccgctgtcaagccattagtgcatagctgaggttacacattcaaagaagatgggcttca

SEQ ID NO: 693243 - DNA, 176 bp, Homo sapiens
tcatcgagctcggtaccgtttcttcgttctgcggtactccaggcctcgttcatcgcctgttccgtccaagccctcccgatgaacacgacgcattccgttgcctccccatgaacacgacgcattccgttgcctccccatgaacacgacgatgacgctgtttctccgtttcgacccag

SEQ ID NO: 693244 - DNA, 147 bp, Homo sapiens
agctgttcaatggaatggcgcatgcaaacagcgcaggcagtggcagggtgtggtgggtgatggtggcctcactcgagagtggaccaaggcccagctccttgcccaaaaccaaatgcccttgggccccgaagtttttagcataacatc

SEQ ID NO: 693245 - DNA, 455 bp, Homo sapiens
  misc_feature (193)..(194): n is a, c, g, or t
ggcccttggggccagatttggcccagtgtaagttttcccccaccccccccggggcctggggtgggcaaaccgttttccatggggggaactatgggcccagggcccccgagttttaattttttcttccgtggaggaaacacccaagggtgggttggggggggggccccattttgtggggttccttttttcccannattacaggaagccccccccgttcttggggtgggggtttttccttttcccgggctggaagggattaaccccccggccgggttttccccccctccccccgttgtttggcagggggcccccaggattccccgccccccccgtgggtggcccaaccccccccctgtggcccctttggcccctttggccctttttttttccggggccccctggggccgggggtgttcccttaactgttccctttaaaatgggcccgttttggggga

SEQ ID NO: 693246 - DNA, 139 bp, Homo sapiens
aatgtcccttactcacaccacagcagtcctagggctctactaaactaccctggcaccctgacagagctataccctgacaagggggggcactaggtaccttaggcgccccaggttacacaagtgagtatcaagaggatca

SEQ ID NO: 693247 - DNA, 1423 bp, Homo sapiens
  misc_feature (282)..(282): n is a, c, g, or t
agcggattgagatccttttccggaggggtcagctcctgacgggttcctgagccagtcttaatctgggcaaaggagatgaggaggccgtacgtcctgatgtacttggtgtactgggtggcatgctgttacccagaatgttgggcccaacagcggagcaatgagttgtgcgtctgtgcaaaccgtgttcttgtaatgagcagcatgaccatcgttttgcaatgaatcctgttaacgtgactgatgcggtaccacgagcttccatggcgtcacttcagtctcccntctttgcggcagcgacgcgcggacgtccctcggcaccccatggactcgtcactggggacgcgaagacgttggacgagaggcgacagcaagggaagactcctagaagcgtttggacacgaagggaacgacgacaacgagaatcattgatgcgttgttgggacttattaaaaagaattcattgaaaagcagcacacgcttagaagtcaacacagtatgggaatcaagacatgacgcgtctagaagctccaacaggactcgtaaacgtatgttgggaacctgggacaacgagacacaaggacgactcggaaaagttttcccagacccaggaaaatctacctcatgggttatcaacggattgcaacggaaatttggacacatgcactcctggcgaagcatcgtttaatcttatggccatcccgagtggaacatgaattttccacttgtctgtaatttctgcacttcacggtaacacaaggcggggggaatttccttaacaggaaacggtcaaaacgcaacggtaaaaccatgttgaggatccacttatatatagaagcctgtggtcgacttctttgggggaattattggcggaacttgctttattgaatggtggccagttacccacgtaaggaacaggcacggcaatttgccccccttttttagattttcggggtagcctatgggttaaccccccggaatttggcataggcgttatttaatggcaagaccatgtgaacaattccctaacggtttttttcaaaacacaaaaccaggttgagagcgcgaaacaaaatctgaccccaaagaaaaacccctgctgtgaagggggcaagtgcatgggaataacaagggctatattaggccgaatgtaaattcttttctaaatttagagggtttggaatacccgcattaagttttggttcacaaccttgcggagagaaaacagtgaggtgccgggaaaaggcgtggggggcccctagaattcttttggacgcttatattatctttgcaataaacgtataaataggaaaaagaaacactttttgtaagcgtggtgggcagagggtcaaattataaacgttaaggttgtctccatcaggtataggagaggaaaacttatagagtttgtagagaacacatattc

SEQ ID NO: 693248 - DNA, 447 bp, Homo sapiens
tgctttctctcaaattattgctagaagtgaatcaattctaaaatcttagctatttttatcttaacagaggtcccttctcaatttctacagaaatatctttgattttttaaaaaatatcacaaaatggtaaggttgagttttataaaataacatctgctttgtcctaatttttagtttttttttctcttctcacatcttaaactggcaatctattaaatgagcaatagctttggggcttgcctgatttatttacatttataatgatatgaaactattgatttgaaaatttttcttgccatatgtgtaagaattatgctttgacattttggattggacactgtggtaatggtgccagccttttagtgtagattgctggtaattggagtggtggtttggtcacctaaagtcccggtggtgctggtgctggccagcacgggcttggtcccc

SEQ ID NO: 693249 - DNA, 106 bp, Homo sapiens
ctccttctgcacgctccttctggccctccttctggacacgctccttctggcctttgcaccttttgcgtggccagaaggagcgtgtccagaaggcgggccagaagga

SEQ ID NO: 693250 - DNA, 1034 bp, Homo sapiens
gactggcgtcatattgcccgtgccatctacacttactttgtccatcctccggactcgcgatcttccttccggagccatgtcagaagggatgtggatctctggatttgatatatattgcttgatcgaggagttcaaccaaggaccccagtagtttcataccaagtgacaggatcatgagttcgcacctgttcatgatcggatgtagctggaccagtcctaccatcccccacgccctacttcgaatctgtcctcccttcgggcgccttcccctggatgtgagtcgtgcccccgacccgagcagagtttccgagcccccgagcatctcgtggtccgtcaagctgtgttgggaggttctccgtgcctgcgcgttccgtgccgttgcgtgagtgcgacacgtaaccctatgtcccttactccagtagtccgcgtcctttctctacccttcgagtttgagtccctgcactgcgtatcctgtggctcgcgccagacttaccccccgtgggtgtggggctatcccccgaggcctgggtctccttttgcgggccatacagagctccctaggcccttttgcgtgacctttccccaacccgacaacgtgcttgcatacacgtgggcgtgccctgcccacccacatgtatgcgtgtgcccactatctttgctaccggggacatgcgttcgccgcggtctgttcatttatagacgacccccaatttggggttagggtctcgtgcgcatttcttgcgagccccttcgccaagcccttgcgctccccgggtggagggtgtacaaggccagtagctcacttgcaacgaagtgttgcgttcgaaggggccgtgaggacgcgaaggcctattacctcccgtggcccccgagtcgctttgtcgcgccagccagaggacttcctcgggcagggcctgatgtcgggggggagagttctcccccgcggaaggtctcatgggaaggcctcgctgtgcctcgacagagcggctggtatgtttcttctcgggggcccccttggttaggcctacctggtc

SEQ ID NO: 693251 - DNA, 841 bp, Homo sapiens
gttgcgaggccgggtggcctcggtcggtaccctgggctgcggagcagttgcctcattagtattcgtacccactgatggcggtgcagcgggccctcggggacagcgagctgtcgcggccatggcttatcactcgtggctacggagcccatgtgtcacagcacagggccctgggtatgcccctgggatcccctctccccgtcttcgatgacacgaagcgggtggtatattccaggccagcccgggggtgatacccaagcccaccatggaggcagacggtgggcctttccaggtgtcaagcaactttggcttgtgtgggggaacccaaattggcccaaatgttggcttaatgggccctaattggccaagctccaatcggctattccccattggcgaaacggacactgggtcgcaccaaggtgagcttgcaccccgttaagaagtgtactgttgaggacaaacttcaacaggttactcttgttaagctgggtgacacacaagcgccctaccggttggcgccacaagaaagcttagggcggggcatagcatgaggttctttaccactgtagaacaaaaccaagaaaacctgtggggaatcgttgcacggtacaacgtcggatgaatggcgtccttcttgccccccccccgggccatagaccttcaaactgcccgccgtgcaccctcttaatttccccgagcggatgggcccttcaattcactttaccgttgcctcccttgggtcttggagattgggcacctggggcattttcagacacacggtgttctcccccgggaggggttgctgtggcccttgtgtgcaaagccacacgcggcctcggtgttg

SEQ ID NO: 693252 - DNA, 106 bp, Homo sapiens
  misc_feature (56)..(56): n is a, c, g, or t
gctggcatttgaacttcgcccactggcagcactgacagaactcacaatcaagcagnctgggctcacccaccctggcttctccagctcacatggcgccagcactggg

SEQ ID NO: 693253 - DNA, 102 bp, Homo sapiens
  misc_feature (12)..(12): n is a, c, g, or t
tttggcaacganccgaagttaaggatgtttccccataaccaatgtacatagttcgtgcatcactctgctgttccctacacataaccgggaaacaggtttaat

SEQ ID NO: 693254 - DNA, 140 bp, Homo sapiens
gtcgtcgtgtcattccgacgagtaaatgttttcccacacttagaacagacaaaatccgcagtgactaagttggcttcgtgatagcgcttgaagtgcatgtcgagaagctgcttctcccggaaggtcttatcgcagtggct

SEQ ID NO: 693255 - DNA, 245 bp, Homo sapiens
atttgcttttctggggagtcctggcggtttttattgagcctgttcatgtaaaagcccaagaggatgaaaggattgttcttgttgacaacaaatgtaggtgtccccggattacttcccaggatcatccgttctcgcggagatcctaatgagcacatgtgtgagagacacacccgaattaattgctcctctacacacacagggagaatatctctccatccaacctcaccatagagcaccagatgtgt

SEQ ID NO: 693256 - DNA, 121 bp, Homo sapiens
cagtttacagcgtcaggggctgttcacctcagtttacagcgtcagggcagtttacagcgtcaggggctgttcacctcagtttacagcgtcagggaggggagagtgttaaagggagaagtgt

SEQ ID NO: 693257 - DNA, 709 bp, Homo sapiens
  misc_feature (3)..(3): n is a, c, g, or t
  misc_feature (80)..(80): n is a, c, g, or t
  misc_feature (529)..(529): n is a, c, g, or t
  misc_feature (545)..(545): n is a, c, g, or t
  misc_feature (550)..(550): n is a, c, g, or t
ctncccggctgcaggaattcggcacgagaatggattgaattagcccaggatgacgacaggcttcgtgaagagcgaatgantgcttagaagaacagagacatgtatgtaggggtttactcagacagagttggaggattcagatacagtgaaagatatgatcctgagcccagatctgggatgaggagtggcatattggaagcacaattgatgacaccatcagcacgttacggaggaaagatcgagaagactctgcagatagatgcagcgactgcgatgaggaaacgagagctagacgaggcagatcttccacaggtgaattcatagatgacgaggagactgtgacgacacagcatattcatatgacacatgccacatcgaccaccacagccatgacacaagcgcacagttacttacacaaccattgatcttgaagcagcagcacactactcacgggatcaagcaaggtcagatcagcatgcttctacttgcacacctgagtcttgagttaagacttcagagcctagtgcgngtcatctgttgacgtngtcanctagtcagtagcaccagactgcaacatgagatcaactgactatctgagatagctgacttgctagtagtgatatgcagtgccgtccacgttcagactcgtggatggaacttgttacctagtgcttcattccacagctctgcatggtgctgtctggcttgt

SEQ ID NO: 693258 - DNA, 732 bp, Homo sapiens
  misc_feature (732)..(732): n is a, c, g, or t
cctgatatgaagtgtaaataaattagaatgacataaaagagaaaacgatgaggtgatggagcagcatataaatagtgtggcaccatagacgaaaacacggagcgacgcagaagtagaccagataaaggcacacgctgaaacgaccacactgagagaacataacccagagaaatggacagaagacgagaagacatatactcaacaaaaacccctaaggcaaaaaacgcagatagacaacgaaaaaaacaacatacgcgaaataaatgaatagaaaacgcggaaaacgaagaggaaaaaaaccaaagagatgaaacagataagattggaaaggaaaagtggtaaaaagctaaaaataacactttacagtttacaatattaaatgaataagaagtcagataaaataataacgggaaaactggattaatacgataaaatggcaatataaattaagcataaagcatcaataaaaaacgatgcaatacaaaagaaaaactaccaaaaaaagaaaaaagactgaaaaaaagagaacagaaaaacaaacaaagacaaacaaaaaaaaacagaagaccaaacaagaaggacaaaaaacaaggaaggcagaaaaagagagaacaaaacaagaaacgcgaaaaacagaagagagaacacagagaaacaaaaacaaacaaaacaaaaaaagcaacgacaaagaaaccaagacaagcaaaacaacaaagaaaaacaggaccaaan

SEQ ID NO: 693259 - DNA, 161 bp, Homo sapiens
cttggaatgcagccaagcgggtggtaactccatctaaggctaatacgcacggacgataacctcagttaccttagggaaggtggaaaggctgcaatttctctggccctaggtccaagtgtgctttgtgcgaagagttgggtgtcccattgtggaggtttcaa

SEQ ID NO: 693260 - DNA, 133 bp, Homo sapiens
ggcaggatacgacggcagtgtaaactgacggcagtgtaaacctgacggcagtgtaaacgaccggccagtgtaaacgaccggccagtgtcaaccgaccggccagtgtacacgacggccagtgtcacaccgacgg

SEQ ID NO: 693261 - DNA, 291 bp, Homo sapiens
cgttcttggcccgctgggagggagtgggcccccgtgtctggagatggagagactatggacagtcatggcgtgtgtctgaatcactcccttttctttcttgggccctggccagcctcctccccagaccagtgtgatgtcaggcccagccgacctgaaggtgcagggttgcctggtgcaggttcctctgggatgaggttctgagggcacccagcctggccttgctccagaagcctgggctctgcgcacagaggggtgagttaaggctgactaaacttggcggggccttgtacg

SEQ ID NO: 693262 - DNA, 961 bp, Homo sapiens
  misc_feature (44)..(44): n is a, c, g, or t
  misc_feature (76)..(76): n is a, c, g, or t
  misc_feature (139)..(139): n is a, c, g, or t
  misc_feature (144)..(145): n is a, c, g, or t
  misc_feature (174)..(174): n is a, c, g, or t
  misc_feature (178)..(178): n is a, c, g, or t
  misc_feature (181)..(182): n is a, c, g, or t
  misc_feature (195)..(195): n is a, c, g, or t
  misc_feature (202)..(202): n is a, c, g, or t
  misc_feature (205)..(205): n is a, c, g, or t
  misc_feature (207)..(207): n is a, c, g, or t
  misc_feature (211)..(211): n is a, c, g, or t
  misc_feature (217)..(217): n is a, c, g, or t
  misc_feature (221)..(221): n is a, c, g, or t
  misc_feature (223)..(223): n is a, c, g, or t
  misc_feature (234)..(234): n is a, c, g, or t
  misc_feature (255)..(255): n is a, c, g, or t
  misc_feature (263)..(263): n is a, c, g, or t
  misc_feature (272)..(272): n is a, c, g, or t
  misc_feature (297)..(297): n is a, c, g, or t
  misc_feature (300)..(300): n is a, c, g, or t
  misc_feature (305)..(305): n is a, c, g, or t
  misc_feature (309)..(309): n is a, c, g, or t
  misc_feature (315)..(315): n is a, c, g, or t
  misc_feature (317)..(317): n is a, c, g, or t
  misc_feature (327)..(327): n is a, c, g, or t
  misc_feature (332)..(332): n is a, c, g, or t
  misc_feature (341)..(341): n is a, c, g, or t
  misc_feature (359)..(359): n is a, c, g, or t
  misc_feature (365)..(365): n is a, c, g, or t
  misc_feature (369)..(369): n is a, c, g, or t
  misc_feature (377)..(378): n is a, c, g, or t
  misc_feature (385)..(385): n is a, c, g, or t
  misc_feature (390)..(390): n is a, c, g, or t
  misc_feature (395)..(395): n is a, c, g, or t
  misc_feature (477)..(478): n is a, c, g, or t
  misc_feature (532)..(532): n is a, c, g, or t
  misc_feature (534)..(535): n is a, c, g, or t
  misc_feature (542)..(542): n is a, c, g, or t
  misc_feature (553)..(553): n is a, c, g, or t
  misc_feature (639)..(639): n is a, c, g, or t
  misc_feature (643)..(643): n is a, c, g, or t
  misc_feature (645)..(645): n is a, c, g, or t
  misc_feature (655)..(655): n is a, c, g, or t
  misc_feature (690)..(690): n is a, c, g, or t
  misc_feature (724)..(724): n is a, c, g, or t
  misc_feature (748)..(748): n is a, c, g, or t
  misc_feature (760)..(760): n is a, c, g, or t
  misc_feature (797)..(797): n is a, c, g, or t
  misc_feature (829)..(829): n is a, c, g, or t
  misc_feature (833)..(833): n is a, c, g, or t
  misc_feature (864)..(864): n is a, c, g, or t
  misc_feature (919)..(919): n is a, c, g, or t
ccaccaagggtgtccaggcttcagcacctagtacagcatgagtnagtacattatcaatacaggcaacttgggaggnatggagtggggaagattccacacaggaaggagactagaagtccttctaggcttggaggctgangcatnnattgtactgagcacaatccacttatgganaaanaannaagtctagatttncattttncananaganaggaangaananattccctatanatagacgggaaaaagagaaanaggattanctggagggnaattccttttttatatatttagaanaanaacanattncacctnanaggtgggtanagganggaaaaaanaaagtttattttaaatanaagcanaaanaaacgagnnaaaaaangtcantttgnagaaggaaaatgcttctgggatggtattcactggccattccattcccaggtaacaggaaagagacacatacgcaggaaaggnncccaggagactacagaacaagggaggtataccccacaggcaccaaaccctccangnnatcccgnccacagcggancagatactacataccactgtggtagatgacacagcagcactttccccacgccgggaagctcaaactgggtcaaggtctttgcagcnagtntngatcacagangagcccgcactggccctaatggggttttgcaccantcctggggtgctagagggcctcaaagctcctganggagaaaggcatctcggggagggngcccccccgctntcacaaagagccaaacacaactcactagtcggagggnagccagctcagatgggtctcctaggactttangggntccattctcatttttctgcgggggccccaangcactccaaatagtcttcccaaccagaggcccctgcctgggtgccatctcatctntgggcaggggtctctcctgtgcaccttcttcagctgcagtcc

SEQ ID NO: 693263 - DNA, 807 bp, Homo sapiens
ggaagagtaggccaacagaactgtactgcctcatgtctggggaggtcttctccattttgccatacctgtggatcctctatttctgcttctccactacctcatagaaggctagagtaaggaggtaatccgagaaataggacaagctaatgaaatattacaagtacagccaaagagaagacaattaaagtggctggaaaaaacaggttactcacaacggggggcagcattagaaaaccaggtaatgtgaatgtcagttcccgggtacaagtcaaccttgcatatgtgcctctgggtagaccaagtcttccactgacataggaagaggagtacatattcgagtcatgcccatggtctgaatatctgagctaaaatccctaaaaagaaatacgttgatgacgtatattctaacataccttaaaaggctaatccagcaacccttccggccgcgttgcccaaaattacttcgcattcagaagcacaataaagtagttcagtactgagcctgtagaacgcaaagaggaagcatgaccacctcaaggttcagactacctaacaagaatgatgaagaactggaaaacagaagagaatagcgcaatattgacttgcaggtacagacaaggcttgtgggctaaagattggcaaggatgtggaagtgaacaaaggtattggagaccatttatagggggtaagaaagatgaacaacgacattggcgaaggttggaaattgaagaataagaatctaggacaataaaaactaacaagaaaaataacaatataacatgaacaaaatagacaaaaaaaataatg

SEQ ID NO: 693264 - DNA, 683 bp, Homo sapiens
  misc_feature (62)..(63): n is a, c, g, or t
  misc_feature (77)..(77): n is a, c, g, or t
  misc_feature (95)..(95): n is a, c, g, or t
  misc_feature (101)..(101): n is a, c, g, or t
  misc_feature (105)..(105): n is a, c, g, or t
  misc_feature (114)..(114): n is a, c, g, or t
  misc_feature (117)..(117): n is a, c, g, or t
  misc_feature (123)..(123): n is a, c, g, or t
  misc_feature (173)..(173): n is a, c, g, or t
  misc_feature (192)..(192): n is a, c, g, or t
  misc_feature (224)..(224): n is a, c, g, or t
  misc_feature (405)..(405): n is a, c, g, or t
  misc_feature (411)..(411): n is a, c, g, or t
  misc_feature (426)..(426): n is a, c, g, or t
  misc_feature (548)..(548): n is a, c, g, or t
  misc_feature (659)..(659): n is a, c, g, or t
ccttttggccaaatttgggtccgggcccccccctcgattttttttttttttttttttttaanntttgggcccttttnttggggattttcaccagnggaccntggncctttaaancanttcttngggattttaaaaagggctcccaaggacagctcctctgctttaaggacctntcctgggacaataagcagnccccagtatgtgcagaagttgtcagggggttncccaggggtatggtgaaggagagttagtccccaagggcaccccagcggggccggtagatctggaagatggtgatccaggaggtgagcactatcacccagaagaggaagcccacagctgagcgccagacatagcctttgatttggctctgttctgtgtaggctgggacaaggaaggcctctnggaganccagaagatgacaancagagaaaaggcaggaaagcaaacccccccaggtagtacttccggcacaggttcaatttctcctcattggacactcgctccaggttcatagtgcgctggggccgggtcgtcccaagggtctncggggcaagacccaagccttgaccctaagtaacagatgcaaggatcacgaacaaccacgccccaggagagctcacttcctccggctggggtgccttagctactttcagttntggacgtttgctcgtgccgaattc

SEQ ID NO: 693265 - DNA, 556 bp, Homo sapiens
  misc_feature (421)..(421): n is a, c, g, or t
  misc_feature (532)..(532): n is a, c, g, or t
ctcccccacacgccgctattggatattcggtctccccttggccccccggtgataggattccccttattggcctcccggctctcccttctcggaattgtgtcccgaaccctccccggttccccccggggcttttttaaatgggtgagaaacccccgccccttgtgccttggccccgggttctcccttgggcacccgccttttggcccaagttccaccttaccctaacttgggcccccgccgcccaaccgaattggtctcttaaaaaccttttctcaaggcccaagccgcccacaaaatttttttttttttttttttttttagaaagttagggtccctttattgggggatgtccagccagagaacgctgggaccatgaaaacacagtcttaggagctttgagaaaggggctcccaagggtctncggggcaagacccaagccttgaccctaagtaacagatgcaaggatcacgaacaaccacgccccaggagagctcacttcctccggctggggtgccttagctactttcagttntggacgtttgctcgtgccgaattc

SEQ ID NO: 693266 - DNA, 947 bp, Homo sapiens
gcagctgcatcaacccgggccaggcagctgccatcgcctcgagcaccatcatggtgcccttcggcctgatctttatcgtcttcgccgtaccacttctaccgtctcatctggattagccataagactgaccgacagtgccaggagctcaactgagctggcgggaatttgcccgctattacaggagcagctatggtacccaactagaggggaacgcaaccccactagacgccgcaggtagaacaactgatgcctaggtcccatgtggtacttgggcccttccaagtagctattggccttacgcccttcccccttgaaccttgtcactggcacccagcctcacggaacagacttgcgcagggcggctggtgcttcagtctaaggtgcggcagaagcactggacggcgaacgaaggatgttgctctatctaccgaggaatacttgcgtgcacttatatgaataagcttgatcctcgtaaggtacgatataacgcaacttgccttgtccttctccaggctccagggtccaccctcgcgtgttatggtgaaggcggttgaggggggccaaaaggtggggccacgatcaacatctgatggtggttcccgatcatccctcaccttgatgaccatttgcccgagcatgggggtgtccgtccgtcctgtccatgacgcggacttcaatccttccacttcacctgctccaaagcaatctgacgctgtagtacaattgtggtggtggtgcagcaccagtcagatagtaccttcattaacggtatcaccgtccatcgccagagttcgttgtgtaagtttggggcatgggctacgtgctcacacctggattatgggtgaggctcttaggaaaaagattatgccaagtctttaaccggaagttattgggtgggccaataccatgggggcccaggcaattcctggaaggccaaggctggcgta

SEQ ID NO: 693267 - DNA, 1139 bp, Homo sapiens
tatgtctcctgctcttgaaaaatcgtgcatatttctaaggttttccattttctggttccaccttttcctggaacctcgaaggacttctcgctcaccttaataagatttagttgccatccagtcgtatgattcatggtttctgctccgttccacccttgatgatggtcccggacagctgttccagccggtacagaaactctaacggggtaaagtggatccaaccgaaagcccactgctggctaaaacttcggctacagcggttgaccagttgatgatatccagaccatatcttctggttctgaaggtgatgactttgaggacaagaagaccttgactggtccaatgaagcgtctagtgctagtaacatctacccgagcgctttgctcttaaatcaacccatgggattgcaattaaatcaaccaactatggcctctgtggacaaggtgtgagagcgcacctgttcgtaagaacacaccgccaattctatgatggcgaggagtcttgctacatcattgatagccaagcttgaaggcaacctgggccgctacctcaaccacagttgtcagcctccaacctgtttgtccagaagtgtcttcgtggatacccatgatcttcgcgttccccatgggatggccttcttttgccagcaaaagaatccgaggctgggacagtaacttacttgggactacaactacgagagtcgaggcacgatgtcggaaggcaaggagctactctgttgctagtggggccactagaatgcagaggacgctctgtctcgtagaggacagccttcttcccgaacccttcttgaacgtgtcgatcttgccatcaggaactagggtgctttccatgagtctcgcttagaatcccctgaacgcgcagaacttctgctagggactagctactccaccaccagctcaatacgttagatatgaaactggggcgattctggactcagatgatgccctgtccaatgtggtgctagacaggcaggatcccgttctccacctccaaaggccgtaaagggtggggagagatcaccactctaacctcggcctgacatccctcccatcccatatttgtcgaacgtgttcgtgcttataacagactttgttcttagtaaagagcctggtattaca

SEQ ID NO: 693268 - DNA, 797 bp, Homo sapiens
  misc_feature (23)..(23): n is a, c, g, or t
  misc_feature (103)..(103): n is a, c, g, or t
  misc_feature (108)..(108): n is a, c, g, or t
agcaaggaagtcggcgccgtctnccgcaagttcatgcaggacccgatggaggtgtatggaatgacgagcagaagctgcttcttcacgatctgcagcaatactnctgcnatctgaaggacagcgagaggaaccgcaagctcttcgacctgctcgacgtgctgaagttcaccaaggtggtgatcttcgtgaagtctgtcaagcgctgtgtggcgctctcacagttactggtggagcagaatttcccagccatcgccatccacagaggaatggcccaggaggagcggttgtcccggtatcagcagtttaaagactttcagaggaggatcctggtggccacaaacctgttcggacgaggaatggacatcgagagagtcaacatcgtcttcaactacgacatgccggagaactcggacacgtatctccacagggtggctcgtgcgggtcgtttcggcaccaagggtttggccatcacatttgtgtcagacgagacagacgccaagatcctgaacgacgtgcaggacagatttgaggtcaacgtggccgagttaccggaggagatcgacctttcccacttacattgaacagtccagatgaaggtcttgacgttctccgaacagcagcagatggatcatggcggagcgctgaacctccgattttaacgcctcctttttacctcaaacccacagttgtttttaccgcttctctctctgaggaatgggcgagatgtctgttttatgatttttgtcctgatgtttttgtttttgggttttaatgaaattaaaactttttatatccta

SEQ ID NO: 693269 - DNA, 317 bp, Homo sapiens
tccgctcgatatgaggatgtcgaacaagcatgggaggtcgcagcgtattaagtgaagaagtcagtaggacagaggaatttctcttgtcttaggagatcttcatttagtgtgactcccatggggaggaacagactggccggcagcacacaggggtcagcacgtggttgacttgaataggattattcgatattaaaaaatacttttccatgtttcctgagatgctctatgataaatcagttgcttctgtgataatacaatacatatgtggacataaacagggatcaaataaaggaggttattgggaggttacttggctt

SEQ ID NO: 693270 - DNA, 384 bp, Homo sapiens
gtctggcccaacgtcgtggaaacccccatctccgcccaaaatacaaacaattagcccaggcatggtggtgcacgcccgcaatccccagcctaatactttttaacactccttaagcttttactaacaatctcctcaaagtccttccagcttcttcccacttctcagttgtaaagttacttctacatttgaggtttctgttatggcagacccccattccagaaaccaaagtctgttctctgttactgggtaacaaattactacaaactcagcagcttaaaacaacagtccaggtgtggaggctcatgcctgtaatctcagcattttgggaggccaaggctggaggactgcttgaggtcaggagttcgagaccagcctggccgacag

SEQ ID NO: 693271 - DNA, 879 bp, Homo sapiens
cacgccggtcttgagcatcctcaagccctgatgcagccagccccagacgaggcccgcaggacagtggccggggacagccagtggtccatggcccgagtgccaggcatggacggggacgctgctgctgggcatcgtgccattcatgtacatgtcagtctccgtcatccaagctagtgcaccgatcttgacacctgtcatccagtgagtccagagacgttcagcgctggaagcaacgaatggaggccgggatcgtgctcagctagcttcgttctgggtgctactgccatgacacaggttgtgagctggcagctcgggatcggattgggggtgagaaggtcatcctgctgtcagcctctgcctggggctccatcacggccgtcaccccactgctcgtcccaccttggaggcagtgccctgctggtcttcatgaccttctcacgcatcctcatgggcttgctccaaggggtttacttccctgacctgactcagcctgctgtcgcagaaggtgcgggagagtgagcggagccttcacctacaggatcgtgggcgcctgggtcccagatctgggacgctgctgtaccgtgggcggtgtggctcccttgtcctggcatggtacgggtggcacgagcatcttcgtatgtctccggcggcctcaccttgcttgggtgtggtacgtgtacaggtccctgctgatgtgcatccaagatctcattctggccttgggtgtcctgggcccaaaagcgggccggtgtccatggcacgagcgcaggggtccccatggagacgggctcttcccggaaagcctgctgtctgggcagccgctgaatcccaggtctctgcacgcatgctccgttcttcatccttctctcctgcgtgccc

SEQ ID NO: 693272 - DNA, 906 bp, Homo sapiens
gcggagtcggacgcaggcagaccatgtggaccctgtgtgagctggtgtggccttaacagcagtggctggtggctggaacgcggtgcccagatggtcagttctgccctgtgtgctgctgactggacccctggaggagccagctacagctgctgcctgtccccttctggacaaattggccacaacacttgagcagtgcatctgggtgtgcccctgccaggttgatgcccactgctctgcctggccactcctgcatctttacctgtctcagtggacttccagttgctgccccttcccagaggccgtggcatgctggggatggcatcactgcttgccactggggcttccactgcagtgcagacgtggcgatcctgcttccaaatgatcagtgtaacaactccgtgggtgccatccagtgccctgacagtcagttcgaatgccctgtgacttctccacgtgctgtgttatggtcgatggctcctgggtggtgcttgcccatgccccagtgcttcctgctgtgaagacagggtgcactgcttgtcctgcactggtgccttcttgcgaccttggttcacagcccgctgcatcacacccacagggcacccatcccactggcaaagaagctccctgcaccagaggactaacagtggcagtggccttgtccagcatcggtcatgttgtccggacgcacggtcccggatgccctgatggttctactgctgtgaactgccaagtggacatattggttgtgcaccagtgcccaaagacactgatgatccgatacactggaatggtgaccccaggacactgtgtgttgcctgaatcagagtaaagtggctctccaggagcacggctacaccgagcatctcacataaggtgactggcacaaagggggatgtgaacagtgac

SEQ ID NO: 693273 - DNA, 273 bp, Homo sapiens
  misc_feature (59)..(59): n is a, c, g, or t
ttacattcgatgtcgaagcactgatcaagctgcgtagccagacgcgggcgatctccgangcgctgaaggcgcaggcggcggattaccttgccaccgtggcgccgctgatccgtccacaaaccctgtttggcgaatacttgcaaggcgcccagcgcagcagcgggcgcgaaacgcagggccatttccagtccctgatcgaactcttcgatcgcatcggctcggccgcgccgtttcagctggtcaacgaactggaagtgccgctgaacctgatca

SEQ ID NO: 693274 - DNA, 129 bp, Homo sapiens
cgaggtgagaggacgaacaaaatgtgacacatgcagtggaatagtattttatatacatatagcacacagcacacacacacgcgcacagacacacacacatgcatatacacacacacatagtatatacat

SEQ ID NO: 693275 - DNA, 173 bp, Homo sapiens
cttcaaaattaccttttcaaatccatgattttgagtccatttgggggatttttaaaaatttgatgtatttcaaaaccctgttcaaaattaaattgtttaattttaaggatgaggaaggatgttcctgaagttggtcctatttaaattatttaactattggaactttaaaaaaa

SEQ ID NO: 693276 - DNA, 222 bp, Homo sapiens
gcacaccatgcacgattcatagtcggcaataatacatagaggaacaagtctctacccgtgaaagaagatgtttacatctcaggtcctgaatgagctcagaataggggccagatggtgactatctgttggtactgcaggtccatgcaatctttgatggcagttcttttctttttagaactgtaaacaaccataccatcagcttgctgtgttgtacagtgctac

SEQ ID NO: 693277 - DNA, 511 bp, Homo sapiens
agaccgagaacggagagtaacaaaagatacacacagagagggagagagagagagagagagagagagagagagagagagagagagagagagaaagagaagtaaacccaaccaccatctccttgtatctgtgtcagggggtctgtggccttgtgggagaacgttcagcgacaatgctgtatttgggcgcgttctttttttcttcttcttcttttctttcttttttgtggagtgatgtctctctcgctctgtcacccaggggtgcggtgcggtggcgctctctcggctcagtgaggtgtctctgcttccgcgggttccgtgtgattcttctgcgagagcgtgggattacagggtgcgcaacaagacgggcggctcatcgttcatatatagaatagagacggggtctctccatgtggcgcacgcttggtctcgaactcgtgaacacaagtgatccatctttgtgggcctcacagagtgctggaaaagacaggcctgagccggcgggattcacgct

SEQ ID NO: 693278 - DNA, 882 bp, Homo sapiens
  misc_feature (31)..(31): n is a, c, g, or t
  misc_feature (83)..(83): n is a, c, g, or t
  misc_feature (86)..(86): n is a, c, g, or t
  misc_feature (90)..(90): n is a, c, g, or t
  misc_feature (99)..(99): n is a, c, g, or t
  misc_feature (102)..(102): n is a, c, g, or t
  misc_feature (132)..(132): n is a, c, g, or t
  misc_feature (141)..(141): n is a, c, g, or t
  misc_feature (150)..(150): n is a, c, g, or t
  misc_feature (178)..(178): n is a, c, g, or t
  misc_feature (180)..(180): n is a, c, g, or t
  misc_feature (182)..(182): n is a, c, g, or t
  misc_feature (186)..(186): n is a, c, g, or t
  misc_feature (189)..(190): n is a, c, g, or t
  misc_feature (195)..(195): n is a, c, g, or t
  misc_feature (201)..(201): n is a, c, g, or t
  misc_feature (205)..(205): n is a, c, g, or t
  misc_feature (207)..(207): n is a, c, g, or t
  misc_feature (212)..(212): n is a, c, g, or t
  misc_feature (222)..(222): n is a, c, g, or t
  misc_feature (250)..(251): n is a, c, g, or t
  misc_feature (260)..(260): n is a, c, g, or t
  misc_feature (264)..(264): n is a, c, g, or t
  misc_feature (267)..(267): n is a, c, g, or t
  misc_feature (283)..(283): n is a, c, g, or t
  misc_feature (285)..(285): n is a, c, g, or t
  misc_feature (288)..(288): n is a, c, g, or t
  misc_feature (300)..(300): n is a, c, g, or t
  misc_feature (304)..(304): n is a, c, g, or t
  misc_feature (333)..(333): n is a, c, g, or t
  misc_feature (336)..(336): n is a, c, g, or t
  misc_feature (340)..(342): n is a, c, g, or t
  misc_feature (350)..(350): n is a, c, g, or t
  misc_feature (355)..(355): n is a, c, g, or t
  misc_feature (357)..(357): n is a, c, g, or t
  misc_feature (359)..(359): n is a, c, g, or t
  misc_feature (369)..(369): n is a, c, g, or t
  misc_feature (371)..(371): n is a, c, g, or t
  misc_feature (387)..(387): n is a, c, g, or t
  misc_feature (390)..(392): n is a, c, g, or t
  misc_feature (395)..(396): n is a, c, g, or t
  misc_feature (410)..(410): n is a, c, g, or t
  misc_feature (414)..(415): n is a, c, g, or t
  misc_feature (436)..(436): n is a, c, g, or t
  misc_feature (438)..(439): n is a, c, g, or t
  misc_feature (446)..(448): n is a, c, g, or t
  misc_feature (452)..(453): n is a, c, g, or t
  misc_feature (471)..(471): n is a, c, g, or t
  misc_feature (651)..(651): n is a, c, g, or t
  misc_feature (668)..(668): n is a, c, g, or t
  misc_feature (673)..(673): n is a, c, g, or t
  misc_feature (685)..(685): n is a, c, g, or t
  misc_feature (689)..(689): n is a, c, g, or t
  misc_feature (691)..(692): n is a, c, g, or t
  misc_feature (711)..(711): n is a, c, g, or t
  misc_feature (728)..(728): n is a, c, g, or t
  misc_feature (737)..(737): n is a, c, g, or t
  misc_feature (871)..(871): n is a, c, g, or t
ttgacaattggcctaaataaaaagactctgnctctaatacaagtccccttactgataataggcatgaaagagcaccatttttnaantttnaaccctttnaantcatttacggcaattcatttaaggagcttnggggccgtnttaaaaggngccaggttttcacaagacctcatccacntntncacnttnnttggnattttnacantncagcntccgatttgntggagtacagaccacagcaccacgtttnntacggtganttcnttnccagcgagccaagggntnttnccaagagcagantttntggaggggaaaacaggggttttttttttnttntttnnntttttttnttttnantngcattttttncncagtttttttttaggnttnnnttnntagctttttttttnttgnnaaacagagagaacaagaaacntnnatttttnnntttnntttttttggggcacatcntctggttgttgattttcatctgcgtcttcggcacattcttccaaattaaagtgaatcccagctgatagtcttggcggggctgttttttattctgttctccaaagcacttgagaaggttttcaggcacgctcttgaccgaggagtgcgtgtgcaccgtggacaggaccctgaagtgctcanagagcagcctgtgcagnacaancaggggcgaggngccncnnggccgggtttgcgttgatnacgatgttttttagcgncccgtaatncttcccaagcactgaattcaagtccagcgcattggtggttaaagtcgtgggctcatccgcttggattatgttggttacatccaagtctgcatcttggtgtttgaatcatcttggagaggccatcaactgcagcnttcaactcata

SEQ ID NO: 693279 - DNA, 361 bp, Homo sapiens
tgatgctactgagcactacataggggagggaaacgccaggagtggctctgacctgctgccgctgccaccacctcttatgccaagaatgtagagcctctgggcgtgatctggatgctctcctgagtgttggaagggcagcctggaaaggcatttggtggtgaaacaccgctgctccagacttacgctaccatctattgttgggggcccagagtccttggattcactgccaggccttcttccagatcggactgtacctgtgtgtaagggctcctactcccacctctcccaggcgcagggagaggacaaaaagcataagggactctgttcaacccagcaaaagtcagtatcccagtgaagaggc

SEQ ID NO: 693280 - DNA, 593 bp, Homo sapiens
  misc_feature (336)..(336): n is a, c, g, or t
acaagctgcctcccctcattgttgtggcaccaggtatgcctgggcccaggacctgcctgctgattgtgcagacagcatttcctcatgagctcgaaggtgcctgctctgtcagagtgggcagctggctcagcatcctgctgtgtgacctcaactgccaccttcccctgggccaggaggtgaacttgtgcacagctagcactgtgcgtgtgtgcatgtgctttgatggtagggtgatctctatgcccctatcttgaccacacatgcaatgccgtggcagcctagcaactcagtgatcaagacactcaggttatggccaggtgttggcttgactagagntgatgtgattgacgggggaagcatgattgttggattgcctggctattacccatacttaccttgtggagttgatgggaacctattagtggcgcacgggcacttgggacgaccagacattgcacgaactattgcttacagactccacaagggagcggttcgtgagaggtcgcacgcaaagaaatcaccccatcaagaggtcgcttgggcattgacttgcgtccggtggggcttgcagggaaggtgaaggaacgggagct

SEQ ID NO: 693281 - DNA, 623 bp, Homo sapiens
  misc_feature (24)..(24): n is a, c, g, or t
  misc_feature (64)..(64): n is a, c, g, or t
  misc_feature (91)..(91): n is a, c, g, or t
  misc_feature (111)..(111): n is a, c, g, or t
  misc_feature (130)..(130): n is a, c, g, or t
  misc_feature (159)..(159): n is a, c, g, or t
  misc_feature (187)..(187): n is a, c, g, or t
  misc_feature (266)..(266): n is a, c, g, or t
  misc_feature (336)..(336): n is a, c, g, or t
  misc_feature (345)..(345): n is a, c, g, or t
  misc_feature (362)..(362): n is a, c, g, or t
  misc_feature (371)..(371): n is a, c, g, or t
  misc_feature (383)..(383): n is a, c, g, or t
  misc_feature (386)..(386): n is a, c, g, or t
  misc_feature (388)..(388): n is a, c, g, or t
  misc_feature (411)..(411): n is a, c, g, or t
  misc_feature (447)..(447): n is a, c, g, or t
  misc_feature (451)..(451): n is a, c, g, or t
  misc_feature (472)..(472): n is a, c, g, or t
  misc_feature (484)..(484): n is a, c, g, or t
  misc_feature (522)..(522): n is a, c, g, or t
  misc_feature (551)..(551): n is a, c, g, or t
  misc_feature (618)..(618): n is a, c, g, or t
cccccaggccgcctctccactccnaagcctcacatgtcgtccttctggcttgaaaatttctgcnataattactgtttttcctccttttgancttccttttgttccccagtnccagaacttccagagcctnctggctcagatgccatctttttgtatgcnattgcgaacagcttaagtaaagcgtgcngaagagaggatgcggcgtgtgtaaaattttctcctgtgtcgctgtgttttctagccaggagcgccctcattttggaaangtctgcttttagcttgtggcacttatcagcaggcaattggtccttgaattcttccatcttggtttctgtnttgtgaatnatttcttcagccatatnaactgcctnaactcgttcctnctntngccggttttcttcagcatatttnttttcatttttaaccatatattcaatataatctttncttnatccaccagaagattggattncaatttgctgcncacgttctgttcctttatttttagcagaaacatgttcnatcccatttgcattaattttaaatgttanttcaattttaggcacttcacgaggggctggtggaattccaattaaagttaactgttcaaggagtttnttgtt

SEQ ID NO: 693282 - DNA, 449 bp, Homo sapiens
gctgattcttgagtatcctcgtaaatggtcgatccagaccaagcagttataaaaccaagacaaggaggacttcgaaacgctcatcttctggactgcggtctccagagtagatcctgaaatgaggatccgtctatactctaccccagcccaaggatattcctgatgaggttctgcagctgattcatgagagagataacatctgtaaacagatccacctgacagcccagagtggaagcagccgtgtgtcggaggccatgcggagcggagtcaggcttgcttggagcagggggcatccctcagttttccatgtttccttaatgaccaaacagtgtccttgtagccaagaacctagcatagtgtgtggcacaaagtagctgctcagtaaatatttattgtatgactaagccactgggcactggagtttgcttctgctcacttcatacgccaag

SEQ ID NO: 693283 - DNA, 1468 bp, Homo sapiens
  misc_feature (1)..(1): n is a, c, g, or t
nagatgagtcgctggtgcgttttttttttgttgtgtggttgtctgtttcgttgttctttgttgctgtgttgtttctttcgtgcttttgttggttgtgtttgtgtgttggttgttgtttgtgttgtggtcttcgtcttgctctttggttgttgtttgttgtgtcgcgtgttctttggccactatctccctgggttgacacgcgggtgggccgtcgttattgttcgggtgggctcccctggggtctcaaaagatgtgtttgttgttctcgccgtccgtttgttttgttgctgtttttatggttggcgaccctcggggtgggcattgttggcctcccgcggggttctgtttgctggtggtttcttttcgcaggttttatgtggagtcccacaccggtgtgtgtgggagatatatgtggagggtgggcctcccagcttgttgcgtgtgtttgggcgcgggagtcctcccgccctcctctttggtgggttttgtaggagccgttgtgtttgtgttcttaagtgcggtcggttttctccggggggtttttatatgggttattatagtgggggggtgtcctcccccccgttgtggacctcggtatccccccccgtgggcatcatcatgtgcggttttcgtttgtgctctctcgctggggtgttgtgtctcactttttttactggggcgttattttgttgtgtgctgcccctgttggtggataccccccgcgcgaatgacccaccccgccgtgttggttggtggttgaacacacaaaaaggtgggggtaaattttttcccgtggtgtgtgtgttgttaaataggggaaaatagagtaatatatatggttagactcttgtgctcgtttaggagggtgtgctgcttggttggttggttttcgccccctgttctgagtaggcttctgtggggaggggggatagtggagggtgagatctcctctccccgcggtgcgcgcgtgtgtcgcgacaccgcgcgggcggtgtgttatcctctccaaggagatgtctctcctcttttctctctccgccccgcttctcttgcccacccacttgttttgtggggggaaaccccccacagagatgttaaatttgggtgcccactctgtgtgtaaagagagggtgaaaaagatttttgggcgccccgacgtggttgtaatagggaaataattcacagcgcgaagataatagggcgcatttttctcacggcgccacaaaattattaatagataataagagggagattcctcaatggagtaggtttcataatagacgcccccaggccccacccccgcggttcgcgggtcaagaacgcttttttgtgtaaaaccccgtgtttgccctctaagcccacccccagatgggtggccccgtctccccccccttggcggtgtggtttttttcttaataggaatggtgggggaggttcccaaaaacacccgttttttcccattttgtga

SEQ ID NO: 693284 - DNA, 875 bp, Homo sapiens
aattcacgggcgtgccgttaatatgttacattgctgtgccctcgggttcttcatatttacaccacagttcgcgcaagtggagctatggaaggcccatggctgtgctgttctaatcatgtgagggattcttaggggttgagggggaaggactgaaaacggctgcagaccgtttaggatgcctggagtggagacaggagttaagccccttactcagagtcgctcttaagaactgcccagggccgggcacagtggctcatagcctagtatatcctagcactattgggagtgccacagtgggcaggatcatcattgagctcgggagttcgagaccagcctgggcaacatggaaacaactctgaatctagtaccctatatcctcgatttacacccttggctactggtagtgagtggctgcactattaaagtaaccaagatgacctcagagaggagctgagggctatggaggaaattcgggtctgcacacacataacgtgatgagccggaagggctaagctgtttcatactgcacgatctactagcaacttgttcaatttgcacaagtcgctggagttcgaaacgtacccagagaacatcttgtccattccagaggaacattcccccagtgcacgggacataaacttccctgaccgccaaagtcggatgtgtagaggggtcaaggccagacagactcgcgcggaagcgccaagaacgtggccaggtgttcaacgcgtggcatggcttgaacaccctggtgccactcatggtctacccctgtgtgaccaagacctaccgacgtgttctcggcccccttttagaggaagtgacacccttgaatactcacagaaccacgcaggtatgagcgccaactccatcac

SEQ ID NO: 693285 - DNA, 169 bp, Homo sapiens
gagtagatacggggtttcatcatgttggtaaggctggtcttgaactcctgacctcaagtggtccactcgcctcggtctcccaaagtgctgggattacaggcgtgagcccttgcaccctgccgtctccagccttttgagtaattgcccttccccttctgtcgtcttctcg

SEQ ID NO: 693286 - DNA, 277 bp, Homo sapiens
tccattgctggttactaccttcatggatgaatgtataccagagaatttaggccaggtgttgttgtcacgcttgtcatcccagcagtttgggagtctgaggagtgtttatcacctgaggtcatttaaatgtgtatgtgcgctcactcacatacacacagaactgcttcattttctctaaagtgtttacgtttgaatacttaaagactgagttatctgaacactgtttcattatagaaatctcaataaagattatataaatgaaagatacaaaaaaaaa

SEQ ID NO: 693287 - DNA, 475 bp, Homo sapiens
  misc_feature (349)..(349): n is a, c, g, or t
  misc_feature (359)..(360): n is a, c, g, or t
  misc_feature (368)..(368): n is a, c, g, or t
gcctactactactaaattcgcggccgcgtcgaccctgtatacctttttcatgttttattttttctccaaagccaattgtttgtctgttattatgtttctacttcctgctaggacacgttttgtcttgtttcttgttgtattactagcacttaacacaatgtctgactcatagtagatttactaaatgtttggtggataaaaggatgaatgaatttttcttaaatatttttgtttaccagttaacataacgatctgaaagaggtcatttgattggtgggatcaggtacttgtaccaggatagaggaaaatggtcagaattttattttggggggccatactatttaaagcngaaaaaaaannaaaagtcnacgcggcctcgaatttattacaagtattcgacccgggaattacgggaccgtttctgcaggcgttccagcttttcctattgagagtggatttaatctttggcgtattc

SEQ ID NO: 693288 - DNA, 165 bp, Homo sapiens
cggatgcgatgtgcgcagctacaagaaggacggagctgagttcgccaaggtggcgttgtgtgctgaagattggggaacacagccccttcagaccctcgcacatctatggtgaaactgccaattgttcatggacctcgttatgactcagtatcgtgccaggcagta

SEQ ID NO: 693289 - DNA, 1639 bp, Homo sapiens
agcgatgccatcgatcgggctggaagcccgcgtctcgacctacgggcgtgactctaaggactagatggtcctggtttgtggtctcagggcatgtccgggcgtccgtctggcgcctggctggcggcgtgtctacagttagccctgtggcgctcctgtggtcacctgcctgaccagtacgtggtaccatgcctcgagagcgcgactggacgcggtgatggtccttgtctctaggtgctcgacgactaccgtccgattactcgcttgcgattcatcggctacccgtggcattgccgcgggagcgaaggagacggggagcatcgagagaggcgacaccctctgagaacagagccacgtaggataagtcaagttctgcaatcaccctagcgtcgggatgaaatcagacgggcacgaaccgagtggtgccgcgagatatcgaaagatgcggagaccatggaggaaagcgacgcgaaccggtggggggttccggaactctattgggcgaaaaaaggaactcgttagggagattctcccccattttaggcgtcttgcatgctttatgggctcggaagtgcgacacgcgatgccactacctcgggcgatggtaaccaaatgattgcggtatgggccctccggttttggagaatatcccccctcagaaatggagatacgccaatatgccacacggtgtccctcggttcatcctccaagctagattcggtgaagagtctagaccagaaggtgcgacgagaggtgggttctgtcccgtttgcgagaatggggggtcgcacggttacgccgaaagcggcgacattaacgtttgggggaggccaaaaccttccaattgaggttgtccttcccatttcggagggagctcgggaatcaccgacgatctagcaacgggttcccttctcatgaaacgggttgtgcaaagatacagaggatagaaatacctttgtggcattggtggtctgccactccgcgccctgtgtatgtaccgggccttgtaaaggtacccggggggtatggaaggggctaccattgtacctccgctatggcggccgtgggaccaaagtggcttggaaaacggtggaccggccgagagacatcaaaacgcgcaagagcttatagggggcgcctgggtgaaacccgccagcgccggactgaacattagtgccctgggtgttggcctttggtgttgggggcgcacccgcttggagcgttggggttcaccacgttcgcgttggtgctctggtcggcgatttgcctcccgccatacggggttaagctggaacaggagggttatcggtctcgcagaaaataggcgcgcctttaggaaattgggccccaagggcaggtaacgccattaggagtatgagcgaaaggagcgcctcgcgaggcaacttgtgaccacccatgcagtgggtgtctgatattccaagttcacgagttgggggagatcaacaaaacgggatcccctttggggaaagaaatcccacgaagagaccacaggggcccatttgtcacgacggtagatatccgtctgatatacaacaggtccccccccagtgtgacggtagacacctttcacacacaacaggggattctgcgcaccacataaagtagattgaaaagactctac

SEQ ID NO: 693290 - DNA, 827 bp, Homo sapiens
  misc_feature (22)..(22): n is a, c, g, or t
  misc_feature (71)..(71): n is a, c, g, or t
  misc_feature (93)..(93): n is a, c, g, or t
  misc_feature (123)..(123): n is a, c, g, or t
  misc_feature (164)..(164): n is a, c, g, or t
  misc_feature (168)..(168): n is a, c, g, or t
  misc_feature (175)..(175): n is a, c, g, or t
  misc_feature (188)..(188): n is a, c, g, or t
  misc_feature (220)..(220): n is a, c, g, or t
  misc_feature (286)..(286): n is a, c, g, or t
  misc_feature (317)..(317): n is a, c, g, or t
  misc_feature (345)..(345): n is a, c, g, or t
  misc_feature (424)..(424): n is a, c, g, or t
  misc_feature (462)..(462): n is a, c, g, or t
  misc_feature (501)..(502): n is a, c, g, or t
  misc_feature (510)..(510): n is a, c, g, or t
  misc_feature (518)..(518): n is a, c, g, or t
  misc_feature (607)..(607): n is a, c, g, or t
  misc_feature (625)..(625): n is a, c, g, or t
  misc_feature (657)..(657): n is a, c, g, or t
  misc_feature (705)..(705): n is a, c, g, or t
  misc_feature (727)..(727): n is a, c, g, or t
  misc_feature (734)..(734): n is a, c, g, or t
  misc_feature (756)..(756): n is a, c, g, or t
  misc_feature (822)..(822): n is a, c, g, or t
ctcgggcttcgaggccgtcgangtggcctggccagtacgcggagacgcctgaggcgctggcgcgcgccgcnaagaagcgggagctgcggcttntactgatcaacacgcccccgggagaccaanaaaagaggggaaatggggcatgggggccgtccccgggaganaagnggccttncgagagggactgnagcaggccgtgcggaatgggcattgcttgaanggcaggaagttgagttttccttgcaagggtgctgtggcaagaggaggcctggtgtatttggcagcnttcctagaggcatggacatgatccacctganggctggccgaataccccaggaagctaancgaatagcagtaaaggctgaaatggaggccgtttttctggagaacctgaggcatacagctggggttttggctcaggagnacctcgtgggactactggagcccataaacacccgcatnactgacccccagtacttcctggacacgccccagcaagcnncacatctnacagaagntaggaagacccaacctccaattacaaatggacatattccactggcagatcatggatgggaacctgacaggaaacatccgggagttcctncccattgttgggcatgtncaggtggcacaggtcccaggccgaggggagcncagcagccccggagagctgaatttcccctatctgtttcaactgctggnagatgaaggctacaaaggcttngtgggcngagaaacagtagagggcttganttggctacgttcatacttgggataggcggggccacccagaggctggccagttaaggcccgcacacnaccca

SEQ ID NO: 693291 - DNA, 346 bp, Homo sapiens
gccagttgagggggtggtccgcccgataccaaatgttcaccgcgatccttccgaactgcgtctgaaacacggggtggcacaggtttctcctggtctttcccaggactgctccgaaattggagatcaccgcgcctgtattccacaaacacatccccatgctcgctgtctcgttccagaatggaagacaccaccaccatgtcatggttcttcgccagcttctcacagaatctggtggtgggccacatcctgtgctgactcagcaaattctgtacaagaaagcttctctctggtacagaaggcaaagggcatagtccatgcttcctggacacagatgatgttcactcca

SEQ ID NO: 693292 - DNA, 273 bp, Homo sapiens
tgatatgctgttcattggattgaattgattgaattgtaaaatgaaattaaactaaaccaggctgggcatggtagctcaggtctgtaatcccagcactttgggaggtcgaggcaggaggatcacgaggtcaggagatcgagaccatcctggctaacagtgaaaccctgtctctactgaaaatacaaaaaaaatcagccgggcgtggtggcgggtgcctgtagtcccagcgtgctcgggaggctgaggcaggagaatggcatgaacccaggagtt

SEQ ID NO: 693293 - DNA, 998 bp, Homo sapiens
attctacttgtatgttgctatgttctcatgtactactcagtgtacttctacatatgcccaagttttgtgtgtaccctctcctatcatagaacttcaatttctgctcttcatggattaacagtacttctgtcaccttccgattgtcaattatccacatgatcatgctaagggaattgggcatgtagtcgtcctatcttcacactttttcccattctggatcctttcggtgtctaatagtgtcttggtttggtatcttcattgacgccctatcgcgaggaagtcggggtgttaacatgaaccaattacatgtcttgcccatggtctgctaaattagaagctacgtggagagcaagcaatacaggaatacgaggaagtaatactctgtcacaagatggaatttgctcgtctctgtcgtgtgttgacctaatctaccattcgttaatctcaaggtaaaacccgtatggataacttctgggtttcaacttgagcacctttgctgcgccagacttcgtcactttgggcacttggttcgccgtcgtgatagttcttcccaaccgggttcctttttttaccttcccttccaattttggttaccccacccttggaagacaaaggcatggcaggaagacacttgcggtaaaccttactttatcggcatccattataccgcctttccctaaacctagcgaaattgtaaatggagacagggctcaagcaaacaattgtgatcggaaggaattaggttaaattggttgggcggcctagaaaccggtaatttgggtaccggcctccgaggtattatggccaaccacaacaaagagagagttccttgccgaaaaagtttttgagggaacgccattcaccttacaacttgtatggaaccattgtcgcttgaacccacatatttggagatctattacaggtagaaggttgccgttgtttgggacccatttacggcaattttctcccaggaagcggttcattttggcaatactttt

SEQ ID NO: 693294 - DNA, 428 bp, Homo sapiens
ctgcatgatgctgctcagatgcacttctcgagacggtcaagtggcagcgctcgtaatgcatcgattgttgcccctttaggtcttgtagcatttccagcgcagttccggattcggcgctaataggccctgagcctgtaccagtggatctaccacacccattaggatgcccaggaagcacgagccattctggaggcctccactgaggaccccagtggccgacgcaggccctaggaggaacgaccaggctgattcagccttcccagtgctgttcctggttccccgggcgatgcctgtgtgaggactgccccatggtcacccttactgtggacaacgtgcacctagaacacggcgtggtgtactgagtatgtgagcacggcaggcgtctggtgccatgtgctgtagaagatcgtggcgccccgcgggtgctt

SEQ ID NO: 693295 - DNA, 523 bp, Homo sapiens
atgaaatgtaaacgtcacttattaactttacattttcggtttgcaatgagaaagagtggagattttgtatttgtgttttgcttatagaatatacagacatgttgtggaagtgtagagcttaattttgctttgtcatagaggcggaaagtaggaaccagatagagatgaaaaggggccactgaaaagtgaattgggtagctcagcatataagcatgattacatatccagatagctctatatggctttctatacatttatgctttgtgtgtgtagtattagatgtaagtttacgctttgaaaggaaatctatgtctcattgtgcattataaaagccttgccaatttagtagtgatgctttccttggttgtacaggtgtgcgtttgtaaaccttcatgctgtactgggcatgggttttgtctcttggggatacattggctttgcagtgtacatttacgtccctgccctctttgacctggcctgatagtgttgtataatgtaagtttatttctccaaatcgagagtg

SEQ ID NO: 693296 - DNA, 572 bp, Homo sapiens
aattccctcccacgcgtgggggccctgggggggatcacacaacaaacccctcttttctcccccctctttgtcccaaaaaaacccccctcttaaaagaggggggggaaaacctcacaactcctttctcccgccccccgcggtggaaaaaaaaaacactcaaaaaattttttttacaccacccctattttgcccgggtgttttggactctaaagggacaaaaaccccaacaaaacccgagggttaattttttcccctcccagtaaatcaaatcccctaaacccccttctaaaatttggaaaaacctaactctgggttaccttttcccgcggggaaactaacaacaaccccaaagcgtttggatgtcctccctgccaacttggtcttgtggcgctcctaggcctgagccaaacggaagcccccgacccttcaccctcacccctgtgacctcaggtaccaaaggggaagggctgctcactgcaggaggagtgacctatattcgggctaagacagctgtgccatgcccacctattgacaatgataaagggaggtctctcttctcagcaaaaaaaaaa

SEQ ID NO: 693297 - DNA, 134 bp, Homo sapiens
catctccacaccagaacagcataaggttcacgcaataaacgcccacacctggcacagcaacggtaatagcccacagtaagtttctacattacattaccaacaccgcatacagtgtacaaaagacagcaaaggct

SEQ ID NO: 693298 - DNA, 755 bp, Homo sapiens
tggcacttcgcccaacacaggacagtggagccccacctggtcggtcccacttccgggtcccccatgcatcttgcccaagggggcctcttggggacggggaatggttatgaggaaacacttttaaagaaaaaaggaagacattgaaaaggttaaagtttctctcccatatcgtgcatgtccctcctcattatagaaagcccagaataaggggctagaacctccaggagagggctcctccccgactctacatctctcgcgtgacggtctccaccaggtattgcagaaattagggacgatggtttacggtgggggccaaagaagtgccccccttcccagggcctctcgagggtttccccttccttcgcgcccccctgtacaatctcttatgtgaggaggagtttcaagtgtgccatcacttctcccagacagtcgtgaggtcgcccaaaccgtgtatactcgcagggtagactcacgcccgcggcaaaagaagaagacataagggctcctcatgtggcgggacaccctctcatgtgcgggagagggccccggaatatccttaggaagcaagaacgactatccccagcgcttagcccctttttagctcagctcgagtgtaggaaccgaatgcaacgaacgggagaaaacatactcctatacagaggaaggggtatataactttataaaaaaaccacaaaagggcctaacaagaaaaaaccagtcaatctaaaaaaatcattcaaaacttttctgggaaa

SEQ ID NO: 693299 - DNA, 735 bp, Homo sapiens
  misc_feature (122)..(122): n is a, c, g, or t
  misc_feature (161)..(161): n is a, c, g, or t
  misc_feature (238)..(238): n is a, c, g, or t
  misc_feature (277)..(277): n is a, c, g, or t
  misc_feature (285)..(285): n is a, c, g, or t
  misc_feature (288)..(290): n is a, c, g, or t
  misc_feature (658)..(658): n is a, c, g, or t
atggcatgtagtgaggacaagacagagagaggaaagaggttccacagccttttaaactactagatctcatgagaactcgacgtcactatcaggaggatggcattaagggcttagtgctttgncattgtgaaggatccactccacccctttatgattaaagntttttccacctaggccccgactctaacattagggagtgtactttcacatgagcttggaaggggcatagagaaaaacngtattattctgtccctgaccccacaaatctcatgtcctnctacatgncannntacagtcatgccttgccagcagtctcccaaattcttaactcatttcagcattaactcaaggttacaaagtccaaagtctcatctgggtcaaggctacattttctttggcctacgagtctctgaaataaaaagcaagttcactgcgtctaaggtacaatgatggtacaggcatttcgtaagctttccatatccaaaagggagacattttccagaaaccttcttatttttatctgaggccccttcagtctggccttcactgtccatgttttggtcagcattctggtcacagccatttaaccagtctctaagatggtccaaaaatgttctcattggtctgtcttcttgggagccctccaaaatcttccaanctctaaccattatccagttccgaagttgcttccacattttcaggtatctttatagcaatgctccaaagcctggtagg

SEQ ID NO: 693300 - DNA, 379 bp, Homo sapiens
  misc_feature (32)..(32): n is a, c, g, or t
  misc_feature (56)..(56): n is a, c, g, or t
  misc_feature (112)..(112): n is a, c, g, or t
  misc_feature (121)..(121): n is a, c, g, or t
  misc_feature (154)..(154): n is a, c, g, or t
  misc_feature (165)..(165): n is a, c, g, or t
  misc_feature (172)..(172): n is a, c, g, or t
  misc_feature (232)..(232): n is a, c, g, or t
  misc_feature (241)..(241): n is a, c, g, or t
  misc_feature (262)..(262): n is a, c, g, or t
  misc_feature (266)..(266): n is a, c, g, or t
agaatattgacaacgccactatctggcacggnacgctagatttaacttataaaatntattaggagacattatggctgaagcacaagcaaattatggtggcaagattatcatngcgtcacgnaaattatcagcacaaggaacagacgcaggtttnaagtttgcgtntgaaacnacacatgactacacaaagtcacgtgataacaactctacggctacaaagtcaggtactttnaacgcaccnggttcacttgaaacaaagttntcanttgatatggtatcaaacgacagcgcaccgttaaaaatgcacaggacgcattgacagcggtgagtaatggaatactggcgtatctttactggtattaatggtcagtaaagggaa

SEQ ID NO: 693301 - DNA, 187 bp, Homo sapiens
  misc_feature (41)..(41): n is a, c, g, or t
  misc_feature (77)..(77): n is a, c, g, or t
  misc_feature (87)..(87): n is a, c, g, or t
  misc_feature (127)..(127): n is a, c, g, or t
  misc_feature (163)..(163): n is a, c, g, or t
ccatccaggcatgctcttaccggcgtgtgtgtgtgtgtgtnagagcccatccaggcatgctcttcccggcgtgtgtntgtgtgtganagcccatccaggcatgctcttcccggcatgtgtgtgtgtnagcccatccaggcatgctcttcccggcgtgtgtgtnagcccatccaggcatgctcttccc

SEQ ID NO: 693302 - DNA, 469 bp, Homo sapiens
  misc_feature (261)..(261): n is a, c, g, or t
  misc_feature (297)..(297): n is a, c, g, or t
  misc_feature (356)..(356): n is a, c, g, or t
  misc_feature (369)..(369): n is a, c, g, or t
  misc_feature (375)..(375): n is a, c, g, or t
  misc_feature (431)..(431): n is a, c, g, or t
  misc_feature (465)..(465): n is a, c, g, or t
tggtggggtgggggtgcggagacagagtctcctttgtcatctacctatgctgtggtgtaatcatagctcactgcagcctccaactcctgggctcaagtgatccttccacctcagcctccagagtagcagggactacagccatctgccgccatgcctagcttggtttttttattttgtttttttgtttgtttgtttgtttgtttgttttttatttttttgagacagagtctcgctctgttgcccagggctgggagtgcagtnggtgtgatctctggctcactgcaacctctgcctccngggcttaaaccattctcccacctcagcctctctgagtaggctgcaacttacaggtatgncaccaccatgccngggttnatttttttttgtatttttgggtaggaaacaaggtttcaccatgttgggttccagcngggtttttgaactcctgtcctaaagtgtatctgnttcg

SEQ ID NO: 693303 - DNA, 252 bp, Homo sapiens
  misc_feature (154)..(154): n is a, c, g, or t
  misc_feature (177)..(177): n is a, c, g, or t
tcctgtgctttgggacggcggaacgggcaggtacatgggcataggtaagcggaagggtacagccacatgcccgacatgccagacgaaggtcacatggatgacggagaatgaggattttgcgccggctgctcacgcagatacctgtgaatctaangaagactcgactcgccacacggntatcacagccctgtaccctgaacggtgaacggggaactgtgttcaacaaacacagcggacttcctcatggaaaca

SEQ ID NO: 693304 - DNA, 1510 bp, Homo sapiens
gtgacgcgtgggtcgacccacgcgatcaggtgacagatgctacatgagaccaccatcaccatgagctggagaaccaagactagagacgatcactggcttccaagattgatgccgtaccagccaatggccagacatccaatccagagaaacctatcaagccagatgtcagaagctacaaccatcacgaggtttacaaccaggcgactgactacgaagatctacctgatacaaccttgaatgacaatgctcggagcatccccatgtgagtcatcgacagcctcacactgaccatatgatgcaaccatccaacactgaggttatcctggaccagacacaacccaagtatccattgactgcgttatcatgcgcacacaggaccacgttgccagagatttacccgggactaacagtcatccaaggtatgagaaagcactggggctctcacgtacaccaagaagagaggtggatacccactcggaaaccacgtaccttggaagcgtcacaggcagagcctaacatacttgacactgggacctggaacacaccggaggacaaccggaacataatagcaccgcgccactggtacactaggacccgtgacaagcactaacgcccagaaacgagcagaaaccccacagcataggagacagagaaacaacccgcaccagggcacacaggaaagccatagtcggcagccacaagacacaccacagctccattgtgcggaaccccagaagatatccacatcgggcaagagcctatccaagacaagtacccagtcaacaactacacaatgctcaaatcgccaggataggagacaccctagacatggaatcggaaaacggccgtaagaaagggacgcacaggggagagcccatggggtaggccaacaacaacagaaagagggccaccatcgatgagagaaggagcaatcaaaccataggacggataccaacgccataagacagcccagcacaacaatgggaagggccagatgaccagcgacaccaaataacacacgagcaaaaagggactccagcgacctaagaggtagtcaaacaagagacgtaaaagacgacgacaacacaacaaggtgaaagagacaacaacagagactaaacacgagaagacaaagaccaagagacacaaacggacaaaggagaaaacagaaaaaaagaagaatgacaagaacagaacaacacgaaccagagctcaagtggactgcacgaacgagctacggaagcacgagatacgaatacagacagagagaagactgagagaacgcaatcgaaggaaacgacacaagccagcagagaggcacaaggcagacagcacagcagagcagaggaaaggagggaagagaacgaagagacagaggaaggcgacgagaacacaggaaagaagaagaagagtagcaggaagagaagagaggagaaagaaaagaaggaacgaagaagaaagggaagagggaacaacgagaaatgatggacacagacgccaagaggagaag

SEQ ID NO: 693305 - DNA, 197 bp, Homo sapiens
gcttctactcctatttttccccaagcagcaggacctacttttacccctttattaccccaagtacctagtatcccccccttggtacagcctgttgccaatgggcctgctgtacagcagaccctaattcatagtcagcctcaaccagctttgcttcccaaccagctggacatttggaaaaataaaactttattaaatca

SEQ ID NO: 693306 - DNA, 194 bp, Homo sapiens
gcctagaggacccgctgatcaacgttttatttccttcttgatgtactgcataaagttagagatacttcattggcttaactccagatgtttctgccagtgcgcggggaatagcttcaaatgcctcagcaaacttcttaatagcatactgttcaagtccaggacatgtctctcccttaagcggatcagcgggtacc

SEQ ID NO: 693307 - DNA, 157 bp, Homo sapiens
atgagcagaatggtcaatggctagttcttgttggctgatgtggctcaggctgcagatgtggccatctgaacaccggaatgaggctgagctgagcctcgtatatgtcccactgcacgggagccacagatggggccaccgctgtaaggatgctcgggcc

SEQ ID NO: 693308 - DNA, 635 bp, Homo sapiens
tggttgtttttaaataaaaggtttaaataaggggaaaaatttaaaaaaaaaaaaagaaaaaaaaaaaaaaacaaaaaaaaaaaaaaaaaaacaaaacaaaaacaaaaaaaataaaaaaaaacaaaattattccggcctctttgacccactccctttttaccccggcccacctcttcattggcccccaatttaccactttttgacccaatgcgcccttttgggccccgttcccatcgcattggccctgttttcccccctctctgctggggaaacccctgtttccccccaacttacaccccttcccgccattccctcttttaccaggtcgctgattactcaagtgcccccccctgtcggcccttcccaactttcgcccctcctaattggcaaacgcttttgccaagctttaaattttgggtaaaatccgcccaaattttgttgaaactcacctcttttttcaacccattgacccaatttgaaaaaccccctttttaatcaaaaaacttgcccccccattggctctggtttttcccccctgttctcaacaaagtgtccctttttcacacgtttactctcctccccttattgtgttcccgttttattcgggctttggctcacttcccttacttcccctt

SEQ ID NO: 693309 - DNA, 182 bp, Homo sapiens
agcgctcggaatcccagacagtacgatatagccactgtctcggatactgcgtaaaggacttgcaatgtcatcagtagtactttcgcatctagagccaacaatacctatacaaactccttcagcgtattagtgtcagtaccgctgtcaggatagtgcagctagtttagctagatataatccca

SEQ ID NO: 693310 - DNA, 202 bp, Homo sapiens
tgtattgagaaccagagtattaagaggggaaacgcccctgtttgtatctgtaggggtattttacattcaaaaaggtatgttggtttgcttttcaaaagtaaagtatttgggactgaattgcactaagatataacctgcaggcgtataatacaaggaaaaattgcaaaactgtttagaacgctaataaaatttatgcagttat

SEQ ID NO: 693311 - DNA, 348 bp, Homo sapiens
ttgaaatgtaagcattctaaccgccccagcactaagaagaggttcagttttgtaattggaacgcctgatgagcatctgatgagtggatccagaggttatcccctcatgtcgagttgatgatgatattttagcttctagacttgagccagatgacagcaaagggaagcggaaaccctgggtcactggttcaggaagacggccaggtttacatcaactttgcaacaaatctggtggcttggtttttcggttcgagaggctgcaccttttcttcctattaatatttgggtccggttgctactttacttggattgattttgcactctaccccactacacaacgtactctttg

SEQ ID NO: 693312 - DNA, 234 bp, Homo sapiens
cgcatgaggagtgaccacgtccgtcatctgtgtccctatcacctacatcaggccaccaatctatccgtgtgtgtttgttggacagagttaaccatgatgagcggccgaaggcaccgggaaatatgtaggagtttcgtgataacgtctaatgatattgtcaggctctaggctagtgtcagtcatatgaggtcagtctcagtccttggagtggtgggatggaaaccagacgggtga

SEQ ID NO: 693313 - DNA, 385 bp, Homo sapiens
  misc_feature (167)..(167): n is a, c, g, or t
ggcgctcctagaggatcccactctaccagaaaattaattttaaattaaaacacgaacaaaaaaaaacctttgttaattttatcacaaatgactcccaaaactagtatttggcctgaaccatcttattgcactgaaacctaacatctattaacatcctataaaatgcnccactggagcattcaggaaatgctggttacagctaaaatatattacttgagttgtagatgttcttttgtaaagtgactagaagaggccagaagagatggctcacgcctgtgatcccagcatttggtgggaggccaaggcaggaggaacaacttgagctcaggagtttgaggccagcctgggcaacatggtgaaacccccgtggggtaggcggtggtac

SEQ ID NO: 693314 - DNA, 316 bp, Homo sapiens
agagctactgacactttatgaggcacgcgactctagtactgcttttctttagtctgctctcctatttcctgtgtgaccttgttctccgacacataggacaattatcgagtagtatcatctcaaactgcaccggaaatagagaccgtttgaactatgctgcccggccatcatcctagtgcatcgtcggccctcccatccctacgcatcctttacataacagacgaggtcaacgatccctcccttaccatcaaatcaattggccaccaatggtactgaacctacgagtacaccgactacggcggacacgaatgttcag

SEQ ID NO: 693315 - DNA, 914 bp, Homo sapiens
  misc_feature (883)..(883): n is a, c, g, or t
gccctgcgatccatgcacaaactttggtccaagtcctgtgactatggcagaaagctcaagtgccaaaaggaatctcaattcgcacaccatcggtcatagctctcacctatctagccacttgtgaactctttcgacataaaggggattattcgctagagcagcgtgactgacattactcgataggcctgtgacatgaaagcactggacatagtctgtggagtacatgacccagatggctcttctgatgggcaggcgtcggcttgttacctctctggaaaacttctccaatcgccaacgattagatggtagatccagtggctggcataatgtttggaattcttgcaccattcatgggagtgacaagatatacatgtatgagccttttctccgcaagcggttcaccaccaaagttcaccctaggtaagtgtggtgtgtgctcgtctttgttttattaacggctacaacatttatctacttgatcaactttgcttttcattagtcatattttgacaaagtagaaaatttgagttaacaatctctcgatttgttcttttccaaagatgtctcgtctaaatctgtgtgtgctagtcatatgaatactcttgttctcttctgactagcttgtacgcaagttgatctctgtctgggaatccagatggaagttcccaaataactgtataagaggttatcagacatctgctaatttcggccatgtgccagtttatacagtttacggcaatatacgcagatgcaagatatatgggggaaatcctatattcagagtactgtataaatttttagtgtactgtgtgtatgtgcgtgtgattaccagcgaactacttaacaataccaactgctattgtaaatcgctattgtgtagttnaagtgtcatgcaaatagcatctaatgaatga

SEQ ID NO: 693316 - DNA, 431 bp, Homo sapiens
caacagtttttgatggcaggggttttaacgcttaacaccgggagattttaagaggggcagcccggtactcagagggagcgacttactcctctaaggcactagtctccctactgtcggcatattgccgggacagccaagtgactactacagtattcatggttgtcacttgggtaactcttgtacgcacgctactggtggaatcgactcaagcgtaattaattcagcataagagggactctgcagctctcacacaacttatccttgctcggctatgtggactactctcctcgcgccctagtgacaagtgtctcactatcccaagatgcacctataacgactcgctcgcaactcctcattcttacgcatgatccggcctacagcagtgtagtcccttgccgactgttcgagtattctatcctgctgaactggtc

SEQ ID NO: 693317 - DNA, 341 bp, Homo sapiens
  misc_feature (8)..(8): n is a, c, g, or t
  misc_feature (88)..(88): n is a, c, g, or t
  misc_feature (90)..(90): n is a, c, g, or t
  misc_feature (99)..(99): n is a, c, g, or t
  misc_feature (118)..(118): n is a, c, g, or t
  misc_feature (132)..(132): n is a, c, g, or t
  misc_feature (166)..(166): n is a, c, g, or t
  misc_feature (185)..(185): n is a, c, g, or t
  misc_feature (270)..(270): n is a, c, g, or t
  misc_feature (320)..(320): n is a, c, g, or t
ggcacgancgctgtcgagaatgagttttctgtccagggggttgatggtgaaggggtccagcacgcggatgttgatcttttttttcttnancagttcggnagcagccaaggcctcgtgnagggtcaccctatncccgataacggtcacctggtcatccttgctcttnaggactaccttggcttgtncgaactggaattactcattgttgttatagatgatggaattttctgggcgggtggtccggatgaagtatataccctttgtattggngggtagttccactgccttctctgtagaaacgacatcacttgggataaaanaaagttgatgtggggactgac

SEQ ID NO: 693318 - DNA, 662 bp, Homo sapiens
  misc_feature (598)..(598): n is a, c, g, or t
caggagagaaagagaataaaacaaacaaactgcatctcaccagaaaaaaaaaaaaagagagagaggccaggtgcagtagctcacgcctgtaattccagcactttgggaggccgaggcaggtggatcatttgaggtcatgagtttgagaccaccctgaccaacatggtaaaactccatctctactaaaaatacaacaaaattagctgggtatggtggtgcatgcctgtagtcccagctactcaggaggctgaggcaggagactcatttgaacccgggaggtggaggttgcagtgggcagagatcatgccactacactccagcctggccaatggagcaagactccatctcaaaaaaaaaaaaaaaagagagagagagagtccaggtgcgatggctcacacctgaatctcagaattctgggagccaaggcaggcagatttcttgaggccagtatttcgagaccagcctgggcaacatggcgaaatcccatctctactaaaaatacgaaaattagctgggcacggcggcacacgcctgtaataccagctactactactctggaggctgaggcatgagaatcacttgaacttgggaggtggangttgcaatgagctgagatcgtaccactgaactctagccgaggcaacaaagtgagaccatgcatc

SEQ ID NO: 693319 - DNA, 158 bp, Homo sapiens
agcgcatcagcacagccgcaggtccaccccaagtatctctgatcagcagatgcggggagctgagaattggcattttttttccgagacagggtcttatcctgtcacccaagctgcagtgcagtgcagtgcagtggtgtgatcacggctcacgtgtagcc

SEQ ID NO: 693320 - DNA, 475 bp, Homo sapiens
  misc_feature (327)..(327): n is a, c, g, or t
  misc_feature (344)..(344): n is a, c, g, or t
  misc_feature (353)..(353): n is a, c, g, or t
  misc_feature (357)..(357): n is a, c, g, or t
  misc_feature (373)..(373): n is a, c, g, or t
  misc_feature (377)..(377): n is a, c, g, or t
  misc_feature (408)..(408): n is a, c, g, or t
aaacatttatggagcaactgaaatattcaggatagaatgtttaaattagcgctggtctctgccttccttcctgcctgtgtgtttctctgttttgtaccctagcccattccggcaacgactatagagcatcacacttatcagatgatgtcataccgtgcccggatgaaagctagttctcaaggcactcagatcatgggcacaaaacaaagagggaaagatgtgtctttaagtcattcatttaggcactattaactgcattttcagaggggaacttcttatccatgtttatttcttcaaggattggaagggactcaggtggcaggcttntcgtggggtggacaggntggggctcnttcnttgtggtggttttttnctcnttggctgtttagggacggtaagggacccccntttttcttccccaccttcaacagggggctaacagttttgttaattttcaggataattttttaaaaaa

SEQ ID NO: 693321 - DNA, 453 bp, Homo sapiens
cgctacagttatgaggaactatatacaacatcatagtgtgcttgatgtcatatatcaaacttggtatcctagtgcttattgctctgacatgtatgactcttcaattgtaatgactatcgagactgaacgctgcaatattcaataaagtcacagtttcacttcaaaccaaacaaaatgatcaatcttctgtatatatcaaaatcataatatcaagataactataaaaatttaactaggatttatctgtggccaatgatggacccagtacaacgttgtcttatggcattctgtggacagtctttgtttgttccttctttactttcgagcttcttcttctgaaacatcttcttcatccgcctcttgttcctgctccacttttttcaaaggttgtgcagattctgataataatttttttgaagggtatgggtatggctgtggtctgcgcctttttga

SEQ ID NO: 693322 - DNA, 553 bp, Homo sapiens
aaggctagtacgaggctgggtgtgggggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagctgcagtgagccgagatgcgccactgcagtccgcagtccggcctgggcgacagagcgagactccgtctcaaaaaaaaaaaaaaaaaaaaaaaacccgggggctcaagtgggggggggggaagaaaggagggtattggaattgtggcgcgacagtgggcgcatagcgcgtggggtctccgtggagcccgaggctttctcttggggtgaccaacggggggtgaagactcttggcgcgcggtcccccctatattagggggaggctcggatattaaaatttccgagaataagcgcacagggtgtaacccgggcattataagtga

SEQ ID NO: 693323 - DNA, 425 bp, Homo sapiens
ggcgactcatacacggatcccgtcgctactgtgtgtacatataccagtcatagcatgaaaaacgggtatttaaatcccgcgctaagaatatctataataagtgttgctatctctatagagttttaaaactaatgttgacctcataatgttaaatcgctttacactcattgacactcgaaaccttttaccattactttgactcactccaacgttcgatagtacttccaaattcatttgttccctaagtctatgtgaatgatttactagcaagtatctctgcaacatcttgcgtgtctaaatttcgcagatgtgagtccctgagatcatgtgagtgaaaggaatttcagattgtaggtagccagtgtttttattgaactgattcctgctgcctatcttccttatcttagcactgtctttattctgcc

SEQ ID NO: 693324 - DNA, 461 bp, Homo sapiens
tctgatgttgctggcaaaatggcataaaaatgagtgctagctcaatacctgggttcatggaattatgattgaggcactacccttgtagtggcccggttgcagttttaatggaatgggtattaaaacatgtgctggatattgggcggtaagttgacaacagatgtatgttgacctgttaagcagatagcttgcttcataatgagacatttcatagctcatgactttatacgtctttctattttacatttacaacatatcttgaactggttttaaaaataatcagtattgatattactagtttgaaaattgtttaaagagagacaaaacagcaatatcaaatttgctgttgggtttgccaagatgccagatttttggggtaattattgaatgttaattgatttaaaaatatttttccaatttgggtgataatattcagtgtttttataaatccatttttgttg

SEQ ID NO: 693325 - DNA, 931 bp, Homo sapiens
cgtctttgttggagtgtgctgcgcgttcctgcaagccgtcgtgcgggcgttcacttctctgggtggttttcgtgcttcggccccttcccctcctgtggagggggtctgccttccccagctgccccccgcgggtgtcggcggccccaatttccgcgctctacgattccgatggggtccccccctgggccgccccatgggtcagattcttccaccccccgacgcaagtacttcgtgtggatccggtggctccatcctgcctcgctggcacctccagcacgatggtggattagcacgcaggggttcacgagtcgggcccctccatcggccaccccgccaatgcttctatacggacctcagcagatgcgtagcactttgctgcactgggttaatttgagaattagaaactttgcccctggccaatgcacacaccctcatgctagccctcccgaactgggataaccttcgaaagaaattgtccctgaaggcttgtatctgatatcaagcacctggattgtagaacttgttgctgattttgaccctgtattggagttaactgttccccctggtattaacgttggtcagggctgagtgttctgggatttctctagaggctggccagaaacccgtgtgttttgtcttcgcgggtctgtcagggttggaaagtcccagaccgtaggaccccgtttcccttcttagctgatgtctttggcccgaacacccgtgggctgttacttgctttgagttggaagcggtttgcatttacgcccgtaaagtattcattcttaatttaagtaaggttttttttgtaccccattctcgattctttgaagagatgaccaccaattttggttttctactgttatgtgagggaccttaggcccccgccacacgtccttgtgtaaggaaaaataaaagtgctgccgtaacccca

SEQ ID NO: 693326 - DNA, 190 bp, Homo sapiens
  misc_feature (29)..(29): n is a, c, g, or t
aagcagttaactacatgactcagtatcanaacaacaacaacaacaacaacaacaacaaaacaatgagcagcttgactaacatggtgaaacccgtctctagtcaaaatacaaaaaaaattagctaggcttggttggcgagtgccggtcatcccgagctacgtgcggaggttgcagtctgtattaaacttgc

SEQ ID NO: 693327 - DNA, 821 bp, Homo sapiens
  misc_feature (1)..(1): n is a, c, g, or t
ntgtattcgcccaccgcagcgagctgcttcttcctgctttgggtgggcgtttgctcgtgccgccccgtccgccgtggggtttgagtactacccgtccttttccttaggattatggggtgctcccccgtccttcgtcgggccgcttcaccgtccgcctctccgcccccctcctcatattcgggcgagctgcttctaggtgagcagtggtgcctcccctctctttttttttgtgtgtgtttgagtatgttgtagagcagcgcgcgctggtcgccgctggtggtgtgtcagcttagcttcatgttagtacaaatatcgttttcgaggagcatcagcgcgcggtggtttttcatcacagagaaaataagctgcccgtcgccactagagcgcgtgttttttgtgagagaccaacgcagagacgctggtagcatgctgctcttctgttctgtgtaggatattttgtagagagtggtttctcccgcccccgagagagaaatataggtctcaccgcgcagctggatacttggttggcggcggcttcatctatagataccctccatggccgcccgcccatttataaacaaggtttcgcgcacccactcgtgttagtttgtgtgtccttggtgacacacaagcgctgcgcacgcgctgtgtgtgtgagacaccgtcgacccacatatctctcttatttaacaccacttggaggcggtgcggcggtataaacacctccagccatgattctctcaccacctgttgtcttattctgggggagtgagaatgatcgtttagcgcacaaaacattgtattctccacaatagcaagaa

SEQ ID NO: 693328 - DNA, 931 bp, Homo sapiens
ggtttcattgttccttccgttgggaccatgcccgttggttaaccccccgagagtgtttcacccatatggcgtcttccactgggtgtctcggcccgcttcttgtgggactcgcccgccagttttgcgtcgacgcgtttcaagtgtcccgttgcgggcccgtaaatttccccggtgttggcccattcgccccggggctggttcccagggagcacccagcggacccctgtgtgctagtttctgcgcctcccaccccttgacggtacgacaccgcgctgtgtttgtctccggcgaggttcggcccccccacttccgtcgcgctcgggtgatctctatggcccccgcccctgcctttgtagttccccccgcggcaatgtggcgctcctccctttcctcagatacctggggtggccccctagggctccttctttcgcaccccttggtgtgacctctccgggggacccccccagtccgaaccacatgggttattcgtctgtctaagcccggtccacgagtccggtacgatacgtctgggggccctcttcgtcttcatttgctccttctcccgtgactcgtccacccatgaggaccacctccgggcacagcttttaccaatcaatctgtacaacgtcgggccgcttgccacacatacgaaatttgtggttcccaccccgatgcggcaaagggatgacagatagtgacgccccgtccgtaagacacctactctggagatggttgcgcaaaccactcgcacgagtgggggcgaaatccactcctacgcgtggccgcacacccgatggctcctgctccctgatgccgttggggctacctcctctcccgccccaactcccgcaccatctgtacccctagctctttttcctcaccacggacccccaaaaagaatttctttttttgggaccccccaaacaaaaca

SEQ ID NO: 693329 - DNA, 342 bp, Homo sapiens
ttctaccccacgttggtcaacctctggtacaaccccctactttctgtttctacgagtttgacttttttagattccacatattagtgacatcagcatttgtctctctgtgcctgtcttattttacttcacaaaatgtcctccaggttcaatgttgtcacaaatgacaaaatttctttcttttaaagattaaataataggccaggcatggtggttcacgcctgtaattccagcactttgggaggccaaagccagcagatcatttgaagtcaggaggcggaggttgcagtgagccgagactgcgccactgcactccaacctgggtgacacagcaagactctgtct

SEQ ID NO: 693330 - DNA, 112 bp, Homo sapiens
ggcacatgtgcggcttagatgtaattaatcttgtcactatactcctagtaatttccagatttgtttttagactggaaatacaaagatgtatagtgcatgttttttaaagaag

SEQ ID NO: 693331 - DNA, 683 bp, Homo sapiens
agctagcagaagaaaagaaatacctaaaatcagagtagaacggatgaaattaagactcaaaaatttatataaagaatcaacaaaaccccaaatggttatttgaaaggataaacaagatcaatcaactgctacctagattaacaaagaaaaaatgagagaagatccaaataaccacaattagaaatgacaaaagtgacattgcaaccagtccttcagaaatgcaaaaaaatccttagagactgttatgaacacctctgtgcacacaaactagaaagtctggaggaagtggataaattcctggaaacacacaagatcccaagattgaatcaagaagaaatggaagccctgaactgaccaatattaatttctgaaattgaaccagtaataaaaaaaaagctactactactaacaacaacaacaacaacaacaactctatcagatgtgcaaagaagagctggtaccaatactactaaaactactgcaaaaaatatcaaagagtagcgactccttcctaattcattatatgaggccagcatcacccttataccaaaacctggcaatgacacaatgaaaaaagaaaaccacaggccaatattcctgatgaacatagacacaaaaattctcaataaaatactagcacactaaatccagcagcacatgaaaatgttaattctccatgacca

SEQ ID NO: 693332 - DNA, 174 bp, Homo sapiens
ggtcgacctcccataagaattttcatctgttggccaggtatggtgtcccacacctgtaatcccagcactatgggattacatagtgcccaagggggcagattgctgaggtcaggagttcaaaaccaggctgaccaatatgatgaaacactgtctctactaaaaaaaaagtcgacg

SEQ ID NO: 693333 - DNA, 135 bp, Homo sapiens
ccccctccccgggtagggggggtgatcataaaacactctttacgccgggttttattgacttgggttaatcgtgggaccgcggtggctggcacgaaattgaccaaccctggggttaggatagcttagataaacttt

SEQ ID NO: 693334 - DNA, 214 bp, Homo sapiens
cgcgaaacctgcgctgacacggatgtagagcaaagcaatttattttagcgtgtatacaatatctatatgaggagactaactacttatttaatttttgaaggacattcttctcagagacagagtctcactggagagctcagcctctgttctgaggaagtgatcctaggctactggacactgactcgcgtgggaggaagaccatgtggatggggca

SEQ ID NO: 693335 - DNA, 879 bp, Homo sapiens
cagctgaaccactatcacgaaataaaactctacctctctatactaatctccctacaaatatctccttaattcgatacacattccacatgatcaccagaacaataatcgaatatttaatgtcttcttctgataagctagacttatctcccaccttgtgcttatcatctacccgatgaggcaaccattgccagaaacggctctgagcgcaggggacatacttcctattgtagacccgtagtaggctccgctgtgcgccctactcatcgaagttaatttactactcacaaatatcgcggttaggcgtcatcataatacattcatacttactcacatctcactgcccaagaacatatcgataactcctgagcctatcaatttaatatgacatagcttacacaaatagcttttatagtgaagataccatctttacggactccatttatgattccctaaagcccatgtctgaagcccccactcgctgggtcaatagctacttgaggtggtactcttgaaactaggcggtatggtataaatacgcctcactaaatcattctcaacccgctgacaaaacatatagctatccccttccttgtgactatccctatgaggcataattatacgaagctccatctgctacgaaaacagatctaaaaatcggtcattgcatatctcttcaattcagccacatagccctcgtaggtgacaagccattctcattccaaaccccctgaagcttcaccgggggcagttcattctcataatcggccacggagttacattcctcattacttaattctggcttagcaaaattcaaactacgaaacgcactcaccagtccgatcataatccttctctcaaggacttcaaaattctatccca

SEQ ID NO: 693336 - DNA, 112 bp, Homo sapiens
tcgcaactacaagagcgagctgttacggatctggggtgctgatgcatcatctgtgtgtgcgccagatctgcgctgttattccggagtcccaaccaaaggagcaatattccct

SEQ ID NO: 693337 - DNA, 104 bp, Homo sapiens
tcggtggttagtttctgttcctgtgttagttgctgaggatgatggcttccagctcctgaaagggagaggccaggtagttctctgttttcctcaaccaccagtca

SEQ ID NO: 693338 - DNA, 663 bp, Homo sapiens
tactttgccatataactttgaacgtgcaccccattgtatgtatgtgaatgtatttatgaatttatatacctgtaagaatagaccctattccttatccataattcaaaaatccaaaaatattctgaaaacagttataactgttttgatggcaagacctgagctgaactgctttagtatttttagttgcttttataccaacttggtacatttttattgcatttaacattcctatgtaagttattgcagtattaatgtttgtggctttttcatgctgaggatgtaaggtaatacatagtatacatactgtatcacctttcgaaaatccaaaaaatcctgaattctgaaacatattgtccacatcataaaacttgcacagaaaaaaaatgaaattaaaatagaagaaaaaataagacactatggtattctgctgggcaccactggcttgtctggcccttcccatgttggagacactgccctagatatttgtcttgtggaactgaatttctgctggcatatatccttatgcctgtaaaatttgctaatctaacctggcttagctcctcttgaagagcccctctaggttcttatgaattataataattaagttaagtagattcaaagtagtcaggaaagctgtcttatacctcatacccttgcagtgtg

SEQ ID NO: 693339 - DNA, 278 bp, Homo sapiens
gtcgacaaatattatttgagttcttggcttacataaggtaggccctcatagtcttatagcccctgtggctctgattcagtgaagattttgggacttcttgtaatgtaccctgtgatttttcattgatactcttagacatggctaaaaattagagagtatttagagatggggtttcactgtgttgcccaggctggtcttgaactcttgagctcaggcagtctgcccaccttggcctcccaaaatgctaggattacaggcgtgagccaccgtgcctggcc

SEQ ID NO: 693340 - DNA, 755 bp, Homo sapiens
cagtctttattctcaggctcactgaattaaacccaggactaattccacagcacaggcacaagaagcctgttgtgtagtgtactctgccagtaccttggatttaggagctccatggggaactgactaaaccaggagagagaggatttggagctagtcagtcctggtaatctatgaaatgctcatttatacccaggttcattaaggtttccaattctattagcaaaccacaggcctctagaggtgtcagagatatttcctatattcatgacagtgtcctcttgtctatgatcccgatgacccaacagttgacacgttggtaacggacttttctacagtctgaacacaacctaaagccctctttcattgttcacacactaactcctactgccgacgaaccgaaaaataattaatgcagaggagatttatgtcttagccataactccagttgtacaactcaatcgccccattctcttttacggttcaaaatgtactgctgaccttgggttagtaacaagtaatagtccgtctttcctgttaggatttataaggggacttttggtagtctaacactctttaaccttttccttgccgtgtactgaggaaagctacagctgttatcaacttcttattcctacgatacctaacacgggatctcagtgtcaggaagaacccatcattcactcacatactgccgtgatgtgacttacctcatccactcacattgcactatggtgcctatatcaaggtaatgaccc

SEQ ID NO: 693341 - DNA, 870 bp, Homo sapiens
gagattcaggagactaacatgccccaggtctcacgaggatcagagaccccagaggccaggaaggagatcaaggtagtcaagcgggggtcgtctcagaatctggttgtgctcgagctatgcaaatgcctctcacggagatgcgaggacctatctattatgatgaccagggcacatccggaagggggcgaacagactttacatctatcagcccttttcaaccacctgatctactaaactggaaacactctgaaaccctgacatcttgctcctggtatcagagagccctgttcgtgcataactgtgtagaaagtgtaggaactccggtttacatccagacagacctgatctccgggacagccttggggcgatcagtagactgaaagctatatgtggacaggagacagttcaatcaacccacacggagagagatgtgcgggatatgtggtggaacgcctggaaactgtcgttgaagaccaggatcgttgctccaaaggcactagcaaacccagaaagatgagctcattgctttaatttgggcctagaactcccgccaagggaaagaataatgcagcgatttacaactgactcgcggatgccaaactaacacctccaaaggacggagaagtatatataggaacagggacgtgaacccgggggacggacacaaaggaccggaggatgaacacagaaccaagggtggagaggtcacacagagcgtaggcaggggcacaagagggaaaggaagacaacacaaggaagcaagacggcaccggcgacaagaaggcaggagaaaacaaacagcaaaaacaaggacgcccccgacccagcgtagacggagaggccacaaagaaggcagcgcgacagacggga

SEQ ID NO: 693342 - DNA, 445 bp, Homo sapiens
ccgcccacgcgtccggtttaagaagtaactatttggaaattctgaagacacataatttgccttttctgaaccttaaaaaaaaaggtacttctgtcacttataattgttttagctcagtaagctattttttttcaatgtgaatctcttttgagagctgaacatgtccattcttaaccacatttcaataacagttactgtagctaaggagctaaatagtttcatggattaatttttttcagaataaatttaaaatatccatgattctgatagtgggcacatgaccaaaagaaaaaagtaaatcaatatatttagccaatggtacatttactttgttaggaatgtaatttatgttcattatagaaaagaattagaagaaaatttcaagtaatagaagataagtaccttcccaagtgaataaatactgcatggaaccactcaaaaaaaa

SEQ ID NO: 693343 - DNA, 408 bp, Homo sapiens
ttcacccatgttcctcaggcattgcttttgcatctgtcatgctagggtcagtctgtgttgcagtaacaagcatcaccaagcctaagtggctcaaaacagcttcctgagtactcagcactgaccgtggctgtgtcctggctgagagaccagcttgcctggggaaaaactaatggctgacagaaatattcaggaactggggcagtttctgcctggaaataggtgatgccacgcctacctgcatttcattggctagggtaaagtcacatgacctcacctagggcattggtcccagtgtgtgatctttatcaacccgcttgccaggatcagtcagagtgggccccagcttgcttccccatggcggaagagcaagctctgtctgtctccctggttcacaggaccgggtcagtt

SEQ ID NO: 693344 - DNA, 114 bp, Homo sapiens
atcctccgcctcctggctccgtgtcctcggcctttctggtgcgcgcgatgcgcttggagcatcgcgtggtccaacagcctggatacggaacggtttggacggcaccacgcctct

SEQ ID NO: 693345 - DNA, 119 bp, Homo sapiens
cacagaggaggcagtggtgggccttgttggcatgctggctcgggagctggcttacaggagggcagctctgcagttgggaggggcacctgtccggagtgagaccagtgcctctgtgctgt

SEQ ID NO: 693346 - DNA, 337 bp, Homo sapiens
gaccagtctttctgatacctatgggcccatctcctcacttaatcatgcatctatggggcccattctatggtagtagacacacacaggatccattgttttacctttctacaaactattccatatgttaaagctggccataatgtaatataaccattcccctgtatataggtggcactctccaacttagagctataaacaatgtttcaacaaaaactcttgtacacaaagtaccttgtacacaggtacaattctataggagtagcatagctagttcacagagcttacgcattatgcactatagatagaaaccgtccatctgacccatctcggggatcct

SEQ ID NO: 693347 - DNA, 654 bp, Homo sapiens
gctaacgataaaggtcaggaaaaaaaaagaaaattgtatgtaaaggaatgtctggagagagttacacaggaacagaaaggtccagcagcggtttctacaaccaatcatggatgttgatataggatgttattttgaagagaaacgctatgcgacaaactgttagacttcatcagatatgacgttaaaacacctaaaaagactaaatatatactacaaaggcctacggcgacagatgaagagagtgtacgattacaaaggttttaccaattaggagtagatctaaaattgaagtattccaagcggaggtcattgaagaagcaagggcggatcaagaatgctactgaggaattgctgcgattagccaatgaacagttgaaacttttcaacagaatagtagaaagagaaaccaattggataatttatccgctgtgggtaatggctaaacaattaattcgtctggcaaacgaatctagtgaacttaataaagactcaattgaagaatgcggacgcactatccatagaagctttactatatgcctcaatgataggaacccaagattgaatgaaagtaaaaaaatcgggtgttatatgtttgctaatctagagttttccatctaccatcggttaagtaataaagatatgattaaaaattta

SEQ ID NO: 693348 - DNA, 337 bp, Homo sapiens
cctagaggatccctgctgtgtacactcctacggtcactcttgcaggtgtaaagccatttaccaacgattgttcgtaggtaatgaacgtggcacatctagttagagaaattgtgaaaatatgttgcactgcgcagcacaccatagaatgggctacctgcaatgaggcaggggctggaggaaagttttatagggtcctgctgatgggtgccccgtgtggaatgaggtcattgtgcccgcaggttgtttgtgattagctgtttctaacaattgttcatacaataattgtccattattgttctcaacttggggctctccccagcctggggacccttcctta

SEQ ID NO: 693349 - DNA, 310 bp, Homo sapiens
aggtaggatccagaagcaacaaaggggacagagatagtggatctgtgtatgctaacagaatgtcaagaattcagctcaattttatactgaggtggtagtaaagagctaaagcaaattgtacaatatctcgcattcagtagtatgaagcatcacgaaggaacagtaatacaagattttcccttcaaaaatggctacaggaaaaggattttattttctcctgcttgggacaggagagagggtccaggcgcctggaccctctctcattcctctcagagttacagtatgatggctgattttgtttattgagcag

SEQ ID NO: 693350 - DNA, 2070 bp, Homo sapiens
tcctaaggtccatgggtattttttttcccccggggaacaaaatatatatgtggaaaaaaaatctccaaaaaggaaacaaagcagggttgacaaaatatgacaccagggcagcgcgggctctcaggagttcaggatagaataaagtgggcgtgcctccacaggggaccgtggttcagtggcccgtggttttcgtgggactccacatttgtgccccgttctctaaaaggtgctccactctcagaagggtggaggagtggaaacagctgagggtggaaaacggtgctgtgctctacacaagagaacaagagtggactctcacatatccccagagaggacaccgagggacacaccaaaaacctctcccctctgtcagaaagtgggaggataacacgagaactaagaaagtgagagaggggcctagaagtgtgtccacagaaacaaaccgtgagacagtaacctaaacatagggaggccacacgtggtggacgtgcgcaaacacggggccactggaaccgggggggacgtaaccggggcgagaacgcacgttctcacaggatacaaactgggggagacaacgtccaaagctcccaagaactcgagcgcccgaggggggcaacctataatacacccacaagctagcgtgttcatcaaggccaaataaccttccaaagggacaactgcgggccattacgttggaattcaacaaagcgcaaaatcttgcccccaagaagaggaatgcaatctccaatgcccaaaattgacatggggaaataaacccctggtacccaaaagaaccggacacactcaaagaaccagaatggggcaggcgacaacaacaagggggcccccacacgcgtgagcaatgtgacacagcacccagaagcgaagaaaaacatcaaaacacgggtcgcggatggatggattccttcagcgtcggtccgggaaacaacaacacacccgtcaaaggcgacagactaacgagcacagagcaacgggtcccaccacgagactcccgagaggagggcccaaaagaacaggaggaattgtcaccaatttgcgtggcgctgtctggcggcgctgcttgtcttccttgctctccgttacctcacaccgactaagctaataaaaaaaaaacacaacacaaaaacaaacaaacaaacatcaaacaacaaaacgaagcaaacacaaaacaacaacaaaaaaacaaagagaaacaaaacacaacacacgtacaagaacagacaaaacgaacgaaactacaaaacaaaacacaacacgaaaaacagaagaatcaaacacggagagcaacaccgacgagaccagagagaacgagcgaaagaacagacacaaaagcgcgacagaacacacgagagagaggaacagaagcaaagaaagcaaaagcaaaaagcgggagaaaaaacgaggacgaaagaggaacgaaagagagcataaaaaaagaaaagagaacgagcgaaagagaaaaaaaagacaagacaagaagaggacgagaagaacagaagacaaagcagacaagcgagcatagcatgagcgcaaagagcaatgagagcaaggagaaggagagacaacaaacgagaaacagaacgaaaaagatcagacacatacgcacgcaaacgaggaccaacaaagcagactaagaacacaagaagagaaaggaacgaaaaaaccggacgaacgaagaaaacaaaaagaacaagcaaaagaagcaaagaacaaagagaaagaaagacaaagacagaaacaagaaacacacacagcagaagaaagacaaacacagacacagacagagaaacacgcgaaaacgaagaaagaaagaaagaagaacaaaaagacaacaaaagaaagacgaaaagagaagagaacaacaaacaaaacaacaaaaaaaaaaaagagacacaacagacacaaaaagaaacacgaaccaaaacaaaggaagaacaaacacaggaacacaaaagaacgacacaagcaacagcacaaagcacaaaaaagaaaaacaaaagagaacaaacaacaacaaaaaacagaagaataaaaaaaaccaaaagacga

SEQ ID NO: 693351 - DNA, 989 bp, Homo sapiens
tctacatataatgagtgacgcttctggttgcatatcttagagtgagactacctatgaaagcgaccaagcttggcttcctcacagcaaacctcaaaacagttactcataaataggagtacatagtctatctgaataatccgaccatgtatctcatcgaagagttctgtcactcagccagtccgcacatatcttcaacttgtccaaaattctaatgctcgtactgagacgtatgaacaacatgcttggaaacggtcacagcttcttatgtcagtggtgtgtgatacatctccttctgtgcaagcaattccataacgcgaattgatcacatacatccgtaaagagatagcttgttgctgagacagtgcttgtaccaacatagcaccagtggcaagcgcataccttatcatcataatgtgccgaggcctattggtctccggtagtcgacactttgcaacggtctctgcggctcacaactcgtcgggcacatcgcaaacacgcaacgacgaatttgttgattcctgtctggcaaatgaatagaaacacgaggacacagtcccatgagcagacagtacttgtaggaaattaactcctaaaaggggttcacacacttccatccatgcgagaggacacgccttaggcaccgcagaaggcaccatcgattcgcacacgagtgccttgattgacttctcacgcactatcttttgactaactttcggaatatttcatgaaaatgaacaacaagtggacgagacagaaactcaattcgaacagtgacacgttcatattaatccgaacttcgttatttgacacaaaaggttctttggcccggtgggactaccaatgttgtggcttcaactggccctttggtaataattcaccacaaaagcacctattttgtggggaggcggccaaagggaagcggctgggattccacgctggcacgggtacactggcagttatcgaagaacccaggcttggcccaagcatgg

SEQ ID NO: 693352 - DNA, 200 bp, Homo sapiens
gcttattgacggtgtctgtttctacaaataatttttaaaatagcctagtgtggtggcatgcacctggagtccctgctactcaggaggctgaggcggaaggattgcttgagtccagcagattgaggctaccagggtactactgtgagccatgattatgccactgcacttccaggctgggtacagagcaagacccttgtcac

SEQ ID NO: 693353 - DNA, 84 bp, Homo sapiens
  misc_feature (32)..(32): n is a, c, g, or t
acatctgtgtacttctgtgccagcagtttaanggcagggggaaatggctacaccttcggttcggggaccaggttaaccgttgta

SEQ ID NO: 693354 - DNA, 926 bp, Homo sapiens
  misc_feature (52)..(52): n is a, c, g, or t
  misc_feature (65)..(66): n is a, c, g, or t
  misc_feature (117)..(117): n is a, c, g, or t
  misc_feature (122)..(123): n is a, c, g, or t
  misc_feature (137)..(139): n is a, c, g, or t
  misc_feature (149)..(149): n is a, c, g, or t
  misc_feature (153)..(153): n is a, c, g, or t
  misc_feature (156)..(156): n is a, c, g, or t
  misc_feature (192)..(192): n is a, c, g, or t
  misc_feature (195)..(195): n is a, c, g, or t
  misc_feature (200)..(200): n is a, c, g, or t
  misc_feature (202)..(202): n is a, c, g, or t
  misc_feature (295)..(295): n is a, c, g, or t
  misc_feature (318)..(318): n is a, c, g, or t
  misc_feature (323)..(323): n is a, c, g, or t
  misc_feature (347)..(347): n is a, c, g, or t
  misc_feature (531)..(531): n is a, c, g, or t
  misc_feature (540)..(540): n is a, c, g, or t
  misc_feature (601)..(601): n is a, c, g, or t
  misc_feature (607)..(607): n is a, c, g, or t
  misc_feature (628)..(628): n is a, c, g, or t
  misc_feature (684)..(684): n is a, c, g, or t
  misc_feature (732)..(732): n is a, c, g, or t
  misc_feature (756)..(756): n is a, c, g, or t
  misc_feature (766)..(766): n is a, c, g, or t
  misc_feature (791)..(791): n is a, c, g, or t
  misc_feature (805)..(805): n is a, c, g, or t
  misc_feature (821)..(821): n is a, c, g, or t
  misc_feature (825)..(825): n is a, c, g, or t
  misc_feature (857)..(857): n is a, c, g, or t
  misc_feature (910)..(910): n is a, c, g, or t
gcccccgctggcgtcatcgagaagggggggaaaaaggccggacaggacagancgaaacggaaagnnaggaagaggccacgcggacagggccaggacaaacaaaaaaaggcaggagcnaaaannaaaaaaccacaaannngaaaaaaccngggnggngcggagaaaacgaaagagggagcgcaccagcaacancgnaacananaaaagaaggaaaacccgggaaggaaaaaagcacgaggggaggagaaaggggggagaaacggaaaagggacaaacgagggaaaaccgggaagcncggacggggcagaaacgacacanagggngcaggagagggagagggggaacancaaaaagggaggagggaggaagcggcaggggagcgagcggcgccccaggccacccggcgccgaggaaaaccggaaagggaggagagagggaaccaggcgaaggcgggcagcagagccagggaggggaaccggccgagcaggaaagccggccacggggggcccaagggggagcggccccccaaanagcgaacgnagcgcagggagggggaccccgggacaccccaggaggcacccaagcaaagcggggggaaggnggaagncagaaaaaggagggggaacanaggcagccaaaccggcacggaagccgggggggccaggcgggaggggaaaaggaaangggggcagggccaacgggggcaccgggggcaaagcgggcgggggaagngcagacgggccgggaaggggaganaccgcgaaangggggcccgccaaggcaaaggggangcacaggaaccggnggggggggggggaaancgcncacgggcgcggccggggcggggaccggggcgnaccaccggcaaaaaggaacggaaaccgggacggcgggggccgggacggaaggngcacccccgggggggg

SEQ ID NO: 693355 - DNA, 163 bp, Homo sapiens
tttttaaaaaaaattttgggggggggggggggggttccccccccccaacccgggtttaaacccaaaaatttcccctttttttttttgggggggaccccggggtttgggggcccccccccccttggggaatattttttttttttaaagcccccccccttttgga

SEQ ID NO: 693356 - DNA, 402 bp, Homo sapiens
cggaccgaaacttatagtggtaggaacgaagtcctggctttgcgtttcagcgtaggcggtggccgtgatgctgctgatggccaaggccagaagcgctttgctgctcagtttcatgggtgaagctcctttggttctcttttttaatgccggtctttttgggtgatccggctattgggtgtggaactcgttcaagctattgcaaacgtttggcgtaggaaatttcccaacaaaagcctgcacgtttgccggggagcgtatttcgctccccgccatccggttattttcttatgggttgatgctgacgcccgagaacacgttgcggccgaaggggcttaccttgaagccttcgactttggcgcttaacggctggttgaccgtcgagtggcactataagtttcggcc

SEQ ID NO: 693357 - DNA, 163 bp, Homo sapiens
cattctgtacttcccatgagcaggagagtcgagtgtatcagtgcaggcatccagcagcgggcgcaggctagccggagtagggggctagcagcttggcgctggttacttggtgacgtgcagagctctctactggggggctgcagctcagtcttgtggggagctt

SEQ ID NO: 693358 - DNA, 417 bp, Homo sapiens
agtggaccgaagctcgtccatcagatacaggttattttagtttctgttctgtggaaagtgtaaagcattccaacaaagggtttaatgtagatttttttttggcaccccaggctgtgatggctaaaggtaacagtctgatgggagcaagatgcccatctggcgtcccatcagggagttctatacatggacctctggtgggttatcaaaacagaagtccaagaggtgtcacacaatgacgctggttggatggtagctgatgggagaagacgggccatcttcgtcccatcaggaggcttcactgagctgtgatggcgccatggtgctccagcctgaggaagagaacaagactctggttacaaaagtttcatccacattttctttggggaattaatagtatccggatgggacgcaagacgg

SEQ ID NO: 693359 - DNA, 1604 bp, Homo sapiens
  misc_feature (191)..(191): n is a, c, g, or t
  misc_feature (300)..(300): n is a, c, g, or t
  misc_feature (487)..(487): n is a, c, g, or t
  misc_feature (1431)..(1431): n is a, c, g, or t
attttagttttttttccaaatggaatatttaataaacagggtagtggccttggtaacaggtgcacacaaactcgcaacacttcaaaaagggatcggccgtgggggacaaaatacactcaaattatgcctagaggggcaaatgtgcaagaaatcaaaaaaatcccggggagggtttccaattaatgggtggngcgacatttatgtcccactatcaatttaacaaagagcctttattggcgccaatatctgtgctcccagaggagagagccagagagttttgtgacagagtgtgagagcggnccataaggggacacgaggagacactctgtgggggcgccaacaaaaagtatctcacacacagaggtgggcgccatataacgcgagaagaggctctctctcagaatatagtggagcaaaagagggctgtggcgacataataagagtgtggtggccactatatgtggggcgggtgggagaaaatatctcnctctctatgtgtgtgccaaaaatttagtagtggggggagagaggagggggtatatcactcacagagtgggggggcagagaaaaaatatataagagagagaaaggggcggggtgtgtgagaagtgagaaggggtgtatatctaggagaaagtcacaaaatatattcctctcacaacacagagtgtattcgtggtggggcaaggggggggctctatttccagagagaaaaatagtgggtctataaaagtgtctataattctctggtgagagacaccccagaggtgtttctcccagacacactgtatatctcccacaaagtggggcgcaaagggtggtctctttgtaaacccgctctccaaaattctctccttatagagaggggctgcgaaacaaggagaaccccacaaatctgttggaaggggggacaagaaggcgtccttttttaaagagagaggggggctcccacaccaaagaggaggggcgcagcaaagtggagggctactccccgggggaggaggtggaggacccccataataaaaaagcgcgacaaaacacacgaaggggggccaaaaaacccgtgaggaaaaaccctctggggtggttcactccacaccaaaaaaagcaggcggggggggagccaacggaggggggaacacccaatcacacacacaaaataatgatcagacacctcaccccgggggagaaatatgtagggggggagcctaaacaccaccaaaaagggcgcgcaacgaaaaatcaaaaagaggcggggcggcgggggggaataagattctacccacccaaacccctgcttcccccgcctaccaaaaaaaacaaacacaacgggggggtgcaagtatggcacaccaatcaacttattgtgccacggagcagaaaaccgcgcgcagacggaataataataatataagaagcgccgcccggtgngtggggggcggacagcaaaaaaataataacgagggggcaagaacataaaggggggacagcgcgcccccaaacaaaatagagaaaactcaccaccgaactaacaaaccgtgagaggggtggccgacactcaacactaaaaaagtagggtgatggcgggcgggtcgactccatag

SEQ ID NO: 693360 - DNA, 550 bp, Homo sapiens
tctagaagagatcccgtttccgagagttagaagcagggtgaacatggactgccaattacaggacagacgttagtaatataagtcgtagtgtgagaatagcaatgtagctacttactccatctgattcccacccactgacttctatacagctctctggatctttgtcctatttccctggctctaatagcaagattaaggtcccctcttcctcagagccaaagaaaaacaattgagctgaggtctctcatattccagttattctaggtcgttgacttggaaaaaccctttgggagtttttcaaatatttgcagattatctttttgaaatccacctttaatcatttttacttgtaattgttccagatattttatagccttgcctacctcagcaagcagagcatataacacacagttataattttgttttaaaaggcaatgtggaacacaggctattgaaataaatctaaagtctacaactgaataatttttgaccttgtgcaagacacttagcctctatcagcccatttcttcatccacaaaatgggactctt

SEQ ID NO: 693361 - DNA, 1173 bp, Homo sapiens
  misc_feature (315)..(315): n is a, c, g, or t
gagaactagtctcgagtttgtttttttttattttttgcttttaaaccaacagctttaaatggcaaaaggtaaaagaccttcattacaaaaaactttaataattaagcattactttcttgtcacatgtgggtggaaagttcttataccgagcttgggtaggtattccgtagcaccgttgaaacactttcactaaagtagctcagagccatctcagaacgccgcatggtggcgtgtgacgaggcgtgccgtgccttcccatcgtgctctcccgtgggaccactctccaggggccagccactagccctgtgttctccncgagaaggagaagacgcttcgaatgctgtgacccctgtgtgcaccctgtgtgtcccccgaatgtgatgtggcggggagacgcaacgtgcggcgtgaggctccccggtgttctatgtgcccttgtgggtgccctcccttcactttcgccgcagaaccgcctcgagcaatttcggggttcatctgagagcctctttcccccacaggtgtgggagaggtgtgagaaggagacaggggcgaagagacttgcgctaggactccaaaccgaattttgcttccgtggagaggtgcgttcaacaccatcttgtgggggagcacacaagagaaatgtcaatgggcagaaggggagaaaggccgttggctatctggagaatcatacaacttcgcgggggcacattaacctgggtgggaaatagcggactacagaggtgatatcagtcggaaaagggggcaacccacagagaagaaagccaatacacacgtgggaaaaaggggggttcccaacaaggagagactgtgggagaaggggtatacgaccaaggtgtgtgaaagaaacacatgggggaaaaatgacaaacaacagagacacgtataaaagagggagcagcgctgtggacaacacaaagggggtagaaagtccccccgagggggcccacaaagagtcagaaaagcccagcatgggggaaaagccacagagaggagtcccacaggagagaaagccgacaggagctcaccaaagaaaaaaaagagtgcgcgccaaaagggtcgcgagacagaatcaacagggtctgtggcaaccacctgcaagaccccaagagatagaaggatgaccacaataatcaaccaaccaaggaagggggc

SEQ ID NO: 693362 - DNA, 156 bp, Homo sapiens
tggtgactctacaggatcccctctctccacactggtgaacatctattggttcatcccaagtcactaagcatatttttattaggtacacctgtttttccttatacagctgtttctggagtatagggtcgcatacccataaacccagtgtggagagag

SEQ ID NO: 693363 - DNA, 200 bp, Homo sapiens
ttcattctcatccctttatttagagcctatgtgtagtcttatgcatagtagatggatctcctgaatacaggagaccaatgggtcttgtctctttatccaagtttgccagtctttgtacttttaattaggggcatttagccccagattacacttgaacgattaatactggttatagtgtgaatctagatcctactcatata

SEQ ID NO: 693364 - DNA, 414 bp, Homo sapiens
tatcaacccaagacggaactcggtcaaactggctacagaaaaacgcgaaatggctctactacaacggtgtgccgctactggaacgggtacaataacgcggtgccgaagtattcgctcgcggttgctcttctcttcgttcctgatgggcgaaatcgctgcggcgactatcttcaagcaaatgcactacaacagccgcgaactggtcttcccagaggcgttccgcaacatcgggcgcgacgaagggcgccacatggcgatctgcatggcgttgatggagcgtgactatccgaaactccccgtcgaggacaaagcgctcgtcaccaaacagatccgcgctgggtacctcttcctctcggcggtgctcttcgaaccgccgatggagttctaggatctgcccgaagacttcatcccgac

SEQ ID NO: 693365 - DNA, 808 bp, Homo sapiens
ctctggttacattacctgacagacaagatgctgaaacaaatgaccttcaagactaaatgtaacactcctgccatgaagcaaattaagagaaaaatccaggagttccacaggacaatgctgaacttcagctctgccactgacttgctctgcagcacagtctgtttaagtaagctaaatgtatcttactgccccgaaatgagaggagactgtcttgaagcctctgtgctgtttcaacctccgtccccacaggagggtggaactcccattctcacaggtttccagtcagcttttcaaacaagaatttgtttccaaatggaaatgaaatattttgtcgaaagtgtttaacattgtgctgataacaaatgttctgaaaggaagtaaactagccgggcgcagtggcgtgtgcctgtagtcccaagtagctgggactacaggcgcccgccacacgcccggagaatttgggtatcagtagagacgggttccaccgtgtaagccaggatggtcctcgatctgctgaccttgtgatccaccgcttggcctcccaaagtgctgggcatcaacagggtgtgagccaccgaacctggcccaatttgtggttaatatttcctcaagggaggaaactgacaggtggtttaagagctgagtgattgagagtccttctgaacggactcggcacattactcctaattctttcccatgtttactggcctcatcgtcctagactcgggttaatactgagactctgtgtcatgtgaacgggggacggtaagaacgcttaatacgggccgcagttctacggtgacggacg

SEQ ID NO: 693366 - DNA, 1651 bp, Homo sapiens
  misc_feature (1308)..(1308): n is a, c, g, or t
  misc_feature (1391)..(1391): n is a, c, g, or t
agcgcggcgtcgactctgatggacccaggttgtgttgcgctacaaaaacaccgcgggcgtgtgtctacctcggtggctgtggattgttctcccgggcgtgatattttttgtcggcgaccaccacggctgttcgaggggcgggtccaaccacttgcggccaaccgagagggaggcgtttggatcaaccactgggccccgagggcgacaaaatttttttgtggagcacccgggggcctcagtggaggcgggggggcatctgcctcaagtgacgcaccggagcggcccttattttggggggcccttttcttgctcagttggcggccgccatgatgttttatagtgatgccccccgggggcccgctggctttggtgtccccgctcggccacaagagaggacctcacggggttgtccggagaagggcctttctcttgtgaaggcccccttcttccccgggggtgtttctgggtgtctcgtagaaaaaccgtctggctgctccccataatatatatgctggcgtgcccccccccccccgcgtttttttgcggggggctgtgccatcatgtgtcctgtgccactctggtagccagtcttcctgccgaatgttctcccgggagtgttctcctcggggccacaatccgtgggctgccacacgccccaaagattccccgggggtggtacgccacccgggccgctttatgaagggggctctttcgtggtagactgtgagcggcgcccaccaatagtaggagcttatcctgggggcgcgggtatttccctcccggcggtccgctgtctctcgtcgggacgagagcccgcggggtgtggccacacagcagcgccgcgagggggtgttcaccaccccgcggggtggtgccgccacttttttcgcggggcaccacagacagcccagctgccttgtgaaggggcttctcacaacagcccaacaggtgggcgctctataacggggtgggcacacagagataccttcgggcacacacacgcgacaccacactgtttcccgcgctgtcgcgccgccttcggtgtcccacaaacacacaccacgcgagaggtgtgagagtggccccctctctggggggagaagacacgcgcgcgaggggcgcaacgagacctcgggagacctcatatgtgagcacacactgggcgcctcgtgcttttgtgagacacaagccacactcgtgggaggcgcgctgtagggcgctgtctcgtgtggcgcgctttcacacgcagcacatgtgtggggcacaccttctctgtgtgtgtttcctcgtgtcacagtcacacggggntgagagcacagctatatggagaagcccccacattcgcggtgtggcacgccacatagagagagtgccacacagcgcacatgccncacaggggccacaacacacgcaccacaataacgctggagaaggccacatggagaaggcacattttctactccagcctatgtgtggaggccctttgcacggtcaccgagtgaaactctgaggtgttgtggaatggaatgggtggatggaagggtggcacaggtggggcgtccccacagggccacacttcttggcacagaagaactttgggtttttaggggtcctcaagtgcctttgtgattaaagaatgttggtttatgta

SEQ ID NO: 693367 - DNA, 333 bp, Homo sapiens
agagcctcagtgtgagcgggaaagacaccaaaacacagcagtatgggtcctgtggagggggcaggtcagcatccctcaaaagccccctgcaaacctggagccccaccatggttgggggccgcacaggcaggccaggtctgctgtgtgactacagtgggaagaggacatgagagactctggctctccacaagcagaggaggccacagcgcatggagtccgcaactggacacagtcgccccaggtttagggtcaggattaaggggacccagagctcctagacctcatggtgaggacctctcgtaagggaaggcgcggtccagccacgggcatcgt

SEQ ID NO: 693368 - DNA, 387 bp, Homo sapiens
gaggacccatgtgcgctcaagatctatggtcctttttttttctgcaacttctaatagtgattttatttttttttcttttgggtcaccggccaacagtttttaatttgtttgtttgtttgttttttttttttggagacagagtctcgctctgtcacccaggctggagtgcagtggcccaatcttggctcactgcaacctccgcctcccaggcccaagcaattctcccgcctcagcctcccgggtagctgggaccacaggcacatgccaccgcacccggccaattttttgcacctttagtagagacgaggtttcaccatgttagccaggatggtctcgacctcctgacttcgcgatccacccgcctcggcttcccaaagggctaggatt

SEQ ID NO: 693369 - DNA, 838 bp, Homo sapiens
  misc_feature (252)..(252): n is a, c, g, or t
gcaagctgggatgatgcgtgcgggacggaagacgaaatctatgaggtgagcgtgctgatgacatgtatgtatcagcgggcacctctttcgccagtagatgtatcgctagttctcaggctcagtgcaggatccagggctgcatgtgtgggggcgtgaaagaaagttcgagatcggatgcctgtggtccttagatggacctctgtcgtctaggttgctccagggggacgtcctactctagtgttgcagcactgncctagaagaggtttcccatctgcacctgtggataggccagcagtcatcccgggatgagcagggggcctgtgccgtgctggttgtgcacctcaacacgctgctggaagagcggcctgtgcagcacctgggagggtgcatgggcaatgagtctgaccctcttcatgagcttactttcccagggggccttcaggttaccaggaaggtggtgtggaagtcacgcatttcaccaaagacctccaacagggagcccccagttgccatcaaagaaaactctaccaaggtgacacggggaaagaagaaccattccggtgccaccgaggggcacctgaccttggggacagcttccaaccatgggggactgtttcattccgtgaccctggggcaagaacatcttcgccccggttgtgtgtggaacggtccaaacatccttggaaccgacacagggggagggaactggcctggcccatccgggaacagtgagcgcaaggggcaagcccacgtggggattgtcactgcgtggggagggccttgtggaatgaccacgtccgggccaagcctgggctgaaggggcacctctaggaaactc

SEQ ID NO: 693370 - DNA, 937 bp, Homo sapiens
  misc_feature (151)..(151): n is a, c, g, or t
  misc_feature (195)..(195): n is a, c, g, or t
  misc_feature (229)..(229): n is a, c, g, or t
  misc_feature (232)..(232): n is a, c, g, or t
  misc_feature (359)..(359): n is a, c, g, or t
  misc_feature (432)..(432): n is a, c, g, or t
  misc_feature (490)..(490): n is a, c, g, or t
  misc_feature (689)..(689): n is a, c, g, or t
  misc_feature (737)..(737): n is a, c, g, or t
  misc_feature (815)..(815): n is a, c, g, or t
  misc_feature (826)..(826): n is a, c, g, or t
  misc_feature (831)..(831): n is a, c, g, or t
  misc_feature (892)..(892): n is a, c, g, or t
ataaactgtgtacccctcctttctttaccatcagtcaaggggcgcacccatatttactcccaaccaaactatatacccctccctttctcactctttctccacaccatcaattcactctacctccattatcaccctttcaaccaccatcttnaccccaaaaaaaaattctaccacataactcctcttttcaacatntattacaacaacttattttctgaagtgacggccngantaaccccacaaccaccacatttatacacgacactatcccttattacccctgatttaaacctattttacccatatcatcaacagccaataacatttaactccccttttataaaaaccaaattaaactnattaacgttcatacatacaggtgcccccaactttccccataattttcttaaaaatactcactctcacttacanatattacgtatttcctactccaaattctacatcaaccaataagtcatttccccacaanaaaccagcccattttactctattactccctagtattcacacactgcccttcctacccctgaccattaattaaagagccgcactaacacgaggcatcttctttctccttaaatacaatctttccttaaacgctctcaatatttttaaaaaagaccaccttatatccctatacttttctacttaacaaaaactctcccttnccaatacctttttaataaaccaataaacactcttcacccctcctcaantataatacccctcccggaaaacctcaataccataaacaaaacttattgaaaaacgccttaaatccctctcttatattntataaaaaaanattanaaaccaaaccgatcttcccttatacaaatatggaggattttccatttttatatttccaagncctccaaaaagcccccctccccccccccattatataaaatttcca

SEQ ID NO: 693371 - DNA, 653 bp, Homo sapiens
ggggggacaaaaaaaaaaaaaaaaaaaaaaaaaaaaaaaatttttggccggcccggcccccaaaaaattttttaaaaccttctttgggggccggggccccgtagaaccttggtggtcaattactgtgttccctaagtaaaatactccggggcgcactacgacctacggctgtgggtgttctctcaccaaaatataaaaaccgcccggggcgggcacccggagcgcgtcctctggacacacatccaacaagtgggcttgtggagcgggacctacacggggagatctcttacacaagagggtctccacaggcgaggagcccaagatatcaaacttttcccccccggctgggggagcagaccattgaccaaccaacacccaaccccacagcccagcacgcgccgggaccgaacgccgaacaatcagaggagggcacgacgaagacgcaagaaaacaagcgaccgcacaggacacatcgaggagaacatcagcaacgctccgacggcagacgccaacaacggagaaaccaacagggaggaaacaccaacaacaaccaaacgaacaaacgacagagacaaccagcgacccacacacagacaaggaaggaggacacaataaaccaacaccaaaagcaacaaaccagcagacaacagaca

SEQ ID NO: 693372 - DNA, 279 bp, Homo sapiens
ccagagtacgctagattcatccaagtgttttcatgagtcgtgagcgcacgccccatgttcctcatctctcagctgtccctcggtccctgtgtgagattgttactcgctatgagggggctcagatggtgcggcctgagtgtgcggccggcggcatatgggatacacccgtagggtgggcggggtgtgtcccaggcctaattccatctttccaccatgacagagatgcccttgtgaggctggcctccttggcgcctgtccccacggcccccgcagcgtgag

SEQ ID NO: 693373 - DNA, 452 bp, Homo sapiens
gaggatcccttgtcttgctggggagatgagggcggtggaaatgactcctttttggacttgatagatttgaaatctgtcccatgaggcatccaatgaaggtgtcaaaataagttagacataggtaattggagccctgagatacatacacatatgtaaaggagaccttaccaaaacagagggctcttggggtgtctttgggaatgccttttctcttctcctagaaaggaaaggccatcattgaagaagaggttgcccgggattgaagactcaggcattctgggcatttagaagtttacactaggaaaagccagcaaagggagaccgaaggcaaatccagagagtgtggtataagaaaagcagtgagtgcgaaagtttttgaggtaagagtggatccagtgggaaattggtgctgtgcaggtagaaaaagatgaagaccagacaagaaccacacg

SEQ ID NO: 693374 - DNA, 163 bp, Homo sapiens
ccccaagcctctcttctgcttcactacattaatttgttttgaccacagtcattcccaacatctctgttgccattgtttcttatagcaggttagggtgataaatgcgtctctgcgattccaatgttaaacagaaaaaaatggagcctgaatctaacgtcgacgc

SEQ ID NO: 693375 - DNA, 398 bp, Homo sapiens
  misc_feature (154)..(154): n is a, c, g, or t
  misc_feature (265)..(265): n is a, c, g, or t
  misc_feature (274)..(274): n is a, c, g, or t
  misc_feature (360)..(360): n is a, c, g, or t
  misc_feature (385)..(385): n is a, c, g, or t
  misc_feature (390)..(390): n is a, c, g, or t
atcaatcccctatgtgtccatcaacatcattcagccttaacaaggaaggaaattctgacacatgctacaacatggatcaactctgaggacatcacatcatgcctaacctgaaataagccagtcacaaaaagacaaatacctatatgatcctacntagagtagtcatgaaaattcagacaccgaagtagaatggtggttgccagggcctagtggcaggggaaatggggagttgatgtttagtggggcagagagtttcagtttgagnatgaagaanaaagttctagagatggatagttggtgatgggttaccccaaccaattgtaaaatggtaccatattatatttaaatggtacacctttnttttttttggagaccagaggtttcntgccngcccaggc

SEQ ID NO: 693376 - DNA, 328 bp, Homo sapiens
gctaatttgagaactttcaaacagagttagaagtatggctattaggcctgatgtggtggctcacccctgtaatcccagcactttgcgaggccaaggcgcgcggatcaccctgaattcaagatcagcctgggcggcgtggtgaagccccgtctctactaaaaatacaaaaattaggcaggtgtggtggtgcgcacctgtggtcccagctactcaggaaggtgaggcagaaaaatcgctagagcccaggaggtagaggttgcagtgagcccagatcgtgccccactgcactccaacctgggcaacagagcgagactgtctcaaaaaaaaa

SEQ ID NO: 693377 - DNA, 425 bp, Homo sapiens
  misc_feature (139)..(140): n is a, c, g, or t
  misc_feature (145)..(145): n is a, c, g, or t
  misc_feature (200)..(200): n is a, c, g, or t
tctcactcgaccgccccccgatcttcagtccaccccttcccgtccatggtcttctgggtgggccctcccttcttcatcagtcccatcctctcctgtccattgtcctctgggtgtccccccccatcttcatcaggccacnnttccngtccattgtgttctgggtggacccccccatcttcatcaagcccaccccttcctgnccatggccctctgggtggcctccccatcttcatcagcccacagcacctggtgctgctttgtagtcactgtcccccccccccctctccgctttgcctctgtgtcctcccagtgtccatgtggtaggaacaaggatcacagcattgatggagaccacatagctgtgcagactagtctcgtctaatttcacagccaagggcttggatccaccgtcacttgcctagtcc

SEQ ID NO: 693378 - DNA, 1033 bp, Homo sapiens
tcaacccaacttacacttaggagatttcaacttaacttgcacgctctgagctaaacctagccccaaacccactccaccttactaccagacaaccttagccaaaccatttacccaaataaagtataggcgaatagcaccattggcaaacctggcgcaatcagcatcatagtcaccgccaaggggacaagcatgcaaacaattcataaccaagcatcaatatcagccaaggcactaacccctcatcaccttctggcattcacttgcacttttcaccttcagccacaattacctttgtgccacagggcagcagccgaacaagctagaagaacccccgaaaacccagcacggagcttcaccgtacagacacaccagcgtcaagaagcagcaacaccccggtcttaatgttagccaaccacatagtggggacagaattctatacgagttagcaggccgaacaaaacacttaacccgagcccttgggtggatacgcttgggcttggtccaaagaagtacgacactctttacaggtttccaacgtttttacacacttttgcccaactagacacgcccttcctactcaaattccgcgtttttggttacaccactttttcacaccgtgggttataggtacccaaaccaggacgtgacaacaacgacctcctttgtgggaaccaactaaggcgcacaacgcagcgcaccccttttggtaaaggcacggcacggcaggtacaaagctcgcacttttaaagagaccccaattaagtgacaggccctacacacaggcagggcgcaaaccacaatttttcaaggaaaaacggcggttccaaacggcgtatccaaagcaccccaaacagtaaacgtgtaaaacaaaattcccccaaagacaatttattaaagtggaaactgtccgttcacaaacaccacaaagttgggcaccacattcttataatacaccccttaatgtagggaaagacacactcaagggggtcacgcactaacgcgtccgacaatcggcaccacgaagttgtccgac

SEQ ID NO: 693379 - DNA, 313 bp, Homo sapiens
gtttttttggggggggggccccccccccggggggggttctctaagggccccccttttaaagggttttttaccccccccaaggggtaggggggctttttcccccccattttcaacctttgagggcccccattttttagacattttttggggcgttttaaaaaagcaacctcccaaaataaattctcgggcttttttaattctttaaaaggccaacctcggccccggggggggaaaaaacctttcccttttaaaacccttttttttaaggggaaaaaaaaatttttttaaaaaaaatttttaaaattgggcccca

SEQ ID NO: 693380 - DNA, 155 bp, Homo sapiens
ttagtagtacaaagcccagtgacaagtccccagtgaaatgcgtgcaaatctctatgtcgctactgatgcagctgtagggtgggggactgcaggatgctcggcatcctcccattagaaacttgtttacatgccagaccttgaagcctacctatttt

SEQ ID NO: 693381 - DNA, 337 bp, Homo sapiens
caatatgatgaacagtaagggagcagagatgaataaggactttcaggaacttaactattctggaataaggaatgaatcaactgaccttgaggaccagcaggtttataactaaattgttacttgcctatctcacccagttaatcagactctgtacttgtttccctttaagaaacaggtgtcatggattaactaattctgttttatggttgtgctaaattcgtaacaggtgccttattctttgcttttagtcaaaccattccatatcagaattttccttgagttactatagatatttggctttaagttgtagtttgtgtataataatgtacaatgttca

SEQ ID NO: 693382 - DNA, 559 bp, Homo sapiens
aggtgaatgccctgcaggtgctcacggccgcgtcagtgcttcgcatacagacagttatcgacgaatgcacgcagattatcgcccgcgctcgagccccgggcacctctgcgcccacgcccctgcccaccgcctgtgtccccggcatcgcacctgcgcgctgcgtcccgtctgcccactgctggtgcgtcccccgggaacccggttgctgcagcacagccgtaagcatgcgccagccctgccgcgtttgcagctgccaagcgcccccaaaacaccctgccaaaggctgatggggcctgaattcttgacccttcatgtgtcgcagcgaccccgtataaagacagaatgatcaacgaaagtaatgcaccaaccgaaaatagctgacgaggaacacacgaactgagacatcaaatgcaaaagaaaataagggcggacccaaaggcaaaagggcaaggacaacaccaattcaattccataaaattctagtagcttgattccctaacaggtgaaatgagaaacaacagcattacaaaaaacccctcacacacgacacgcgactaag

SEQ ID NO: 693383 - DNA, 81 bp, Homo sapiens
cctgaggacacggctgtgtattactgtgcgagagattggggggatcctaggggtggggttattgactactggggccaggga

SEQ ID NO: 693384 - DNA, 242 bp, Homo sapiens
tggggtagtttaactacggaaagagattagagtggcgggagtgaggtcagacctatatacccaggacttagggaggccagggcaggcagatcactcgaggtcaggctttagaggccagcctaaccaacatggtgaaacctcatctctgctaaaaatacaaaaattagctgggcgtggtgacatgcgcctgtaatcccagctacttgggaggctgaagcaggagaatggcgtgaacccgggag

SEQ ID NO: 693385 - DNA, 970 bp, Homo sapiens
gggaacaccagcggctgacgtctgcttcagcgtgatgtgcgggcgccagaaaggcccgatcgaaaaaccgtggagaggtgcgccgaactacaccccgagtgggatcagccagtccgaagccaatggcgccacggcgtcaaagcggagacgaggcagcattcgacctccatggcgccactcgcctggtgtgttgtccacagtgccatgggatgcagtagataaactggtagctgatcgcaggaatgaagttgttcagaaaaattaagagcgcattgggaatggttcgttatggggaagtttgctgaaggatgtgataatcggtacccaggtctagtcgttgctattaaaatcatagtacttgatggaagcctgatagatgaaatagaagacgttctgtaatgaaataactgtcttgagtctatgtgtgacaggatcactattgtaaagcaaattacatagtgtggtcagtatttcatacagtggtgtcttaacagttgaattggactcataatggtaaatactgtggtcaggattgatatgaaccatgggaagtctgtgaaggagggttgaacaggtgagacggacaatcgcgtatcggcaaaagaaagttaaagagtgaacacttttgtgacgggctgaaggaaagattgaggataagacaatgaacattggcagcgaaagcgtaaaggggttgacgtgtcatctggcacttagaggggcaaggatctgtacatgagattgagggttaagcaagttgaatgtgatgattgacagattgcatagaataataaggagtagtaagtggaatagcgtttagatgagaagggaagataagcaagagatcagcttgaagcaaagacagagatcataaggggaataggtgaaatgaataacgacagtacagagaaaacttgaatgatcataaagcacgataaaaaggaggaacagagatggagtagtaagtaattat

SEQ ID NO: 693386 - DNA, 284 bp, Homo sapiens
acgctgagtgtaacccgccgccagctcatcacagtacctcgagctgtacagagttgctatgttctgaccgttccatcgtatacactggccgctagattgctacatggtcccactatcctgaaactgctggtcttttctcacatgtcacctcagtaaggctttatagtcccttatcatccttaatcatttcaaaatgaacctctctactcaacagtctgccccctataacccttttctgtcaaacttttgtccttacttcatgtcaccatttaacatactgtatg

SEQ ID NO: 693387 - DNA, 757 bp, Homo sapiens
  misc_feature (251)..(251): n is a, c, g, or t
gaccctcgtttagcgtaaatattatagtagcagtttaccatctcactgcatagagattagtaatatatcgcttgacagataatgtgctccctactgtgcctagaaggaatgtactatcgctgaacatggtggctactctcagtaacgccgtcatcacagtggatccctcttgagaccaagcatagtgcctattgggcatattggggtcattaggcagcgctgctgaagcactcggtggggactagaccctnactatgtatcaatctcgcaggagatatggtctagagctacgtacatatgctaaggctactctgatgttactcgtagtcggcccagcaattatgttaggtagctagctgtcgtgtgaacttgttcggaaagaagagccttagttgtcgcatcaggggatcattcgagagcccagtagtccctgagattcatgtagtcgctcggtccactctacctatgtacttaggctagatcgataacaagctagtttagcttgtcacacaaggcgtgttggccctgctcggatgcgccgcagtatggaatcagtggcctgccataagtatggtactgatagactgagttccataggcctgtcaccagctctttgtgtgaaggggattcgctaaggtgtatcctaatgtgagccgactagttcagcggactgcatggcttctgcctcgtgctagtgcctcaagtctttccgagagtactcggctgaatgatagacctttcagggtcgacggaaatg

SEQ ID NO: 693388 - DNA, 1450 bp, Homo sapiens
tcaactttcaactcccatactttatggggcacaaaggaggaaggatgcaaaccatcaccacaggcccacccgaccagagggtgctccaggctctcgagcacctagtacagcatgagtcgagtcacttttatcaatacaggcaactggggagggatggagtggggcaaatattccaccaaaggaaagggaacattagaaggtcctatctgaggcttggggcgctcgaggctatgtctctgctcctgggccacaagtgcccactttatggtatcgaaaacaaggcaggtctaaggagtctcccagttgtggcgaaagtagcatgaggcagaggacagcacatttcgccatataatattcgcacgcggcacacaagaggaaagaggcgatttcaccgtggcagcggcacaattcccttatgtgaaactaatatttggggaacagaaacagacgcaaaatttgttccacctctatataacacgggtgcgagcgacctaatacgcgaacgcgcgacaaccacactgcagcaacaagacttcaaatattataaacctatatctctagaccacacgtaatacccaagacaccgtgtgtcaaacaagcaaacacacgtcttatatttcgtgccacaagctaagagagtaacaaacaggagagaatactgagagggacgagcgacaagacaaacacaacgtaggggcaaacaaacatcacgaagtattcaccaaagagtatagaacacaggtgaaacagcggaagaaaccaacacgatacacgccaagggaaacaaagaagaatcccacaagagatcttcaagaagacaaaccaaggggaagagaagaaaaacccaccccaaaaaagggagaacacaaaacaacgccataccacaatgcacgcaaaatccccggacaccaacaaggggcagaggacccgacagaaagccaaagacaaccacaaatgtgggaggaggaaaacaaaaaaaagcatgcaggcagatgatccaccacacaccgacacgggaaacagactacaacaagtgcgcagacgagtaatatgaaagaacgtctagagagtacaacaagagagacacccagactactggcccaacagagatgagcaaaacacatcagagacacaaaaaacgcctaaaacaagcccacgaagaggaacgaaaaaggcagacagaacacacccacgcaataaacgaagacaacaaacacacccagcagaacgaggacacacgacaaaaaggaccccgcgacacaaaaggacacaacaacaataggtcgggagacccgccagacaaacgaaaaggattccaacacaagagagcaaagcgaaacacgattcgtgcacaggagctaccagcaacatcaacagagaatcaagcgccctgcgatgggaagaccacatggcccagacaaaggaggaacagatccaccaaccagagaga

SEQ ID NO: 693389 - DNA, 575 bp, Homo sapiens
  misc_feature (49)..(49): n is a, c, g, or t
  misc_feature (54)..(54): n is a, c, g, or t
  misc_feature (75)..(75): n is a, c, g, or t
  misc_feature (79)..(79): n is a, c, g, or t
  misc_feature (86)..(86): n is a, c, g, or t
  misc_feature (107)..(107): n is a, c, g, or t
  misc_feature (140)..(140): n is a, c, g, or t
  misc_feature (253)..(253): n is a, c, g, or t
  misc_feature (258)..(258): n is a, c, g, or t
  misc_feature (282)..(282): n is a, c, g, or t
  misc_feature (514)..(514): n is a, c, g, or t
  misc_feature (532)..(532): n is a, c, g, or t
  misc_feature (555)..(555): n is a, c, g, or t
ggacctgagagctggaggggcgtgcgcgcgccttcagctctgttgcgcncggtngtcaccttgggcgcgacgggngccncgccacnggggacccaggagcctgaggncattgagtggcgatggcggcgacggcgagtgcngggccgcgggatagacgggaagcccgtacctcccctaagtccgtcaagttcctgtttgggggcctggcgggatgggagctacagtttttgtccagcccctggacctggtgaanaaccnggattgcatgttgaagcggggaanggggccaagactcgagagtacaaaaccagcttccatgccctcaccaagtatcctgaaggcagaaggctgaaggggcatttacactgggctgtccggctggcctgctgcgtcaagcacctacaccactacccgccttggcatctataccgtgctgtttgagcgcctgactggggctgatggtactcccctggctttcttctgaaagctgtgattggcatgaccgcagtgccantggtgcctttgttggaanacagccgaagtgctcttatccgntgaatgccgatgccggcttc

SEQ ID NO: 693390 - DNA, 513 bp, Homo sapiens
  misc_feature (10)..(10): n is a, c, g, or t
  misc_feature (19)..(19): n is a, c, g, or t
  misc_feature (43)..(43): n is a, c, g, or t
  misc_feature (107)..(107): n is a, c, g, or t
  misc_feature (109)..(110): n is a, c, g, or t
  misc_feature (112)..(112): n is a, c, g, or t
aaaaaataancaaacacanaaacagcattagtttaaaacaacnagcaaaaaggcaaagaacacccccgccagatattataacaaaaaggaggcggcccaccaccaananngngagaagagaataaaccaaagaaataagaaaaccaagaaaaaaacaaagacctataaaaagagacaagaaaccacagtaacaaagaaaaccaaaggaaacgaaaaaagtaccaacaagataacgaaaacaacaaacagaccaaaagaaatccgtgacaaaaagaaagaacaaaaacaattaaaaaaaagacgacataatgcaaaaaaggaacaagagaacacaaaggatcaaactaaaaaaggacaatgaaaaaaacacctgacagcgcaaagaaaaaaaggacaaaaaaataaaaacaacgaaaaacaaaaaaacgagaaacgaaaaaaaaaaggaattacaaacattgaaagaacccaagaaaaactcccatatcaccataggaaaaacaaattcacccc

SEQ ID NO: 693391 - DNA, 195 bp, Homo sapiens
gtagcgatctagaggatcccggacacaggaaaaggaccctttgctctgccaggagagtcacagaaggctttgctggtggaggatgagatgcaatttcagcctgaaatgatgaggagtttgtcttcagccatgtggagaaaggagcattccaggcagagggaccagtctgagcaaacgcattcgggtgtaaaatta

SEQ ID NO: 693392 - DNA, 195 bp, Homo sapiens
tggctggggaagaggggattccagctcctcatctctgcagggactggcttgtgcctagggaacactagctgtccaggaaggggagagcttatccctgtagccccccgatgtgtgtgcagtgcagagagagagcaagctacttctgaggaggggagtttgtggggaagggcaacgttacgtctttacctgacgggt

SEQ ID NO: 693393 - DNA, 967 bp, Homo sapiens
  misc_feature (967)..(967): n is a, c, g, or t
tgaaaaaacttggcggggccccgggggtgggtcgaacccccctgggggggggccacccccccctttttgggcaaattttgttctccagggggcccaggcgtgtgaggttgggggggggggggagccctctacttcttagtcgcccccccggagtagtagtggggggggtctcctctaaatggtagagacttttttcggcctttcgtaacaggagggggtcctcacaagaccgaaaaaaatttataaaattaatcagcggcccgtcgtaaaacaaaagtaagtgaccgccccccacaagagtaatacgatagtcgtatcgaggtggggggacctactgacccggggtacgcccatacataaagtgcttgggggcctcttgcagcgagaatgcgagcgagagaagaatctgtggttggggagagaagaaagtattatatttatctccacgcggagataataaatatatagcctagacaaagagagtattcggggatagaatgtgcgcacaatggggggtacccgaggaaaaatggggaaacttctgggaagagggcccctccattttgatgggagagaagtgcccttatggtggtaggaacactagtgtggagggtgcgaagccaaacagattaatctgtttcgggtggttagaaacaaagtaacctgtagaaaggttggtctataatacaacagcgaagcggtgccctttgttgtagaaaggaaagttatttccttaggggctcagagcagtcgagcaaatcaatttatatattgcccggggagggggggagccagaaaaaatgtgaccgaggggggagacagataaatttgaggagaaaataccctgtgctcctaccaccaggtaagattgtgttgccgaacactgagacgtttatagtacaccttttagggtttgggaggttaaagaatgcgcggagaaaaacggcgttaggggatcgggcagtan

SEQ ID NO: 693394 - DNA, 675 bp, Homo sapiens
  misc_feature (310)..(310): n is a, c, g, or t
  misc_feature (332)..(332): n is a, c, g, or t
cagagggattttgacagtcatatgtggggttgacacgttcctagaatttgagcttctcaatgtataggcacagtgagagaataaagcaggactggcccctacttggagcagtttcaggagggagctctgctgagcactggccacacaagccagtggtgcatcacagagtaccagcactgcaaggatggggtgagggcaaggaaggggccacagaaaacagctaccatcttcccagcaggtgtggggcccagctagcccaggaccagagggatctttcaccccaggtgaggatttgtcttggcattgtcanggctaagcttggaatatctctngtcaagagcagtcctgaaagatagagcccggggagaccttagaaactatccagcccatggcttcattttgtaaatgaagaaagaaaaacaaaccaaaaccaaaatcacctaattgcattctcccaaataccagagaagttgaatagcttgttctgtttcaaatagtaacaagtaacttacactggaaacaacctcagttctgccgaaacaacactatcactatttcttcatgtaagagctagtctctcttcctcaagttttacagatcaaactcagacccagttttccctcaactaccagcacctgcatcctccatgtgctgagggatcctctagatcacctc

SEQ ID NO: 693395 - DNA, 153 bp, Homo sapiens
agcagctcatcttaagttcagctctcagacattgctggttgagtttggaacccaaaacctcttaacaactggcagataatagctaaatcttaacatacaaagaagaacatattttccttggcactagctcgctgtagttgagggtcaccgagc

SEQ ID NO: 693396 - DNA, 167 bp, Homo sapiens
tggacatgcacagaggaggtggacagcacagaggaggtggacagcacagaggaggtggacagcacagaggaggtggacagcacagggggattgttgtttggaagggggatgcgggggaaatgttgttagtaatgagaaatcctgcgaataggcctcctctgtgctgt

SEQ ID NO: 693397 - DNA, 149 bp, Homo sapiens
aagtcggtaccccccgatagcccgacaggacacaggcgagctcaggtgatgcgggcaccagcaatgccatggcctggtagctccggttctgctttcatcgctaagagagtgtttcttcagctcaactcgaggtggcattggtggtgtga

SEQ ID NO: 693398 - DNA, 537 bp, Homo sapiens
tggagacagagcctcgctcggtcgcccaggctgggagtgcaggggtgtggtctcggctcactgcaaggctccgccttccgggttcacgccattctcctgcctcggcctcccaagtggctgggactacaggctcctgccaccgcgcctggctgatttttggtatttgggtggggacggggtctcaccgtgtgggccaggagggtctggatctcctgacctcgtgatccactgtgcctcggtctcccgagggtgctgggattgcaggcttgagccaccgtgcccggccacagccattagttcaaattgactcttccagaggtaaatttaatacgccaatacgaaaccggtagggatatagatcctagttcgcttctcctttttcataaagaaaaaccggtagtatatcacggtactcgggtgagattcctatcccttataattccttataacaacaattcagagagtggggtctaacctacactggaccaggcagggcgttgaactgtgcccaagttgatcctcccattttgacctcca

SEQ ID NO: 693399 - DNA, 847 bp, Homo sapiens
agcgggccgggccccgccgcgcccgcgcgcacccgggaccccgacacacatgagattcttcagagctcactttcaagtgcttcgtggactgcttctgactgcgccgcaccgcgcccagaaaatcagcccaatattcgcagcaaagagaaaaaaacaagagcaaaaagaagacaagacacaacgacaagagagaaacaaaaaagaaaaacaagcacaaagacacaaggacaaaaacaaaaagagagaaaaacaacagcgaaaacacaaaactccaagagaccgacgacagcgagacagagagagacaagagcgcacagctgacgcgcgcgaacagagggagaaaagagagagcccacagaagcgacagacagagcgcggcaccagacgccacacgaggagagtagcacgaaggaacagccgacgaagaagcgcagacacaggccgcagaacgaacagtcacgccgccggacacgtgaaagcaggacacgccaagccggcaacatgagcgcccgcacggagacacgtccgaggcggcgagcaacgcgacacagactgcaacacacaagacgcacaccaccacgcagcagccgcagcgagacaagacaccgaaccacaggtggcgggaacacaaacgagacagagacgaccaccagaccacgagcgcaccagcaaaagacacgcgacgaagcaccaaacacaagcggaacagagacgcccaaactacacaaaccgatacaagccacagagatgaacagaaacgcgaccccaagaccgagagcagaaacagcgaccaccaccagacagacaagagaaagccaaaccagcggacgaacaaaaaggagaagaa

SEQ ID NO: 693400 - DNA, 489 bp, Homo sapiens
cccaaaggaagacctaaaacagaatcacgggctggtgggacagtcatcctgaaaggccagaggaactgttggagcacagcctagagacaaacactgagtaacgttctttaacaaggactgaacgtgaaagatggaaacaggagccccccacccactggggctgagctggaggctgcagcctgcccctagccaggaggcacagtatatggaagaagctgatgtcccaagagagcttcctgccaagcctgacgctcacctgcctggggtggtttatttgcagtgcagcccgaagatgggatatgctgccgtcccgcctctcacccatgtgaggaacaggcaaatgctcctctaagctcccatgtggggtctctaccgaaaccccatgctgaccccagaggcccacagaccctgccaagttcaccctgctcaggtgataagtcggagccccaaatgctcgccacagatgggtggcacttgtgaacgatttca

SEQ ID NO: 693401 - DNA, 109 bp, Homo sapiens
agaaaaaaggaaaacaccaggaatttaaaaaaacgaagaaaaaccgaggggttttaaaaaaaaaaaccccccaagctggagaagaaaaaaaaaaacaaacggaggaaag

SEQ ID NO: 693402 - DNA, 400 bp, Homo sapiens
tggaaacagagtctcactctgtcacccaggtgggattgcaggggcgcaatctcggctcactgcaacctccgcctccggtccaagcgattctgcggcctcagcctcctgagtagctgggactacaggtgcccgccaccacagccagctaatttttatattttaagtaaagagggggtttcactatgtgggccaggcgggtctcgaactcctgacctcaggtaatccacctgtctcagcttcccaaagtgctaggattacaggcgtgagcccctgtactgggcctatttttaaacttttctttacacttggagaaataacgtcggctatttcatagatgatgatgtactagtgataccctgtctctaaaaaaattgtaaaccgtgggcggggcatagatggt

SEQ ID NO: 693403 - DNA, 132 bp, Homo sapiens
  misc_feature (124)..(124): n is a, c, g, or t
  misc_feature (128)..(128): n is a, c, g, or t
ctaggataataccttgtagagagagtaaaatattgaagcacccatcgtaggcctcaaagcagccaccaagttaaggaaagcgttcaagctctacacccactaccttaaaaatccctcacatatnactnaacc

SEQ ID NO: 693404 - DNA, 326 bp, Homo sapiens
  misc_feature (29)..(29): n is a, c, g, or t
  misc_feature (46)..(46): n is a, c, g, or t
cctgtaggaattgaaataatactagtganctatggcgggcacaagngctcacgcctgtaatcccagcactttgggaggctgaggtgggcagatctcttgaggtcaggagtttgagaccagcctggccaacatgatgaaaccccgtctctactaaaaataaaaaaaaaaaaaaaaaaaaattaactgggcatggttgcacatgcctgtaatcccagctactctggaggctgaggcaggagaattgcttgaacccaagaggtgtaggttgcagtgagccgagatcatgccactgcactctagcttggaaaacagcgagacttcacctt

SEQ ID NO: 693405 - DNA, 773 bp, Homo sapiens
cacgaggcagcgacgcacggctgatcgccatcttcaaggagaacaagcggccgtccaaggagatgcaggtcaccatctcgcagcagcgtcggcttggagctcaacaccgtcagcaacttcttcatgaacgcgcggcgccgctgcatgaaccgctgggctgaggagcccagcacggcccccgggggccccgccggcagccacggccactttctccaacggcctgaggcgccccggccaccgcagccctcacacatgactacaacggcctgggcgctgtgcccccacagtcacctccccaacatcctgccaggcccggagaccacgaccaccaggggggaaaactgaagaggggtgctatccaggagacccgccacaataaccagcgagggaagggcggctaaagccagccacaacgacgcaagcatggaccacaatacgttgcacccaaacaaacgggggcccggcaattacatcacccatcagctattgacagaactactaccgtacaagcgcaacacagacaacagcaccatcaaacgaacccacacaacccagcaataaggaaacagcccagcaaaagagacaccacccctagcaccccgcacaccaatgagaggagcgaccagaccaggacccgaaacaaaaaaaccaggggacagcacggacgtgaacgaacagcgcgcgcccaacagcccccacatctaaacaccataaattcagacatataacaacgtggacatgaacacacgcaccactccgaagaataccatcaa

SEQ ID NO: 693406 - DNA, 369 bp, Homo sapiens
aaacaggctggcggaaagaaggctctagagcctgcttatagagccacaagagtttgcagacaactgtgatgtcagccaatgtcactcgtacgccgccagaaaagtcctcgtcttcaatgtaatgcatccagcagccccgcgaattctgcctcacttcctccgtttgcattctcatgtggccgtgtttgttgttggtgctatgatgccctaaggtgggagaacaccacaggtacttggcttttgggcactatatacggaatcagcaaagatcacccactgcaccacctgggctgctgcctctggagtacttccccgcagctcctcattgctcacatagtaggcaatggagttgctctcaaacacacagaa

SEQ ID NO: 693407 - DNA, 189 bp, Homo sapiens
cgggagaaagggcatcattataacgctatgagtggagatgtcctgtcaaaggtgtctcacatctacacgttggctgggaggcttttatggggcccggtccaggtagaaaagaaagggtatgtagagcttagatgtccctatggtgacagagccagggggtgttggtaataataaaaccaaagaaacatt

SEQ ID NO: 693408 - DNA, 230 bp, Homo sapiens
gcaggcccgcaagcggtgtgagccgtcgcagccgtggcatcgttaaggagtgctgtttccgcagctgtgacctggaccctcatggagacgtactgtgctacccccggcaagtccgagagggacgtgttcgaaccctccgaacgtgcttccggacaacttccccagataccccgtgagccagttcttccaatatgacacctggaagcagtccaaccagcgcctgcagcaag

SEQ ID NO: 693409 - DNA, 285 bp, Homo sapiens
  misc_feature (36)..(36): n is a, c, g, or t
cctcatccccgttttgggtgtcctcaccaacaaggnggttggggggcccctggtttgtccctaaccctttttcccagggcaaaaccagttttttttgttttgggttgggttgggttggtttttaaaccaatcatgttcccctaaaaaaaacttggccctcctgggccctttgcctggacaagcacaaaacaaatttaattttcctaaggcaggggggggcccggaacaatggggccttcagcgggagctggggacttttgtacaaaccctaaaattttgaagtta

SEQ ID NO: 693410 - DNA, 638 bp, Homo sapiens
ataaaaagctaaagctgccaaatttctgttgaactcttaaaaacagctcatgtttgttgtcctctcgggttgtggcctagcctattgcaatgtaatgaagctgcagggttcttgtatagctaaagcgttcaatgcatttcacgtgctgtggtggatgtgggtgctgtagacaggcttcttctcttcctgctctcaaaatacctcggcttgacatttggacagatcctgtcattgtttaagctgagcaaaaaaccacacaaaagttgtgtaagagatgagataacaaaggagcgagagaaatctcatgtgaatttccaagttttaattcgttctccatgaaggattttcattctcagtgaaagtcgcagcagaagagggaactttctgggagtttttgaggaatgcaaacacattttatcacacttcttggaaatcaatgcttgcatagaaaatcaaatcagggaccaagaattcagggaatgtctattgaggggttgaggtgtttattatggtcgttaatttaaaattcttacttggtctttttttctgtaaacattaattggtctgaaaagtgaagttgggtggagttgatgaggtggatggggtgcgtggactaggacaggggaggttcggattca

SEQ ID NO: 693411 - DNA, 113 bp, Homo sapiens
gttagagcatcacaaaaagaggtatatttacagatcccgacggctgagatagggcttacgaaggctgcgaactcccctactcgcgcgggtttttggacttgcctatcccaagt

SEQ ID NO: 693412 - DNA, 124 bp, Homo sapiens
  misc_feature (88)..(88): n is a, c, g, or t
  misc_feature (99)..(99): n is a, c, g, or t
  misc_feature (117)..(117): n is a, c, g, or t
agtgcagatgtgtagtccagctatcaggaggtgaggaggaggatgtttgagccagtagttcaagatcagactgggcagcataaggagnacccatctttncaaacaaacaaacaaacnaaaaaac

SEQ ID NO: 693413 - DNA, 1436 bp, Homo sapiens
  misc_feature (1436)..(1436): n is a, c, g, or t
tccagtaataaatatgaccttttattgggcacccgatgtggcaatacaaaatctcctgtggcaggtgggagtgtggaaaggttctcttctcttcaaattactttccattactattgttcgacccaaaggcaggactttggcagcaaggcctcacaaaccacccaaacaaattattttattggaggccccctgtgtgacttacttacagggccataggcattttggcatgggagaccatgtgggacagatgttgaagggaagtttattcctcacacctttgaatagtgtcttctcaaggggacgcttaaaaatgtgccagggtgcgattacaaacgcaaaaaccacatgtggcacaacaaccccaacgtctcacaaattaatctacatctcccggggttctttatgtgcgtcaaaggcggacacaattcttatattccaaaacgaggctaggggactgtgatcacctattaaggggattgtgggcccatttggccctatttccttttccccctctcttttctcaacttctacaaaacagaaaccattttctacagtgacagaggggcccccaactctatgtgtttgccccaaagcccacctttggggcatcacctagtgcaagtgcgtcgtgcaaaatttacagacgccaaaagaccccaaaggggtgttattcctgggggcgccccattccattttttatagcaaggcgccccgtgaggatataaggcggggggaaaagaaaccgcggacaaacatgttgcaccacccacaagtgtttaccaacagccggtttacgggccacttttgcttttcttaacttaaacacagcgtgcggccaaatctaccacgtgttggcccctcatcgttgcaccggggcgggtaaacacatgtcgacaccccacgacagcaactatgtgcttgcgcgttaggacacagatggcaacccccagcagcaggaacgagcgtcctaccgcgaaccctctgcggccttccacagcggggcacccgctgttgcgacaaggcggggcgccccccccgggtggtgaaaaaccagttttgggcgtacccacaaccagcacaaccttgtatcgcagacggaggaacaagacgaaaatcaggagggacgacacaccgcccacaccgccttctttcgctaacgactacccacagaccacaaagatcattggtcgatatggatcgacgaggacaagtcatgcgtaaacaagcacaatgccctctttgaacacacactaacggggtcccccgcagcgacgtgacaaaacgacggcggcgggcagagcggataaactagcagcagtagcgaccagaccagaacaacagatatcatcacccaacacagccttcctgtgtcaaccgcaacggcgaaatcgcaaaccaccacatctatcgtggtcagagcccccgctcgcggtcgn

SEQ ID NO: 693414 - DNA, 313 bp, Homo sapiens
cgcttatatgacagcgcagcacagagagacatgtgtggatgactctcatgtgtatggttgacaccaggcgagatactctacctctttctgtcaggaccaatattgatttgcggagccttacattacaggaactaacattactgggctctgcaggaccatgaccttgcacaggcacatatagctggaatcctcctgcactcaagttatttaacgtgctgcgttcacttaattgtgaattgcaggcatggcccatatctcaaggccttgtcggcaacatcgtgatactgcgttaacaagcagaacacctctcctt

SEQ ID NO: 693415 - DNA, 896 bp, Homo sapiens
tatatggcccgcccgtcctcttggtgcttctctccttctttggtcttccctcctccacctgtgttttccttccctccactacgtttctctatgggggcgttatccaccaagaacgaagcaaaaatcacagtggggccggttctttacatctggtgtgctcactatctctggtgttccccagacaccaccctttcctccaactgctcttcttataccgcgggggacatcttctgtttttcgccccgccgagagatgttttttttccccacgcgagattttttgtggctcctgttgtacaactccctgcgccttggtgccctcctccccccacttaattggggggggctgctgtgccccacccctacgggagttgctcccccccttgattcccctctatgggctggtccctcctcttttcaacacatacgcccgctgttttttttgctactatcgcggggtcttacatctcctccgcggctgtgccccctcttcgttgattgatgaccacgccccgctctccctatatttttgttcccgcccttgtgttgatcttaattctttttgggtgtcttttttttttcactcccctctcctccagaccctcgctcgtggggtgttttttggagtgccccttcaccctcatgttcgtgcgggttattttcggggccaaaccactttgtggtggaccacccgagcggtcttcctccgggtttctcctgctttttattgggccaaattgttctcccactaattgtgtttttcccccccccattattttctccttttaaccaccccaaacaaccctgttgtgtttgaacccccccccctatttggcctttttttaaatgtgggttttttttttttttttttttttcttttttttgggggggggttta

SEQ ID NO: 693416 - DNA, 933 bp, Homo sapiens
  misc_feature (10)..(10): n is a, c, g, or t
cattcaaatnccaattgcgctataagctctacccccacacttacacatctttgcccgaacaagcagaattttatacacaagcgctctccccaaaaattaatgatgacccccctgggcagtcgcgccactcacaaactttgcccgagactaaccctattaccccggtggtcacccaaaaccttagctctgttccccccacagatgtttccgttaaccttccccgaagagctataagatgaattgtaacaccggcaaccaacttccccgggtgaaacaaacaactctgcacccagggcggcaaaacacaagcggcttcgggaacttgacaacaatggccacgcctggcagttccccccgggatctcctccacgggggtgtttggctccccccccgtccccccttgtgtgggcattccccctgcgccccgcacaaaaaaacccgtgggcaagaccgctgttgttgtaaagagcctcggttccatttacaccacgctctttggtcaagaacacacacttcagtgcggtgcggactactttaaaactcaacaatgtagcaggggcatgaacacaagaatagatgtttttcaagagacatttttagggtatccccgcgcgatgttccttcacgccctggtgtgaactacaatcaataccgaaggggacccataaatttgtgacgcacaaaaatcttgatatgcatgtctctggtggataaaatatacgtcttgtgtggagcagggcccctcttcgcccctgctctcctccaaatgcggttctttgatatctcttagaaaccacacgtagaggaggttaataaaccgatggtagaacaaggaaaatctctttaccagcgagttattgggggcgcgtcgaatcacaccaacacgccctagcgccccccccaaaaagaacaaaaaaaaacagaccacaaaac

SEQ ID NO: 693417 - DNA, 803 bp, Homo sapiens
ccagacgccttggggccccacaacggaggggtagactatcttcccccccccggccagtacacccacagagagggggccttccacccacacacagctgagagagacacatcgcccccacgcgggggtgaacacacacgcccacccggctgtcaaactagcgagagcgatgaagcgcgggatatcacacaacaaagaaaggcccccccgcggcgctctgtctcgccacctgtggtatgacaccacacgcggaaagagaacacacgactggtatagtccacgcacaaatgtgctcatacaccccctctttgtcacacgggagttttgaataaaggaaaaggtagccaagtttcaccgcacaaaggttctgaggcgacttatcagataaaaagcgtaactctttcgtgtacacgcaatttgctgattgaaaagagagtgtgaaatttttatgtgtgtaagatgcttcccccgcactaaatacgcgtcttactacgctctcatcatatatgagtgtgcaaagagaacctcttttacagagcgtgtttcccccccagcaagggatttccggtgccaccacatacctcataaaagtgcgccggtcccacccacaggagggggatagtagccacacactgcgacccgggagaacttctgccacataggattcgcgccaagagcaataaatcatatcacccacaagattggaaggaatggaagcgaaaacacaaagaacatggtgttgggagacaaacaccgacgtacaatacaaaactgttggtggaaacccacaacagccaccccaaaac

SEQ ID NO: 693418 - DNA, 413 bp, Homo sapiens
  misc_feature (243)..(243): n is a, c, g, or t
  misc_feature (261)..(261): n is a, c, g, or t
  misc_feature (283)..(283): n is a, c, g, or t
  misc_feature (297)..(297): n is a, c, g, or t
  misc_feature (312)..(312): n is a, c, g, or t
  misc_feature (315)..(315): n is a, c, g, or t
tccgcgttatagccgcgcccagtatgaccgggtaatggaagagctttacccgcgtctgaaatcactcaccctgctggcgcgtcagtacgatattggtatcaacattgacgccgaagagtccgatcgcctggagatctccctcgatctgctggaaaaactctgtttcgagccggaactggcaggctggaacggcatcggttttgttattcaggcttatcaaaaacgctgcccgttggtgatcgnttacctgattgatctcgncacccgcagccgtcgccgtctnatgattcgcctggngaaaggcgcgtactnggntagtgaaattaagcgtgcgcagatggccgcccttgaaggttatccggtttatacccgaaggtgtataccgacggttcgtatctgccctgtccaaaaag

SEQ ID NO: 693419 - DNA, 749 bp, Homo sapiens
gctcctcagcttcaggcaccatcattgacctgggacagtgaatcgacagtgccgtcttctgtctcgtggggcatcctcctgctggctggccatgtgctgcctggctccctgtgcatcactggactgaggagtccccagggagatgactgtccagaagacagatacatgccatcatgatcatggatcatgccaattcttcaggacaagatcacccccatcctggtcgtgagttcgcacatgcagccgtagtatccgtcagctgtacactaccatgtccaacaagtgaactactatcattcgttctccccgagtgtagcatctgctacaggcttatgctatgctctccctggggaccaaggctgactctcacggatgaaatctcgtggagggtcgtgaatttgcgaacgcatcaggatattccggaggctcagatccatgaaggtttccaatggaactccatccgctacccctctaaacagtcagactagtcgatgcgtccatgctgaccgaccggtcagatggcctgtctcctcagcgagggcctgaggcttggtggataagtataggaggaggttgaaaggttgtacctaatcatgaagccttcattggtcaatctgtcggggacagcgagagtaggccaagtaaatcatgatcaagcgagtactgtggagcaagggtactcatgggaaaatgtgtggatttgggtcaagggaggttgacagaagacagaagttttatgtctggtgaat

SEQ ID NO: 693420 - DNA, 321 bp, Homo sapiens
aggagcatccatgacgtcatcaggataagcgccatggcccctgggtcacaggcttctaggtactctctgctgggcttcattccttctctttaatctctccaactatgtgcttcccattgatgaaggcttcgaagccacacacagcggccttgtcatccaaaggaaagatatatatagcctcaacgggcacgtgacttttatttgtgtatgtctgaaaaacaatggcctgggctacagtgtctatgattctccctttgatgtggacatcctccagaggaaccaagtcatgttataccggtctaacatcacttggttcctcct

SEQ ID NO: 693421 - DNA, 143 bp, Homo sapiens
ccaggccacctccaacactgaccattacaattgaacacgagatttgagtggggacacatatccaaatctcgtgttcaattgtaatggtcagtgttggaggtggggcctgggggaggcgattggatcatgagagcagtttctca

SEQ ID NO: 693422 - DNA, 778 bp, Homo sapiens
agctgggccggcgggcagtggttcgatgagcgcgcagagtccagactggcggcagggcccgaggggccgacccgcagggtccctggtctctccagccctcactcggaaccgcacgtgatgggcaaatccgccccggtggctggcttatcatcgcggggcacagcccctccgtaggcctccctagacggtgtgggcgagagggcgtccgggtcgggggaagcacggaaaggtggcttcgcgaggctgaagtggggggcgggacgggcagcctggcgatgcctggacagtggttggtgggccagaaacatttatcgaaagatagcttgcccacttagatggcagaggacactggactaagcaacgtcttctgccctgtaatgcggtggctcacagctctagtagtcctagggatgccgacggagggaggatcgcattgagtccaggaggtgggaggctgcagtgagccgtgatcgcgccaccgcagctccagtcctgggcgacagagtgagaccctatctctaaacaaaacgaaagaacgtcttcatgcactggagccattgagctggagtttggcttgtctgtcgctctctctacagggatacaggtgaacgggggcagacccctcatcatgctttccaaggcatctggccacttcccaggaactgtctcccgtgggataaacgaggcgaagtccctggcttgtgcaagaagcaagtagctgtgtgggtgggcacagtcagggataattcggggggccctgtggggatgttcttaaccc

SEQ ID NO: 693423 - DNA, 186 bp, Homo sapiens
  misc_feature (109)..(109): n is a, c, g, or t
caggatcctctttgctaggtggagtgaaggaaatctcggtcacacaactccgcttccaggttcaagcgatgcctcagcctcccgagtagctgggattacaggcatgtgncaccacacccgtgcaattttgcatttttagtaagagacagggtttcaccactgttggccggtgttggtcctcgaact

SEQ ID NO: 693424 - DNA, 193 bp, Homo sapiens
gaatttttttttggggccaaaaaccccgttgttttctttatatttaaatggggaggattgggccccaaacctaggtatgtttccaaatcctaaccaggccccttaggggttttcatttgggttttgcttatgaaatgtcatttaaagttccctttttgggccccaataaaaagggaagctggggggttttgga

SEQ ID NO: 693425 - DNA, 325 bp, Homo sapiens
tggggttttttttggggttttaagcaaggtggctcctaatggctaatgggacccataatgaaagccttgttgccgcattagggtaatgggggggggttttgcccttaaaaaagggattcaaatgctctagttggaaaggttcaagaaaatccccttttttacaaggggaagggcttttagggtttcccccggggttttacatttgcagagttttggggggtggggtgccctttgaagggatttgaaattggtttaaattggggtcctaaattttatattccctattttccctaaaggaacccttaataaaatttttttggtcaga

SEQ ID NO: 693426 - DNA, 316 bp, Homo sapiens
aaacacaatcaaagggaccttatgagcctaccttaattacaggcgatatatttggaactggtgcaagatgaatgacagcacctttgtcatccctagataaaagcccccgttccccatggtcctgtgggctgaccggatggcgctggggctgccaacgtgctgcctacaatggctctgcctgctcctgcaacagtacggcccctgcccggagagctcacgaggactagctaaaagaactgactggtggtcgaagcaccatcttcacagatgtataggggcaggcgggggatccacccaccgtcaatgaaggaggcag

SEQ ID NO: 693427 - DNA, 169 bp, Homo sapiens
ccataagcctgccacgtgctactcacgtgcacgtgcacagcccacgtacactgccttggcagcaccatccctactgacacggtctccctaggtaccctgtcagcatgtccatagaacttggccgtaatgttggaccgtaagactcctggaaaccctcgtcccgttccgc

SEQ ID NO: 693428 - DNA, 168 bp, Homo sapiens
tccctgagatggggctcccactcggttcttccaggctagagtacagtggccgatcacagctcagtgcagcctcattctcccaggctcaagcgatcctcccacgtttctgcctcctgagtacctcggactacagtgtgctagggatatcctcctagatgtcgacctgca

SEQ ID NO: 693429 - DNA, 155 bp, Homo sapiens
gactgttattggtcatgagttgatagttcttgtggcagtgagagtgagtagtagaatgtttagtgagcctagagtggctagagtgactagagtggctagagtggctagagtggctagagtgtgtagagtggctagagtggctagagtggctagag

SEQ ID NO: 693430 - DNA, 209 bp, Homo sapiens
gacacacaatggggaatccgtgtactacctagttcagccatgctcccgctaataaatccagacatgggaagtgtccagacaagcctaactctgactatctgacttgtataaagtattactggatttttaagctgataggtattcaggcaatagataaggttaatacactggacaaacagcatcagatactttgtaatatgctaaaagat

SEQ ID NO: 693431 - DNA, 258 bp, Homo sapiens
ggtcgaccgtagagataatgtttattctagagaatgaataaatattgtattccagagaaataaatatcataaagaaaaaaagaatcacaacttctggaaatgaaaaacacacttagagaaatgcagtatgcactggaattcccacaatagactagaacaaatagaagaaagaacttcagagctcaaagataaggcttacaaattaacccaatcagacaaagacagagcaaaaagaataaaaaagaaaaaaagtcgacg

SEQ ID NO: 693432 - DNA, 814 bp, Homo sapiens
  misc_feature (66)..(66): n is a, c, g, or t
  misc_feature (78)..(78): n is a, c, g, or t
  misc_feature (115)..(115): n is a, c, g, or t
  misc_feature (157)..(157): n is a, c, g, or t
  misc_feature (166)..(168): n is a, c, g, or t
  misc_feature (210)..(210): n is a, c, g, or t
  misc_feature (224)..(224): n is a, c, g, or t
  misc_feature (241)..(241): n is a, c, g, or t
  misc_feature (244)..(244): n is a, c, g, or t
  misc_feature (259)..(259): n is a, c, g, or t
  misc_feature (262)..(262): n is a, c, g, or t
  misc_feature (265)..(265): n is a, c, g, or t
  misc_feature (269)..(269): n is a, c, g, or t
  misc_feature (272)..(274): n is a, c, g, or t
  misc_feature (279)..(280): n is a, c, g, or t
  misc_feature (307)..(307): n is a, c, g, or t
  misc_feature (369)..(369): n is a, c, g, or t
  misc_feature (379)..(379): n is a, c, g, or t
  misc_feature (385)..(385): n is a, c, g, or t
  misc_feature (399)..(399): n is a, c, g, or t
  misc_feature (408)..(408): n is a, c, g, or t
  misc_feature (428)..(428): n is a, c, g, or t
  misc_feature (435)..(435): n is a, c, g, or t
  misc_feature (438)..(438): n is a, c, g, or t
  misc_feature (739)..(739): n is a, c, g, or t
  misc_feature (804)..(804): n is a, c, g, or t
cgcctgtttcgcgaccatcacgcacctcccctccgcttgtggccatgtaccgctacctgggcgaangctgttgctgtnccgggccgggcccgctgccctgggctcggcgtccgcngactcggccgcgttgctgggctgggcccggggacagcccgcngccgccccnnngccggggctggcattggccgcccggtgccactacagcgaggnggtggccgaccgcnaggacgaccccaacttnttnaagatggtggagggnttnttngatngcnnngccanntcgtggaggacaagctggtggttgacntgaggacccgggagagctaggagcagaagcggaaccgggtgcgcggcatcctgcggattatnaagccctgcnaccatnttctgagttttttntttcccatncggcgcgacgacggctcctnggaggtnatngaaggctaccgggcccagcacagccagcaccgcacgccctgcaagtaggtatccgttacagcacttatgttagtttagatgaagttaaagctttggcttctctgatgatatacaagttttcagtggttgatgtgccgtttgggggtgctaaagctggtgttaagatcaatcccaagaactatactgataatgaattggaaaagatcacaaggaggttcaccatggagctagcaaaaaagggctttattggtcctggcatttatgttccttctccagacatgagcacaggtgagcgggagangtcctggatcgctgatacctatgccagcaccatagggcactatgatattaatgcacacgcctgtnttactggtaa

SEQ ID NO: 693433 - DNA, 1625 bp, Homo sapiens
tcgctgggtcaatagctacttgaccgcagtactcttgcaaactagagcggctatggctataatacgcctcacactcattctcaacaccccgtgacaagaacacgatagccgtagacccgttcctctgtactagtccgctaatgcaggcataaattataaacacagcatccagtcatgccgtacgagcaagacagcacctacaaatcgcagtaactatgcaatacatcattcaacaatccaagaggcaaccagtagacacccctcgactagctaaaccaagcccaatatcctcagtccgaaccaccgcgcccataacacgacgtatccagcacggacgtcacactcaattcatccacaaagaatcgtcccccggacgagcacgcttaacagatcacctcacacttacagtaacttgtacatggcacagtagcgccagacaccgtcacgacacgcatacacgcacacggccatacctacgacgaagaatcagcccagtcacattacactcccatcagtacagtcacaaaggcgggacgccgtcgtccagacagagccctaccgtaaccgttcacgcgaacgttcacacgtaaggcgatacagtacatggacatgcaaccacagcgccataacggccaaacagagcaccctacggagcaatataagacaccggacggacccaatatatagaacgaccagaccaagaataacgttgcagagcggcgcataaaccttggcggtcaccgcaaaacaccgatacacacaatggactagcacgtacaggcgctgtcaaacaccaagcgggaactacacctgaaccacacatggcaagttacaagacgacgactaacttcaagcgcatacacataacagttacagcagtagcaaaggcggcaccctgaccgacaccaacctaacacttcacgagctacgccaacgcccccccctacgataagcgatacccccgtccgcacacaaccactagattcataaacaaccaaacagaagacaagcgcaaaatgagagaggacactccacgcaccacacgaccaccacccacagagcaccgtgaagaaccagcagcgcaacttacacacaaccgagccgatcacaaatccacacgcagccgacacgtgaaaacacaggacagccgaaccgcacagagagtcacaacgcacaagcaaccagcgcatagaatgatagatacgccaataaaaaccgaaccacatcacaacaacaaccacacaccacgacgaacaaccacccggcaaacacaatcgcacatgaaagacccgggcgaacgccacacccagcagcacgctcacaaacaccgacaaccaccacacgtcgaccacaaagaaagcgagtcaaagagaccacagcgtcgacccgcgatcaagcgcctacatgccacacccacgaatacaggcgcgggaccacacacaacaagacaccatacaagctcggcgtgcaccgaccaccgcacagtccatactcatgcgagacagacacaacaaacgagagagaccacactcaacataaagacccggacgaaacgacaaagctaaaaagagcaaccacgtaccacacggagcggcgcacgtcaccagcagaacacacgacagcac

SEQ ID NO: 693434 - DNA, 148 bp, Homo sapiens
tcggggttggttgaaacccctgggtggggggttgggggaggactaatggggagtcggggaatatttgggggtattttttttacttctttttggttcccagttgtgacacgttttgatcaaaggagaaccaataaagggataacccata

SEQ ID NO: 693435 - DNA, 174 bp, Homo sapiens
gatccccttgtggagggcagtgcaaggcttgcagcacctcggcgggcaggccttcgccaaaacattcgccgaggctttgctcgcgcacaaacttcaacggctgggctgatcaggcccgtgccaacgctccaccagtgctcatttaccctaccttgagcacatacaagcgcctgg

SEQ ID NO: 693436 - DNA, 216 bp, Homo sapiens
ctagcatcgctgataggcatggtggcatgcattctggaatcccagctactgggagggtggggcaggagggtcacttgaggccatgagtttgaggctgcagtgagccatgattgcaccagcggcactccagcctgggcaacagagcaagatcccatctcaaaaaaaataggtcaggccagtggctcatgcctcatcagcgatggctgggttccgagc

SEQ ID NO: 693437 - DNA, 104 bp, Homo sapiens
atccccgtacattaagctcacggcaggcccactttcctggcaccctcgactttcatataagttgcactgcgttcaagaacccacccttgaatgaatacaaggag

SEQ ID NO: 693438 - DNA, 353 bp, Homo sapiens
gctgggtccttgtgtggttaaaatgggtctctctggccaggcgcggtggctcacgcctgtaatcccagcactttgggaggccgaggcgggcggatcacgaggtcaggagtttgagaccagcctgagcaacatggtgaaaccccatctctactaaaaacactaaaattagcttggtgtgatggcgcctgccgtaatgctagctactcaggaggctgaggtaggagaattgcttgaacctagcaattctaggaggttgtggtgagccaagattgtaccaatgcactccatcctgggcgacagagcgagacctcgtctcaaaaaaaagaaaaacctttaaaagatataaagaaaaa

SEQ ID NO: 693439 - DNA, 587 bp, Homo sapiens
  misc_feature (214)..(214): n is a, c, g, or t
cttacgaggtgatgggatggtggcctgcatgcctgcataacccttgggtggctggacatcctgacgggctcttgcacctcttactccttcttcccggacaagcctatcacccagtatccacatgcggtggggacagaacaccctcctcacttgctggagcttaccaggccatggagacgaatgcgccgccgtctatctatcgagtcggcatccnctcgtacttgcttgcagccgcactccattgccttcaacatcatgtctaagtgcatgaaggtgctggcgcccacggtgtctccacacgcacgggtagttccgcatgacaaggccaatgtaattaacgtaagcttgtgagcccttctccgctgcgtggggtgttcaagggacgtgaagggctgtcctccagctgctggcgtgccatggctggtcaccaatcaaatccgcgggtgggggccagaatgacgaaggcgcccccgagcccccaaatgggccccttaccagcgtggttcccactatgaaccctaaagctaggagggtcatagcatccggtggatcgcatgcctcgctcttccaacatgggctaatggggc

SEQ ID NO: 693440 - DNA, 1806 bp, Homo sapiens
ggtgcgggcgccttccgtcccggtcccatcctcgccgcgctccagcaccctctgaagcttttgcagctgcccagaaaggaggcgaggaacggagggagctgtgtgacgcaggacgggatgcaacaacagctcacccctaaacacatttactttcaacggacgcacacaatgaacaacatgggcgcggtgctgcaacacacattgtgcttgtgggccaaacttactatgacaaaccattgacgcgatcctagacgcaagccctgctgccactttgctctgcgctgcgcgactctcatgcctccgctgctttccaaacactccattccggcccgttttccttggcttgcggcacgggccttctcgacttttgccttctccaggtggggcccccaatccaacacccgggccacgcttggttccctttaccaccttggttccgcggctttgacacatttgtatggcttgcgggactttgccccccctggctcccaccggacaacccccaacttcctaacccactatggaacccacaccaccaccttgcgggctatcccagagtctggcccccattcttggcggcctggaacgccgccaatacgttccaacgtctcgggttggcaatcccatatcggaaacgttccccctgtattgcgaagctacagtttggtgaatcaacgcaaacgcggcccacaaacgcctttcccccaaccaaccgcgggcggccacacgagcttgtgtgcacacccgttcctccatacacgttttgaaacctgaacttcccggccttggtttttacataccccccattggcatccgcccaaagcgtacagtttgtgccatcctcagacgtttccgccgccaccagcagaactccatatcttggatcgacaaagtggaaattgtgaacacggctttccccgcgattctggcctggcattatgccccctaaaacaggtttgtaccaaacattggtccccctttgtgacgccgacctaagtcttccccgcggtttggcccataatgccgccgcttgggcgcgcgagcgcaagctttctggcccccctgttgtcccagcacactggccgctttacgcacacggccacaaattccctcgataccgatctttccacacgccaactgccaacagccagcgcactttggcccttcgggtgaagagtcaggtggttcattttcgccctaggttgtggtctgcccccctggctcttgctgctcgccccccccttttggtcgtccgcgttgtctaaacccccgggttctttggctatcgcttggtgtgcagcccccggccccatcgtttgcgctctgcgcgcttgggtgcagccgctctgggctgccacccccctttgtccctgcccttcttttgcgctctccccctatgctgtggtacagacatctgacaacgctttaaacgccccagagtcgtcgggctcatacccagctcttcgcgaccactcacgtttgggcctcgaccaccccttttctccctactccgactttcgctatccgccgcctgacagtgtaaactccgctcccgtccacgtctgaagtggcccacttcgtgacgcctggttctcctccggtcttttttccgcctctcaccgtcgcacgtctcgttggcgttcccaccctgtgggttcccccgtttgtctcccccgcttttctccgcactttcgtcgatgctcacgtccagtgtcggcgggtcccgtgtgcctttgcgtccgccccctaggtctccagcaggtctctgtcctgcttgtaaccccccttgtttcttcgttacgtcgg

SEQ ID NO: 693441 - DNA, 1334 bp, Homo sapiens
  misc_feature (277)..(277): n is a, c, g, or t
  misc_feature (657)..(657): n is a, c, g, or t
gatagtgtggtgggggtcaacgcatagattttatgctgaagggggaggtcgcatgagggagggagaactgcatagtcatggtgaacttgtcttttggaagatgatacagagttgatgtactaattagtatacttaaatgtatgttagatatggtattatagatgacttcttggtgctagcgtaagatgtctattagatccgtttgtactattcattaggctaaatgatttcatagtacgaaaaagagtgagtgaaagactgtatatttgtatgtagntcactcgatgggaagggtacataggactttaaggggtttgcatcaacatgaacaatgtttgggaagaggtttgaagtaatggaatgctagcgtttcgagtagaggatgatcatatagatagtggtgtttgtgttatcgcaaaaaatttgagggcatcaggaggtaattacggtagtcctagtaacttgagtaactgcagtatttaggataggggacaaaatgagtgtagcagaatttagacaatgtgaaggtggaactgtataggagtactttaacgatgtatcaggttttactgatggtgagtcatgggatttattgtaagaaaatacatttgactgtaagggtcgcaagcgtattagagataaggaaggtgtttgaanaacccgcaaggggtgcactttgctttcattgacctcttgtggaattaatttcggcattggactcgggtccagtgcccaagaaacgttaggtcgctcgatttttaccattggcccatagcgttggaaaacgagccttttttcacactataaactccgctaggtacgcgaggagctatgtgctttcaaaggacatgaaaattcggggggaaggggcggttacggagatatgatggtccacattgttgggtgaaggcatggaaattacgctaaaggtttccacagggtgattgtgttaccacaatctgggggagagttagtatcacagtaaggagttagcgggggaacacggttgaatacaaggaaaagaatttttagcagagacagtcaattttggggaacacacttaggggagacgtatttaggagtccgtgttcctttattgaagtaattgcattcgcaacaaggattagttttttaaaacttgttgggagaatagttttagggaaggcaagagggtaataacaagagatcctacgttttgtgtgggaagcaacatacggtataaagtgggggaccaacaggtgtgtttgtaactccttatagggataggagaaatttgggagaggaggtggaaactcacatgagatttatatatcgtgtgtacttatatggtccag

SEQ ID NO: 693442 - DNA, 420 bp, Homo sapiens
  misc_feature (97)..(97): n is a, c, g, or t
gatgagcgcgcgacgggcgggttgatatccgaacgtcgaaaagcgtcacgagggcggaactccgagctgcatggctcgatcacgcatgcgcgtcgcngattccctagcgcggtcgagatcgtcctggttgggccgtcccttgttcacgccaccgaacaagccgagcggccccacagtgtcgagtccacgacatgagaacgatccgaggacggcgaatccattcgactcaagccggcgccggatacgtccgctataaccgagcagcggcagctccgggccgccgctggtgaagaacgtgaaaacgggtcggccatgtccgggaggaagctcgtagatcagcttctgcaaccgtggatgcggggccaggtaatagacacccgacccaaagcagaccaggtcgtagtcaccgatcgtgtagac

SEQ ID NO: 693443 - DNA, 152 bp, Homo sapiens
acatttactactgtaacaaagaaagatatccctcattccaatctagagtagtaatatcctaccatgtgcattgtagagcccattcatgtacaggtctcctcactaagccatactcaacctattattacctctttcctattttcaacctctca

SEQ ID NO: 693444 - DNA, 268 bp, Homo sapiens
  misc_feature (15)..(15): n is a, c, g, or t
  misc_feature (17)..(17): n is a, c, g, or t
  misc_feature (24)..(24): n is a, c, g, or t
  misc_feature (28)..(28): n is a, c, g, or t
  misc_feature (39)..(40): n is a, c, g, or t
  misc_feature (68)..(68): n is a, c, g, or t
  misc_feature (72)..(72): n is a, c, g, or t
  misc_feature (109)..(109): n is a, c, g, or t
  misc_feature (116)..(116): n is a, c, g, or t
  misc_feature (170)..(170): n is a, c, g, or t
  misc_feature (214)..(214): n is a, c, g, or t
  misc_feature (221)..(222): n is a, c, g, or t
  misc_feature (240)..(240): n is a, c, g, or t
aacgaggccatctcnanccacggnagtnattaaccgctnnttatgagccatgcctcatgccagggaangtanacattcagatgtgctgcttgaagctttgcccattggnatgacantgtcctgaggtggtacaccctaaggttacccccatgagtcatgcccttgtttangcccatctgcttgagtgtgagtaaaacctgtgattttctcttancccatannatatggtaaaagtggtangatgccactaacatgatacattatgttg

SEQ ID NO: 693445 - DNA, 1058 bp, Homo sapiens
aattaaatcttttactttatactcacttaaaatcaagaatcccatctaaaacacataggtaccttatctgaaactcttgcacttccccaaccaggcagaaatgaggtgggagaagtttgactaaaatgagggatgggggaaagtaaaagatgtttttttttttttggaaactcgctttgtcacccaggctggagttgcaatgggcacaatctcaacttcaccgaaaccttccgcctcccgggtttcaagcgattctccgtgccttaagcctcccgagttagtggggattacaggcgcctgcctccaatgcctgggcataatttggtattttaagtagagacgagggttccctccagtgtgggcccaggcgggtcctcaaacttccttaaccctcggtgaatccgccgtgccttcgaaccttcccaagaggggcggggattacgagcgcatgagccaccaatgcccagccaagagatccattttttcaatatagattttcagccctttggtaaactcttggtaccgggggagcgtatagagtagaacaaaacaccgtattagtctaacaccattttggtctctacaaatttaccctttaaaaactctttacataccggctaaacaatagaggggcgtgttaccccttaaggaaccaattaggggcccctttgtggaacactgcagatccttgtgcgcctaaaataaacgtctgaactgggaatataagtgtgtctccccaatttaacggcttgtccacacgcgactgcgactaagcggcagaaaacagttttttacccaggacaccttttcacacgtaccgtacagtgcggtgatccaaccccgtgtgatcactcctcacaaattttacaaaatttttcattgtcttggttacacgaaggcttaaccatatttcgagggcggggatccatttaatacaggcggccacacttttcaaattcccacgaaatgtggacagtgtttatactctccaccgggacacaacgattttcgggaaccacgactcccgcaaatctccctacacatatatgtcttcacag

SEQ ID NO: 693446 - DNA, 501 bp, Homo sapiens
gagggaccacagtcagcgtgaagcagttattttctacactacctgtgcgccataaggaatttcaaaggaatattaagaagacgtgcctgtttccccttcgccttctgccgtgattgtcagtttcctgaggcctccccagccatgcttcctgtacagcctgcagaactgatggccgtataagaaaataaacaacttgctaaaactgctgaaactccctctgcttgtgagatttaaaaaaactggctgaaattggttggaaccaacatgtccaatggagtctgaatagaaagagcttgctgacatcacagcccgaatttccaccacatttcatactaactccccctgaatttgcatatgcaaaccacaagcaagcatgatcaaacagacaactgcgcgtgtccgaggactttccagatctcccctttccttccaccaatcacttactaatctgagaatccatcccctaataaaatcactaccttaaagcctgcacaggaagac

SEQ ID NO: 693447 - DNA, 1322 bp, Homo sapiens
  misc_feature (800)..(800): n is a, c, g, or t
  misc_feature (823)..(823): n is a, c, g, or t
aacctcttctgagatagggagtctccccccccacaagagtgtttggcaccccccaagaaatatctccccagggcctttttggtggtaaaaaactggttccttgcgtccccacacgtttgtactcttaatattgtaacccgggggttccccctctataaaagggtttatatcctgaaaggggcccctctttgggtgttgtgtgtgccgaacaaattttccggggggccaccccgagaaagggggtttttttctcccctttggcgtcccccggggggtggtcccctcccactagggggggccccccttatttggccacagccccacaattgggtgcgccccccccccccccctcgtggaatattggcgccacaatagggttctcctttttgaaaggcgcctcccacaccgttgtgcgcccaccccacaacagagagacctttgggcgaaaaccgtgggcgcggccctgttggggcaccaaccgtggggggtttaaaacacccaagcccccgggcgcccccgttaaaagaagttcctcccgccaaggagaccgtgataatgggcgccccccgggcacaaaagcgccaccaaagggcggccgcccccgcgaagatctggcaccactcctggcggtgcgcccctcgcgcgattctcggggggttctcccacaatctccgggcgcacacaatctctggggcggcgcctttgcgcccccccacacgggtttctcgggtgatcccacccccccgcgagaagggtggcgtcgcgcgcccggcgctcccacgggcgttttctacaccccntgggagaggagagcctcacaggngtgggcccgcgcacattcacacccacagagaagagtgtgccccgggagaccacatctgcgcacatgtttctctgttggagatcccgagaggagaggccggggacacacagtctcacccggaggtctccctgcacaggcccaaccgtgcaagccggctgaaaaggaggtatctcccgtctccaactctaatctcttgttctccccaggaagcccctctggcgcccccacagagaagggagagaccacagtttttgtctgagaagaactgtagaaactggccacacccacagctgagccggagcccggtcacatgcccgctcccgggaacgttctaataaagaaaggagagaaaagctcgagagtcacatcacctgagaggagaagaagaaaggaaatttccaaagccttcgctagtttccctatggcccctgcccacgcctcggcttttcggcatacgggcccaaaagagcccagggagcccccaggaccggatgttgta

SEQ ID NO: 693448 - DNA, 177 bp, Homo sapiens
  misc_feature (1)..(1): n is a, c, g, or t
nttctggcttgcactatagcgatgagaaatggtgtatgtacagtatgtcctagtactgtctgtcttctctaataccgtatcacaaggaagaatcactatcagcatattgtcacattatctgtaaagttgctacagaagtacctggccgaacatgtcatgactatcataaataatcta

SEQ ID NO: 693449 - DNA, 1074 bp, Homo sapiens
gaagacactgtggagtgccagttctggagctattgcagcctcggttgccctggccggggaccctgagccgaaaagttatcgtcagaatgtcgtggcaaagaccgaattgaaatctttccctcgcgaatggcacagaccatcatgaaggctcgtttaaagggagcacagacaggtcgaaacctcctgaagaaaaaatctgatgccttaactcttcgatttcgacagatcctcaacagaagcatcaatcagagactcaacacatgttcgatgggcgcaagtgcatgagcagaagctgcctttatcactagctgcaagccgaaagttcaacagccaggtgcacttcgagccactacagttatccaaaatgtccataacgcgcaagtgacacgattcgagcgcaagacagataatgtagcaaggtgttactttgccagtatttgaccattaccatgaaggaactgaacagttatgaactggactggtttacgccagacggtggggaacagttggctcaattacacgacggccttatgccaaagccagtggaactactggatggaactacgcttctctgccgaccttctcaggtcactttggatgcacgctaataaagaatcacacaacagggcgatggtacattgcccattgcaaccattgtcctccattcccccgggattctcaccgttactcttggcgttctactcattcaagcagctgcagcaaagacaaccgaagcagagtctaacgtaaagaaacaccagaccagacaagatcaaacgaacaaccggcccaggccagcagcacgcgaacacagtgaaaagctcgggcacgacaaaactacaggatggacgaaaaggccagcgcaacgctagtgcacacaagcacgggaccggccataacagcaccaccacgggacatgaccgacagagaggccgaacacggacccacaacgccgcactagcggcaacgacaaaaatagccagcagtgaccacacactacacagatcacacagctaaaaagagactagcacggcgaatcagcgacctacctcgctaccttggccgcccccacac

SEQ ID NO: 693450 - DNA, 312 bp, Homo sapiens
aagtgtacttagacagttaaacaccccaataaatgtaataaacattcctatgcaaattatacccatcctaatagtagcagcactgggcccaggtggacaaaatctgctctgtgtgcatgtatcagagtgggcaccagcgctgatgacctgtgtgtaataaacaatgactatatgggctccgtgtactagtaatgcagtgtgggtccaggtaaccctggacagtcatacagagggaacatgagttcgtaggatgctacaggacctctactgaagaagtaagatatagctgcactatccctgctaactttagta

SEQ ID NO: 693451 - DNA, 309 bp, Homo sapiens
atccagagaagggtccttacaccaggaactcactgtcttacaaaaaagcacaacaggaaagcgttctgggcacttagcaagcagaatagcgcggatacctgggtggaggcagggaccaacatgtacttgcaaacaacaggagtgtgggggccttactaccccaggtctcggtccttttgccggaagaaagggaggggtctcgtccgtctgtgggcgaggcctggagccacaaacccgatcactggtactgaatcaccccgcggagaagaaaagaaggcggatcctgccagacctgtaggcggggtttgg

SEQ ID NO: 693452 - DNA, 514 bp, Homo sapiens
gctgctgagtaaatctatactactatcaaatagaggtgaatgcaattactaatgtaactacgaagtctgatttctatatgtcagtcaggttaatcgtaataggctaccagtgtagtaattgacaacatattgattttagaatgtaataaaatttattctatatttagaaaatgaacaagtagaaaagccaagaattctgtgggctctttacttcaatatgagagattcgtcagacatcagcaggagctgttataatgatttaccatccaacgtttatgtctgctctggcccagattgtggtttaggaaatgataatgcagtcaaacaggctgaaacacttttccaggaaatctgccccaatgaagatttctgtccccctccaccaaatcctgaagacattatccttgatggagacagtttacagccagaggcttcagaatccagtgccataccagaggctaactcggagactttcaaggaaagcacaaaccttggaaacctagaggagtctctg

SEQ ID NO: 693453 - DNA, 820 bp, Homo sapiens
  misc_feature (374)..(374): n is a, c, g, or t
  misc_feature (405)..(405): n is a, c, g, or t
ctcccaagtagctgggattacaggcacacgccaccacccgccccctcctaatttttgtgtgtgtgtttttttaatagacacggggtttcaccatgttggccaggctgatctcaaactcctgacctcaagtgatttgcctccctcggcctcccaaagtgatgagattacaggcgtgagccaccacacccggcctcttcttcctctttttatgtacttatgtgaggcatgatttctctgtacaccctctatcctgagagacatcccatgtgactgagaagatgcctacttagtggttggctgtgtctctctgggcctcatgaagcactaatgtcaccttgccttgctttcctgccttccctgcctttttccccctntttcatcatctccatgtctcccaaataaagnattagcacaaatccttgcctcagattttgttttctaggaaacttggcctaagaccattatttatgaattccaccttgtgacggcaaaggagacattaaaagtactgcttatagaaggggtgtttgggcctgataagttgagaaacaatggacacatataatatgcttgtacatgtattaaaatgtctggaaggatacatttaaaaaatgtaaaaaggcttcttactatcagttactgctgagaaatgggactagggatgatgggtatgaccttaatacccttctagattacatgaacttcttaaatgtgcatttcaaaattcccttttaaaaaaggttctttttttatggctaatgttctgatatggtgaataatatatttagcctgtctataaaatcctgaataatagaactat

SEQ ID NO: 693454 - DNA, 250 bp, Homo sapiens
cgctctagaggacccctcgaaaggaggtagggccggggcgggggaagagggaagggctcatgggacaagggcaaagaagaaagtaactaaaagccttcctttcacagtttcgggcatcactaccagtactgattaaacaagaataagagcacattttatcatcatcggctttatccacataaatgaggtggggatgaataagtctgcttttatgcagacacagggaatgagggggctccgtcatggtcct

SEQ ID NO: 693455 - DNA, 634 bp, Homo sapiens
gagcggggagtaaagtgaatggagaaaggtgagatgttgatcaaagggtacaaacttccgttagaagaaataagtgttagtgacctattacatagaatggtgactataataaataataatgaactgtatgtttcaaaatgctaaatgagcagattttaaatgttttaccacaaaatactgagaaatacgtgagctgatggatgtgttaattagcttgatttaatcattccataatgtaaacatataccaaaacatcacattgcaccaggcaggtggctcacacctgtaatcctagcactttgagaggccaaggcaggcagatgcttgaacccaaaagttcgagaccagcctgggcaacacagtgagaccccatatctaacaaaaaaaaaaaaaaaaaaaaaaaaaaaaattttgtggtggggcgccgggccttcgggcgcccttgaagaaagcgtttcttaggacacttcggtgtgtgggcggcgggggcgccaaattaggtgtagtgtaacctgggcgcacacaggtgtcgccaagggagaacccggggcaatgagaacaggtgcgtggggttccctacccaaataaaaaaacggccggggggcgccagaggtgtgtcttggacaatacaaat

SEQ ID NO: 693456 - DNA, 1471 bp, Homo sapiens
  misc_feature (240)..(240): n is a, c, g, or t
  misc_feature (852)..(852): n is a, c, g, or t
ggactatacagagagaaaccctcatgctcaggaggtgtgcatgtacctaatgccggagcgggataggaggcgggccggcacccccttctgacctccagttgcctggctggcctccacgatcagacattgggcacatgaacattgaatgagaccttgtggccggcgacggggtaggtcctgagcagtggctccctgggtgcgacattggtgcactgagcctctgaaaagacatgttttgcntgctgaggccagtggcgccagataggactacagagttgtagtcgctgaagtcatagtggtatcaacgcggatgtcatacgtgtctggagacaaccaagcatggcgcaattctatacatatcaagattcgggggattccaggctgagaacgctgcaaggccaagtgtacccacgctaaattcacattgtgagcccgacagtgagacccatttgcatacatatcaaagcgtaattcgcccgtttgggtattcccaagggtgagcacccgattgtattgctagttgactatttcctgggtgcccgatgaaactccttcggtagaacccattcttccgcttacgccccattaacgagcggctttctctagataggaaggcgctagcgcaggaagtagcgatcggaaacttatacttccccacttgccgagagagttagatatggattccatcggaagctcccgaaaaagtcgtcctttccaaaggagaatggacggtcttccgcgttaagcacctacttggttaaacccgaataaactgaccgcgtaaagtggcgggccttttggaggaagctttaaccgagaaggtgcaaaagcaggaggacttagataaagacnccaagtacaccagttataggattaccaaaaccggacaggcggttagtcgttcccaatgagaaggattggaatcagggcttcaggaggccgcccagtcacgtgttcttgccaagaagttcgggccgccgacttcggaccgcatcggcccgttttggacactcttcgagcccggcaacgagcacggcgtggcccccccgaacggtggggattaatttccagccgctgttagcgtgtctacgggaagtctcccccacgacctgccaggggtgtgggcacacgaccggtttggacaacctatcacggcactggcacagggcgaggcccccaagaacgcggtcaccccttctaccgatagggacacgtttccacttacgccatttggggaaatttggcagcttagcatgggggcgccaatttcgacacacaaggctaagggcccttatgaaactgcctttctattacaggggccccgcggaagcgcaagggcataatcccgaccaaggagccgtttcgctcattgggcttcagtcaaacacaggcgcgcaaatcagtcatacgcaagcacagcgattgggcgccaccccccacaagacacccaacggtcaacggggcgacccca

SEQ ID NO: 693457 - DNA, 223 bp, Homo sapiens
ggagaaggcttcttcggtacccacagaggaggcacttcttggtcagtttcccaggttagaagagtaatttttctttagagcattcctaataaaggcattgaggcatagcatgctcactagaatgaaacagaggtcttttcggttgcagattattggtagagatgtgatgaactcttatttatttatattatatggagacggagactcactctttttggtccac

SEQ ID NO: 693458 - DNA, 373 bp, Homo sapiens
tcacgagtgagatctataattttatatatgttgggatctataatatttcatgggaagttaaatagttgacaaagtatgtatttgctgtgtgtcgtgtaaatattggtattttaaaataaaaactgtgtacattactattttaaacatattcacggcaatttaaatatcacaacaatttgacacccttcattcatttatataaatgagctaggtctttagtaggtaaacatttcaaattggcttttctccttctggatttccataccacttttcaggccagaattctatcataatgtgatctattatgcccgacatcttttaatcattcaccccattactctttgtgaactactcagtccagaacctattttgt

SEQ ID NO: 693459 - DNA, 110 bp, Homo sapiens
gcactgtcttcacagagctcaatgatgagaaggtgctgcaggagctagacatgagtaattttgaggaccagttaaggaccaagtccaagggcccaagcctggacctagcg

SEQ ID NO: 693460 - DNA, 394 bp, Homo sapiens
  misc_feature (134)..(135): n is a, c, g, or t
  misc_feature (371)..(371): n is a, c, g, or t
  misc_feature (377)..(377): n is a, c, g, or t
ctttttttttgaggcggagtctcactctgtcacccaggctggagtgcagtggcacggtctcggctcactgcaacctcaacctcccaggttcaagcaattctcctccctcagcctcctgagtagctgggactacnngcatgcgccaccacgcctggctaattttttgtatttttagtagagatggggtttcaccagttggccaggctggtctcgaactcctgacctcaggtgatctacctgccttggcctcccaaagtgctgggattacaggtgtgagccaccgcgcccagccaaagcccttccttttctcaggtccccccaggcccatcccgtgcgtgtgttcagtagggagaaggcacaggtggtcgacngccgcngaatttagtagtagtag

SEQ ID NO: 693461 - DNA, 843 bp, Homo sapiens
  misc_feature (1)..(1): n is a, c, g, or t
  misc_feature (108)..(109): n is a, c, g, or t
  misc_feature (167)..(168): n is a, c, g, or t
  misc_feature (170)..(170): n is a, c, g, or t
  misc_feature (177)..(177): n is a, c, g, or t
  misc_feature (181)..(181): n is a, c, g, or t
  misc_feature (185)..(185): n is a, c, g, or t
  misc_feature (188)..(190): n is a, c, g, or t
  misc_feature (194)..(194): n is a, c, g, or t
  misc_feature (205)..(205): n is a, c, g, or t
  misc_feature (209)..(209): n is a, c, g, or t
  misc_feature (215)..(215): n is a, c, g, or t
  misc_feature (245)..(245): n is a, c, g, or t
  misc_feature (263)..(263): n is a, c, g, or t
  misc_feature (278)..(278): n is a, c, g, or t
  misc_feature (284)..(284): n is a, c, g, or t
  misc_feature (287)..(288): n is a, c, g, or t
  misc_feature (291)..(292): n is a, c, g, or t
  misc_feature (302)..(302): n is a, c, g, or t
  misc_feature (305)..(305): n is a, c, g, or t
  misc_feature (310)..(310): n is a, c, g, or t
  misc_feature (312)..(314): n is a, c, g, or t
  misc_feature (317)..(317): n is a, c, g, or t
  misc_feature (320)..(320): n is a, c, g, or t
  misc_feature (322)..(323): n is a, c, g, or t
  misc_feature (327)..(327): n is a, c, g, or t
  misc_feature (340)..(340): n is a, c, g, or t
  misc_feature (343)..(343): n is a, c, g, or t
  misc_feature (348)..(349): n is a, c, g, or t
  misc_feature (367)..(367): n is a, c, g, or t
  misc_feature (375)..(375): n is a, c, g, or t
  misc_feature (380)..(381): n is a, c, g, or t
  misc_feature (386)..(386): n is a, c, g, or t
  misc_feature (395)..(395): n is a, c, g, or t
  misc_feature (403)..(403): n is a, c, g, or t
  misc_feature (411)..(411): n is a, c, g, or t
  misc_feature (413)..(413): n is a, c, g, or t
  misc_feature (417)..(417): n is a, c, g, or t
  misc_feature (423)..(423): n is a, c, g, or t
  misc_feature (433)..(433): n is a, c, g, or t
  misc_feature (436)..(436): n is a, c, g, or t
  misc_feature (458)..(458): n is a, c, g, or t
  misc_feature (460)..(460): n is a, c, g, or t
  misc_feature (466)..(466): n is a, c, g, or t
  misc_feature (635)..(635): n is a, c, g, or t
  misc_feature (642)..(642): n is a, c, g, or t
  misc_feature (704)..(704): n is a, c, g, or t
  misc_feature (726)..(726): n is a, c, g, or t
  misc_feature (759)..(759): n is a, c, g, or t
  misc_feature (806)..(806): n is a, c, g, or t
ncccataggcctggggctgttgagacgggagatgtccccactgtgctgcacctggttttgtctcctctccaatccttgagcaccctgatatgcaacatggggggtaannagaaggaggaggcagcctctgatggggcaacggctgagggtgggggcagtgtgtaagnnanctttagngggnagcncannnaaantccatcgccanaaanaatgcnaaagtgtagactgaatgaaattctgtaggnaaatggtaaatggtagcngggccagtagctaantgcaanggnngannaaaaaaagtnaanggaanannntanctnannaaanggaaaaaaggaanatnttggnnaaggtcatcctgccagtnaagaaaanaaaanntaaanggaacaaanaatcaaantggctgtngngganaatcancgcctgggtnttnttatgtcaagacactgagaggncnccatcngcagtggccaagggctgcaggttctgccatgctgggcattgataggtaggacgagagagagcacgtagggccagtcctctgggaagcaggaggtgggccatgtgaatgggagatgggtggctgtgctgtccaggcatctgctgacaacattgggtggatagggccttgngagaganacgtctataggcctggagacagcagggcgttggcgggagaggcaggctgataccaagcgggnactcactgctagcccccagatncagcccgagaggaggaggctggcgggttagggnaggcccaacctatctcacccctgtgatgggttggcctctgagcacangaatgatggtgactatctgagggcacaaggcaggaaa

SEQ ID NO: 693462 - DNA, 293 bp, Homo sapiens
ccaagaggtttcggttgttcctttccaccagggccggcgggggcttgtgtgggacctcgctacctcttaactggttagacatgtgtgtactcaactaacagagttgaacctttctttttacagagcagttttgaaacactctttttgtagaatcttcgaggggatatcttggatacatttcaggatttcgttggaaacgggaatatcttcatataaaatctcgacagaagcattctcagttagacttctcagccttggggactgtgagccaaataaacttgtgttcatcatac

SEQ ID NO: 693463 - DNA, 1809 bp, Homo sapiens
taagaaatagggttttgctctgtcacacagactggaatgaagtagtgcagcctcaaactgttgggctcaagtaatcccccaacctcagcgtccccagtagctgggattacaagcatgtgccactacacccaattaattttttttttttttttgagactgagtctcactgtcaccaggctggagtgcagtggcatggtcttggctcactgaacctgcacctcccaggttcaagggattcccctgcctcagcctcctgaatagctgggattacaggcatgcgccaccacgcccagctaattttgtatttctagtagagacggggtgtctccgtgttggtcaggctggtctcgaactctcaacctcaggtcatccgcctgcctcggcctcccaaagtgctgggattacaggcgtgagccagggcccccggccgtatatataacatcttaagcacatttaatttgtctttaatttgcatttaactttttgtcccttgagaaataacaaacaaaatgatgataaaagttgttaaaactctggctgtatccccactgatttcgagggacatcctcctgttatccaggggagtctaattgtacagtctgttgagcccgggcaagtctgtgcttgagagaaactccccagacgactgcctgcctgtaagagacagtgaggaaacgcaaggcaggagacacattttcttcagttttatctgcgtaagcctgaagctttatgcattgaaatacagccagatatattcataatcatctcttagagcttggccatcccagtatcttcagttctgtgaccctgacagggaaggtcattggtgcagcccttccaagcaaatgcagttaaatttaacagaattttttttttcaatatgccagacacagtggtaaacgtgtaatataaagattgctctgacactcgtttgaatctgaacgactaccaggaaccttccttcttattatccaaagcctttctcttgcaattcactctttcttagcttttataataagggttgactacttgaaaatatggttcaattgtccttaccagcactataagcaattttagtttctcactagttttcatttgcttttcattttttgcaatgaaacccatcacagtctattgacctactacaattattaagtctattttatttgtgattatagtttgtgaaaatacaattaattactcatattatcaatgagagtacaatgtagcataatttccaccacacgttgttaatttaccaaactacttaaatctgatttacggatttttttctcgatagtagtttagatgccgtggtactttcaagatgatgagagaatcatgaacagagaagttcctttcaagtgaaaaatgcagctgtcgcagaatctctagtgtatccaggttagaatatttaaaactatgtattcatattagagagacatcatgggatatgataagcagaaaagagagacactaattgtgaatagataaaaggattcacatatgtcttaaaactttcaaataaaatatgcagagtgagtttttaaaacgtttttcctgtttatcccttgtttaatgttccgttttagttctaagtctatcctacaactaataacagatatgaaaagacttggaatgattgtctctgtgttctttgtgccataatttaaagtggccagaagcaagcaagtggaataaacaggacaattgcagagtttatggaggattaggccaattgcaggcttccacacttagggaggagaaaacatcctcatgaatatgagattggaagtgtctagctgtgag

SEQ ID NO: 693464 - DNA, 1368 bp, Homo sapiens
accacgcgtcgggcaggccattggagctgggcacagctgggagagttctgtacactcctcgccacatcctggttctgtgtgctccaagtgccatcaaggccctgagggacctcagactcccccaccccctggcttctggagccatccccagatgactagtctcctcagtaaggcaggagggaacctctaagaaaaagctggtcaacaggtgcatggcgtgggatggcaagagtgagagaccggccctgagatcctgcgacttgccaacacactgatgctgatgggctggctggcccatcagacactcggtgcccagaggagtggctaatggacctacagcacatgtgcacaggtgccttgaaagcagcccatcctgacatacacggctgaggagcacagaggacacgccgggcccctggcacctactggcgctccagcaaccccacaagcgcccgcagctcaccacaacccacggctgaacacagcaccagacacctgcatcccccaacgcactcctccagagcccaaggcaaccggatccatgtccgctttgcacacgggcagcaccaaccgcactgtcctatgcgccacccctcaaaaggtccacacgcggccagcaccgcatgttgagcaccacaatcctagaccccacaacaacagaacactaacccccttgctcacaaaccggagcacccacctctcccccgcacccttaggcacactcccaccagacacaaacccgctacaactcccactcaccagtcccaaatcctcaccccacataacccccactcaccagtgctaatacaaacacctcctcatctcacaaagccacaccaaccccacacacactcatctgcccaccaatccacacaccacatcctcctaccggatacccaacctcttaacaataccctaccctctccgtatcactcaaaccactgaccaacacacccaccataaccaccaaccaactcaacaatcccccctacttcactaacacaacacactcaccttcgtaaccatcccctgtcacaaacccacatcccagcgacactactcaactcacatactactacaaaacacaacaaatactcctcacgacccccccactacaaccttaatcaactacaccacccccctcaccagaccacagacccccgcacgcgccgcagagagcagacatacgcggcgacgtacagaaaccacacgaaccacgcccgcagcacgaagcgcaaccagatagaagcagcaggcagacacaatgagcggacagctgcccaaaccagcacgacgcgacacaccagccaaggactcacctagaaccggcggccagacaaacgacgctcatcaccggccaacgacact

SEQ ID NO: 693465 - DNA, 531 bp, Homo sapiens
accccccgcaccactgcaacctctacctcccagcttcaagcgattgttttgcctcagctttcgaaatagctgtgactacgggtgtgcaccactatgcccaactttcctatttttagtagagatgaggtttcatcatattagccaggctagtctcgaactcctgacctcaggtgatctgccagcctcggcctcccaaagtgctgggattacaggcgtgagccactgcgcccagccctattctttcaatttctttgttttcttttgagacggagccttgctctgtcgcccaggctggagtgcaatggcacggtcttggctcgctgcaacctcctcctcccaggttcaagcgattctcctgcctcagtctcctaagtactacaggtgggctcctccacacccagctaatttttgtattttcggtagaaacagggcttcaccatgttggtcaagctggtgtcaaacccctgatcttgtgatccgccgccttggcctcccaaagtgctcaaattacagatgtgagccaccgcaccc

SEQ ID NO: 693466 - DNA, 142 bp, Homo sapiens
gggggggccccggtcccccccctgccccctggttcccccttggtccccgggggtttttcccttttttgggggggtttttttttttggggggcctgggcccccccctcaggtttttggcccccccctttttccggccccccca

SEQ ID NO: 693467 - DNA, 845 bp, Homo sapiens
  misc_feature (320)..(320): n is a, c, g, or t
atgcgctgcatatcgtcacctggcggctgctattaagtgtgcgactttgttgatgctgctagctagatgggacgtgatcgatcatcctgcatgattccgaggatcctgcagattcaacagtaaaagacgttatagtaggatatacatcgccttatagttggacggtagatctactagtggagtgctcccgccaatcataggctgaacatatcgagagatagtaactagatgccagtggagccctctagtagcgatgagatagcgtaagagaagtcaggaatcctgcgcgaaaaccgtgtgtgtcgtcacattccaagtcnccagaggcacgtctagagaactgtggagtgagatcatatccctagcatgagtctgcacaggttgctacacagatatcgaataggtgctcgatcaataggtactatacttgacaagaaccaaataaagcgtacttgtgcacttaccactgtgtccaatgtccaagacaaactggcagggttacacaggtcgtggtacgactgcgtagccttaacttctctcacactacccgggcgtggagcgtatcactgggttccacccaggaataagcgcgtagaaagggggcgcagccggatgcgttcaacgatgtcattggagcaacaaaggccctggcagctgggtcggaccagccctcctagtgttggactatggagacctccttagagattccaagtgccacaaggtgtgacaaggaaccgcagttgcaggacacccgattggagactgaacaaatccggggttgtcctgaggaggacaacacagaatggactgtatcacactggcagatggcaatcttgactgatgtc

SEQ ID NO: 693468 - DNA, 116 bp, Homo sapiens
tcgatctaacgatcccgtcgagtctgggtagaggctggattggaggggatcatgctagttgtgcttggacatgtgagctccagccttggcttcacgctgtcgatctcacttggtgt

SEQ ID NO: 693469 - DNA, 734 bp, Homo sapiens
  misc_feature (10)..(10): n is a, c, g, or t
  misc_feature (20)..(20): n is a, c, g, or t
  misc_feature (87)..(87): n is a, c, g, or t
  misc_feature (114)..(114): n is a, c, g, or t
  misc_feature (119)..(121): n is a, c, g, or t
  misc_feature (127)..(127): n is a, c, g, or t
  misc_feature (471)..(471): n is a, c, g, or t
tctgggcttnaacatttatnacaaagataaaagcagaggctggtgagtaacacttcttcctccccaccaggtgctctctgcagctcnggaaaaagggtgtcctcttggtggtcncccannngggtgncgccaccttccagccccgccccagccatcatacccagtttcttcagtctcgtgccagcggttaacgtgaagccttcccagaaactccgtggactccggggccccatagttacccatctttctcccaggtgacccgaggagtctccgtgccatcacagtatcgcccgtgacacctgtgtataaccgtgacaagccgtgtagaggttcgtatcacatataagaccagacaatcagctgaaagaggtggtctttcgagaataagaggggatatctgacaagcaaggtgcggtgggtgcaaccatgttgtttctccccaacactgtggagagacccatcagagtgtgngcgcgcacaagtggcacataaccacaatctatatatggacacaagcgtgtcacctcacacaagacaagccattcaagaaaggacacaacccacattcccaaggccatgtgggccccctttgggtctcttgcacccttgatgagtcgcttaggtcccaggggcttggggtacacgagatgtcgtgccagacgaccgattgtccaccacctcacgtacgtgggggaaaacgtagcctggttcctccctcgttgggtcccagctac

SEQ ID NO: 693470 - DNA, 110 bp, Homo sapiens
acgtgtggcactgtaaatattaccaaaggtcacagacatgcgtagtagatgagatggggaggctagctaaagaggaggctgagaggggaggagggcactctatggttgga

SEQ ID NO: 693471 - DNA, 821 bp, Homo sapiens
  misc_feature (394)..(394): n is a, c, g, or t
ttgtggtgcgagcacacaatatggttctcgctcggggggtaaatttcgggggagaaccttttattggggccccgttcgcaggcatcccatcacaccatcacactcatctcgcctctctcctgggggagaatgattatcacaagagagcccacttcgggggcgcttttttgagaagagtaccgtcggtgagcatcgtttataatagtagcagtcgcggcgcgaaaagagtggttgtgatatcatccccctctttttgtatatgtcggggtgcgcactctctctcacgaaacgccacgttgttctcacagagacagagctaaaaatgtcaacgagacgatacacccccctgttcccgtctctgttgcacgaacacaccctgggagcctggaggacncaaagggaggggccctcgggggagaggtcccataataggggtgagggcaccccggtgatattgggagagagaggacccacagaggccacaggggggtccacagcaccacttcttttttgtgagactggcggtgtctacctcgcctgcgtcagtggcgttgggcgtccaccagggacagggggtcagaggcatctccacgtaaattataatgggcgtaatataaaatagatgtcaagagatggacatagagatctaatttttttttgaaacaattcccctccccaatccctcttcccacagagttctggactgttccaggccctccagtgggctgattctgggacccttaggatgggggtcccaggactcctttttcctgtgaatggaggcagagacctccaataaagtgccttttggggttttttta

SEQ ID NO: 693472 - DNA, 403 bp, Homo sapiens
ggattggtatgtttgggcatcattgtttagtataaagatttgttgaaaatctcatgcgtttgagtgggttaagaatcatgctatggataggacaaatccaatgtctccgatgcggttgtataggattgcttgtagtgcagctgtgttggcgtctgttcgtccgtgtcatcatccgattagcaggaatgatatgattcctacgccttctcatccgataaagagttggaagaggttgttggcggttacgaggattattatagtgattaagaatagtagtaggtatttaaagaatcggttgatgaaggggtctgagtgtatgtatcatatggagaattctataattgatcatgtgacgaatagtgctacgggaatgagctgttctaactggagctgttgtaactgg

SEQ ID NO: 693473 - DNA, 1327 bp, Homo sapiens
ggacgtgatgtctcggagaatagttctccgttcccaggacatgggtccctcggcttcctgcctcgtgaagtcgcagaagcaggcatcgctgcgaaggtgaattagcttaccttagcagtatgatgccgtccagatccggtccgaccgtctagcaggccttcctgtcggatacaacgggctggtcagtgagttcgacaatcgtggcagggcatatctcgagtgagaccgcgtgcatctcaacggtagtaactaatcaacgtgaggtgtagggttggacgagtctagtgatcaagtttgctactgtgggaacgaactcaatcctagtggttcgtgtcttgctgcgtgccattagtttgaagacgtaagctgctagtaaacgaatcccatcttgcagggatgagttccttccctagggtacgcgtctcctacaatgcatccttgttgcgtacttggacatggtatgtccagccacttcaatgtagtaatgcaaagttggccgaaaggaaagggccggttacatccccattagtcacacgggagcactctagtgcacgcacttaagaccaattcggttaaacgacagacgaacactaggccgtttttgacctcaataacgggtgagacgttagcctaaacgaaacattagtggtggccaaccggggttacttggattgcggtagttgggggtcggataggaacaaggttcgaccgttctcggagaaagggaaaaggggcaagcagtttccaaacgccgatggcaattcgcaagcggaacaagctgtacccattgtccctatcaccggtgcggtttcccaagagtggttcgattttctagactcccggaatcaaccccccgattggacttcgccatggcacagtgggtcttaactcctccgttgcgttggggaatagcccaataggggaaaattcgagaacgcgctgttagcgccaacccgcatatgcaaatttgtgggaatgcatctcactgtaggccgcattggaggctctggtaacgaaggggccactcgggttggctttggcgggtgcccgttaccgttagaattgaccttttgggggaattcaatggggcccgcagtccccagttgcccacgaaaggtcgaccctcccggaaagggcgcggcccccaaatcattggataatccacttagagttgtcaattgcccgaaacaacggtacagtttatgttgccggcgcgtcaaaggcagcaaaatgcacgttgaacttgccactttcgggaacgtgggtaccatatgtcgcgatcacgttgccgtagtataccacaccattgtgggttacacaaaacgct

SEQ ID NO: 693474 - DNA, 406 bp, Homo sapiens
ctaagcgagtttcggagacgcaggggacactggagtatccatgtggaaccccagattcagcaacaggctgagaaggtcactgtcggaacaagatgcacagcctaatgccctctcgccgtgcccaaacgcaacccaactctctctctggccaagctgggcgccgttaatgctgtgtttctattctgttgtcaccctaggatagtcattgcaacgtgacgcccttgtcctttcaggttcaggcgcagctgcaggtggacagcgctgtggcgcacgcgcgccgccgcctgcatccgcacctggccgcgcacgcgccttgcatgatgttgccagcgccgcccttcggaatgccgctccccgcgctggccgcgtattagaatacggggacgagggtagtggcggcggctag

SEQ ID NO: 693475 - DNA, 143 bp, Homo sapiens
aatatcattcgggctggatgtggggaggggtaattaaaggggttggctagggtataatcgccggtcacgagatatccatcctcatcctagcaataatccccatcctccatatatccaaacaacaaagcataataatcgccggt

SEQ ID NO: 693476 - DNA, 284 bp, Homo sapiens
agctgccatgtcatgaagctactcagggaggtccatggagaggtccacatggcaaggaactgaggcctcctgccagtagccagcaccatcttgctggccatgtgagcgtgccatcttagatgcagatcatacggccccagtcaagccttcaaatgactgcatccctacttgacattttgactgtaacctcatgagaaaccctaagccagaacaccagctaagccactccccaattcctcatcaagagaaactgagataataaatgtttattattgttttaagct

SEQ ID NO: 693477 - DNA, 472 bp, Homo sapiens
  misc_feature (10)..(10): n is a, c, g, or t
  misc_feature (18)..(18): n is a, c, g, or t
  misc_feature (29)..(30): n is a, c, g, or t
  misc_feature (55)..(55): n is a, c, g, or t
  misc_feature (63)..(64): n is a, c, g, or t
  misc_feature (78)..(78): n is a, c, g, or t
  misc_feature (102)..(102): n is a, c, g, or t
  misc_feature (107)..(107): n is a, c, g, or t
  misc_feature (122)..(122): n is a, c, g, or t
  misc_feature (128)..(128): n is a, c, g, or t
  misc_feature (138)..(138): n is a, c, g, or t
  misc_feature (200)..(200): n is a, c, g, or t
  misc_feature (203)..(203): n is a, c, g, or t
  misc_feature (367)..(367): n is a, c, g, or t
  misc_feature (369)..(370): n is a, c, g, or t
  misc_feature (376)..(376): n is a, c, g, or t
  misc_feature (389)..(389): n is a, c, g, or t
cgacccggantgtgaaanggatcacatcnnggagatatttccacctatgggaaantacaatgnntgggggccgtgganaggctgcatccccatctgtccaanggctntgcgtacgtagagtncgagantccagatgangccgagaaggcgctgaagcacatggatggaggacaaattgatggccaggagatcactgccancgncgtgctggccggctggcctaggccagcccccaggagattcagccctcccaggagaatgttgccaccacacgcctgtgtggcgcaggtctcccccatggatgaggagaaggtcccgctccccgaggcgcaggtcccccgtgcgccggagatcacggtccccgggncnncgccgncacaggagccgcnccagctccaactcctcccgataaacaggccactgaagctctcgcccctgtaacttataccccacccagctcagtcgaacggac

SEQ ID NO: 693478 - DNA, 710 bp, Homo sapiens
  misc_feature (6)..(6): n is a, c, g, or t
  misc_feature (17)..(17): n is a, c, g, or t
  misc_feature (33)..(33): n is a, c, g, or t
  misc_feature (285)..(285): n is a, c, g, or t
  misc_feature (357)..(357): n is a, c, g, or t
  misc_feature (426)..(426): n is a, c, g, or t
tagggnaacagtttttncagccccctgccccanaactggctggccccccaaaagcttaccaccaggtccgtaaaccagttttttgggcagataatatcgagttcttcgggggtacaagggcaaaggctccaaggggtctcagtggtttgccacaaaaaaattccccccaaaaccaccagggccctgccaaagtggcctgtattggggcatggcatcctgcttgtgtaccttctttgtggcacgcgtggggcagaaaggctccatccccgcccttagatcacaaanaaaatttataagattggccaggggcttccttatcaagggcggcaaactgatcaaaaacaatgcctcccctgnctattacctattttacaaaagcatcaaccctttgggtggctttgtcccctatggtgaaatgaccaaaanctttgtcattcttaaaagctgtgtggtgggaaccaaaaaacgggtgctccccctccgcaagtcccttttggtgcaaaaaaaaagggggggctttggaaaaaatttcccttaagttcatttaccccccccccaagtttggccatggccgctttcaaaccatggaggaaaaaaaaacattcatggggccccttaaaaaaaacccaatttcaaaagaaaaaagagcttaattccaggaacaaatttttcagttggtggggtttcaaaaaaaattattttccccttga

SEQ ID NO: 693479 - DNA, 106 bp, Homo sapiens
ctcactacaatctatccgtagcgaacaagcatatgacgcatctctccctctgaactctacacaagcatatttgtgtcaccaatgacccttacttctaatcctaccc

SEQ ID NO: 693480 - DNA, 251 bp, Homo sapiens
gatgggggtgactatagcaagtggtggttatgtaatagttctatagtccttgctgtcttttcaacaatattcacagcatcttcaccaggagtagattccatctcaagaaccactttctctgctcattcttaagaagcaactcattcattcaagttcaatcataagattgtagcaattcaaccacagtcctcccagcttcacttcttcaatcactagcaccgagaccacctcaaagagtactcccagcttca

SEQ ID NO: 693481 - DNA, 888 bp, Homo sapiens
ggaaaacgaacctgtgaatgttgaagaattagctttcaagcttggcagtcaccagtattaaaaatccctcagacctcccctcaagtgctcaggatcggagggatttttgaaactgtggaaaacgaacctgttaatgttgaagaattagctttcaagtttgcagtcaccagtattaaccgaaaccgaaccttgatgcccaataccacattaacctatgacatccagagaattaatctttttgatagttttgaagcctcccgaagagcatgcgaccaactggctcttggggtggccgccctcttcggtccttcccacagctcctccgtcagtgctgtacagtctatttgcaatgctctggaagttccacacattcagactcgctggaaacacccttctgtggacaacagagacttattttacatcaacctctacccagattatgcagctatcagcagggcagtcctggatctggtcctctattacaactggaaaacagtgacggtggtgtacgaagacagcacaggtctaattcgtctgcaagagctcatcaaagctccctccagatacaaatcaaaatcaaaatccgcagcttccctctggcaataaggatgcaaactctgctcaggaggatgaacgaaaggcaaggagttctatgtgatatttgatttgttcgcacgagaaggtgctgaaattctttaagcgagatttgttcctggggcctgatgactgaattactttcgcctaattttttcaccaaccctggacttgtttgctttggatctggaaccctccacgggccagggggcacatgcgggggttcgcggggggaattggggacccccccgggtttccccatttgaaaaggccccgggaatattggggcccccc

SEQ ID NO: 693482 - DNA, 250 bp, Homo sapiens
tgagctggcccctcttggcgagctgcagctcagggcgagctgctttgaggggttccagtggtgctgtctggctcctctgactcctcatcctcactctccttctcctcctgctcctcctgctggtcggctgtggcttggtgctgtgcgtaattggcactggtggtgtgggagcgtgagcttgcacgtggtcagatctggtgattgctggtcagatcccggtgctcatctgagggcagctcgcctctgagtt

SEQ ID NO: 693483 - DNA, 180 bp, Homo sapiens
gccgcgctggtagcccgtcgtcgagccataggtgccgatggccaacgccgacggccgtggtgttgccggacgtgccggacgcgatgctctgcacgccggtgttgtcgctgagctggctcagcgtggtgccattgccgctgccgttgccggcattgcccaccatgtagtagttgccattgg

SEQ ID NO: 693484 - DNA, 115 bp, Homo sapiens
atggtgtgtactatcggaccacgggtcgaaccctacacgggaaaagtgaaaaaacattcatcgttctacggcctaaactgtgatagctaaaaatttgagcatatgaacgaaatga

SEQ ID NO: 693485 - DNA, 317 bp, Homo sapiens
catagctgattccagaggatacactaaaggcgagtccaggcacatggcacctctagcctctacaaaggactagatctctcaaaactacatgaaaccctccgtacccatactcgcctggtaagcctatttaataccaccctcactgggctccatgaggtctcggcccaaaaccctactaactgttggatatgcctccccctgaacttcaggccatatgtttcaatccctgtacctgaacaatggaacaacttcagcacagaaataaacaccacttccgttttagtaggaccttttgtttccaatctggaaataaccca

SEQ ID NO: 693486 - DNA, 169 bp, Homo sapiens
  misc_feature (134)..(135): n is a, c, g, or t
tgttgggtttacaggtgtcagccaccacatttgaccccaggcaggcaccagttttaaaatttaagactgtgttgattgatttaaaagtgaatgtttctttgggctattgaaatattgcactgactcaacctatnnttatgtacctttattcataatatctcattgctta

SEQ ID NO: 693487 - DNA, 150 bp, Homo sapiens
gcttttgcggtgcctttcaaagcttcacagctgcagcagtgctatgtgtgggacacatcacccccaataatccagcagcacagagccagtctgtgcatcctcacggtccgggagggccacatgccacctgtttgaagctcacagcctctt

SEQ ID NO: 693488 - DNA, 181 bp, Homo sapiens
tgcttactactggagtctaacctttggctgtgatgaaacaggaggagtactgatcaaaggtttgatagggactgtgttagtttgaggtgtgcacatggtcggtgaagcacactcgggtcgcgcgctcgtactcgttctcgtggtcatcggtgtccacaggagagcgggcgaaaaccaggag

SEQ ID NO: 693489 - DNA, 230 bp, Homo sapiens
catcgagctcggccccagttacacagcttttgaattgtgtacgtttgagaggatttgaggggcatgagattattggggatcttttcattcctagatgtccataacttccaagacttccttccaagtaagtgcagaaggacacaggctctctatttaacaaaatgggtggtctatgcctctcttcacttatactttcttaagcctgctcattgttgagctgttgtaactgg

SEQ ID NO: 693490 - DNA, 723 bp, Homo sapiens
  misc_feature (597)..(597): n is a, c, g, or t
gctgtcatggcggagaccgtctgagagcgactgacaccgaggtaggcagtgtatcactcccgggaccccgtgctgcgaaacttgcgccctccgaagtccacctgctactgaatcacattcgagcaagtttcttcatgatcagcctgtctggcgaggctcggtgaagtggacctcttatgatcttggccacttcataagagcctcatgaccaattgccagtggacgccgtccagaggaggatgaagaggaggagctcgggatcgggtggcatggagaagtgtacggtatgcacagatagtgacatggccattgcgtggtgtccattactttcaatactggtagcctgcgtggtgtattgactctctcctgaaagccgcggactcaagttacaagcgagttctgcaatcaggggtagtaaatgtgcatccggaatgagcgaccgggaggtcaatgttgctacatccacttgcaaggtcagaacagatatcgtactgggtgggcatattaagtggctctagggaatgcttcgacaagatgaacaataccgagtgggagtgggaacccggaattgccccgagatgctacttgagagtagantccatgtcgcttatggtgaccttggccaacaaaaagcacaagcgaaacctcaaggccctgtattgcccctgcgctaccaagctgcaacgcggaggattgtggtcctggccaagagctaacatggga

SEQ ID NO: 693491 - DNA, 537 bp, Homo sapiens
tcatcgctctgctggtagtgttgagccaattacgtgtcgtttgaaacctccattgtcaggtggtttattaaagattatcttcccgcggacaagagctagtgtttagccactttggatggtacgagacctacggtttaacactaccgtgcacgtactcacggcccactatttgtgtataggacgaacttggggagctacgcttctctgtctgtatggtcgtcgaccccccttgttgtcctgcgggcgaacaaagacttactgtatgcacctacgggcgcactacccagagctaatgacgcgacctgataatatttcgcgggggtaaatgagatgtaccccaccacaccgaagcggctgatactcacccacccccccaccttagggccataacataggcgacgcgacgtattgacgcccgtgggcacaccacccccttacgcggtttcttaagaccgtgttgcctgccatattgcctcggtagttattattctcactcccaatatgcccgccgtttttcacccacacaaatcacaccag

SEQ ID NO: 693492 - DNA, 232 bp, Homo sapiens
  misc_feature (220)..(220): n is a, c, g, or t
tgttaatgtgttatatcacattgattgatttgcatatacttggggtccttggcagtaaaagagtgctgcagtgctgcctgatctcttttccttcgtatcaggggtagttgtggccaaggggatgccttgtggtaggttcagcacatgggcatgtttgggcacagagatgctactgttagagtgcaggcatgcagtagtcagccgcatagctagtttgacnatgtcatcaagt

SEQ ID NO: 693493 - DNA, 879 bp, Homo sapiens
gtcgaatggattccaaacaccagtgtgtaacgctaaatgatggccacgttcatgcctgtatggggcatttggcacctatgcacctccagaaggtaccgacccaagtatagctttggaggtcacaaaatcagacaatagaagctgggttccgccatatggcattcgtgctctatgttatacaatatagtgaggagcaggttggactggcgccgtccgcatttgaagattggtccgagtggcagttgtgacacgagagcacgacatattcctaacatctgtcaaacgctttggctaccactttgtcattcgaccagagttggtccggagccagcgcttgtgaaaacttcactgagacgaacagctcaattggagctatgtggaccctctagtcttattccattctccaatgtctctaacagccaccggtgaaggaacctttcaccagacatggatgaaccctgggaagaggtaactacttctgacatagttggatctctgtaaccacctggagggcccttggacgaacgttgtaacggattgctgcgatgggccctaggtcccatttgtgggttgtcgaaagcttttcaatactgcttgtgcggggcttgtaatgaattgaattgcctctaactagagaccatggacctcatatgtacaaagggccttgttctgataaccagggtgaaatggtcactccggtaattcaaccccgaagatcaattggctccgattctgcaaggtgccacaaatattggttcgtggttggccactaatgcactgcggttccaccgagaaagaccgatgggtggacccaggagacccgcgcgcactcgagagagagcaagacactgtgccctgggcaaaccgaagaaccagact

SEQ ID NO: 693494 - DNA, 814 bp, Homo sapiens
cggagcatggagtgtttgtaggcaggggaggtgatctttgaagtcttgattgttgtgttttcatagttgcagcgtatgatgcggagttcacgttgggggtgagttccacaccaccaccctgggtaccctgatgtagtttccgggctcaaagctggcaaagatgttctatagcttatccaaggcctccacggacgcggagggccgctccttcatcgaccgccccagcacctatctcagacccattctgcactacctgcgcactgggcaagtgcccacacagcacatccctgaagtgtaccgagaggctcagttctacgaaatcaagcctttggtcaagctgctggaggacatgccacagatctttggtgagcacgtgtctcggaagcacattttgttgatagcgccgggctacagcgagaacctggagctcatggagcgcctggcacgtgcagaaaccagaacagtaccgataaacatcgcacttgcgcgcttgttgtaatctcgggagcatgatgcatatcatctcgatgccctgttcttttttcctactctaagatgtgtcctccttcctcactcgttgcacccgtatcgctgccccaatcatcaataatcctatgccctgtctcatgactctcatgaatgcacaatgttacagcgctcttcttctatgtctcttaatctcctcccactctcaatccatttcatttgcaacttgcattcccgcctatctctttacggccgtgttgataaccggtattgctcgactatggcttgcccttatttctcgtggcagtcgcaacatcacactctcttc

SEQ ID NO: 693495 - DNA, 214 bp, Homo sapiens
ttggcatggacaggaaggtctcggatttaaagtctgtgcaggtatagacagagaagcgactttggcaaaacgcagagtgaggccccaggcagggaggaggtgagacactcggtctcggcatctggctccactggaagagaggtatacccagatcccagggtcaaaatgtaagtaacgcacacatgcatccatgcctgtgtgtgagtataaagga

SEQ ID NO: 693496 - DNA, 299 bp, Homo sapiens
tgcatggtctgatcatcaatgtggatttccatataggatttttctggcatcgatgggctgggttgatcttggcttggcctatttttttgcgtagtcatttcgcatattgcccgtccctttagggatcgtaacaaagaaaggataggaaatggaccggccttggaattagattcgtggcccaaagaatagtaacaataaggacccccagtatgtattcaatattctctgggggggccatatggacatctatatagtattggaatgtatttgggtcccaatgggacataagtatttctggg

SEQ ID NO: 693497 - DNA, 109 bp, Homo sapiens
tcgagcctgtaccctatcgtgtaccagagacaatgaagtggagcaggaagatctagcacagtccttagccatggtgaaggatgtgattggagctgtagacagcaaagtg

SEQ ID NO: 693498 - DNA, 808 bp, Homo sapiens
agcggagccccctgacctgcagcctccggacctcgctgcagcgcggacccggccgaccgcccgaatgagtcagctgaggctgctgccgtcccgtcttggggtgcaggcctgcgaggcctccatggccatgacacatgaccgtacccggctgtttggcatggcaagcagcaggtcctccgaggcacaccggacaccttcccaagcagcaaaggtgcgaaggcggctccaggttacactggagcgagatgtacttcgcctggttgcgacaacaccccctagagctgatccgacacaagctccgtggcgacacagctctctcccagagggaacagcccagccgcagggacagcccactattacctggcctctgccatcaagcacgacggaacccccatatcatggttgtcccaatgacggcagccagagatgctagccacggtcgtccaaagctcgggaacacgcaaggaagccgagggcgaacacgtacggcaaggcacgagaacccaaccctggggcactggtggacgagagaacccgtgcactcgcgggggccccttacacaagcaatcccgcggcgctccaccccacggatgcgcacccccaagacgctggggagaacccccccccctggggggacaagttttcatggggaaattggccacgaaaaccctggggcaccagctccgcatagtagggctggccccggtcacgggaaccgtgtggaagtccacgcccaagccccaagttagggactaaacacacctggggcccctttccgctagttgaaacgcatttaccagcgacgggc

SEQ ID NO: 693499 - DNA, 99 bp, Homo sapiens
tggcgggatgaagcctgataaggagaagggatttcggaacgtggtactgagattcttctgctgcttaggacgatcgtcggactaggagccattggactg

SEQ ID NO: 693500 - DNA, 448 bp, Homo sapiens
  misc_feature (224)..(224): n is a, c, g, or t
agagagagtagagagagagagagagagagagagagagagagagagagagagagagagatacagagagagacacagagagctaccgagatagactcctctttccctcttctcgcctctatctcgctctattgtctcctccttacactctcgttgtgtctctttatgctccatcctttcctgcccgtgttccttcgtcacttgcttctccttgtacgcccttttcntctctatggttcttgtcctactcgtttcatctccttgtccgatactatgtactctctcactcttgcatctcacacctatgtttccttcagctgatcattcgcctcctttctcatacctccttttctgttgtcctatatctgcttctcgtctcattcccttcctcctcatcattgctatccttcacattcgtcttgtcctccttcttttcctcctcgttccctcc

SEQ ID NO: 693501 - DNA, 1030 bp, Homo sapiens
  misc_feature (367)..(367): n is a, c, g, or t
ggctgagggaggccggagcggtagcgcgttgcgatgctcggcgtgcgtttcaattcacagacctggggtggggctgataaggcagtataacataaggaattggataccaggatagcagctctggttcattcctggactaaaggagcacgaggaaatgggatgacggtcatgccacccatgatagcatgtcatgaaggcgatgcttgggattcaagggtcgagccgtcgtgcaggccgtggtctgggaagatatgactcgcacgatacacgttgtatggcccgatgaatgatgcggtcattctgtgcactggagttgccaggccttggaaagattgacaaaggagatgaagatgggaccaatattgantgatggctgggtcctaagcagggagcgtctaatctcttgggggtgcgacatgagcacacttctcaatcctggacgtcatcggcttgccatgtgagacgcgatgagtacctgaatggtggcaggacagggggactgagcccgtgaaagggggtccattgcaattagggcccgacccaaagtctatgaacgctagtcgctacactacacatggggttcatagatgcggtacttcggctcgaaaaaggtgagtggtgggggcgagtacacagttcctacaagggtatacggaaacactctgaaccacgtacggtttggcataagaaggcacttgggcataggcgaaactggcacccttcgggacgagttcccaactatgaatacaacacgttcaagacgttgctgggaaagacaccactccaaggggggtaagatgacccacaaaagggaacccgtggccgtatgaagtttacctatcagcgagacagcgtctggacgtcgtgcacccatggggacaactcggaagccttttcccggacgggtccaatggcctggcggaattgggcaagcacgttatggtttgagacaagggtaaccccctaggagcattggggcacaactaggaatgggttggggcgcgcaagttgcaaacacgtttgaaccatg

SEQ ID NO: 693502 - DNA, 299 bp, Homo sapiens
acagggagagtgcagaggctgccctgaggctcgggtataggtagcctactgaaggctggtggttgttagaccctagcacgcagcccgagagtacggtgcctactactacagaagtgctactatgcctgccggcctagatgggtgatagaggctactatctatactggcacctataggcatggaaatagagcatacacagaagctcacaaggcccagggttagaaggccttactgtatttcaaagcaacagtaagtggccaccccatattggctataaatatgtgctatttcatgtattg

SEQ ID NO: 693503 - DNA, 764 bp, Homo sapiens
ttgcccaattcctgagacggtgttggggaatgttaagggcgcctcccggcagattgcgggcagcgttatccagggacaggaccatggtttgtgccggcgtccaaggcacgcagccaagcttgttgactgcgcaagctcgggacctccgcgagactttccggaccgcacgtcctgtcaactcagcgtgcccctctccccccactatgaccctgtggtcctgggcggtggtccggaaccctggatgtacccccacctccccccggatggccagtttgaggcccggttcttcccatttggcccttgaagaagagtttggaagactccagggtcactttggacctatcaaccagtgttgcccctcccatcctgatggccagagctacagcagcggcggcgaagatggttacgtccgtatcccgttacttcgaccccccgtacttcgaatttgagtttgaggcttaagaagctggatctcctgcccggcgtggtggctcatgcccgtgatccccccacccttttttttaaggcacggcggatcacctgaggtcacggagtttaagacccgcctgacccacaactggagaaacctcgtctctactaaaaatacccaaattagcccggcatggtggcacacgcctatagtcccagctactcaggaggctgaggcaggagaatcacttgaaccccggaggccgaggttgccgtgagctgagatcacgtcattgcactccatcctgagcccccagagccaaactccctttcca

SEQ ID NO: 693504 - DNA, 385 bp, Homo sapiens
gaataacatcatgagactcacacaaagtgcgactagcgatgctggaagtgctctcaagaagcagagaaaagtcatgatggccgggcgcggtggtgcgtgtctgtaatcccaactactctggaggctgggcttacaggtgtgcaccaccacacctggctaattttttagttttacttttgtagagatgagatctcgctatgtcgcccagtctggatcttgaactcctggcctcaagcaatcctcccgcctcaccctcccaaagtgctgggattataggcatgagccaccactcctggcctggtctctggtatctttattttctatcagaaaaatagcatgaacataaaaagtatacttggttaacccatatgctacttggatttaa

SEQ ID NO: 693505 - DNA, 112 bp, Homo sapiens
tggcttgtaggtcgatgctgtattcaccacggcggtgcatgcctccctgtacaagtaccgacgacacgtgagcaccgtgcgttgacctccaaatatcgtcaagctggagcct

SEQ ID NO: 693506 - DNA, 640 bp, Homo sapiens
ggtgggaacagcgcggagcagtctgtcagcactgccttcaaaatgcacccagaatagattcgcaattctaccatttctctcaaccgccactgtcaccaccttggccaggcccccatcatctgagaagcaccaaaagaggcaacagtgagatgcagacaaatggatcagtccgtatgcgtgatcatttggaatagagaatggagaattaaatgaaaaggtaaagtccttttaaagacctcagaagatggatcgtgttgcgttgtcaatcgtgctttgtgaggccagaaggaaatatcagttgagaaaacaagcagcaccgtggaagtgcatcactctttaattctcaaatccatatgatgtgcccaagagaagagatgctatggtcatcgaatactctcagcaaggcttcataaaattaaaggaactaaaaaatgaattagctgatatgcatcataatatgggaagccatccttacagaaaagcaattttggaaacaagttcagcttaggcattgtgaaagctataggaaaatatgagaattcacaaagataatctacgctcaaattatggctaaacatcagaatgaagtacacaaaatttaaggcaatacttaaggaaatcgcaggaaagggaagaatct

SEQ ID NO: 693507 - DNA, 124 bp, Homo sapiens
gcgaggcggaagccatcttgttgaacgtgaagtccctccgggagtccactgatagtccacggtcgttccacttggacgtccagggggaagtgggcctggtcatgttcttcacaactgggagtga

SEQ ID NO: 693508 - DNA, 726 bp, Homo sapiens
gacgtcgtggtcgttcggtccttgcatttcgatctccgtgatgacgatgacgcggaagaagaatgggcccaagcgggagcttggtgttcggcgtccgtggggcgcagtggaaggagggcgtccgagtctaacaaccgcttcgagctgataaacattgacgatcttgaggatgaccctgtggtgaacggggagaggtctggctgtgctgtcgacatgatcgctgtggcaccaggcaacaaaggacgcgggtcagctgtgaaaacacagagagcaagacggatggagatgactaccgagacagttgccctcagagcagatctcatgcaagtggcaaactccggaagaagaacagagaaaacagaacacaccgaatgaaaagcagcgacgggagatagcatctgtgacacatagcgtgcactagaaggatatcgatcgcatcctagagaggattgaggacagcacgtgggttgaaccgtcccggcccagtctcccctgagcgtccaggaagtcacgttctctacagtggatgctacagactcttgaatcctagacacagaacgtgaacaaggtattatggtgcccgggcaatcctgggggaagcaaaggcgcacggtatgagacgaccgtggtgtaccccaatgtgcacatgggtgaccacccctaaaagcacctgggtcccggtagagcaagtccagtgtctgtccatgcggattgctggtaatcaag

SEQ ID NO: 693509 - DNA, 350 bp, Homo sapiens
gtcattgcagcatgttgctggccttggaatgagagtctcgagtgtgggaacgctcgcgcgccacagtgaggaagaggtaaatgacagcaaagatatagaatgatatacagaaagaccaaagggaactcctagagccaaaaatcaagtactggatggctcaataagtggaatggaggtaagagagaagagaatctatgatcttgagagataggttagccagaaattatcagtctgaacaatggcagagagaatagattgccccacaaccactggtcacaggagaagctcgggccccaatagcgctgtgggacaggaccagggcctccttatgtgactgcggggtttgcgta

SEQ ID NO: 693510 - DNA, 154 bp, Homo sapiens
cacgtaatagttgcgcggcgtgcttgtgtttccttaaagttaaaactttgatacagatctgattatttatgcaatatgctgtctgattgcataaatatacattagctgaagcgtgatgatataaacaatttgcgtcttttggcgtcgggtttgt

SEQ ID NO: 693511 - DNA, 743 bp, Homo sapiens
tgcctgcgctgactcctgggaagagaggaagcgggagaggagcccacgtcgcctgtcacccaagtatctccagcctgtgcagtcccgaagagtgtaagatgttctgcctgcgccaagactctgcctgcaccccctctctgactcctgagctggataccatgagtatgcatacatgaccaatttcttgcatacagttgtaatctcgaccagagtgctagtatgtgactaggagagtggctctacgtgtataataattgtgtgtgcccagaatggtgtgtctcagctaatccaaagtggagtttcagaccatgtgcaatacatgcagaatgacatttgataacttgcttagccaacatattactttgtgttgcatgtgttgcatagcaaccatgtcagctgacgttgtggctagtgtatacttgtgtagcttagtgtatattgtgacacaagtacttgtgcgcgagcgctatactcatattgtgtataactagccatgaaacacacctatactgactatgcaacgctatgcaagtcatagtttcatcactacttgcatattcactgtgtgatatttgcctatgtccttgaacgctactgttgtctactatattgttttgactagtggttgcttaacttgattttgcttgccatgtaacaaattacttgctatgacatgttggcatacactatcaagtaccggactgtattctgtgtatcttactgtgaactccgaaaactgtacc

SEQ ID NO: 693512 - DNA, 781 bp, Homo sapiens
cggtcgcggcgggcaggtggcggcagaatgtgggctaccagtggtatttagacctacttggcgagcgagcaatttccacctctgtgtgtgtacgagctcatgaaagtgttgtgaatgagcgaagacttttcgctcccagactatatatggatcgtgcagtgaccaccccttgccggaggtggcccatgtcaagcacctgtctgccagccagaaggcactgaagggagaacggagaatggcctcctggagcagcctctccatggattgagaaagtcgagttgtatcgcacttaagttcaatggacgatgctttgctgagatcgaacaggggctcgaccgagtggcagacggttgtgggcggtgcctatgcttcttctatcgtgtttcaccgcgctcgtcatcatgtggcaagaagctctatgtgtacggccccctcccgctcagctttgactcaagagtgggtggtcatgcgagaccatgaggatgctggacatgaaggtgaaccccatccatgggcttagtcctccaagtgggactacgaagaagaacgagtggaagaagtgagagatgctggctgtcgcctgcacctgcgcctgggttctgtcaccgtcatgcgactccatgcctatttactggaaacctgtatgccaacagttgtaccactgtaataatgacaggtacctgataaagagaagaaagaagaaagaaaagcgggcgtattttgcggggaaacaagaaaaacgcattgcaaacttccgacacatcgtcagggaatgcgacca

SEQ ID NO: 693513 - DNA, 215 bp, Homo sapiens
  misc_feature (8)..(8): n is a, c, g, or t
ggatgtantggtaacaatgattccaaatctcccacttttcccaaatcagaaatttaaattaataatttaagatacaacttgatgtagtgtcacagatgtggcttcagatctggcattgctgtgactgtggtgtagaccacgcagttgcagctaccgattttgacccctcagcctgatcggtaacatccacagggcgtaccggcagctcgacattc

SEQ ID NO: 693514 - DNA, 230 bp, Homo sapiens
tgatacgcctcgaactcggtaccctgtttgcctaggacatgatattaataaccatagggcgggttgtgcgcttggggcctgatagtgagtcaaattctggtgcccctgggtgcggcgtggactctcgccaggagacggggggcatgaactgggcccatggctcacttccgatgtgtaagttcctcacgttgtgtgcgataacgtattatatagtacatgtttttaactta

SEQ ID NO: 693515 - DNA, 547 bp, Homo sapiens
caggaatgtctaggagctcaggtgttatttattgggttgcagagcaagctgtaaagggggaatttggtaagactgaagctcagaagactggtgggagggcaggactgggggcacaggagaggagattaagaggagggtcgactgaattttggcgagggcaagagttctggctgcattccagaaggggggcgagcacagggcagggaaccacggggctctagggcttgtgggtccgaagtgtcctggtgactggaaagcctgaggggaggctggaagctgataccaggatgccggtggctttgtgcgacagaatgagctctttcttcctgaagagggacagaggggagagaagagagcagacatccacacttgctccttccatcccctgcccgtgtgagacatcacgtaatcaaacttacggtgcctggaagacatcactcatcaggattgcgctagcatctcccactagagcccagaacaaacctccgatccccagcacaggctccagcagccacccctgatctatcagggtaggagcttaaggctg

SEQ ID NO: 693516 - DNA, 704 bp, Homo sapiens
tagagacaaatttttttatttttttgccatgttgcctggctggtctcaaactcctgggctcaagcaatctgcccaccttggactcccaaagtgctgggattacaggtgtaagccaacacagatctctgttattttttattttttttgagatggagtcccactctgttgctggagtgcagtgacgtgatctcggctcacagcaacctccacctcccgggttcaagcaattctgcctcagtctcatgagtagctgagactacaggcacccaccaccacgcccagctaatttttgtatttttagtagagaggggtctcactgtgttggtgaggctggtcttgaactcctgacctcaagtgatctgcctgcctcagtctcccaaagtgttgggattacaggcgtgagccactgtgcctggcttgttgctgttttaaaaacaggggctcgctctgttgcccaggctggagtgcaatgacacattcagagctcactgtaacatttaccttctggactcaagggatcctcccacccagctattcaggaggcttgggtgggattacagtttgggcccaaaaggttgaagcttgagtgagctttgtggcacacttgactccagcctgaattaccaaacgagaccttttttaataaaaaataaaaaactcttggggggggcctggtcccatttcggcctattgggaggtgtttt

SEQ ID NO: 693517 - DNA, 471 bp, Homo sapiens
ctgcaagatgctttctactgccaccagacctcctttggaggttttcctaccgcttaataaccaggaacttgttggcgtctgacagagcatctcagatttcttacataaaatgtggaattgtcaatagtcagatgcatcagtggccaaggctatggtgtgcagtttctatcagcgtgtacaggacatcctgcctggttttggcctcaaggaagcaatggtgagatttcgtagctcatcgtctcctggttggagcaaagggtgccaaacagaggtcaagctcgggccacagggaaactgggaaaatacgttcattgccatgtgcgaggagtccagtggatttcagaaatcttctgtgtcttcttataggctacagtaacagccccttactggaagaacattttaggtaatccccacgacagggtgacatacactgatgttggagcatttaaataaaaagagtctcactgtgta

SEQ ID NO: 693518 - DNA, 767 bp, Homo sapiens
ggagaagccaactcagactcagccaatcagagatggttgatttgcctcttaagcaagagatgcattgcagctcagcagtggctcagacgcagctcatacgtgtcatgcatgatctccgtgcctgatgtttcgtgtctcgagagccaaggccaagaggcgccagacagagttgcgcccaggccgcggatcgagcctgctccagaaggcaccaatgccatatcagccatcctacgtgcttacgtactttagatgaagacccgtgagaccgtgggttgatgcatgatctcatattgccaggaacgatgaattccgggctaacctggtgtctgtgctcactccaggccgagggtgccttcagtggcgctcactgattcaaggtagcagtggcacgtgatgacttcaatgtctggattggcctccaatgaacacctaaaaagaaccgttcgatggctattgtgagacacgtgtggtccctggttcgtcctagcgaagtcctggggaaaatggagcccccaggccagagttaagcactggcctagctgggtgaagccgtgaacctcaaaagccaacaggagtgccagaaagtggacgagatggtgcccatgaggaaagaacaaaggtaacacagcttagatacagtcgaagcgcaacaaagacataacaggcagactgtgccgatcgcctggacctcacaactggatcaagacacaacacagggagagccagaataaagacgcgacagactctccaaccgacccatgcgggaa

SEQ ID NO: 693519 - DNA, 472 bp, Homo sapiens
agcttacctcttttacctgttgatagtattatgagcaaccaggagctgcactggatgcactggagacacccgggacaaggttgtcagtgttgtcgattttgttcaaactgtctcaacctgatccggctatttcggaaatatatgcgccatatgtgccgccaagagtaccctaaggacacgaaggatattaagttgatctaaatgctcttacttctgtggattaagaggatcatccgctgcatgtactaccttgaaaaccatgttaatattttgtatacaattgaagcatctgaaacttctgaagaaaacacaaattaaattttggcggccgttttggccaatttgtcccttaactctataaaccctagccatgttatgggtggtggcgctattctggccaatttggcctatttggcctattattacacttttcacaacgacctttacgacgttttacaatgtgataaccgtg

SEQ ID NO: 693520 - DNA, 233 bp, Homo sapiens
caacactaaatatacaatcaaaacataaagtatatattaagtattttatacccaaataacataacataaaaaaagttttaaaaaataaacttttactaacctttaaatttttttggggtttaactgtttcttcttcttatagtaaatgtgaagtatcgattttagaggctcttggttttttggattttgattttatcaactcttctacaaaatcagattcagaatctgatgag

SEQ ID NO: 693521 - DNA, 186 bp, Homo sapiens
atgctatccgtgtcgctcattgaggataaagtttctggagacccttttggaaggcagagactcaaggctgaagagatggacactgagggcaggccagagcgcgattggggtggacactgagccaaggtcaggaggcagatgaggcaaactactaagcaggtcaggcagtcagcagctggaggagcg

SEQ ID NO: 693522 - DNA, 130 bp, Homo sapiens
cggtaccggtgcgtctcggcgcggctgacgttggtcagcatccgcaccagtcgccacttcggcccgaagtggctttcgatatcgccgagggtagtgggcgtgtcttccaccgtgtcatgcagccaggcgg

SEQ ID NO: 693523 - DNA, 163 bp, Homo sapiens
tatcgtgttcgggcttgaccgacggactttatggtgcaaaccgtgcaggagaaaaaaaaaaaaggtgcgttgcttacatacagggggagggcggttgcctaaccccacctttttaagagggaagctaactaaattggctttccccaaaccccaaacacggatg

SEQ ID NO: 693524 - DNA, 188 bp, Homo sapiens
  misc_feature (3)..(3): n is a, c, g, or t
atntccgttcttgaggtgtgttgtctttctctagtgatcaggaacttgcagtccttgtgcaaagaggtcatcgctctgcacacttgtggtgcaggcggggaggtggaacgccagtgtcacagccgcagcactctggggcatgtttttcttcaccccatatgctgtggaagtggtggtggtgccattgg

SEQ ID NO: 693525 - DNA, 370 bp, Homo sapiens
tttctgagaagagagcctgtgcacatattgaatgctcagggttaaataaatgaataaataaatgccaaagtgtgtatataatatttccatgagtcgtgtggttgagaggcatatgcagaattgtgttaaatggtcactctcttgacacacaagaagacaggcattcgaaaatttttatcttcatgacacgtctcctcaagcttcttaatacaccacaagatacgcaggctgtgctctagccacacagacaaagacacctggaggccatatatattttatagaactcagggtttagagtacataacgcaggcatgatactcctatcaagagtgtcaaatgtgcccactgtaatgaaagggtgatgtctact

SEQ ID NO: 693526 - DNA, 1463 bp, Homo sapiens
ggtgagtctctggcgtcccaaattgcctgtttatctcgcagtgctctagttccgtgtctgctgtggttcgcgcatgcctctaggggaagacgaatggccagtggcagctccaacagcacagcatgtggcgctcggtctggccgtcgagaaggctggttctactagaccgacagacacattgtgaacgaatgtatgcctgtcttcctatcatatcggagtctgcaagactagcaagatgagatgtagatctgggagtgtgagagtaaggtgcaagctatacgcaataccataggttgcggctatatatgggcatgcaggcagacatcactgcatggactgtagtgtggccggacttagttcccacgtccacgtcgtgattcgaccgtcgaataatcccatgggcacatggcaaggctacgatacttggtaggtggtacacgacaagttactgcgaagaatgtactacgtgctagattgaaggtggtgggcacaatacgatccataatcctttgtgtgttagcctctatgcggggtgtaagaagtgcgaacgtgtacttagcgcacgatgtcggtgcgtacaggcacctacgcgcacgcacattgtgaccgtatgtgccgttggcaaattctttgcccctctgtggcatagggttgtgcgacctttgtgcggcgcaatgccattgggaattccattatggcgtccattccacacgagagaaggaaaaagaatccgtcacatggcgtactacgttggtttacgtacacgagcaaatcaaaagctcggtagtttagatgccaccattaatctatatgcgatagagagcccattaagaacaactcgccgtactccggacgcaatagcccacccagggaactgacatcttatagtagcggcacaaagagaactagcgaattatcagggggaagcgaatctgagagagaggccaaaacatagggtttcgcctccacttggaccattctgacgcgttgttcaaaccaacatcacaccatcatggaccacaagatgggcgagcaaataacgagttgaaccccattggttcgccatagcacacacaagctaccttgtccggccggggaccggggaactgtcgcaccgcagacgataaggtggcgataacaaatgcagctgtagccgccataacgctattgtcgacttccatatgttggtcccacatactatggtacgaagagcgaccaattttccaaagagccgaagagtaggcacgtattgaaacccacacagagagattgacaccgcattcactcattgcaccgacttgcagaagccgcgactggtgtccccacaaagtattatgtttcaatgatgggcctagatatctagcccaacggtggcgcgaacggagtcgcaatataaaaagacgcatcgacgatactccatatgtaataagacagtgtcactagtgacccaatgcgtgtggacc

SEQ ID NO: 693527 - DNA, 316 bp, Homo sapiens
  misc_feature (57)..(57): n is a, c, g, or t
  misc_feature (211)..(211): n is a, c, g, or t
  misc_feature (220)..(220): n is a, c, g, or t
  misc_feature (226)..(226): n is a, c, g, or t
  misc_feature (248)..(248): n is a, c, g, or t
  misc_feature (265)..(265): n is a, c, g, or t
  misc_feature (275)..(275): n is a, c, g, or t
  misc_feature (294)..(294): n is a, c, g, or t
caccccattgccactactcagacagcaccttcaaacccaacacacaaaatccacagncaggaagacaccccccgcagacaccaagccttttcctcctgcccaatactgttctctagattcagaaataaaataaaacccttgggagagcaggagtcccggccagcctcggcagcaccaggaccaaaggatatgtacaaccattaggtgaganagttacatnacagtnaaacaccaaggaggtttagaanatcgggagacttggaantaagatgganatctgtggagaggctgtanagttttacaggtttgcactagg

SEQ ID NO: 693528 - DNA, 219 bp, Homo sapiens
  misc_feature (12)..(12): n is a, c, g, or t
  misc_feature (65)..(65): n is a, c, g, or t
  misc_feature (195)..(195): n is a, c, g, or t
ctcccacctcancctcccacagtgccaggattcccggtgtgcaccaccacgcccagctaattttnaatttttttgtggagatggggtcttgctatgaggccaaggctgatctcaaactgctgggttcaagcgagtccgcacctcagcctccaacgtgccgggattacaggtgtgagccaccacgcctggcctttnatgacattttgatctaataaccaa

SEQ ID NO: 693529 - DNA, 455 bp, Homo sapiens
tatccccaatgtcattagcgaaccagtctgtggtactttgttatggcatgccctagtcaaactaatacacgctaggaatcagaataccaacaacagaaaggaaaatcctccctaaaaggggactcgccggtacggtggctcatgcctgtagtcccagcactttgggaggtcaaggcaggcagaccgcttgaacccaggagttcgagattagcctgggcaacatggcaggacctccctctctacaaaaaatacaaaacttagctgtgcatgttggtgcatgcctgtagtccctgctacctgggaggctgaagtggagggactgattgagcccaggaggtcagggctgcggcgagccatgatcacaccactacactccagcctgggtgacagagcaagaccttgtctcaaaacaaataaaaggggaattggcaggtagtcacagaattggactcatg

SEQ ID NO: 693530 - DNA, 736 bp, Homo sapiens
tcagtcactttggaggttgtcacaacgtcactatcacatgggctgtaggatgcatatgcatgatttcctaaactgcttgtagaactctccttaacaatctcaactaccctatttgtccctgtggccctggtgccacaggctgacaacctgcagtctccagtttacaataaatattccatagtggtgacatgtctagctgcccactgatacctcctttggaaaagtggtgcgctgtggatcaagacattttggtatgatagtcatatatcattgttggcatagactaaagaggtgtccagtagtgatctgagtcctccatctattgtcctccactaaacatattattgcatattcttatatgtggaagaatagattttaaagtacaagccaaatgattctcagttggtggaattggtagaaaataaagtaaactataaataagagcaagaatacttggtttagttgaataatagcagcataagtttatgaacaaaagaaacataactgaggttgcatctaacaagttgatcgatggttgttccattaagttctggcgtgagaaagacgaggtgattggaggggaagaactattcagatatgggactaataaattggttttggcaattgatgacctagatcgttggagggaacagtgagggctaatcggaaccaactctgcttcccctgtgtggtgctgcggtttgaagtgttcaatatgaagcggtggtatttaccg

SEQ ID NO: 693531 - DNA, 1469 bp, Homo sapiens
cgggactttgtgggagaatccacacatggtcgccatcgcatgcgtgctatgtctaccggaagcagacaaagaagcatggagcaatgagtcgtgccacggcagggggacagactcgtgccaatgcacagacatgcctccgcacagcaggcaggtgcacagcaccatctgtggcacatgcagcagcaggagacatgaatacaggcaacgggcacgcccatgggcaactgcatgggaccggtcacgatcagagatgacaacatatcggcatcaatcgtcattcaccatctccgcattcgataatatatagttacccgatagtaaatatattgatattaagctaatatgagataaaatgacaatgacgtgccattgcactaaataacacgagtattgcgatatgtacaagtatctctacgacagtaactagagcgtactgctccacaacttgaccaggtggtgtgacccatacgatgacatgtgtactattaccttgtaatggctactgtaaaaaaacagaacgaacaccaacgtgacgttcataaccccatagagactacacagacaaagacacaaaaagacacaagcattgactcacagggtatgacgatagtgtaactaccataccacctgtgacgaatactacctactatgggaagccaaagagacttgccacgcatagtggccaatctgatgccctctgtgtcaaccgctagacacaaggaaaggaccaacacggacctcatccgtgtcccccctatccatacgagctctataaagaatcaaacagggttaaaaacatccgggagtttcagttatggattatgggattgccacaagatcaacattggcacggttaccgacacgcagattgggaggccccccgtggatggagcatcctataacaaatttaacgcctttcttggcacaacgagacagttacagaaaacaccagatgttaacatccaagacgatatagctaaggatggcaggcagtgggaaaggcatggaaagaccagagacagtacaccccggattaccacaacacgtgcaggcacaaacgcggaagtaacgctgtagtgacgacgcagagaacgagggctggcacaagacaatgggagacagcgaaaacctaccccggtacacaaaacgatatgagaatagaaaaaggacccccaggggaggacaagaaaaaagaaccagagatgatgcagtagaatacaaaataacacaccagagaaaaaccaatacagaacgataacaaaaggtagataaagataaaatccacaacggggagaaaaaataaactatgaacagacagagataagtatacgaatggaacaacaagacggacagctcacgacagaacataacagtagcacaagatacaacaacgaacacgagaacaacaccaaccaaccaaccgataagaacgatacaacgagacaacagagcacaaccaacacagtaaa

SEQ ID NO: 693532 - DNA, 873 bp, Homo sapiens
cgcgtgccgaccgtgatgtctccagaaccaagagaacgtggacgcgaagttagattccgtcaacgctttgtgagacgaaagcacgcgctcgtgagcaggctgatgctgcatgtatgcagtacatgtaacttcccacagtctctgctgaagtagtgctcaacaaattatcctgggtatcttacgtcgccaagcaggttatgatgcttggtgtgtcacatccccaagacccatgcttgaaggagttccgcatcacgaagcctcatggctatgagggctgagataaagactcagttctacataggttgcctgcaggatctgcggaaggtctaatcaaaactagcttggacagaggaacgcgaaaagtcctgtatcgcctcagacgtgtgagatgtcgggcgatgagggccaacctggaacaggcgtgctaccgacacgctgcgggctatcctagtcgttgcggtgagcgaaggacttgagttaccgtggcggattgcccgagggtgtcccgtacagttttagcggcgttattcgcatggtttcctggagagtgtcccccacagagttcctctcaggaacaaccaaacgtgggcaccagaactaatccccaagaagaccgtaaagggtacttcacaggggatggctatcagtgcgatgtgtgtggaaccccagcttggctggttggcaacacctaggaagcgccgcggccgcaagtttcgttggccacctggaacacgccggtcccagcgcacacatgggcgccgcggaaagctctcccaactgggattgacgaaggtcctcacccctttcaacaaggttgacttccccaaggtcgacaccaagggggcttcacgaacagcaatacgggaactcacc

SEQ ID NO: 693533 - DNA, 326 bp, Homo sapiens
  misc_feature (168)..(168): n is a, c, g, or t
tattatttatatatttttatttttatttattatttatttattattaataataaatatatttataaataatattaaattatatcttaaattttttaattactttattttttcatttattacattttattaatttatttataatttattaaaataaaatataaaaattanatcttttttttaatataaattcaattaattctattccttaattttatcaattcatactcataaagggtattgggataattatcctatttctatatttttaatttttacgggtactaatgggactataagggtaaacccattttagggtcatacataaa

SEQ ID NO: 693534 - DNA, 627 bp, Homo sapiens
  misc_feature (208)..(208): n is a, c, g, or t
  misc_feature (395)..(395): n is a, c, g, or t
  misc_feature (567)..(567): n is a, c, g, or t
aaaaccagaagtgcccagtgggaaacaagaatcgagtctcttacatctcatagaagttcttaaacagtagaacaggatgggacgaagaacaggagatgtctgctagtgttctctctcaagaagtatcccataagtcgagacagcaagaggaaagcagatgtcgtctcagcaagatgcgtgtcttccatgtaaatgaggcatagtccgntctgcatgtatcgatccacacaagaaatggaccgtggactatgcagctcagcccttagactggtaaagcaaaagaacatcaagggtcaaggatctggaaggcaaggaaggaaaattggctaaacattgacctctattggttgctgcacgaaggtgtaacaatgcttccgaatggcaggatctttggngagggcctaggtcttctcgagggacccatgtgtcctggtgacagtgaagagctggatctgaagccacttagcaagcgacagtatcggataatgcgctaatgtcattccactggacctgggagctgggcataggtgggaaggtcaccgttcgacgtacattataaaagcctgngcttaccagttaccagaaacgttcacttttctactacgtaagtggcccgaagcaagctta

SEQ ID NO: 693535 - DNA, 470 bp, Homo sapiens
aagattctgtggccttgtagaatgaattagagaagaattccctcctctatttattttctggtgatagtttggaaagacttggtattaattcttctttaaaggttctggtagaatatcagcaataaagcctgtctggttattaggatttttttgttagtagaatacgaccgttttactcactgacttctctcgtcatagacttgtagattggatactatttgtagttttctttatcctcactgggcttcaatgctttatagagtagtactgtgtccagcgaatttattcatttctctttaaccttttcacaatttattgagcatatttgtttttcctcagtatctctctaatagtatcctattatattttctattgttgtccattgttgacatatcctctatccgtttatgattttttcaaatttgagtctctttttttctttttttctgagtttcactaacgttttgttg

SEQ ID NO: 693536 - DNA, 471 bp, Homo sapiens
gctgtgctcaggagcgcctggtcactgccctgcaaaatgctggcaacgacagtcttgaaaaagccgctgatgtagtagtgagataggtatgaaggttattgaaacacctgggccttccaagatgtccaaaagtatggaactccacgtgaaatccagctcagtgaagctaagcacattgcagaagaggcagataggaagtatgacgaggtggctcgtcagttggtgatcattgaaggagacttgtaacgcacagaggaacgagctgagctggcagagtctaagtgttctgacctggaggaggagctgaagaatgtcaccaacaacctcaaggtctcttgaggctcaggcggagaattactctcaaataggaagataaatatgaggaagaaatcatgattcttactgatcaactcaaggaggcagatacccgtgctgagtttgctgagagatcggtagccctgtgggaaagta

SEQ ID NO: 693537 - DNA, 528 bp, Homo sapiens
  misc_feature (22)..(22): n is a, c, g, or t
  misc_feature (516)..(517): n is a, c, g, or t
cccaaaaaaggcctgttaaaangtttaaggggtcccccctccccatatatttaagccatgtgggtagggatttaagtacacccttaacaaactttttggggtttttaacaacattttccccaaattttccctacataaaatagatattatttttgaaaacagggaaaaaatgttttgttaatgtttttgtaaaattaaaaaaataaatgtcctgggagacccaggcgtggtggctcatgccctataatccccagcactttgggaggtcgaggaggggggattacttgaggtcaggagtttgagaccgccctggccaacatggtgaaaccccatctctagtaaaaatacaaaaattagccgagcacagtggcgggcacctgtaatcccagctactcaggaggctgaggcaggagaatctcttgaacccaggaggcagacgttgcagtgagccaagattccgccattgcactccagcctgggcgacagagggagactcagtcacacacacacaaaacnnccgaaatttta

SEQ ID NO: 693538 - DNA, 248 bp, Homo sapiens
ctgagcaatacccacgcaagattctgtcctaggggaggtaccacagctgacagaaggggacagcggagtctatgccggcggagggggcttgaccacagacgggggaaagacccagaaggtcaccctgattgtccacagtgattacgagccatcaggggaagagcagccaaggcctgagactccaaaagggtttcttcggccctattggtcccagatgcctgcttatgccagttcggggtaccgagctc

SEQ ID NO: 693539 - DNA, 239 bp, Homo sapiens
gagatcatgccacttcactccagcctgggtgacagagcaacactccgtcccaaaaaaaaaaaacaaaaacaaaaacaacaggagaaacattacaatctagtctctctaaagcctgcaccctggaggcgtcatctgcttgataaaaccttggtccccaaattcctataccattataacccagactttctttcctatggataattaattctcggccaggcacaatggctaacgcctgtaat

SEQ ID NO: 693540 - DNA, 787 bp, Homo sapiens
agcgggggtcgggagcgcgggcgtccggggtggctgcagtcccgtcggtctccctgctgtccggcgcgagcgtcttcgagtctggcttggtcggaagagcacagacagtggaaggggcccatgccgtcccttagctttagaggacgaagtctctggggctggcagtcgcaacgcccggtagaggggaagggcggcgagacccctgctgccgaggagccggggtcctgaagagctacgtcgtgtcttcgctcatgaagggatgtttcaggagcccctgagaaggacgaggaggaatgctgagggcccggtgagggcgcacgtgacctgtagggagctgctacatgcagctcgtccagggtgtgcaggagtggcaggatggttgcatgtaccagggggagtctggttgaacatggaagcttgtgatatggcataatgtctcgttggccacaggcgattcataccatgggcagtcttaccggtaccactgccatggtcggggtacctacatgtggccagatggcatccagtgttcaacgggcacattttgaccgtcagcatcgagaaggctacaggagccatgtacatgaaggacacggcttttccacgacatcagatgccagaacgagaattgtcaacgcttctcctgcgagctgtggggccagacggtgaagcaagtggctcaagatgaggggtctcacggaacctcagcatgtgtttcctcttccactagccccgtccagtccttcaagccccaatgtggtgaagcggaccatactgaagcccagga

SEQ ID NO: 693541 - DNA, 944 bp, Homo sapiens
gacgcagcagaaggaggaggcctagcactagcgatcgttcgggagcagcactcctctcactgctcatgttggatgtctatctactaggcgaagggctgaacaaggaagatgtcactgagcatgtaaaatagacagtgagttgtgttggttgccgtcctcagagcaatcggccgtgtgcgcatatccaggtctactgacggctgattctggagatctagctgcagtgcagaggcaagacgttgaacaactaaaattaatcgccagatagcgtgaatggccagatatgggttagagccctagatcccactctctggcaagcagcagtcttccgtagcacactccatagaaaatgctggtgtccttcatggatgcatgaacaatggagtattcagcattagggaaggaccagtatgcaggtaaagtgctggcgaaaggacaatgaccagatggatgattgttggattgagtgaagcatgatcgaatgacacatgtggaaaagaggaagtgagatcctatttgtcatctgaatcgatgctgtatgagtgtagaatgaaaatgaatgagtattttctagagtgtgatgagatcttacctgtgtgagtgaactctgtatgatttgtttgaactgggtattcaatgaaacctgtcaggcgtcagaaattatgactgtccaagaatgtacgtccgcgagtatgagggtattgagtggcagataagtggataggtgaaggttaagtggagtagtgcggcataaatgaatagggtggggagactagacatctaaaacgctgattggttgggaagaagtcattcttcccttggggaaagcgagaaatttagtggggtttaaaagcgccacagggccaagcgtgacggccttgttgggaacggagggcattggacatctggtgaaaggagcttgatcattttggagaaaaaagcag

SEQ ID NO: 693542 - DNA, 184 bp, Homo sapiens
  misc_feature (25)..(25): n is a, c, g, or t
ttaaaacacgcaatctccagtctgngtgacatagcgagactctgtctcaaaaataaataaataaataaataaataatgtaagaattctctgtgggaaaatgaattataggtgacaaccagtattacaagatgacattttccttactcccttcccacctcttcccttaagctgtgtgacccctga

SEQ ID NO: 693543 - DNA, 137 bp, Homo sapiens
ggaaacggcttcacatggaagatgcgagacggtgagtcactgacgtcaggagttgaaccagcctggccaacatggtgaaaccccatctctactaaaaatacaaaaatcagaataggtgttggtatagaatggggtct

SEQ ID NO: 693544 - DNA, 304 bp, Homo sapiens
  misc_feature (132)..(132): n is a, c, g, or t
gggggggggggggggtcggggggggggttttattaaccaagcctttttttttaaccggcaggtcccctgggagcccccttcccccttttttttccccccttggaagccccggggccggtcccccccccgggntttagggtggggcggggggggggttaccattttcccccgggaccccctttggccctttgggcctttttggggccccttttgaaccagtttgggccaaaaaccgggggggggccgggcggggatttccggggttttaaaaacttttttattaattttttcccctttttaatta

SEQ ID NO: 693545 - DNA, 241 bp, Homo sapiens
aacgggtgatgcggttgtgcatgcctgtaatcccagctactcaggaggctgaggcaggagaatcacgtgaacccgcgaggcggaggttacagtgagctgagatcgcgcctttgcactccagcctgggcaataagggtgaaactctgtctcaaaaaaaaaaaagggagggaaagggaaaaggaaaaatttcttctttggttaacctcctggccttttccctttaaaaaaaaaaatttccaaa

SEQ ID NO: 693546 - DNA, 170 bp, Homo sapiens
ccaagggtcagggcccgggtccactctttccttaggttgagcacctttaggccctttaggttggggaagcaaattggaacccatggcaataataggagggtgtccaggttgggcccctcccttggtcctcccagtgtttgttggataataaatggaactatggctttcca

SEQ ID NO: 693547 - DNA, 568 bp, Homo sapiens
ggacgcgtgggtcctgggctgagtccgcccgcggtcccggcggcgccacggtgcgttcactctgcccggctccaagccagcgtccgccgccggccgtatggctgccccccggctcctcgccccgctgccgagatggcgacgcgctcctgtcgggagaaggctcacgaagctgacgagcagcacccgctcatcctatcccagcttttgagggaggaggaccacaagtactgcgccgactgcgaggcccaaggtcctcgatgggcttcctggaatattggtgtgtttatttgcatcagatgtgctggaattcatagaaatcttggggttcataatatccagggtccaaatccagtccaacctagacccatggacagccaggacaagattaccagtgcatgccagatatggggaatacttaagcacagactactttatgaagacccattttccagaggactttcgaagaccacagacagatcacagcagtggaatttttcatcagagattaatatgaaagaagaaatactacgattaaaatgccatagctattaccaattaagaaaaggga

SEQ ID NO: 693548 - DNA, 420 bp, Homo sapiens
gaaagaaaacaatagaactatgacttgcaaacttgaagtagaagttactttcaactcagaattttatacccagaacaaattactgatcaaatgcgaaggaagaataaagatttttttcagtcatgtaagatgtcaggaagtttttgttttccatgtattcctttctcagaaagctactaaaaaatgtactccaaggaaataagtaaaccaagaaagaaaatacaggaaacagtaaacaggggaaccagtacaaaagagggcaaagaagtttaaggatgatgaaaagagaagtccctggataacaactatgaaataggcctagaaagtaaccagtcctaattgcattaagaggttccagggttagcttgtctcaggaaatgaagcaaacaacaacaaaaaatactaactggggatcctcta

SEQ ID NO: 693549 - DNA, 1419 bp, Homo sapiens
gggaaatctcgtcaaagaatggcgatcgtagttgtgtgttcttttgtgcagattgaggtgactggatctgcttatgactgtagcctaggcagaacacagagtgcgtcgctggaccacctggactcgaacgtctgtataggatccacccgaaaggcccgttcttgcaactgttctaggatctactacagacctgaaattgtggccgtttcttagcagcgtatcatcggaggtaattgaaatgaacgacggcattgttgtacgggcaatcagacattgctcttggggtcgagtggctacttcttggcattcatggatgccctgtaaagacagggatacatagagtcaatgttgccttgtgaacgccacgcaatcgtatcaccgtggagggtgaaccttgtggagttctgcgctgtcaccctgcgtagagtcgagatgcactgtggagctatttctcgccgtgcccaacatgcatcgtaagcagagtggcctgagcgtctagctcactcgttcaacgtctgggtgtcacgattccctccttgttggtggaattccagtgggcgcgtgcagtgacttgtccctctaagagacactagcctcgtttgtccagaggagccatacgtgcccggcgaaaggtgtcctctctgtgaacttccccgggcgtattcaatgcatacccgcttacttgagcggaacctctcgccggattctatccacagtggaagacaaatctctggcagaacccaagtatttggagccaccgttcgggagaatatcggaagtctgcggctcgtcaagaacgaaaagcgaactatcgggaagtgcgagattacgtgactgcaccaaatcacctggccctgcctaaaagttccggttaactcactacaagaggctggcagtctaaggggaacgaattgcgagagaggacgcgtgtggctttgttaggcaagaccactattgggtcatggaggttgcgcacctggccggagacttagaggcttcactctataaggggatactggaaatgcgttggcttcgttgtagagttgtgtcccctttaccagagagagtcctccggcaggccctagtaagcgtcccttgggtcattttccatggcatggttgaaagtgcctattggagcatggaaaaacccatcagtgccattgtactttgactcattcgttcactttgacctccgatttcttcgggggtacgttaccaattgagccgccaagttcttgggactggagagggggaaaaaaactgggtaccttggtggttatgcggagactaaaagcaccacaatgatttgtgggccagtagaggtgtcttgggaggattggatcctttcgatccttggttgggcgactatgaaccatgtgcgcgagatccccctttggaaaaaaaacattggtttgggtc

SEQ ID NO: 693550 - DNA, 407 bp, Homo sapiens
gattctattcaattcctttacaatccattcgattcttcacaattcaattccattccattccattccattccaagtgggccgaatccattccattccacttcgtcccattcccttctattctgtgccattcctttccattccattccattccattcccttcctttcctctcgggttgagtccattcctttccattcctgtcgattacagtcccttccattccactcgggatgattccattacattccattgcatgccaatctaatccactccattccattccatttaactcgaattgattccattccattccattccattgcattccattcctttccattccattctggtgcattccattccattccattcgcggagactctattcaattcatttactctccattaca

SEQ ID NO: 693551 - DNA, 173 bp, Homo sapiens
gggcacccccgccttgatcccttttgcagccacggacctccttgtgagtagactaggtcgctgcccgcgcctccttcctccccctttgaatgccacatggcacgtgcctgaacgtgccccccctcatgggagtcgagacattccttgctcgaccacaagctcatgccctgggg

SEQ ID NO: 693552 - DNA, 362 bp, Homo sapiens
gggtggtgatctagaggatcccggacagcagacgtaccggagtgcagtggcacgatctccgcttactgcaagctctgcctcccgggttcacgccattctcctgcctcagcctcccaagtagctgggactacaggcgcccgccagcacgcccggctaatttttggtatttttagtagagacggggtttcaccgtttttagcgcgggatggtctcgatctcctgacctcgtgatccgccagcctcggcctcccaaagtgctgggattacaggcgtgagccaccgcgcccggccggctgcttcttattctccttcttattctctgggttgcaattggtttatcacttctcaaagaggttttctct

SEQ ID NO: 693553 - DNA, 471 bp, Homo sapiens
  misc_feature (284)..(284): n is a, c, g, or t
  misc_feature (373)..(373): n is a, c, g, or t
  misc_feature (383)..(383): n is a, c, g, or t
  misc_feature (451)..(452): n is a, c, g, or t
  misc_feature (471)..(471): n is a, c, g, or t
gcaacagagaagcctgtgattctaggaagatctattctagcactgcaacgcaggatgaatcagatggccgctagacctactccttatagaggtgcaaaaaggcctacaatcacaaaacacttgtgcaccttaaagccacctgtcagggctatgtcctcatgctgaggtcctacaagagggctaacccatgtacactctgagagtgatgcagggagaacctaatacttacaggccttagagcatgaaactgatatcctctgtgactgatcatttgagcagctggngcatttaggaggtgtgagaagagaccaagaggagaaaaaattggacactgtaacatgtaactggagcctaagaaatcccttctcccatngttccctagngaatatttacaatttcctgatttcaaaaaacacctttaaaagctgggctgaaagaactgtttactggnngcatctttaaatgaaacan

SEQ ID NO: 693554 - DNA, 199 bp, Homo sapiens
acataacccacacatgatcaaaccaacacaaggcatgcacataaggaaaggtaaaaaaaagtaaaaggaaaacggacaaatctaaccccgacctgtttaccaaaaacatcacctactaacatcaccagtattagaggcaccgacctgcccagtgacacatgtataacggccgcagtaccctaaccgatgaaaggaagtt

SEQ ID NO: 693555 - DNA, 690 bp, Homo sapiens
ctaaccagggtagctgggcacaatagttgagcaggattctcattaggctatcgagagaatcaggcagccatccatagatcaaagtgaatgcacctatgtcagactactgcatacctctacgtcgtctgggaatcttacctagtctggcacgtgggaatggatgcaattaaggctactggagtaccctgaaactgtcacgaagcttgatgcaatgacatactgcacacatctcactctgagccagttgactatcacttgtcccagcccttgatatattggaagattagaggggaattgccagaagtaaaccaactgtctgctgaaagaaatagacagatatcgaataacttggaaaaatgagtacttacgttcggtggcaaaagccaaacacacacctgagtcttcagagctcagagtaataggtggggctgaaactgcaataggcatacaatgaaggtcctttgtccatccgttttaaaaggtacgggttggcctgggcacagtggctcacacctgtaatccctacactacgtgaagccaaggcaggaggattgcttgaggctcaggagttagagaccagcctgagtgacatagtgagactttgtctctacaaaaaatgctctgacattagccaggcacggtagcatgcaccaaggatcgcttaactcaggcgggcatggatgtcttcga

SEQ ID NO: 693556 - DNA, 145 bp, Homo sapiens
ggggactgggacctggcggagggttttggccctgttggggttggaccctgggatgtggggccttgtggaggcaccctgtggtgctcaccttgcagcaggcgagagtcgtgggaggagacggaggtgagggtggagtagtccccgg

SEQ ID NO: 693557 - DNA, 287 bp, Homo sapiens
gctcgaccttatttagctgtacaatgtcagtgggttctgtgatttcctcagtggcttatggtgtagtagttagtagaggctgtggtgaagtttgggtaggaactggaatgccaggtgagctagtctttgggcctgggtggtgatggcagtgggataatcatgcctgttcatggccccatggtgacgtacgctggcactgattttaacttgtgcaagcaggctgattcttggggctccaggtgacttgcttgggtaccagcagtggcagggagggtgggcaggttctt

SEQ ID NO: 693558 - DNA, 400 bp, Homo sapiens
tgagatggagtctcactctgtcacccaggctggactgcactggcgcgatcttggctcactgcaagctccgtctcccaggttcacgccattctcctgcctcagcctcccaagtagctgggactacaggcgcccaccaccacacccgactaatttttttttgggatttttagtatagacggggtttcatcatgggagccagtatggtttcgatctcctgacctcatgatccgcccgcctcgccctcccaaagtgctgggaatacaggcgtgagccactgcgcccagccaagatgtgccatttttaaggaactttttgaatggaaaaactactgccagttaaactgggcttacttatcacttagaatttctacattcttctaagcgctgttttggactaaatt

SEQ ID NO: 693559 - DNA, 194 bp, Homo sapiens
acgacaggcttctggagggacgtaaaacttcagatagtgtctgatataagacaggtagaggaggtaccacataaaaatggagtcccttatttaacacatatttaatagaggcaccctattatagtgtgacactaaggataccagaggtaaaggacaggagacttcacctaattgagaaaaaggccagccaaagt

SEQ ID NO: 693560 - DNA, 163 bp, Homo sapiens
tcgagctcggcccccttacaatcatggcagcaacgccacttatccaccacaccaccactgaggcgtgttacggaggcgctcgttacggacgttacggaggcgctcgttacggaagcgctcgttacggaggcgctcgttacggatgttacggaggcgctcgtta

SEQ ID NO: 693561 - DNA, 148 bp, Homo sapiens
ctactccgtatctcaggctgactgtgctgtcctgatagtagctgctggtgttggtgaattagaagctggtatctaccaagaatgggcagacccgagagcatgccctactggcttacacacatggagtgtgaaacacactaatagtacg

SEQ ID NO: 693562 - DNA, 386 bp, Homo sapiens
  misc_feature (179)..(179): n is a, c, g, or t
  misc_feature (184)..(184): n is a, c, g, or t
aaactagacagaaatatcaatgtttgcctgttggtttctacttatgaaacttatgtccatatgtactgcataatttcattccattaggtgatagtgtgcatttttttctggttgggggagagaggagaggagagaagaggagctcttttgtggttatttgtgttgtgctatttatcatnaattnttgctacttgtggcaacaccttcccatatttgcgtgtgagatatcacccttctaattgtaacatttaggtaaaatcttatcatcatttactgtgttggcttaagccagatggactgttcattccacatgtgacaatgattggttcagattagggcaaatacttcattcttaacaggactattattttaaagctgctcctgtt

SEQ ID NO: 693563 - DNA, 389 bp, Homo sapiens
  misc_feature (2)..(2): n is a, c, g, or t
  misc_feature (261)..(262): n is a, c, g, or t
  misc_feature (265)..(265): n is a, c, g, or t
  misc_feature (283)..(283): n is a, c, g, or t
  misc_feature (286)..(288): n is a, c, g, or t
  misc_feature (290)..(291): n is a, c, g, or t
  misc_feature (294)..(294): n is a, c, g, or t
  misc_feature (296)..(296): n is a, c, g, or t
  misc_feature (298)..(299): n is a, c, g, or t
  misc_feature (301)..(303): n is a, c, g, or t
  misc_feature (306)..(306): n is a, c, g, or t
  misc_feature (310)..(310): n is a, c, g, or t
  misc_feature (312)..(314): n is a, c, g, or t
  misc_feature (316)..(318): n is a, c, g, or t
  misc_feature (321)..(321): n is a, c, g, or t
  misc_feature (323)..(324): n is a, c, g, or t
  misc_feature (385)..(385): n is a, c, g, or t
ancagatcaactggcctctcggtctgtacaaagtgtggggcgtgaaacgcctgggctgcccccacttctcccataattccctgccctagagcagcacctccagagctaggagaaggagagggggccacccaaggccttcccttgaggagaggggtcaggagtggactggagtgggggctgttttctatctgagggaggcaaagaagcagaggagaaaactggagtggcggaaccctcccgctcctcatcccgtcccctgtnnccncgccccagagtccactgnatnnntnnagngncnncnnncancctnannncnnnctnanncattatccattccacttccatttcatatttccacgcctctttgcatgccatttgtgcatantgcc

SEQ ID NO: 693564 - DNA, 362 bp, Homo sapiens
  misc_feature (310)..(310): n is a, c, g, or t
gtttgtctgctgttaaacagcagacaaaactccgagccctggccgggcccaggtgtcacgcctgtaatcccaacactttgggaggctgaggcaggagaatggcatgaacccaggaggcggagcttgcagtgagccaagatcatgctactgcactccagcctgggtgacagagtgagatccgtctcagaagaaaaaaaaaaaaaaaaattagctgggcatggtggcacatgcctgtaatcccagctacttgagagactgaggcaggagaatcacttgaacccgggaggcagaggttgcggtgagttgagantcgtgccattgcactccagcctggaaaacaagagcaaaactccgtctcaaaa

SEQ ID NO: 693565 - DNA, 431 bp, Homo sapiens
gagcattacacacaggactaatatacagaacgctagaaggaatcaaacaagagtcagaagtaaaaaagaagtaatcctatcagaaagtgggcaaaggatatgaacagacatttctcaaaagaagatatacaaatggccaagaaacatgtgaaaaaaatactcaacatcgctaatcattagggaaatgcaaaataaaaccacaatgagagaccacgttactcctgcaagaatggccattattaaaaagtcaagaaacaataaatgttggcgtggatgtggggaaaagggaaagcttataccctactggtggtaatgtaaattaatacaacctctttgaaaaatagtatggctattccttaaagaactagaaatagatctaccgtttaattcaacaatcctactactgggtatctacccaaaggaaaagaagt

SEQ ID NO: 693566 - DNA, 128 bp, Homo sapiens
gtctggccgctctagagatccccgctgcagtaggtgccaacccagaggcggaagtactctgggaggacgttactcgaagatccagaggtcgtttcactggaataaatctgcgtgtgtaggagcagagc

SEQ ID NO: 693567 - DNA, 757 bp, Homo sapiens
  misc_feature (47)..(47): n is a, c, g, or t
  misc_feature (81)..(81): n is a, c, g, or t
  misc_feature (89)..(89): n is a, c, g, or t
  misc_feature (111)..(111): n is a, c, g, or t
  misc_feature (267)..(267): n is a, c, g, or t
  misc_feature (273)..(273): n is a, c, g, or t
  misc_feature (352)..(352): n is a, c, g, or t
  misc_feature (354)..(354): n is a, c, g, or t
  misc_feature (368)..(368): n is a, c, g, or t
  misc_feature (567)..(567): n is a, c, g, or t
  misc_feature (586)..(586): n is a, c, g, or t
  misc_feature (627)..(627): n is a, c, g, or t
  misc_feature (668)..(668): n is a, c, g, or t
tttgtttcatttttattatgacaaacaattttcaagtctatttcctntatctaaatacaaagctaaaccacaaacacgcgnataactcnagacatctcgtgtctcacattnacactcccatcggatcctcttccaatttgctgaccactgaccaggctagcggggggtgggagggaagactttcttaggtagcaccgtcgtgaggcccgaggtggggttgggggggaatcaaagacgaggacagacctctcatacctgtttccattnacattnacctgggaccagggtgggcaggagaaaccagggcatggctcctgacccccggccccctggactaaagggacaatgtgtnanatcagtcctcgctnaacgagcgcgggaggaagcacgtcacctatccctcctgcctacagcagtcagagggtgaaaaccttagccactatccttgattcctgggggctgccgggccctgtatgcccccctgcacacctgggtgcctctctgaggctggcagcagccgccggggtcacgagcgcgtcctggcgctcctaggctcacacctaagcncacagtccgcctacttccnggaggacactggtgtgtctgaaaaacacaaggactcgacancagggctggaactttcaaccccagcaggatgagggggaatnggggtggatgttaggtaagttatttctggtcccactacaaaactttatttttgattagagtaccaatctcaatctcttctacaaaaagc

SEQ ID NO: 693568 - DNA, 461 bp, Homo sapiens
tattgatgtgggaagatggatatactggatagtgttcttttggcagtacgcataggatatgtggcatttgtgtcgtgcagctgttgactgttgcttgtccgtggttgtgactgtatgttgtggtggcattggatgtcttcacaattgtgactaaaagctgccttcggacacgatcgtgaacttgacctgccattttgtatatataccacggcatccgttgaatctcatgacactggttctagttcttgggcttgaactttaacaacctgctttattttctgacaaccactgctattctgattgctatggcgaggcaccatgtgaggcttaggcgagttagtagctctggcagggctcaaaggcctgacaggaaacggaccccaagtggattgagctggtggaaaagtacctccaaagtgggtcatgggcaaccttggtggacggatctgctggaaagtctg

SEQ ID NO: 693569 - DNA, 301 bp, Homo sapiens
  misc_feature (11)..(11): n is a, c, g, or t
  misc_feature (18)..(19): n is a, c, g, or t
  misc_feature (57)..(57): n is a, c, g, or t
  misc_feature (72)..(72): n is a, c, g, or t
  misc_feature (80)..(81): n is a, c, g, or t
  misc_feature (86)..(86): n is a, c, g, or t
  misc_feature (93)..(93): n is a, c, g, or t
  misc_feature (99)..(99): n is a, c, g, or t
  misc_feature (117)..(117): n is a, c, g, or t
  misc_feature (133)..(133): n is a, c, g, or t
  misc_feature (135)..(135): n is a, c, g, or t
  misc_feature (140)..(141): n is a, c, g, or t
  misc_feature (163)..(163): n is a, c, g, or t
  misc_feature (190)..(190): n is a, c, g, or t
  misc_feature (193)..(193): n is a, c, g, or t
  misc_feature (234)..(234): n is a, c, g, or t
  misc_feature (253)..(253): n is a, c, g, or t
  misc_feature (275)..(277): n is a, c, g, or t
  misc_feature (279)..(279): n is a, c, g, or t
ttcttgaggtnttttctnncatacaggccatgtcttcaagtctatgtttgggttcanttttctttgcataanccaggaannataantcatgcnaaagcnagttgtcttgccaccacnaaaatgagttctgaancnaaatnnaaagatgacatccggtgtggtnttgtacattttggctagtttttcccgnatntctgtcttaggcactgtcgccttcccggggtgaaggacatnaatgaccatttgtttcctntgaagtagtcggttggtcatgnnntntctagtgcggatagttacggtg

SEQ ID NO: 693570 - DNA, 106 bp, Homo sapiens
cttctagctcggtaccccagatgagcatgagggggcaataaaaaaataagctaagacaaactgagactggaagacaaacaccggaagggcctgtggtgggagctta

SEQ ID NO: 693571 - DNA, 168 bp, Homo sapiens
ctctagaggtatccccgcacccaggcgcacttctgctgttccttgccaccgctgctgctgctgctggcacgtccccacggtcggcggtgcaggcgtcccctctgcaagcgttatacttctttgcggaatgggccaccatcttcacctactaagactaggcaactctat

SEQ ID NO: 693572 - DNA, 84 bp, Homo sapiens
  misc_feature (30)..(30): n is a, c, g, or t
  misc_feature (42)..(42): n is a, c, g, or t
ccggtgtatccccaacccgacccaatgacnccaaacacagtntgggctcggtattatatattttctcattaaaggtttaaaagc

SEQ ID NO: 693573 - DNA, 971 bp, Homo sapiens
  misc_feature (402)..(402): n is a, c, g, or t
ttttttgtttttgttttttggaaaaagtcatcggagcccatggggtagggtcttgaaaccagcttgggggggttcgatcccttcctttttggtctaaatttttattgttatacgggttcttcgaatgtgtgggataggggtgtggggggcatctccataattagcctcacctccaggtttaagtggagggttctctctactattataggactttctcgctctcgaagcgaaggctctcctcaaatctcagtgaaaatttattaattataacgtgcgtgtaagagaaagtgaagtgagccatacagagtgaataggagtgtttcacagtggtgggtgatagtgcatctcggggaatagtctccgagtatacacgcgctcgggggcatctcccggaattagccnccgagaaaacagtctgtcttggtgcggcaagaaaacgtctatagaactctatagcgccgcgagtgacatctattgcatacgtggtgacaagtgggatttttgcggcggatacgcgttgtgcgcgctcccataagggtgtgtatacgccccgtgggagcaacattgcgggggcgcacaacactcccagcgttgcaatgtgacacgccccctccccatattttgtatggtgcgggcaacaatattacgagccctcacatatgtgtgcagatgcgcgaccatataggcctggcgcacacgtgtatgagcttaaccacaagcgtgtatatgcatacagcggcgtgtcttccggggggatacgtccacccgaaagtgcctccccaagactgagcattagacaggcttctgcggccgtaaaatttcaccaacagtgcccgcctggtctacaaggggcccccccccacattaccggggcgtgtcaaacaccacgacaaacggatagtggcgaacccccctaaggggcgggctccacaaaaaacccacctttcgtgcggaccgacgcaccacacatt

SEQ ID NO: 693574 - DNA, 128 bp, Homo sapiens
  misc_feature (14)..(14): n is a, c, g, or t
  misc_feature (111)..(111): n is a, c, g, or t
  misc_feature (118)..(118): n is a, c, g, or t
aggccagagccagnaccgcccagtctgcaccaaacccatgctcttcgattggggtaaaattcaaaaccagcagtgagtagatctttcctccgcataatgtttgtgatgcanatcctgnagtttgtttg

SEQ ID NO: 693575 - DNA, 908 bp, Homo sapiens
aaaaacaaacaaacaactatttaggaaattcttatgatctcgtacatgtaatgcttcggctcctttcgccgtaccatactactgtctcttacccactccgtggattctaaagacaggttattacccaatccagtatcgcccggcccgtgtggcccactccaacgacaccaataggttgtccaacaaaagaaacgttccaatttacctgaatctctccagcccgcttttctaggctaatcctcctctgtatctcgtgtttttcctcgccccgcccctgcctctcggggttgcccccgcgagttttttgggttcaggcccaagttccacagtcgggagccctggggcgcggttgtgtataggcgcgcgattattccgtggggggaatatacgcacgcgcggtgaaaaacggataaacacacagtgagcgccgcttctaaagtgtgcgcaaacaagggagcttcgcctagaagtttcctgaaggcaccgatggctcccaatgaggcgctttataatcggcccccgctgctgtgatgctgtcgccccgcgtgttgggaaaacaaaacaaacggcggatttgaattcggaggctcaaactgggaggagttagcacaaagcattatgtggcctcacgccgtgtggagccaccagcactttttcgcgcatgccggagttcgggtggattgacctcttatttttcagttccgcttcaagatgcagcaatgcacaacatcggtaaaatgggagatataaaaatgcgtaagaggccgcataaataaagagcaggcggtgggtgagataaagtggagagtgtaaatcatctccccgtcttaagtgagtcaagagtcagatgacccccgcaaaggtgctataaaccacaaaaagaattttctatatcccccacaaaaaca

SEQ ID NO: 693576 - DNA, 1122 bp, Homo sapiens
gacagttctagatcgccagaaacctggaaagttctttggaattcgcctgcaattacagtatatagtcatgtcctgcattacagcagtgcacaatcatttatccaagccttatgttatcattggcattatcattctctacttcaacaatcaccacacgtgtattcatcacattgcaacatgcaccagccccaacaattaggcattggttatacccaacaacccacatgaacagggcatttcacagcattcaatattatatattgtactgtttatgaagcagcaccatagctatcatacatcaattagctcagttcagcaacgagccagctcacaaaccagcgtgatacagtatcattgtatcttctgcacaacagatcccagtacctaagcagccaggcattctatcgcatcagttcatgtcgcagaagtgcaaacaaggttatgtcatggttcttggtcccaaagtacactacagttcttcacaacattccttgaacacatgcatcgtcaacacccattcataccttatcaacagggtttacatttcgacagcatgcgtgtctcaacaggtaccacgacatatttagtagatacagagtacgattattatacgcgtcccgtcagttacatagatagcctatctataacttaatcacagtactaggtagttacgcttctacagcaaacaactcgcaggtaagggccaaacgcaatcccagagattcattagatgcgcacaacaaccaaagaacaaaatctttcaaggggatcacgacatagaccaattgataaatataccatggcaagaagacgaagccatacgacacaaaacaacaaaacggacacgtgagacccaataatagcgcaacccctagacaagaataccagcgatccgcgaccaagagaaccaacagaaaagaaacacacaacggagaagacagtaacctcgcactacggaacaaacaacaagatatgacaaaacaggaaagaccgaaaggaacacggtacaaacaaacaagaaggaaacacaagtgacacactatatacacagacgcacaacaacataagcagagacgaagacacaaacaaggcgacccaggagagaacaccgaaaaaaaggaa

SEQ ID NO: 693577 - DNA, 219 bp, Homo sapiens
cctaggcaggacaggtggtaggctggtgagaactggcggtcacacagcaccagctgccgccatcaccgcagcggaagcactcgtcctcggacggcctcttcccttcccctttggctcggcgccgcctcgttttcttctgggtcttttggcccttttcctcggatgaaagggtcgtcgaggtcttgggtctatccccgaggaggaagaggtcagcgtggt

SEQ ID NO: 693578 - DNA, 1278 bp, Homo sapiens
agcggcgggcgctgacgtagtctgggcggtcggcttccactccttcaggcgtcggcagacactagtcgtggcgagaggggcggggtggacggggctggcgctccacttggcccccggatacaacggaccgacgcaaccgccgcagagggacacagagaacgaggggatatacttaggagacagagcagcgaggaaaaccgaaaaagaggacaagaacagacaacgcgcgcgcagaccgcgacacgaagacatgcggaccgagccagaagaaacagaggacaaacaggaaccagaagcaagaacagacgcccaaacacacacccaacgccctgggccaaatacaaaaacaacaataaatggacaagcgaagcactggcacccagatccaacagacaacagaaagaaacccaaaacacacctgagggcaaagacacgcaaaacaccaggaaacgcagacccgagcgcacaaggacggcacagaacaagaaaagcacacaaagacaacggaaagacaccaagcacgcagcccagagacagatcccagcgcacaaagaaaaccactaacgaacaagcaacgacgcagcacaaccacagagcaaggcacaacaccagcagaaggggaccacagaggaaaccgggcaagacaaacacacaacgaagagcgccagtacgacaccaagacaacaacatagaaagagaacagcaaccacaaaccacgatgcacagccacaggaaggcaccgcagaacagaaacagagaccaacaaagaaaagacgagcgcacaacacagacgacgaaccgaagcataacaacaagaaacaaccaaagacacaagaagacaacagacagaaatcaggcaacaaccaaacgaaacaaacaaaaagacaagagaagaacagacaaacgacaacagacaagacagaacaacaacacagaagagaaagcgacagcagaagagaaaagaacagcgagaggaaagggaacacgcgaacaacaaaaggacagaagcaacaaacagaaaagagaagggaacagcgagccacagagaaaaaaagaagacacagaagaagaagaaggaaaaaaagaggaacccgaagcaagcaacgaaggaaacggagaaaacgaacagaaacaagaagaggaagagaagcaaagcgaaagaaggccaaacgaaaaagaaagagagacaaaaaagcaaggaaagcagcggaagaacagaaagacataaacgcaagacagagcacacacaaaggcagaacgagtagaaaagagagaacc

SEQ ID NO: 693579 - DNA, 151 bp, Homo sapiens
tagctctctgtaataccatttgagctgaatatctggttttgagacggagtcttgcctattgcccaggcctggagttgcagtgggattactcgcgtggagcccgcatgcctggtcagactattctttattgtacactttaaagctgtaattt

SEQ ID NO: 693580 - DNA, 183 bp, Homo sapiens
ctggcttcttgagaatttaccaatgtgaacagagtacgtagttcatcaggcgtcccgtaaaagcgaccaggaaactgactgggtctctttggctaccggattaacattaaaccttgatgttctgtattctgtactttacttggaccagcagactttcaacaactcattgaaccggatagcttg

SEQ ID NO: 693581 - DNA, 101 bp, Homo sapiens
tgtccacacatatccctattctccaaactgatgaaacttcctccaaatactgcatctcacgaggtacttttcctttctctaaacttccaattaacttgaag

SEQ ID NO: 693582 - DNA, 517 bp, Homo sapiens
  misc_feature (335)..(335): n is a, c, g, or t
  misc_feature (364)..(364): n is a, c, g, or t
  misc_feature (372)..(372): n is a, c, g, or t
  misc_feature (399)..(399): n is a, c, g, or t
  misc_feature (422)..(422): n is a, c, g, or t
  misc_feature (442)..(442): n is a, c, g, or t
  misc_feature (448)..(448): n is a, c, g, or t
  misc_feature (494)..(494): n is a, c, g, or t
  misc_feature (502)..(502): n is a, c, g, or t
cctttcatttgcgtcactgatgtctgttcccagccactccccacaatagatctgacctcatttgttcatattccctgcctggctctgaggtctgctctgtcccctgccgggcaaacatcaataggaggaggtggaataaaggctggccttggcatcccaccagcctggcattagctggcattaaggctgggaaaaacagtcctgtgcgaaaccagatggtccctggtgaaggaagctgctcctccgtggggggcctttccagtccatttgtgtgccaaagatggaagctgatggggaccctttgaagtaggatgtaggcacacaaggtatggctngggctcagaactttccctacttccatctnccccagtnaccttgccctagcaagagcttggccantagggaaatggggtcctattganggttcctgttcaattgccantttttnaacaaaaagggtgatttttccccttatttttttgtttagggttttnttttgggnagaaaaggcaacatt

SEQ ID NO: 693583 - DNA, 477 bp, Homo sapiens
  misc_feature (106)..(106): n is a, c, g, or t
tccagttctttcgataacgcgatgtaatcgtcacaactgagatgagaaaaccagatacctcgtgaagccaacggatgttgcttaacaatccgagccatctcacggncctcgtccagagatgcccccgacggcaagtggatagtccagcctctcaggtcaaaaccgtcaagatctaaagccgccacctcgtcggccggaacaccatgccgatgcatcgacgtctcgacttcgaccaaaatcgacgcgctcggcgcgaggtcacgcaccgcagcgacgtcctcacgccgcgaaatcgtcgtaatgaccttgggatcattcaacaggccggtggctacttcgtcgccagggcgccacggattaaggacgatgacatctttgtcccagccgtactgacggaccgacgccacctcttgggctaccccgacggcaagaatgtcgattcctagtcgttgggactcctgaaccagcaactcatgc

SEQ ID NO: 693584 - DNA, 124 bp, Homo sapiens
gcacccaggcgcacttctgcacccatggcgcacttctggacccaggcgcacttataaacgctgtcgcaatttgcctgcggtgcgcaattgtgcctggggtgcggatttctgcctcgatgtccga

SEQ ID NO: 693585 - DNA, 251 bp, Homo sapiens
atcgcgcccctgcattccagcctgggcaacaaaagcgaaactttgtctcaaaaaagaaaaaaaagaaaaaaaagcccgagagcctcataaggtcacgtgctttttttgtctcgctagacaaatttttttgtttgttttcttttttcgggttgttttttgttgttgttgttgttgttttacagctgaaaccaaccagcaagcccttgatgaccaaaaggggtttctttcaaagctatagggcccaaacacca

SEQ ID NO: 693586 - DNA, 461 bp, Homo sapiens
  misc_feature (78)..(78): n is a, c, g, or t
  misc_feature (246)..(246): n is a, c, g, or t
  misc_feature (283)..(283): n is a, c, g, or t
  misc_feature (314)..(314): n is a, c, g, or t
  misc_feature (376)..(376): n is a, c, g, or t
cagcgacccggtatttctcgcaaccttgcaccgaaaaagcacccggacgcgaatactttaactatggttggctgggangccatttgcgccattttccgggtgttgatccccgagatgtgcaggcgacactggcagaactcaccgccgtgacccatttctgaacaagttttgttgagcggtggctgcgaacgattgatggtatgtggtggaggtagtcgtaatccgctactcatggcgcgtctggcngcattactgccaggcacagaagtcaccaccacctgancgttggcattagtggcgatgacatggaagcnattgtttcgcctggcttgctggcggacgctggcgggattaccaggaaatctgccttccgtcnactggcgcaagccaggagacggtactgggggctattttccccgctaacccgtgatatcagagttaactgaatttttcttaccgcg

SEQ ID NO: 693587 - DNA, 279 bp, Homo sapiens
cagccttacccctacggttgaacatgtttgttggtgtatatattgtaattgagattgctcgggggaataggttatgtgattaggatctatgggttaggatgagtgggacgaagaaagagaggaagtccagtctaattatgcctttttgggttgaggtgatgatggaggtgagcagtatttggatgctgtgcaaatcgtctcaggtaatagtcttttctactccggttaggtctcggacgagtaggggcaggtctgggctcgtcagaaggcctaaggggt

SEQ ID NO: 693588 - DNA, 812 bp, Homo sapiens
  misc_feature (177)..(177): n is a, c, g, or t
ggaaaatttcgaatgtggggcggtagttccaggcgacggggacggtggtacggtcctggagggcccagtgcgcggggtagccgtggtggagagcttcgaagagccttgaaatgtgaggaggaggaagatagctgttgcagaagtagtggccaaggtatcgttctgacgcgcctgggnggaggcgtcgcccgctgtccacattcccgccagccccaccttccacgccggggcttcctgtgagtccctgaacggaggagggaagtaggtttgaaggtgcgaaacaagggcgtagtgatcccgtgtttgacttcccttcggtttccagtatcattctcaaatttcgggtggccgaaaggctcgggccgttggagtcccgagctcgcccgggctttgcggcgggttcaggccactctgatctggcggcttgcagatgtcccgggcttccagtggagaccctaatttcctacttgtgcaaaatggtgtagataacgtgatgtgcaaataaaggctttaacaatagctaaaagcccgtggcatcaacgtaggggaccccagaggaaaaattggccatgcagtccttgtgtgcaggcggtgatacccgttgacgtcctccttgtccgagggccaattctcttcctccacttacccttgtgctgagggccgtgcaccttgactaaggttatccctaaccccttggggttgggtctttccgcaagcaggggccttatttgcgggagaattcatgggcccgcggggatcagatatggcgaggtccttaaagtccaagagcgtttaccccgaggttcttgtac

SEQ ID NO: 693589 - DNA, 793 bp, Homo sapiens
ggaaaatttcgaatgtggggcggtagttccaggcgacggggacggtggtacggtcctggagggcccagtgcgcggggtagccgtggtggagagcttcgaagagccttgaaatgtgaggaggaggaagatagctgttgcagaagtagtggccaggcaaaagatggccaaggaaagatgcctgaaaaagtcctttcaagatagtcttgaagacataaagaagcgaatgaaagagaaaaggaataaaaattggcagagattggcaaaccgcagggtctttaatagctgtaaccatgccaaataatcaccaaacttctaacaactgctgaaaaattaccaagacaacaacaaaatgtagtttagcttgggacaaatgaaaaattccacgcgtgacaagaagcccagatatcatcctacagtgagcaacgaatgttactatctcacatgtcagtatttgcttggacacggacacacttacatcaacaaaaaacagtagaacctgtcagaaaacaggaaattatgttcctctgggaatggacccaatagtggatgacagtccagaaatttatttgtgaggggatttaccgttagtatcaaagtcctttatccaggataattcaatacctaagaagggtttaaattctgtgcattcatttatgaacgggcaatgtgcttatgtcaggtcttatattggtaggactgtggctcctctagtgcgaactttatttaaggagaatttgatgtgttgaacttttattaaatatagcaaggtaagggtctttattatataacacct

SEQ ID NO: 693590 - DNA, 183 bp, Homo sapiens
caaaaaaaaaaaaagggaaggaaagggtaattggggggaaaaaatttttttttcccttaaagccttaaaagggggggtttttttttttggaattttacccaaaaatttgcccttacgggttttaagaaattgggaaagattttaacttgggaaagaaagttttggggcaatggaacttttaag

SEQ ID NO: 693591 - DNA, 712 bp, Homo sapiens
  misc_feature (656)..(656): n is a, c, g, or t
gttgcagattatagatgcagaaagagaaaatgtcctttatgtgtgcatgagtatacatgcactgtgcctgtggctggctgagaagggcaaggtggatggctcttcattcctggaaggctggaccgccactgctgcgagggaagaatcagaagagctgcctgccaacacacttgatgtgtgcaaacagccctcaagtatctgtcagatgacctatataaggtattgaataaggtattcttgtcagtttagaaatggactggataaaacttacttggttgtcattattttatctcatttgtcctgttacatgccctatgttaagataattatattgccactaataatcaagatgctaaatgagtattacaactggctaatatcattttttatatacaagggtatgtgtatatttggaattgatatgagaaactcatttgtacccatttgagtgatattgcacaacaaacacagatacctacagactccgttttcattttctcgtgttctttatgataatgatcttgtagatgggttatttctgtactttatctgtaataaactttgtagatcctgtgaaccattactttgcctaaatcacttgagacttgagtctttaataacaaagcatcaatattcactaaaagtccatctctttngagtttctgtgacttggtagaagtcttgacactaaggatagtgttaattttcccgg

SEQ ID NO: 693592 - DNA, 185 bp, Homo sapiens
  misc_feature (174)..(174): n is a, c, g, or t
cggggaagcctggtccatgacctccaaatgtttagatagcctttcgttgttccactgaaatcccgtgtggagaaccttggtctcagttctgtgtgctctttagacgtaggttgcgccatgtcgcttcgctattctccttgcaaggttatttctatttgattcattatgccgaangtccaggtatg

SEQ ID NO: 693593 - DNA, 259 bp, Homo sapiens
cggcacgaggagcaccttgagctcctgggatgcttggtcgttgtttggttgggttgttttaaatttgatttttcttttcctgaactatgttagaagtcagacctatgcaaggaaatccatggcccacttcagcatccacccagtgggggtgtctactcggtggtggtaggattcatggaaacgttttcttgaaatgaaagcgaagatgatgtactcacattgtaaaatggttcacactaaagtttggcatctttctcca

SEQ ID NO: 693594 - DNA, 944 bp, Homo sapiens
  misc_feature (3)..(3): n is a, c, g, or t
ctntcataaataaacaataccatcctatataaagacaaacaccatttggcctctctcccaccatcctcttttacagaccttctccctatttactttgcgtttcccctacctacctaaaaccgtttaccaccgcagcatttctctttccccgggtatgtgggccgacacacaaatacaggtggggccaagaaacctctctaatattggcactcttttcggcatttgacaactactatctgtgttcgccaaacactttatgtatttccagtgcgaaggtttatgcggtcccccacggctgttccaacaatatgcggccccattttctgtggaagccccctagaatttcaaaaactctgcgggttcgctaccccaacttttgtaatataatttccacccccccccagattgccccaattgtgaagctattagcacacactcttcacccacggcaaacgccccccttttcggagatacaacatcttgttcgccaccatgctagttaaccacaacaatcttgtctcccgcaccttaaatttcttctgcgcaccagtcttcctgtgacgccacggagatccatcccccccgattgtgcgcaacttcaacaaagtctatttggtaaagagtggaaatctccaaacttttaaatcccacgcaatcttacgtgacgcaaagtcaaccccacttctggcaccccttacacacttgtcatatgccaaattccgcccctcagaactcactaacaagtatgaaacccaccaattgacctcatgaacatgaatatttttgcccccaatatatctttgtatcaaaccaaatacagcatctgcccttttcaacctttttcgcgccctttctattaaaatactttttccacgtttcccttagtcctaacgttccccccaatttcgaaaaacaaacccccattcccccctttccacataaca

SEQ ID NO: 693595 - DNA, 106 bp, Homo sapiens
tcctcacccatctcccaccttgtggaattaaatactatgttagcacttcccaaaaggaagaaggagaggctgggtaccctgtgccctgagctcagaacttcagagg

SEQ ID NO: 693596 - DNA, 202 bp, Homo sapiens
  misc_feature (36)..(36): n is a, c, g, or t
tttggtattttagtagagacaggggttcaccatgtnggccaggctagtcttgaactcctgacctcaggtgatctgcctacctcagcctcccagtgtgagccaccgcacccagcctggattgttgaattcaatgcttgggtcacctccagattcattttaattagttggggttgtggcctgggctttagaatcctaaggtgtg

SEQ ID NO: 693597 - DNA, 444 bp, Homo sapiens
agctcttggcagggtgtggtggctcacacctacaatctcagcatttttgggaggtggactcagacggacgacttgaagtcaggagtttgaggtcagcttggccaacatggcaacaccttgtctgtactaaaactacaccccttagccaggtgtggtggtgcatgcacgtactcccagcaactccagaggctgagatgggagagtcccttgactccaggaggcagacactgcagtgagctgagatcatgctactgcactctgtcctgggagatggagccagacactgtcttacccccactacgagatttttctcacctttttgtgttgttgttcatcacctatcatcgctaatgtaagtgcattttatatgtagcccacgacacttcttccagtgtggcccagggaagccacacgactggacacccctgcagtttaaccgaacct

SEQ ID NO: 693598 - DNA, 374 bp, Homo sapiens
  misc_feature (172)..(172): n is a, c, g, or t
  misc_feature (206)..(206): n is a, c, g, or t
tgcatgttaatgggtgtaatggagagggcggcgaagaggacccgcaggctgcaaggagctacagcgatggtgagaaggcaacctatagtgcaggacatcaaagacaacctgaaagaggcgattgttaccattgtggcctccatgagcgacctggtgccccccgtggagctgncaaccccgagaaccagttcagagtggactacatnctgagtgtgatgaacgtgcctgactctgacgtccctcccgaattctatgagcatgcacaaggctctgtgggaggatgaatggagtgcgtgcctgctacgacgctccaacgagtaccagctgatgactgtgcccagtacttcctggaagatcgacctgtcctctagagt

SEQ ID NO: 693599 - DNA, 349 bp, Homo sapiens
gtgtattgaaagatacttagcaccaagaaagattcactatgaatatcctatgttatagaggccatgataatgcataggtggccggatgaagtcatcgtcatgaactgcacacgtaattattaattcctcggcagaggacattactgggtttccaaggctgcttgttgtttttgctactacaaataatgcattgatgataaatacttttacatacatggttgtatgtttatctgaactattttcaccaatatattcacctagtgtgtatggaagtgtccatttttgtcatacccctggtaaccctgtgatattatttataaacattttgctaatggatctctgttcttgt

SEQ ID NO: 693600 - DNA, 143 bp, Homo sapiens
tacctagtcacctgagtttccctaatgtataatagtaacgacttagcaattatttgaacttttttcaaaagtaacatagattggccaggtgcagtgtctcacacctgtagtcccacactttgaaccggcggtgcggcgtgcgt

SEQ ID NO: 693601 - DNA, 227 bp, Homo sapiens
gcccttctaactcccctgagggctaggagttatagggaaggggttatttgtcccccacccacttgccacaatgggaaggtggagggaacacggctcaagcctcctcacttgtctaaaatgaggcctaaatgtgtgaagtgcgatttctgcttttgtgaaccccacccccccccttatccccacgctgcctttgtgtgtttgtgtccataaaaagcccaaacctgtga

SEQ ID NO: 693602 - DNA, 143 bp, Homo sapiens
  misc_feature (74)..(74): n is a, c, g, or t
  misc_feature (124)..(124): n is a, c, g, or t
cgatgttcatttgggcttgagtccgaagcgtgatgagtaagaagatcctgctactacttttagtgcttgagtanggggtaccgctgagactgggcgtaaagccttctatggctgaggggagtcngggtgtggagacctaattg

SEQ ID NO: 693603 - DNA, 182 bp, Homo sapiens
  misc_feature (125)..(125): n is a, c, g, or t
gcacctccaactccctagagttgtactacactctagacctgttgccacacacaaataaagtttctacatttacatatgtcattgtgtacctaaacatctccactttggaaatatagatacctcanactatgcatgtctaaaaaggaaatcattctctttccatccaaaccatctcctttggc

SEQ ID NO: 693604 - DNA, 975 bp, Homo sapiens
gacgagaagcagctgctggtggaggccatcagacgtgcccgctagggacatgccagcctcgtgccgcggctggtaaacatcaccatcatcaaggagcaagccagagacgtggtgtcctttgagcagcctgagttctcggtcagccgcggaggaccagggtgtgcccgtatccctgtgcatccggacggtgtcctggaggggcgggaagtcccagtgtctcctacacgctagacaggatggcaaccgcgcagggcaatcgggactacatccccgtggaggcgtgagctgcttgttccaagcctggtgtgatggccttgtgaaagaagctgcatggtgaaagctcctggagctggcaacgaatgtttgactaccctcctgcaggggaccgtcagtgttcctgccggttattccatcgtccagctcgagcaagccctaagtttgggggcccagctggggccagccaccatgtcacacatcatcatcatcagggagcccaggatgaactgggaccggagcgttcacggaggtcagcatgtggatgcatcgcaagtcatacccgttacacggtgacgcgtggggggcacccgtcatgaatgcccaattgcgaagggcgctgtggataccaggaaagatccatgtacagacgtggggtgtaccccgtttctggcaacgccaatgggggggttacagggggctaaaaggtggctgggacttccacgggtagagcatcccggaaatctcgacagtgcgcaacgtggctgctgacaagcacaagtgttgcgccctcaagttggggaggacgtgcaacccaggatccagttacgccgggtagttgggcgaacctactgacgactgcacaggggtggggcggcccctaacggggggcttacaagaggacgcagggggaaccggtaagggagctacccgctgggtggtcccatggccggctgggcccaaccgagggcaccgcaggac

SEQ ID NO: 693605 - DNA, 660 bp, Homo sapiens
tggaaatggagtcttgctctatcacccaggctggagtgcaagggcccgatctctgctcactgcaacctctgcctcccgggttcaagcgatcctcttgcctcagcctcccaagtagctgggattacaggcttgcaccaccacgcccggctaattttggttattttacagtagggaccgaggttccatcatgtgggccaggctggtctcaaactcctccaaataccacaatgtaccccatcaattatgtcacaatttatggtcacttacaatataaaagcaaaaaatgttggtcagattaaaacaaacaaagtattattgtgaaatatacagtatatgtcctcgcgaatcaccaactattatacagggtccgtctatcgacgagacaacatcgtccccctgaactgcaggtctgaccaccttttggcacgaacgccacacagcaatcacaacacccttcccgtcaactcttttacgagtggtgaaccgcacgaaacacacaaagcggccaggggcattggtgtgctgggagtgacccgtgtcctcacgcggggacacttggggtgggccaacgcttgtattggcccagggacattacaaacctgtaccaacttggggagacattgggttccacctttttcccttgaacccccttaagttccc

SEQ ID NO: 693606 - DNA, 111 bp, Homo sapiens
  misc_feature (21)..(21): n is a, c, g, or t
cgaatctagaggtatccccgntctagacgctgaactactctgcactacatccgacaacgtacaaccgcttcgagaagcgccacaagaacatgtctgtacacctgtccccct

SEQ ID NO: 693607 - DNA, 444 bp, Homo sapiens
ggattcattgaacacgatggtcctgagtgagctactgtgtcatacagtctccagaatagtgttctatagaagaatacgatcttagagtttgatgccataataacagttttattgaggttctctcttgtctctatttgaagctatgtgcccgtttttctttctcaatatagtgtcaaaagctttgagcaaggttttatatataatcacatattatgtatactttcatcatatttgcttttctcttttatcactttactaaaccttatttttagtgtatgtgaacttctgttaagccacttcaaaaccaatagcaaataattgttccttgatcttttttctaatgttgttagttttccaatgttgttaaattgcaggaaatggaagggaaatggagggggaaataacagaaaatgtataatttcacttggctctaacactacacta

SEQ ID NO: 693608 - DNA, 531 bp, Homo sapiens
gaatgagccggtaccgggagtggagagagaacgtaggcagttcgcacttcagctatgacaggaaatatcctctccatagggcgcaggccaagtaaatgactttgtatctttacttcatactcttcatttacatagggtgtaccccaagtaaccaatggaatcctctagagggtatttaaactcccccagattctgtaacggtgcccttgaggccctatgcttgggcctgctcccacactgtggagtgtactttcattttcagtaaaccccttcattccttccttgttttgctcgtgcgttttgtctaattctttgttcaagatgccaagaacctggacaccctccactggtgacatattttggcgagccagcggggaggaagaggtaagtccaaagtttgggattcctttttctcctttctctttttcctttctgctccatacaggggaatcaatcaatcaatcaatcaatctctctctctctctctctctctctctctctctctctctctttcccttctctctccactcg

SEQ ID NO: 693609 - DNA, 1422 bp, Homo sapiens
  misc_feature (37)..(37): n is a, c, g, or t
ggccctgaaggtgccactccagtgcccaccagcctgntcctaataaaacttaagttgtatcactcaaaaacaaaaaaaaaaaaaaaaaaaaaaaaactttgtgtgcgggcgcgcccgtgggccccctagaagaaggttttttaagacacccttcgtgttgtggggcgcgccgcgggggccacacagtgggggtacaggtgtgacccgtgtggccacaaagagcgtgtgtttccctatgaggaagaaagccgcggcgtcccgagagaccctatgggggcgcgggggacattctctcacaccaaaattaaaaaaacgccccccggggggcaccacgccagaaggcgtttcttggaaacaaaaattcctccaacaatgggaacttctcgagaggggtccaactaacgggggggaacctctatcacacaaccgagagggggacgtccccccaaaagggcgagaacgctctcagcaaaatcatctcaaatatttagagcgccccaccgacccctgtggggtggcccagcacctgaagacagaaacacgacagcaagaacacaagaacatcaaaacgaagcaaaaaaaaaagaaggaacgaagagcaacgacagaagaacgaccaagccatgaacagtcagacaaccacagtaccgagcgacgggaagaagggaagtgaggaagcgaggagatgcggggaacacgaggacagagcgggcgagagcaagggtacgcaaggacgaaaggaggaacgaggcgtagcggggagggagccggagagaacgcagaagaaaggacagaagagcagagagtagagaggaggaagagaaaagaagaggagagagaacagagaaagagagggaggagtgaggagaagcgagccaagacgaaagcatagggaggccagaaacaggcgcaacgagaaacggaagacaaggcggacgagctaaaacacgagagacggcagcagcgagaggggaacgagggcgagacaggcgacagaaagaggaagcaggcggagaagacagaggagcagggagagaggcacgacacagaggcaggagataggacgaggtaacgacggaataggcagaagaacggcgggagaaaagcaggaaagacaagcaacagccgacaacgccgaagtcagagcaggagcacacgacgcggcgcataagcagacagccaggcgacaagcagcacgaagcaggagcgagagagaaagggaagaggcaaaggcacaggaagacacaacgaatgatagacaagagaaagaggacgagagagggaacggcgaacgacaggaaggagagaaggacgagaaaggcaaggacagagagcaggaaagaagagaaacgacgatgaaaaaggaacagagagagaaaaacaaagcaaaccacgaacaacggcaaggaccgcaacagacca

SEQ ID NO: 693610 - DNA, 374 bp, Homo sapiens
  misc_feature (23)..(23): n is a, c, g, or t
  misc_feature (49)..(49): n is a, c, g, or t
aagtaccctaatttgatcattcncattgtatacacgtatcaaaatatcncattgcatcccacacatgcataattattaaataaaattgaaggccgggcacagtggctcacgcctgtaatcccagcacttttggaggccgaggcgggcggatcacgaggtcaggagatcgagaccatcctggctaacacggtgaaaccccatctctactaaaaatacaaaaaaaaaattagccgggcgcggtggcgggcgcctgtagtcccagctactcgggaggctgaggcaggagaatggcgtgaacccaggaggcggagcttgcactgagccgagatcatgccactgcactgcagcctggtgacagggcaagactccgtctc

SEQ ID NO: 693611 - DNA, 96 bp, Homo sapiens
atcacggcgatgcggtccgacatgctgagcgcctcgccctggtcatgggtgacgaagatcgtcgtcacgcccagcctgcgctggatgtcgcggatc

SEQ ID NO: 693612 - DNA, 264 bp, Homo sapiens
  misc_feature (7)..(7): n is a, c, g, or t
  misc_feature (14)..(14): n is a, c, g, or t
  misc_feature (54)..(54): n is a, c, g, or t
  misc_feature (58)..(58): n is a, c, g, or t
  misc_feature (65)..(65): n is a, c, g, or t
  misc_feature (67)..(67): n is a, c, g, or t
  misc_feature (247)..(247): n is a, c, g, or t
  misc_feature (254)..(254): n is a, c, g, or t
gattctngaacggngggagcgggggatcccaacggcttgcgctgcctttgcganagcnaggctantntccacgtcgcggcctggctggggtaggagagggcggtccccagtgcagttgggtgaactaccgttgcacactggagtttctggtgtctttgcttggaactgacctagctcgtggcagggggaactcggctaacggcccacagcccctgctgactcaaaacaactgagttgtaagacagtncatatgncgtgttatac

SEQ ID NO: 693613 - DNA, 292 bp, Homo sapiens
  misc_feature (96)..(96): n is a, c, g, or t
  misc_feature (176)..(176): n is a, c, g, or t
  misc_feature (212)..(212): n is a, c, g, or t
  misc_feature (229)..(229): n is a, c, g, or t
atgatgaagggttggagtgatgcacctagaagtgaaggaatgccaatggttgccagcaaagcaccagaaactagggagaaacaaggaaggattctnccacagtttcagagggagaatggccctgccaacactgtgattttggacttctggcctccaaaactatgagacaataaatncctgttgtcttagaccacccagtttgtggaattttnttacagcagaactaggnaacaaatacagtttttttttgcagtaaagaagttttaaatctgggttatgtccaatgtatcaa

SEQ ID NO: 693614 - DNA, 477 bp, Homo sapiens
gccggagccagcggatctctgatacagtaatgaaacaggcaaaaaagaaacatgaaggtatctcataataatagctacaaaaagaaaaaagaaaaaagaaaagaaagaacaaaaaacccaacaacctaggaataaatagaccaagaagatgagagatctctacaaggaaaactcgcaaagcactgatgaaacaaatcgaagaggacacaaacaaatggaaagacatccgatgctcatggattggaagaattaatattgttaaaatgactcttctatccaaggcaattggtagattcaatgcaaccgctatcaaaacaccaacatcagtttttcaaagttagaaaaaacaatccgtaaaattcatatggaaccaaaaaagagcccaaatagctgaagcaatcctgagcaaaagggacaaagctggaggcatcgaactaccggacttcaaaatatactacaaggctctagtaaccaaaa

SEQ ID NO: 693615 - DNA, 201 bp, Homo sapiens
tatttataaagcaaaggagccacacccacaagccatcagctgggtgaaatatcagcgtgtccacgccgtggtatgccaattcgaggaaagttactccgttggaaatgcttggaagcaatctacgttgctggaaacaaatagcttcatctgcataaaaagtgtgctacaaaagaatccctgtggttagcttactcgtacaca

SEQ ID NO: 693616 - DNA, 202 bp, Homo sapiens
agagctgcgtagtaccccaatacagaccacagtgtgagccagaagatatgttacatcagcaagaacccacaagaacaagaggcatagtaaggtacggcgagagcatgaccgatggataccagaacgagtatggcggacagggactcacgaacactgccgatgtggacatccagctgaacatatactgcgccctgattgtaca

SEQ ID NO: 693617 - DNA, 1650 bp, Homo sapiens
  misc_feature (1310)..(1310): n is a, c, g, or t
gctccatcggacgttctggagagtctgcaccgtggcgggacgcggtcgacggtaggttccacgaatggagataagcaatcgtagaagtaggacaactgaggaggacgtgcgaagagagatcgatcgaaatagacgatgcgccgtacactttgtccttcttgtcgctagacgatccacacgtacgcccaggaaggacgctgtccttctggatggacatagtcgtgtgaggatcatcgatctcacagtagtaattggcatacgggggttcccatgagtagcgaacttgtgtggcacacgtctggaggtcgcacgacttcgacaaagagagcgaatcgtagcgagaatcatgagaacgtgcgattgcaagcttagaacgatgtgactagcgacgtggcgttaatccgatgaccacttcgaggttctccaggccccccaatacgccctcgatgggggtgtcgaccacaagtacgtcagcgcccaggtgaattggtcacaatagggcatacatccgaagtgggcaaggacatgcatgcgaaatagaccgaagggagcgcctagtaagcataagcataggctggaacagtcatcgagcatctctggagtgatcccaggggatcccgagtgcacactgatcttcacctctcagagaccggcataggcaagtgtgtgacccgctgaaccaaggtgctttcaaaagacgatccgtatcgaactgtaagagggatctttcggtcgccggtgctatgcccgtgacgtaggagagaatcccctctagatcgaaatgcaaggtgccataactggggagaccgatgtgaacgcggatgtgaaggccttgaccttagccccaaagagggtaagttgggctctaggttaccctcccctgcgtcgtggtaggtctcgtactctcaaccttagtaccagagtagggcaagcacagagcccacgagtggagaggtaagtgttggagcataatcgcgctctgggggcggggggacctctggggacatgaagcgtggctagcggaacttgccgtgggaccgaagggtcctactgaggaaacggaatgggcgagtaacctgcgtaagcccatggcgagacagcggagcgggcccctaacaacccaatgtaacccccgagcgcctaggaaatgttcccctgtccccaaaaggggtcccccccttacaaaaatagcgggagccagaacgggcaagaacacccagataccagttatcctcccccgctgcaataccactgcttctacccggtgcacacaggacgtggccggacatcagtacacgagcgacacgagncacaccaccgcatataagcagcatactccgcgagaggcccccacaatggcgtccccccaagtgaacaggagccccccccaagaaagagcagtatcatcacgacaagacgccatgagtggacaaccacacgggagtgtactaatgccgcacgcaaaagtggtatcaacgacaaaacccgacctaaaatacgtcgcgcaaaccatagctgtaacccacccgacacaacacgacagctccgagaacacagatgatcaccaacagctctgcacgcagtcgcaagtagacagcacgacacatgacatgaggcggatcacaaccagaacgatgcacaagcaacagc

SEQ ID NO: 693618 - DNA, 2140 bp, Homo sapiens
  misc_feature (89)..(89): n is a, c, g, or t
  misc_feature (140)..(140): n is a, c, g, or t
ctctgccaagcagcatgcctgagctcctggagacgaggcaggcccaggtccttgctgcttgctgctgggaaaggacccagacggagaangggccatgttggggctggaccctcaggtagaggatcaatgtgtccgttatnttgggtatagagagaagtgggtagagctgcatgtgcatctgatcccagctctgtcctgagagggcccacagcccggactcagccacagcagatgccagttccacagttccaggcgctagttccatggttcctgccctgctcacaggagcccgggctctagcatggaggcaggttcggaaggcacaggaagcagctgaaaggggtccccaaggaccagaactaggccaataggcagtgacgttgaagaccacaatccactgactcaaccaggaaatcatgggtccaggctgatagcaatggacagatcggtcaggggaacggggcactcttccacgcgagagtgccagccaaggaacgcgacaggaacggcgcgccgggcgaccacggatgggtgctgaaccagagggattcccatcagacggatgcgaagcagcatctccccacacgtgacttcttatttccaagggaaatgctggctttccagtggagcagcctgtttgaccccagctgacccgagtgatcagagctcccatcgccagtgctgggatgcgcctgtgtcacgcgcctctgggcgggtcgcactgagacggcacagactcgcgctcggggtccctgccaaaaatgcagaacctgagcttatgcatgaggagacctcaggcaagcccaaacagagggacatctgcagatgagcgggtctagatgcttggcgagtgcccaaacatggaagctggggagccactccagttaggagacctgggagaccccatgtagaaatgccaggtgggaccctggaccctgcacaggagagacagcgtcagggcatcatctgtagaaacgccacgtgggaccctgggctctgtacaggagagacgggcatcaagtcatcatccgtagaaacgccacgtgggaccctggaccctgcacaggagagacggcgtcagggcatcatccgtagaaacaccacgtgggaccctggaccctgcacaggagagacggtgtcagggcatcatctgtagaaacaccatgtgggaccatggaccctgcacaggagagatggcgtcagggcgttatctggacggttggtgacatttgcacacgggccacggaccaggtcacgtattgtgtacacccacccaagtactgaggtgtgacgcggcactgcgtctccagcctacctcctgtagtgcaggaagccagtgcagggtgggtgaggaagtgcacaggggtccagggactgtcccacagcactcctgacgaaagctggtccccttccacggccctagccaaggagccaggtctgcaaagctgggaccaggtgtgtgcggaggcacgtgttcccacttctcccatggcagagggagagcctgtggacaacagtggggcactctgctcccaggcaggtcccactgggctgagccgcacagcctggctttgggcttccctgactgcaccacccacatcagctgcctctagcccttaaaatacaaaacttcccccagtcactggccgccagggctgagttgggggatgtgttacatccctgggtccactggggggcagtgttggccatggtgttggtgctggctctgccgagaggcgttggagtggctgtgtggggcggtgagcgccggcccagcctgatggaacccactgtaccaggcccaggcctcagcctctgagaaggacttccctgtgtcactcactcatacatgtcctcaggacgtgaagacatttcagcagaccaaagtttccttcgaattttcttcgaatcgtccagatacttggagacatctcctcctcacctgtggggtgctggggcagtcctaggcgtgggggcagatgggtggacagctgctgctgccctgctgggggtgggcagcccttggagcacacagtggtgaagacattcctgaatatgtctcaggctgtagaaatcttattttgtggaaagattttagagaatcatcaaaataaacttttaccaaataacattttaccag

SEQ ID NO: 693619 - DNA, 1536 bp, Homo sapiens
  misc_feature (89)..(89): n is a, c, g, or t
  misc_feature (140)..(140): n is a, c, g, or t
  misc_feature (1427)..(1427): n is a, c, g, or t
ctctgccaagcagcatgcctgagctcctggagacgaggcaggcccaggtccttgctgcttgctgctgggaaaggacccagacggagaangggccatgttggggctggaccctcaggtagaggatcaatgtgtccgttatnttgggtatagagagaagtgggtagagctgcatgtgcatctgatcccagctctgtcctgagagggcccacagcccggactcagccacagcagatgccagttccacagttccaggcgctagttccatggttcctgccctgctcacaggagcccgggctctagcatggaggcaggttcggaaggcacaggaagcagctgaaaggggtccccaaggaccagaactaggccaataggcagtgacgttgaagaccacaatccactgactcaaccaggaaatcatgggtccaggctgatagcaatggacagatcggtcaggggaacggggcactcttccacgcgagagtgccagccaaggaacgcgacaggaacggcgcgccgggcgaccacggatgggtgctgaaccagagggattcccatcagacggatgcgaagcagcatctccccacacgtgacttcttatttccaagggaaatgctggctttccagtggagcagcctgtttgaccccagctgacccgagtgatcagagctcccatcgccagtgctgggatgcgcctgtgtcacgcgcctctgggcgggtcgcactgagacggcacagactcgcgctcggggtccctgccaaaaatgcagaacctgagcttatgcatgaggagacctcaggcaagcccaaacagagggacatctgcagatgagcgggtctagatgcttggcgagtgcccaaacatggaagctggggagccactccagttaggagacctgggagaccccatgtagaaatgccaggtgggaccctggaccctgcacaggagagacagcgtcagggcatcatctgtagaaacgccacgtgggaccctgggctctgtacaggagagacgggcatcaagtcatcatccgtagaaacgccacgtgggaccctggaccctcatacatgtcctcaggacgtgaagacatttcagcagaccaaagtttccttcgaattttcttcgaatcgtccagatacttggagacatctcctcctcacctgtggggtgctggggcagtcctaggcgtgggggcagatgggtggacagctgctgctgccctgctgggggtgggcagcccttggagcacacagtggtgaagacattcctgaatatgtctcaggctgtagaaatcttattttgtggaaagattttagagaatcatcaaaataaacttttaccaaataacattttaccagaaactgaatccgagagaagtagaatcgttcactccctgcccccgaggtcactgtgtgcagaatcacgtgantaggacatgggccctgtgatccgtgccctccttcctttgcctgtggggtcaacagcaagaaggcccctcagtgcccctcaagcctggcaccagccgcagggcccggtgt

SEQ ID NO: 693620 - DNA, 195 bp, Homo sapiens
ggattggtttgatgcaggcgcggtgttcaagctgtatcccagctacttgggcggctgaggcaggagaatctcttgaatccaggaggcagagatagtggtgagccgagatcgtgtcattgcactccagctaatttttaaatttgtagtagagatggggttttgccattttggccaggctggtctcaaactcctgac

SEQ ID NO: 693621 - DNA, 1004 bp, Homo sapiens
gatcgacctgctgacaggctgatgggtaacatgtctctctcacgctgtggatgtcggtgggtctgtcggcccgcggccttgcgcccgtatcgtgtatgagggtctagaatatggcacctttgaactatatattaagcacaggaggaaagtaaagtcgcagtcaaaactgtcgcaaggacaatcgtttacccaaagttctattgtaaccatggctggagggcggtcaaagtgaaacattacttgtggctcgtagacatagagtagagaagtcctggagaaccaaggctttcggagagtgattctgtgatgggagatcttataaaacacttgataagtgatcgcccctgggttatgcaaaggggggctggagagctcgaagaaagacaagcgccgtgctcatccatgagctgtgttccttacgagatctgaggggacctgtgtcgggtgccactgcagtatcctcacagtagctgtacaggcgatgacagaatgcgcagtattgttggtcaattaaccagtaacgctggaaaatatgaatcgctcatgtgctatgctacgtgagatagggtgactacatagtcgaggaatggggactaccttttatagagactcacttctgacctagttactgaagtgcacttcctgaggaagtagggcaggaaaggccccccgattttaatgctgatgggagtcccttattctggtccaattgcacataaattggagacccgggatatcgaggctgattagacggcggccatcgaactagtacatctccttaaggtccgtcatcgacgtagtcagactgataagcaaagcccttctattcctcattggcagatggagttgctaccagtgcatgttgacacgtaatgatgcggcggctctgaccacacatgtgcaacaggcaaattacagggacttgagggacacatcgagaaaggtggtgcgccggaagccacaatcagagatggatgaatcacaggccgtccgaaaaagaggaa

SEQ ID NO: 693622 - DNA, 2186 bp, Homo sapiens
  misc_feature (89)..(89): n is a, c, g, or t
  misc_feature (140)..(140): n is a, c, g, or t
  misc_feature (1187)..(1187): n is a, c, g, or t
  misc_feature (1196)..(1196): n is a, c, g, or t
  misc_feature (1215)..(1215): n is a, c, g, or t
  misc_feature (1219)..(1219): n is a, c, g, or t
ctctgccaagcagcatgcctgagctcctggagacgaggcaggcccaggtccttgctgcttgctgctgggaaaggacccagacggagaangggccatgttggggctggaccctcaggtagaggatcaatgtgtccgttatnttgggtatagagagaagtgggtagagctgcatgtgcatctgatcccagctctgtcctgagagggcccacagcccggactcagccacagcagatgccagttccacagttccaggcgctagttccatggttcctgccctgctcacaggagcccgggctctagcatggaggcaggttcggaaggcacaggaagcagctgaaaggggtccccaaggaccagaactaggccaataggcagtgacgttgaagaccacaatccactgactcaaccaggaaatcatgggtccaggctgatagcaatggacagatcggtcaggggaacggggcactcttccacgcgagagtgccagccaaggaacgcgacaggaacggcgcgccgggcgaccacggatgggtgctgaaccagagggattcccatcagacggatgcgaagcagcatctccccacacgtgacttcttatttccaagggaaatgctggctttccagtggagcagcctgtttgaccccagctgacccgagtgatcagagctcccatcgccagtgctgggatgcgcctgtgtcacgcgcctctgggcgggtcgcactgagacggcacagactcgcgctcggggtccctgccaaaaatgcagaacctgagcttatgcatgaggagacctcaggcaagcccaaacagagggacatctgcagatgagcgggtctagatgcttggcgagtgcccaaacatggaagctggggagccactccagttaggagacctgggagaccccatgtagaaatgccaggtgggaccctggaccctgcacaggagagacagcgtcagggcatcatctgtagaaacgccacgtgggaccctgggctctgtacaggagagacgggcatcaagtcatcatccgtagaaacgccacgtgggaccctggaccctgcacaggagagacggcgtcagggcatcatccgtagaaacaccacgtgggaccctggaccctgcacaggagagacggtgtcagggcatcatctgtagaaacaccatgtgggaccatggaccctgcacnggagagacngtgtagaaatgccacgtgngacnctggaccctgcacaggagagatggcgtcagggcgttatctggacggttggtgacatttgcacacgggccacggaccaggtcacgtattgtgtacacccacccaagtactgaggtgtgacgcggcactgcgtctccagcctacctcctgtagtgcaggaagccagtgcagggtgggtgaggaagtgcacaggggtccagggactgtcccacagcactcctgacgaaagctggtccccttccacggccctagccaaggagccaggtctgcaaagctgggaccaggtgtgtgcggaggcacgtgttcccacttctcccatggcagagggagagcctgtggacaacagtggggcactctgctcccaggcaggtcccactgggctgagccgcacagcctggctttgggcttccctgactgcaccacccacatcagctgcctctagcccttaaaatacaaaacttcccccagtcactggccgccagggctgagttgggggatgtgttacatccctgggtccactggggggcagtgttggccatggtgttggtgctggctctgccgagaggcgttggagtggctgtgtggggcggtgagcgccggcccagcctgatggaacccactgtaccaggcccaggcctcagcctctgagaaggacttccctgtgtcactcactcatacatgtcctcaggacgtgaagacatttcagcagaccaaagtttccttcgaattttcttcgaatcgtccagatacttggagacatctcctcctcacctgtggggtgctggggcagtcctaggcgtgggggcagatgggtggacagctgctgctgccctgctgggggtgggcagcccttggagcacacagtggtgaagacattcctgaatatgtctcaggctgtagaaatcttattttgtggaaagattttagagaatcatcaaaataaacttttaccaaataacattttaccag

SEQ ID NO: 693623 - DNA, 2366 bp, Homo sapiens
  misc_feature (89)..(89): n is a, c, g, or t
  misc_feature (140)..(140): n is a, c, g, or t
  misc_feature (1187)..(1187): n is a, c, g, or t
  misc_feature (1196)..(1196): n is a, c, g, or t
  misc_feature (1215)..(1215): n is a, c, g, or t
  misc_feature (1219)..(1219): n is a, c, g, or t
  misc_feature (2257)..(2257): n is a, c, g, or t
ctctgccaagcagcatgcctgagctcctggagacgaggcaggcccaggtccttgctgcttgctgctgggaaaggacccagacggagaangggccatgttggggctggaccctcaggtagaggatcaatgtgtccgttatnttgggtatagagagaagtgggtagagctgcatgtgcatctgatcccagctctgtcctgagagggcccacagcccggactcagccacagcagatgccagttccacagttccaggcgctagttccatggttcctgccctgctcacaggagcccgggctctagcatggaggcaggttcggaaggcacaggaagcagctgaaaggggtccccaaggaccagaactaggccaataggcagtgacgttgaagaccacaatccactgactcaaccaggaaatcatgggtccaggctgatagcaatggacagatcggtcaggggaacggggcactcttccacgcgagagtgccagccaaggaacgcgacaggaacggcgcgccgggcgaccacggatgggtgctgaaccagagggattcccatcagacggatgcgaagcagcatctccccacacgtgacttcttatttccaagggaaatgctggctttccagtggagcagcctgtttgaccccagctgacccgagtgatcagagctcccatcgccagtgctgggatgcgcctgtgtcacgcgcctctgggcgggtcgcactgagacggcacagactcgcgctcggggtccctgccaaaaatgcagaacctgagcttatgcatgaggagacctcaggcaagcccaaacagagggacatctgcagatgagcgggtctagatgcttggcgagtgcccaaacatggaagctggggagccactccagttaggagacctgggagaccccatgtagaaatgccaggtgggaccctggaccctgcacaggagagacagcgtcagggcatcatctgtagaaacgccacgtgggaccctgggctctgtacaggagagacgggcatcaagtcatcatccgtagaaacgccacgtgggaccctggaccctgcacaggagagacggcgtcagggcatcatccgtagaaacaccacgtgggaccctggaccctgcacaggagagacggtgtcagggcatcatctgtagaaacaccatgtgggaccatggaccctgcacnggagagacngtgtagaaatgccacgtgngacnctggaccctgcacaggagagatggcgtcagggcgttatctggacggttggtgacatttgcacacgggccacggaccaggtcacgtattgtgtacacccacccaagtactgaggtgtgacgcggcactgcgtctccagcctacctcctgtagtgcaggaagccagtgcagggtgggtgaggaagtgcacaggggtccagggactgtcccacagcactcctgacgaaagctggtccccttccacggccctagccaaggagccaggtctgcaaagctgggaccaggtgtgtgcggaggcacgtgttcccacttctcccatggcagagggagagcctgtggacaacagtggggcactctgctcccaggcaggtcccactgggctgagccgcacagcctggctttgggcttccctgactgcaccacccacatcagctgcctctagcccttaaaatacaaaacttcccccagtcactggccgccagggctgagttgggggatgtgttacatccctgggtccactggggggcagtgttggccatggtgttggtgctggctctgccgagaggcgttggagtggctgtgtggggcggtgagcgccggcccagcctgatggaacccactgtaccaggcccaggcctcagcctctgagaaggacttccctgtgtcactcactcatacatgtcctcaggacgtgaagacatttcagcagaccaaagtttccttcgaattttcttcgaatcgtccagatacttggagacatctcctcctcacctgtggggtgctggggcagtcctaggcgtgggggcagatgggtggacagctgctgctgccctgctgggggtgggcagcccttggagcacacagtggtgaagacattcctgaatatgtctcaggctgtagaaatcttattttgtggaaagattttagagaatcatcaaaataaacttttaccaaataacattttaccagaaactgaatccgagagaagtagaatcgttcactccctgcccccgaggtcactgtgtgcagaatcacgtgantaggacatgggccctgtgatccgtgccctccttcctttgcctgtggggtcaacagcaagaaggcccctcagtgcccctcaagcctggcaccagccgcagggcccggtgt

SEQ ID NO: 693624 - DNA, 320 bp, Homo sapiens
atatcctacgtagtgtaccatgctggtcgtcagacataaagtctcccatgcacacatctttgttttgtaagtatgtttgtttgtttgtatgtttgagacagagtaatcactctatgtcacccaggctggagtgcaatggcacgatcttggctcactgcaacctccatctcccgggttcaaggaattctcctgcttcagcctcccaagtagctaggattacaggtgcctgccaccatgcccggctatttatattttctttcttttctttctttttttttttaatgggtgtaaatttaaaaaagtgcactttgggggtcccg

SEQ ID NO: 693625 - DNA, 355 bp, Homo sapiens
agattggttgtagggaatttcatcgccatccccgccttcagcgccgagatagggagcactcccggctctaccttgcatggtctctgcccagcgactgcacctctgcctcacgggagcagacttgatagaggacggctgccagccgtatcgctgcatgctgtcctcgacacaagtcaaggccgctggagcactgcttactgtacggggggagcgcctgtcacgtgtcactgtccagccctgcactcgtgtgtcctctcactaaaggacgtagcagagtgcttttacagaaaaagtgagtactttcccacctcgggagagcctaccaatgggcattactcctcaggaagccacgggg

SEQ ID NO: 693626 - DNA, 177 bp, Homo sapiens
  misc_feature (137)..(137): n is a, c, g, or t
atgtgtcatacaaggattataatacaatcatgtcatcatggtaatggagtatacaagcatgatgattattccaatcattattcttcaattcattttccaattgttttgattttacatggtggcaatgtaaggtcatnggtggaagggatttatatggtcaattcatgttataaacca

SEQ ID NO: 693627 - DNA, 473 bp, Homo sapiens
gcgacatggcaactccttaaacgtgcattattagataataatagattatgataacgtgtttttaaaaagactcaaaactgggccgggtgccgtggctcatgcctgtaatcccaacactttgggaggccgaggtggctggatcacaaggtcaggagttcaagaccagactgggcaacatagtgaaaacccatccccactaaaaatgcaaaaattagctgggcatggtggcacacgcctgtgtgtcccagccactcaggcggctgaggcaggagaactgcttgaacccaggaggcagaggtttcagtgagacaagatcgtgccactgaaccccagcctaggcaacagagtgacactctgtcttaaaagacaaaagagaaactacactgttggtggtttggacaaatcctgcccctgcaccccaactgcatgtaccctccatgacttcctgttgtgtaccaggctccctgaggtgg

SEQ ID NO: 693628 - DNA, 451 bp, Homo sapiens
  misc_feature (45)..(45): n is a, c, g, or t
attcattaagtggtggttataactagggctcatgggaagactagnctaagtgaaattaatagccaatacattttaaattaatacattgaccattttaatgactttaaccatttctatttcagtggaatcagattgaaatgtcaaatagtgaaactatttttaatgtgttaagcctgtggtttagttttaagttaatgtcatctcagggctaaagtttgtccaattgagattcccattaattttatataaacctggaacggctctcaggagctgaaagtaagtggaaagtttccagaacactttaccatcagaatgccacactagcctggtaaaactctctttctgacagccttatagcaccatctagtgtgctattcttagatagcaagacaaaggactttcagctcctttttgttttctccatattaaaaagaaaactgttattctaaaa

SEQ ID NO: 693629 - DNA, 570 bp, Homo sapiens
  misc_feature (237)..(237): n is a, c, g, or t
  misc_feature (407)..(407): n is a, c, g, or t
gtgaaacggcctggcctccgggcattggcggtttccctgatcctctctcccaaattttccggcaggtgattgatctgatggcgacatttagtgactgggagtgggcgagggagtggcggttctcgtcccaaggttactaggtgatggacgttcagagccaaggcgtatgccaagatctgctgccgccctgatatgcttgatggaggcgcacgggattcgaactcaagtgctgtgccntcaattcctagagcccgtagtcgaggctcgttgatgagaaaacccgtatcattgacctcacatcgttatgggttatgtccgagtagaccaggtgacgcagggatgagttcgagatagctgcaaatcgccaacgacgtcgtgccgttattgcgaaataaatactatctttntcgagccacgcgatgaggtcgacactgttgggacactctagcaccatgggactccctactccagatgaggtagacgctaggagttttccctcacgctcgagttccgtgtctacccaagctgcaagatccgagctttcacggggtgtgcttttctccagatcgc

SEQ ID NO: 693630 - DNA, 829 bp, Homo sapiens
ggttagtgccatggaggcatcactagcttgaaggaggcgctatgagattctgcattgcgcaggcgagaagggatggttgcccgtcgttgaatgaagatgatgagcttgtgggcattattgcccggacagagcttgatgaagaatcgggactacccattagcctcctatgatgtgcaaggaacacagtcgtgctggtgatgccggcgcacgccagttggacagctcactgacgggagtgactaagttatagggctggacgttggctcgtgcccagggcgtgggtggtggaatgtggatgggtttctgtggagccatcgtatcccagcggaaaattccactcattcgcagtactcacaatagtggactcaagatagctgtccatcaggacgaaaatagccctatgtactccaagttcattgggagggcaactgtagagtaccaactgactgctcccagggcgcaaagaaactcttcatttgataggcaaggtgtggtgaatagctcctgcgagaggtgaggcagtggagaagggattgggcttcgcattctcgtcgttgactgcaagtgatatgtggcatggagcgctgtgaggtcggtccgcacaacgtcatagcgagcaaggtgtaccagagggtgtccacgaggtattgcaccgggtggctctatggtcgttccagagtctaatatgcgtggacttggatggaagtccgaaaaatgtgggatcatatttgcgaacagcacttggagcctgggggccatcccaccagtcgatgatgggctctctcgctgggctggacacacaattgagggcctcctggtgaaatacttc

SEQ ID NO: 693631 - DNA, 363 bp, Homo sapiens
tgcaggaattcggcacgagggattgtcatgtgtgtttgaacaatatgaaatcagtatacccggactgactgcctgcggggtcgggcagaatagagccatatttttcttcttgcagaaagcctatagaaggatgtgcaagtaggagaaatattgctgaattcttttcccagcatggaagaaccctggggaaggaatgcattcctgggggtaggtctatagatggccgctctgggagtgtttgtcttatgcggttgagataaggattgaaatacgccctggtgtcctgcagtaccctcaggcttactaggattgggaaattccagccgggtattctagtcaggtggttctctgttctcccctgtt

SEQ ID NO: 693632 - DNA, 429 bp, Homo sapiens
  misc_feature (83)..(83): n is a, c, g, or t
  misc_feature (111)..(111): n is a, c, g, or t
  misc_feature (151)..(151): n is a, c, g, or t
  misc_feature (163)..(163): n is a, c, g, or t
  misc_feature (206)..(206): n is a, c, g, or t
  misc_feature (228)..(228): n is a, c, g, or t
  misc_feature (251)..(251): n is a, c, g, or t
acaaaatggggcgggtgggggaggggccctatttttaaaataaaataactgttccaaaagttgggggttttttaaaaaaattnaagaaaaaggaaagcctaatcctgtaantgccacccttttccacaatttaaatacattttccttacantttccctgtgantttccgaaactaaaccattgtgtgtccctgtaagtgtccctgngtttgactgcccgctcagcagncttccctcggggggatttggaanacctgtgtctgtcgccgcactgcctgtgggaggcgcccagagggctgctgggactggcgtctgtacacacttgtttggccttttctgtagttgatgctgtaaactctatggctttttaaaaacgatttcatgtttttatttagtattggaaatccaatacacttttttaatccaatca

SEQ ID NO: 693633 - DNA, 222 bp, Homo sapiens
cagtcagttgaactcacattctggtgggcttgttgtgtccggcttctctcacttaggcaccatgtagagggggttacacacacactgcaacatggatcagtgcttccttcctttttatggctgaatcatgttctatgtatggaaggaacacatttggtgcgttaattcatctgctgacaggcattggggttcttcccaccttgtggccactgacaacggcct

SEQ ID NO: 693634 - DNA, 139 bp, Homo sapiens
ctataagctcgcgcttcttgaggtttttatggagtctcagatgtttgctggcttcatccaagacaggtagctaagaaagtgtcgggcaaagggcctttttgagcagcgagtggagcagtacttagaaggtccaggtatg

SEQ ID NO: 693635 - DNA, 394 bp, Homo sapiens
  misc_feature (391)..(391): n is a, c, g, or t
  misc_feature (393)..(393): n is a, c, g, or t
cagtaagaaggcaatcaatccaattagaaagtgggcaaaaggcatgaagagatattttacccaaagaggatatacggatggcaaataggcacatgaagagatgttctacatcaatagctgttaaggaaatgcaagctcagcatgggtgcacgcctgtaatcccagtggtttgggacccaaggcacaagaattgcttcaggcaggaagttcaagatcagcctgcgcaacatagtgagaccccatctctatgggcatggtggtgcgtacctatagtcctagctacttgggaggctgagatgggaggactgctgagcccaggagtccaaggctgcagtgagctataatcatgccactgcactccagcctggacaacagagcaaaaccctgaaantna

SEQ ID NO: 693636 - DNA, 614 bp, Homo sapiens
ttgcttccgagggtttctggcccctcattagttgcgttgtgcgtgcgcccctgtcttccctggctagctagggctttccaacgtgtgtctatgcgtgtcagttacccctttggtgtttctcagcgtgcgtctcctagggttttctccgcagtcctgttggctttgccgtgttatgctatgcccgggtgcttagctagcttcctagctgctctaaatcttgtctccgactctactttcgtcctcccggtaagagcttctatagtagcctaaagatacctgctgcaagtcactgccgttcacatagtgcagcaacccgagcccatggagtattgcctcttctaggcagctgctcaagccatgtccttcatcctgtttctggagagtagtctagaccaagccgattgcagaaccacattctcgtggttcccaggagagccccattcccagccgctggtactctccgtgccgcagttctatattctgcttcaaatcagccttacaggtgtcaccacagcatggcccactgctagacaccgagtacaccaaagtggttcccgaatctaaatcatgccatgacagaggccattacccccatggctaatatttgttatttt

SEQ ID NO: 693637 - DNA, 567 bp, Homo sapiens
tgggggtctcttccttgacctggtaacttgcactcttccacccactggtggaggactaagtgtcttgaacttccagaacgacagccaggccccatactgggccttggggagaagtggggaggcctaagcagtggtggggggccacagcaaggcatggcacacagtggtttttatttctttcagggatttataaaggcattgagcacagtgtaatttctagccaagtgaaatgaatccaaggaaatatatcaggacctgagggctgtttttttaacgttatgggaaaggatgatgagctgagagcacgtgtacagccacgcttgtgcgcagcgcccactctgtgcaataaacatgttctgcccatgttcctcagtcaggaggttcaggctcctggagagcacctgagggttccatcactttggtgcccaacaagcatatgccccccaagctgcatcttctcggagagctgcggcaggaagtctctcgtgaggaagagggtcaggaaccaggacagcgagatgctggagatcacccccaggtcctgcatcttctcggagagctgcgtca

SEQ ID NO: 693638 - DNA, 104 bp, Homo sapiens
ctggtggtgcgttgttttgacacgacgacgatgtagtctgtaggtggattctggactggtttgtgggtctgtgcctgagtctgggctggggcaggtgggctacg

SEQ ID NO: 693639 - DNA, 347 bp, Homo sapiens
ttttgtatttttagtagagacggggtttcacatgtattggcgaggctggtctcgagctcaacctcagatgatccatccacctcgggctcccaaagtgctgggattataggcataagacccagcacctggccaatagattagttttttaatgactccctcaactttgtcaggtctgtgtatttgagagcatgtatttatattggggccctaactgtatttttacatttacctattttatttatctcaggtcttgctttttacattagagacggacgctttactagtactctagttggaggggtcatctctttatcaggaaagcgcccgccaaagggtaccgaagctcg

SEQ ID NO: 693640 - DNA, 390 bp, Homo sapiens
  misc_feature (117)..(117): n is a, c, g, or t
  misc_feature (178)..(178): n is a, c, g, or t
gagatacgtccttatcgtctgtgtccaatcaccgattgagagagatgcaccatgcagtcaccatgttgattcgcgtaaaaaccagcgacgatcagacgagttgccaccatttactgnagaaaaaggatgctgaacacgcaagtcggtgcaaattattgcaattgctgtgttccaccgnccttaaagtagtcagttttcttctcttctttgacattctaagaacttatagataacttaaaacttttgtgaggaagattaatgtgggccataaaacctttaaatgttaagtgtcaagaaactgcactctcccttcttaaggactgcctaaagtgtaaaatacatttgaatgccattttgtggaagaattttttaaatgttccgttccattat

SEQ ID NO: 693641 - DNA, 212 bp, Homo sapiens
gtgaagatcctggtgtcggccatgggccggccgccccggcctgttgttacggtattgtaaggacaaggcggaaccaaaggcttggttcttccgagagtgttccttatgccaagattcggatattttgacctctgggccgaaaaagggcaaaagtgtgatatagagtttcgctttgtgtggcacatatgtgtgtagatagtgatatatagcag

SEQ ID NO: 693642 - DNA, 985 bp, Homo sapiens
ggttaagggtcactgctagatggcggcgcccaagaggctgctgagtgcgcggaacggaggatggtgctgttggcgttggtggctggggctcggctggggcggcggctgagcggtccggggctggggcgaaggggcactgtgactggcgggcgggcgctcccggagccggcgcgaagcgggagaatcctgatggccggacgtgcccctgtggtccagtacgtgagcgtagccgcgctgaccgcgccgatcgctgtcttcgtgtggggcttaaagtcttctcgggggacgctggcgtgcctacctttgtggtgcccagactccgggcccgggcccccgggacgatgcccgacgcgccggaagaatccaagcccgtgccctatcgcctgagctggacccacaagatttcatctgctgattgcaggtatggattacacactgctgtactctaatgactgctggataattacgaaaaatgtctgggagatgggactcaacaaagattctcagctagggattacacaggagccgaaagataaaacggaggggctacgaagtatgtgtgaagcctcacccgtctccctggctctgcacagaaccctcaggagaaacggttgcgttgcaggtctcatgggccgaggtcactctctaggtgtagacttgacaggaaaggagtctatcagtcaatgggaaacaattcttatgcgcaatgttgaacgaaaggttgttccaaaatttaaatttaacttgaaagtacacatagtccaacagatgcaagcattccatgtcccagttggaccagtcactatggacaggaacagacatcggtccccgaagaataacggaaaaacctaaacctgtgcaaggctgtctaatgcgaacaggatgaactacatataacaagacccaccacatgagagacgagaaagaatataaagtgacccagtatgcagcagcaccgagagatagatgaccgaaacacgcccca

SEQ ID NO: 693643 - DNA, 585 bp, Homo sapiens
caaggtgggaataatagaaactaacctatcatgcttaactctttgctgtactgcagagggaagcggaacctttcagggtgtccacttctcatctaaatggtttttgccacagacagtgacttcttcaccccagcagtgtctcatggcgtggcttagaaggtagatgaacttaccttggttggtgtttcaacttttccttttcttttctttttgagacagagtctcactctgtcacccaggctggagtgcagtggcgcaatttcggctcatagcaacctctgcttcctgggttcaagcaattctcgtgcctcagcctcccaagtagctgggattacaggcatgcaccaccacacccagctaatttggtataattagtagagatggtttcaccacgtcggtcaggctggtctcaaacccctgacctcgggtgatctgtccaccttggcctcccaaagtgctgggattaccagcatgagccaccacgccagccttggttatagctttaaatgtataaatcctttatcgacatagggatgcctgtggtctaaagagtcaggggatccaaagccttcgtgaatacagtgg

SEQ ID NO: 693644 - DNA, 2669 bp, Homo sapiens
ctgctggtaagtggtctattcctgcccacccccgggtgactagcttggccagtagtcgaccccacccggggaccgactctgggggttggagagactcttggggccggggtcgggcactccagctttcttctagccccgagctgggattccctggcctgcgccagctgcgtacacggcgagtacaccgcacctgcccgggacttcacccgcagctgcgagactcctccattcccggagggctccccacacctgctgcggccgtgccccatctccccgcagctgcggcgctgagcacccccatgtcgagaggctgagaccaggacagcagccctgaccaacgctccaataggccgggatccagccatacttcaatggatcccaggggtatcttgaaggcatttcccaagcggcagaaaattcatgctgatgcatcatcaaaagtacttgcaaagattcctaggagggaagagggagaagaagcagaagagtggctgagctcccttcgggcccatgttgtgcgcactggcattggacgagcccgggcagaactctttgagaagcagattgttcagcatggcggccagctatgccctgcccagggcccaggtgtcactcacattgtggtggatgaaggcatggactatgagcgagccctccgccttctcagactaccccagctgcccccgggtgctcagctggtgaagtcagcctggctgagcttgtgccttcaggagaggaggctggtggatgtagctggattcagcatcttcatccccagtaggtacttggaccatccacagcccagcaaggcagagcaggatgcttctattcctcctggcacccatgaggccctgcttcagacagccctttctcctcctcctcctcccaccaggcctgtgtctcctccccaaaaggcaaaagaggcaccaaacacccaagcccagcccatctctgatgatgaagccagtgatggggaagaaacccaggttagtgcagctgatctggaagccctcatcagtggccactaccccacctcccttgagggagattgtgagcctagcccagcccctgctgtcctggataagtgggtctgtgcacagccctcaagccagaaggcgaccaatcacaacctccatatcacagagaagctggaagttctggccaaagcctacagtgttcagggagacaagtggagggccctgggctatgccaaggccatcaatgccctcaagagcttccataagcctgtcacctcgtaccaggaggcctgcagtatccctgggattgggaagcggatggctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactctgggctgctgtgtgtggcatgtggttcataccgacggggaaaggcgacctgtggtgatgtcgacgtgctcatcactcacccagatggccggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgctctacttcaccggctctgcacacttcaaccgctccatgcgagccctggccaaaaccaagggcatgagtctgtcagaacatgccctcagcactgctgtggtccggaacacccatggctgcaaggtggggcctggccgagtgctgcccactcccactgagaaggatgtcttcaggctcttaggcctcccctaccgagaacctgctgagcgggactggtgacccatggctgggggtgctgaggagagccgagttggactggctacccctcctggccacccagtactccctccagcctcagctggctgaacctcgccgctccaaccaccagcttcctcagcgagcagggcccagggctctgggcctgaagcaagagccagcccggctcccagtgtctgcccggctcccagtgtctgcccagccctctcccagacaggagcaggctgccaccccttctacctcaccactgcccctcgaagaattttgcaaatggccccttgccccattttaagcaggagcaggtggctggtttgaagccccaggtatcccccttccctgctatgggaaaggccaagctgctgggtggggacagaagctgcaggggagagggaagcagccgtgctgtcaacatcatccggcaccctctggggtaggagaacagccattccacatgtgttccctctatccgtcctgcttcctgggcagctggtggtgctgggaatggggtgccccagccttggtgaggacagtgttgggaggcccaggggcccagtaaagtgcatttgacattga

SEQ ID NO: 693645 - DNA, 254 bp, Homo sapiens
tgacgtgcaggttgtgggctgactggctgggactcgttggtgctgtgactacctgtgggccgctggggacacgacggctgctggggctggcgttgtgacgctgaacgttgctgctacgggctgacgcacgacctgggaccttgacggctgacggcacgacctggtgacccgaacgctgtgggttgaaccctgacgtgcctggactgggtggttgtcacgctggtggctgacggctggacgctgaccgaccgacg

SEQ ID NO: 693646 - DNA, 566 bp, Homo sapiens
acataaggcagtgtctaaagacatttacggttgagacaactgtgggtgaaggggtgctactggcatctagtgggtagaggctagggatactgctataataaatacctataaagaacaggataggctggacatggtggctcacgccagtgatcccaaaactttgggaggccgaggccagcggatcacctgaggtcgggagttcgagatcagcctgaccaacatggagaaacctggtctctactaacaatgcaaaaattagccaggcatggtggcacacgcctgtaatcctagctacttgggattctgaggtgggagaattatataaacctgggaggtggaggttgcattgagccgaaatcgcaccactgcactccagcctgggcaacacagtgagattccatctcaaaaaaaagaaaaaaaaagttccagaaaggagattaaattactatctggctggggcatacatagggttaattaagcaagacttactgaagttagggagcttgattattaaaaaggagtgaccagtgcaacagaagagggagcccattccatagcagcttaca

SEQ ID NO: 693647 - DNA, 2319 bp, Homo sapiens
aaaattctggccatttgccctccttccccccttcgtccgctctcattggctctgctgccttcatgtgcttcagccctacgttgtttatgtccagaatcagatattggagctgactctgcctgtccagggcctgcagagtggctgagctcccttcgggcccatgttgtgcgcactggcattggacgagcccgggcagaactctttgagaagcagattgttcagcatggcggccagctatgccctgcccagggcccaggtgtcactcacattgtggtggatgaaggcatggactatgagcgagccctccgccttctcagactaccccagctgcccccgggtgctcagctggtgaagtcagcctggctgagcttgtgccttcaggagaggaggctggtggatgtagctggattcagcatcttcatccccagtaggtacttggaccatccacagcccagcaaggcagagcaggatgcttctattcctcctggcacccatgaggccctgcttcagacagccctttctcctcctcctcctcccaccaggcctgtgtctcctccccaaaaggcaaaagaggcaccaaacacccaagcccagcccatctctgatgatgaagccagtgatggggaagaaacccaggttagtgcagctgatctggaagccctcatcagtggccactaccccacctcccttgagggagattgtgagcctagcccagcccctgctgtcctggataagtgggtctgtgcacagccctcaagccagaaggcgaccaatcacaacctccatatcacagagaagctggaagttctggccaaagcctacagtgttcagggagacaagtggagggccctgggctatgccaaggccatcaatgccctcaagagcttccataagcctgtcacctcgtaccaggaggcctgcagtatccctgggattgggaagcggatggctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactctgggctgctgtgtgtggcatgtggttcataccgacggggaaaggcgacctgtggtgatgtcgacgtgctcatcactcacccagatggccggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgctctacttcaccggctctgcacacttcaaccgctccatgcgagccctggccaaaaccaagggcatgagtctgtcagaacatgccctcagcactgctgtggtccggaacacccatggctgcaaggtggggcctggccgagtgctgcccactcccactgagaaggatgtcttcaggctcttaggcctcccctaccgagaacctgctgagcgggactggtgacccatggctgggggtgctgaggagagccgagttggactggctacccctcctggccacccagtactccctccagcctcagctggctgaacctcgccgctccaaccaccagcttcctcagcgagcagggcccagggctctgggcctgaagcaagagccagcccggctcccagtgtctgcccggctcccagtgtctgcccagccctctcccagacaggagcaggctgccaccccttctacctcaccactgcccctcgaagaattttgcaaatggccccttgccccattttaagcaggagcaggtggctggtttgaagccccaggtatcccccttccctgctatgggaaaggccaagctgctgggtggggacagaagctgcaggggagagggaagcagccgtgctgtcaacatcatccggcaccctctggggtaggagaacagccattccacatgtgttccctctatccgtcctgcttcctgggcagctggtggtgctgggaatggggtgccccagccttggtgaggacagtgttgggaggcccaggggcccagtaaagtgcatttgacattga

SEQ ID NO: 693648 - DNA, 2370 bp, Homo sapiens
ctgctggtaagtggtctattcctgcccacccccgggtgactagcttggccagtagtcgaccccacccggggaccgactctgggggttggagagactcttggggccggggtcgggcactccagctttcttctagccccgagctgggattccctggcctgcgccagctgcgtacacggcgagtacaccgcacctgcccgggacttcacccgcagctgcgagactcctccattcccggagggctccccacacctgctgcggccgtgccccatctccccgcagctgcggcgctgagcacccccatgtcgagaggctgagaccaggacaggtgcagggcgttcccactcacccccgaaagtcctcctccttcctctgcgagtctgtgttggaggtagagaaatagtatgtggggtttatgtgcaggtcctccccaggctccgctccatcccctaaagctccatttcctagcccagcatcccatttggtaaagcccttcgaagtgggccgcagcagggctgtgctgaatctttagcgcaacccctctgaggaatggtgtcgtttcctactcctcaaaagtacccccgatggcaccagccttcccctcatttcccgtaatactccaacttcgaaaggctggggagtgtgaagctaggctaaaccactgaagtttaaccgggtttgaagagaccccctcccccgacccgcttccccaaactgggctgctacccccaaagcctggtcaggaaagaccctacctccataggcaaaggggttggagggcctcaattctggatttccacgtgcagcagccctgaccaacgctccaataggccgggatccagccatacttcaatggatcccaggggtatcttgaaggcatttcccaagcggcagaaaattcatgctgatgcatcatcaaaagtacttgcaaagattcctaggagggaagagggagaagaagcagaagaggcctgcagtatccctgggattgggaagcggatggctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactctgggctgctgtgtgtggcatgtggttcataccgacggggaaaggcgacctgtggtgatgtcgacgtgctcatcactcacccagatggccggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgctctacttcaccggctctgcacacttcaaccgctccatgcgagccctggccaaaaccaagggcatgagtctgtcagaacatgccctcagcactgctgtggtccggaacacccatggctgcaaggtggggcctggccgagtgctgcccactcccactgagaaggatgtcttcaggctcttaggcctcccctaccgagaacctgctgagcgggactggtgacccatggctgggggtgctgaggagagccgagttggactggctacccctcctggccacccagtactccctccagcctcagctggctgaacctcgccgctccaaccaccagcttcctcagcgagcagggcccagggctctgggcctgaagcaagagccagcccggctcccagtgtctgcccggctcccagtgtctgcccagccctctcccagacaggagcaggctgccaccccttctacctcaccactgcccctcgaagaattttgcaaatggccccttgccccattttaagcaggagcaggtggctggtttgaagccccaggtatcccccttccctgctatgggaaaggccaagctgctgggtggggacagaagctgcaggggagagggaagcagccgtgctgtcaacatcatccggcaccctctggggtaggagaacagccattccacatgtgttccctctatccgtcctgcttcctgggcagctggtggtgctgggaatggggtgccccagccttggtgaggacagtgttgggaggcccaggggcccagtaaagtgcatttgacattga

SEQ ID NO: 693649 - DNA, 605 bp, Homo sapiens
  misc_feature (434)..(434): n is a, c, g, or t
taacaccactagcctaataatacccccacatattttctacccacattagagcaatattttctccccccaaattatgtttgcgcccacatctctagaaaatctctttgttattattgaatctcccctccctgtccctctttaataccacctgtgtctcatcatagatcctcaccgccacgacactgtgctaagaacaactattttgagacaacaagcaaaaggagcctccggtgttccaaaagctcttgtgtgtataaagagctctctctccccccctctctttgtcgcgattctgtgtgttaaagaaagcctcgtttttcgcccacactctctctcacagggggcgacgagagagagaattttgtgcccactactctctgtgagcagccatcggtttatctctctcgggaacagtgcgaacactcgcgccacanggttattctcacctagtgtaataggagtggagaaccctgtttcgcccacaaaaaggcgtatcttttgtcgcgccaaattcaccacctcctaacattctcgcaatattattttcatcgagccctgtaaacactaaaaagttaaaatatcggtccttcaaccaacagacaaaa

SEQ ID NO: 693650 - DNA, 917 bp, Homo sapiens
  misc_feature (905)..(905): n is a, c, g, or t
  misc_feature (907)..(907): n is a, c, g, or t
  misc_feature (909)..(909): n is a, c, g, or t
  misc_feature (911)..(912): n is a, c, g, or t
aggccctgtccaaacgggcactaattggccccgggtatttaggcgccccctttttttttttgcagtaagtaactcagaatgactttactcaggaaatatgaccatgactcactggctaggagtgccccatgcccagttcttagagacccttgatagctcctagaagacaggaggctgccgtggtcaagaagggccaagccttgaagtctcacggcaccccctgtggtggaggtataaggctcaggggccaactactgggtcttgcagtccccatcgttgctgtgggctgtcttcaccttctttagttccttctgtagctcagactcggccaccacaacctcctttggcttctggtaagagatgatcagggtgcagttggcgtgggcaaagctcagcaaggcgtcatccagaggtagctggtgtctatctagatcaggaatggagaacttcttgtagtacttcttgttggttgttctgacaatgatgcagcgctccttctggtccacagagacactatagacatccttaggataggggaggtttcgaatccgccactggaaactcatcttggtgtccttgcgcatgaagataggattggcattgctttccttgatgagttcaggccccaggttccctgctcctaggggcgctgggtctcctacttcaagctgccactggcccatggctcccagggcacttttcacacgccactttctcacaagtagttcactcgtcttctcgtcatattcttcagccatttccttgccgtctgggaataaatagtgaaccttccttctcccgtcctgcagcagcgcagtcttctgggctgtccgcagactctccaaccagcccgtcaccgccatctttcccctgctaagcagcacgcccagccgctgccatggcancngngnnccgct

SEQ ID NO: 693651 - DNA, 419 bp, Homo sapiens
  misc_feature (20)..(20): n is a, c, g, or t
  misc_feature (67)..(67): n is a, c, g, or t
  misc_feature (96)..(96): n is a, c, g, or t
  misc_feature (101)..(101): n is a, c, g, or t
  misc_feature (111)..(111): n is a, c, g, or t
  misc_feature (118)..(118): n is a, c, g, or t
  misc_feature (131)..(132): n is a, c, g, or t
  misc_feature (138)..(141): n is a, c, g, or t
  misc_feature (144)..(144): n is a, c, g, or t
  misc_feature (150)..(150): n is a, c, g, or t
  misc_feature (154)..(154): n is a, c, g, or t
  misc_feature (156)..(156): n is a, c, g, or t
  misc_feature (178)..(178): n is a, c, g, or t
  misc_feature (195)..(195): n is a, c, g, or t
  misc_feature (231)..(231): n is a, c, g, or t
  misc_feature (258)..(258): n is a, c, g, or t
  misc_feature (272)..(272): n is a, c, g, or t
  misc_feature (282)..(282): n is a, c, g, or t
  misc_feature (293)..(293): n is a, c, g, or t
  misc_feature (300)..(300): n is a, c, g, or t
  misc_feature (328)..(328): n is a, c, g, or t
  misc_feature (331)..(331): n is a, c, g, or t
  misc_feature (333)..(333): n is a, c, g, or t
  misc_feature (336)..(336): n is a, c, g, or t
  misc_feature (339)..(339): n is a, c, g, or t
  misc_feature (345)..(345): n is a, c, g, or t
  misc_feature (374)..(374): n is a, c, g, or t
  misc_feature (379)..(379): n is a, c, g, or t
  misc_feature (393)..(394): n is a, c, g, or t
  misc_feature (404)..(404): n is a, c, g, or t
  misc_feature (412)..(412): n is a, c, g, or t
ccacctttaatcaggctgangtcctggcttgcacaggaaacacgcacctaacctcaccaacctcaanccctccctcctcaagtctccatgcaaagnctgtnccagtcagantcgagcngtccccccgacgnncccccnnnngcncccggncggncntggctgtcattttgagggcggnaaataactggatttctngttaattggtgacatcctcaagagctgtggcaagcnatgtctcggccgcgtgatggggcaganatggtgggtcctgncggccttgtnttcaccttgtnctccttnctctcagcttacttggggttcattaccntcntngtngcnctcttnttaaggggattatcattgttccactgggncttgngcttctccttctcnnagcgcctgtnctcccggnggtcgct

SEQ ID NO: 693652 - DNA, 234 bp, Homo sapiens
agaatacagcataactaacaatttagtgttgaagttagatgatctggtgccattcatacataattagcataagagcttaaaaaccaaagttgtgcccgtggcttccatctataggcagtaacctgtcattccagaggatgctgagaaatgtgttagggcacttctgtggattctcatatttactaccgggcttcctgttcggcactttagagcctaaacgatcactcacccctg

SEQ ID NO: 693653 - DNA, 2282 bp, Homo sapiens
aaaattctggccatttgccctccttccccccttcgtccgctctcattggctctgctgcagccctgaccaacgctccaataggccgggatccagccatacttcaatggatcccaggggtatcttgaaggcatttcccaagcggcagaaaattcatgctgatgcatcatcaaaagtacttgcaaagattcctaggagggaagagggagaagaagcagaagagtggctgagctcccttcgggcccatgttgtgcgcactggcattggacgagcccgggcagaactctttgagaagcagattgttcagcatggcggccagctatgccctgcccagggcccaggtgtcactcacattgtggtggatgaaggcatggactatgagcgagccctccgccttctcagactaccccagctgcccccgggtgctcagctggtgaagtcagcctggctgagcttgtgccttcaggagaggaggctggtggatgtagctggattcagcatcttcatccccagtaggtacttggaccatccacagcccagcaaggcagagcaggatgcttctattcctcctggcacccatgaggccctgcttcagacagccctttctcctcctcctcctcccaccaggcctgtgtctcctccccaaaaggcaaaagaggcaccaaacacccaagcccagcccatctctgatgatgaagccagtgatggggaagaaacccaggttagtgcagctgatctggaagccctcatcagtggccactaccccacctcccttgagggagattgtgagcctagcccagcccctgctgtcctggataagtgggtctgtgcacagccctcaagccagaaggcgaccaatcacaacctccatatcacagagaagctggaagttctggccaaagcctacagtgttcagggagacaagtggagggccctgggctatgccaaggccatcaatgccctcaagagcttccataagcctgtcacctcgtaccaggaggcctgcagtatccctgggattgggaagcggatggctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactctgggctgctgtgtgtggcatgtggttcataccgacggggaaaggcgacctgtggtgatgtcgacgtgctcatcactcacccagatggccggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgcaaggtggggcctggccgagtgctgcccactcccactgagaaggatgtcttcaggctcttaggcctcccctaccgagaacctgctgagcgggactggtgacccatggctgggggtgctgaggagagccgagttggactggctacccctcctggccacccagtactccctccagcctcagctggctgaacctcgccgctccaaccaccagcttcctcagcgagcagggcccagggctctgggcctgaagcaagagccagcccggctcccagtgtctgcccggctcccagtgtctgcccagccctctcccagacaggagcaggctgccaccccttctacctcaccactgcccctcgaagaattttgcaaatggccccttgccccattttaagcaggagcaggtggctggtttgaagccccaggtatcccccttccctgctatgggaaaggccaagctgctgggtggggacagaagctgcaggggagagggaagcagccgtgctgtcaacatcatccggcaccctctggggtaggagaacagccattccacatgtgttccctctatccgtcctgcttcctgggcagctggtggtgctgggaatggggtgccccagccttggtgaggacagtgttgggaggcccaggggcccagtaaagtgcatttgacattga

SEQ ID NO: 693654 - DNA, 1170 bp, Homo sapiens
ggcccagcggaacacactctcttggataattaccacgatggcgtcagcaaacactccaccctgtgcctttttagtccttcccgccctcctgcctctcccttacaccctcttaacgactttcaaactaaaggtatacatcattatactgacaaactcaatgtggtccctttcaaaggaattagccatggagtctcaaaaaggcaaataaatggctctaagtggaccaggttttgctttcaaaacaagtaacatctacatttgtgtcttttttttttcccagttctcctgttcatgtcctggttgaacatcacctgttggtgtcttaatttctcaaattccttttggggcaagaataatcaacgcacggtgaatttaaccattatgtccatgtacggtcaggtggctgtaacctaatagttaatgtgggacttgattctttacccaagcctgggctcaacgaatctgtggaggcatgtgactgacgtacctaaattaaaactttattttgtgaaaaccaaaactaattttttaaagcccacaaaggttgtccataggtgcatttcaactcacaggggactgaacaacaccactgaactttttaaagaactgtaaggttggaacctattggtcaaaggacagtttttacaacgcagcggaatgtccgtgtatttccagcattttcaaataattggcttaaaatccccttttcacagacatctggacaattcgggcattcggtttaaacccttgtgctggacctaacaattcaaattcacctcggggggttgtgctaaatctaatttttacccatatttggggttaggcggcgtattaatacaacgaactcgggtaagcgggggacccacaacggaaccgggtaaggccaccaggggaaacgtaccgcgactatcaggcaaaacggcatttggaaacaaccaagtccatgacacaggtgcttctgattaccacaccgacagataagcgcaccaatacgacgaaccatggggtacaaccccgttgggataccactgggacccaacatgggacaacacagtcgccctgagtgcacccacctgcgagtcaaaccaaaacacgcgacagcagcagaacacccacaagacaacaaacaatgatgtcggcccacacacgagagtaggacaacaacaacct

SEQ ID NO: 693655 - DNA, 1535 bp, Homo sapiens
cctggctctgcccacaatcaccagggcagcttggtaaggatgaagatgacaaggtccatcctcagactgatggaatcatgaacgagcatcttaggatagtggcagggctggatgatggcatgtttcccatgctccctgcctttcccaagtcctgctgagtacagacccaactgcccctaggttggtcctgcctctagccttccctagagtctggggcgatggaagccttgtgtgtgtgctcactcatgcctcttcattggtcctggatccttacagcttcccatctggctgcttttttccagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactctgggctgctgtgtgtggcatgtggttcataccgacggggaaaggcgacctgtggtgatgtcgacgtgctcatcactcacccagatggccggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgctctacttcaccggctctgcacacttcaaccgctccatgcgagccctggccaaaaccaagggcatgagtctgtcagaacatgccctcagcactgctgtggtccggaacacccatggctgcaaggtggggcctggccgagtgctgcccactcccactgagaaggatgtcttcaggctcttaggcctcccctaccgagaacctgctgagcgggactggtgacccatggctgggggtgctgaggagagccgagttggactggctacccctcctggccacccagtactccctccagcctcagctggctgaacctcgccgctccaaccaccagcttcctcagcgagcagggcccagggctctgggcctgaagcaagagccagcccggctcccagtgtctgcccggctcccagtgtctgcccagccctctcccagacaggagcaggctgccaccccttctacctcaccactgcccctcgaagaattttgcaaatggccccttgccccattttaagcaggagcaggtggctggtttgaagccccaggtatcccccttccctgctatgggaaaggccaagctgctgggtggggacagaagctgcaggggagagggaagcagccgtgctgtcaacatcatccggcaccctctggggtaggagaacagccattccacatgtgttccctctatccgtcctgcttcctgggcagctggtggtgctgggaatggggtgccccagccttggtgaggacagtgttgggaggcccaggggcccagtaaagtgcatttgacattga

SEQ ID NO: 693656 - DNA, 281 bp, Homo sapiens
  misc_feature (217)..(217): n is a, c, g, or t
aaagttcaatgcgaagttccttatgatgagactttcttacaaaattaaaccatcaattaatttgtaattttttgagtatagaaattgaaagaagagggccgggcaaggtgctgggattacaggcgtgacaccttgcgcctggcctatagaattcttaatgatgaaaatcttatgaacatatcaatctcctaggaaagtttttgttgttgttttaggnttttaggagcatacatgacgtattaccttgctctaaaggggttgttggcattctggtatagaag

SEQ ID NO: 693657 - DNA, 128 bp, Homo sapiens
gggatgggagatgtctggacggtcacacacaacgctgcatgcaggaactagaaacacatcttcagcctcctccggggccagctcttgtgctagagggtggggcggagccagcccctcaccttccgggt

SEQ ID NO: 693658 - DNA, 751 bp, Homo sapiens
gggcccagtggctcaagtgaggtcctcctgtctgcccatcagtccacactcaggcctttcaagtagttcactcgtcttctcgtcatattcttcagccatttccttgccgtctgggaataaatagtgaaccttccttctccccctccataggcaaaggggttggagggcctcaattctggatttccacgtgcagcagccctgaccaacgctccaataggccgggatccagccatacttcaatggatcccaggggtatcttgaaggcatttcccaagcggcagaaaattcatgctgatgcatcatcaaaagtacttgcaaagattcccccaccggggtatcttcagccgcctccttgacagtcttcggcaggaaggtataagctccatctctgggtgagcaggttgacagagggcagcacaggtctgggggccccctcagagggagaacctcagaagttccagtcctgaggcaggaagcaggggaacagtgctttgccagcatcccatctctctatcggggccggaatcctctccagggagagatggaacagccccgccacaccttgtgcccacgggagcctcaggaccaccaagcggagggcggtctgcaaggagatgtcccctctctacctccctgcgaagaataaattcgggctgcagatgcccctcgggctccgcagggaggagcctcactcgccactctagcttcaggctctgccttcctgatcctaacaccctccaccctctgggac

SEQ ID NO: 693659 - DNA, 893 bp, Homo sapiens
  misc_feature (79)..(80): n is a, c, g, or t
  misc_feature (123)..(123): n is a, c, g, or t
  misc_feature (125)..(126): n is a, c, g, or t
  misc_feature (156)..(156): n is a, c, g, or t
  misc_feature (168)..(168): n is a, c, g, or t
  misc_feature (201)..(201): n is a, c, g, or t
  misc_feature (205)..(205): n is a, c, g, or t
  misc_feature (231)..(231): n is a, c, g, or t
  misc_feature (236)..(236): n is a, c, g, or t
  misc_feature (238)..(238): n is a, c, g, or t
  misc_feature (248)..(248): n is a, c, g, or t
  misc_feature (255)..(255): n is a, c, g, or t
  misc_feature (263)..(263): n is a, c, g, or t
  misc_feature (294)..(294): n is a, c, g, or t
  misc_feature (297)..(297): n is a, c, g, or t
  misc_feature (302)..(302): n is a, c, g, or t
  misc_feature (309)..(309): n is a, c, g, or t
  misc_feature (316)..(319): n is a, c, g, or t
  misc_feature (323)..(323): n is a, c, g, or t
  misc_feature (326)..(326): n is a, c, g, or t
  misc_feature (344)..(344): n is a, c, g, or t
  misc_feature (349)..(349): n is a, c, g, or t
  misc_feature (356)..(356): n is a, c, g, or t
  misc_feature (358)..(358): n is a, c, g, or t
  misc_feature (383)..(383): n is a, c, g, or t
  misc_feature (409)..(409): n is a, c, g, or t
  misc_feature (431)..(431): n is a, c, g, or t
  misc_feature (854)..(854): n is a, c, g, or t
tatgtgccaggcactgttctagaccccccccagaagaaaaaacaaaaaacaagatagaggcagcaaacacaaattctgnnggagaggaaaggggcagttgagtaagacggctaagggaactgngnnggcgtgggggtgatgggggctctgccttangcctcctcttcngcctcctcaccgaaatcctcctcctcttctgcngtgncatcctggtactgctgatactcaganacgangncgttcatgtngctctcngcctcggngaactccatctcgtccatgccctcgcctgtntancagtngaggttngtttttnnnngggngangggagtggaatggtccgngatgngcttgangngctcctgggtgggtgtgctattgcnaatgaaggtgactgcgatcttgaggncacgaggtgggatgtcacaganggctgtcttgacattgttggggatccattccacaaagtagctgctgttcttgttctgcacgttaagcatctgctcatcgacctccttcatggacatccgaccacggaagacagcagccacggtgaggtatcggccgtggcgggggtcacaggcagccatcatgttcttggcatcgaagacctgctgggtgagttccggcactgtgagagctcgatactgctggcttccacggctggtgagaggggcaaagccaggcataaagaaatggagacgtgggaaggggaccatgttgactgccaacttgcggaggtcagcattgagctggccagggaaacggaggcaggtggtgacacactcatggtggctgagacaaggtggttcagatccccgtagttgggtgtggtcagcttcagagtgcggaanagcatatcatagagggcctcgttgtcaatgcaataggtc

SEQ ID NO: 693660 - DNA, 307 bp, Homo sapiens
tttattcccctttattttctattttatccccttgttaagaaagtagtggtttttatgtatgaatgttatatcacccccaattgtgattcccactggtttttaaggaaacctttggctctcccctttccaatgggtctcttatttctttcttgtatctagttgatttgagatcagtgttgagtcccagtgattcaggtggcatgcttattttgttcgtgacatcagtgggacgttttaatgtttcagcgtttaacttgtatgaagacatgtattttccttgccataataaaaaagtatttgtgtgttt

SEQ ID NO: 693661 - DNA, 510 bp, Homo sapiens
tagcagtgaattatatggtcaggctccttccgtgagccccctcccgtggctctcccccatgctgaattagagatgcgctattctcccacaagcataccctagggcttggggctagaactgaggactcttatgggatgggaagtgggcagggaaagaggaagactctccctgatgcagtgtccaagaagtctgggtgaatcttacagagatgatcaagagatgatcagggtgcagttggcgtgggcaaagctcagcaaggcgtcatccagaggtagctggtgtctatctagatcaggaatggagaacttcttgtagtacctgtggggacaccgagaggccataggggcactcggaaaggtgacccaacagacaggcgtcaggccctctgctgcctagcttctacctagttcttccacaccttccacatacgcagagagggagaagggaaaccagttagaacaccagtatttcagagctcagtggccctggaaagcatagaatgcaagcctt

SEQ ID NO: 693662 - DNA, 973 bp, Homo sapiens
ggcgcgctggggctgcagagcgggatgctgtacccccaggagagcccgtcgcgggagtgcaaggagctggtacggcctctggagcttccgcgccgacttctctgacaagcgacgaccggggcttcgaggagcagatggtaccggcgggcgctgtgggagtcagtgccccactcgtggacatgccgagttccctccagcttcaatgactatcagccagtgactggcgtctgcggcatttttgtcgtgctgggtgtggtactgaacgggaggtgatccttgccggcagcgatggacccattgacctgcgcacaatgagtggtgctgcatgattggcagttgcccattcctatgccatcgtgtgggtgaactggggtcgacaacgctagagcatgaggggtggctaccctccccttcgaggccgacaattcatgcaaaacttggtccagtgttggtggccccgtgccactcccggttccggaatcacgtatcgccatcaaacgaagacaatcaacaccgcaacagcctgcctagcagaggaccatcccaagtaccatgatcgtgacatctccaagtatcccaagggttactttagtccaagaacacataatttggacgttattcaagctacgctggactgcaggcggtctgtacttctgtacacgagagccaacactacatcgatgacatcaccgtcagcaccagcgtggagcaagacagtgggctggtgaattaccagatctctgtcaaggggcagtaaccttgttcaagttggaagtgcgtataatgggatgcaaaaaacaaagtcgtggcgacatggaacttgggaccaggggcaacttaaggtgccaggtggtcagcctctggtggccgtaactgatgcagaaggccctgcatatctagatcattggaaggtgaagatgattgacctgaagtcactggggctggtttgattttaaaactccaggggggaacg

SEQ ID NO: 693663 - DNA, 285 bp, Homo sapiens
gttgctgcgtaccaggtgaactaagggcttccaccggtacgtcgcgcatccacgttcaccacgacgcttcgagcgatcccaatcgcgactcagatgccgggtatcggaccagatagcgccggtccctcggtggcgattacggccttggcgaaatatcgctggaatttcgtcgtagctcatcgcatgcttgtgcttctcgcgcatgcgcagggccgccgcctgcctcacgcgcgcggcgacgggattcaacgtgcggaagtacacgtcctgccccacccacaaggc

SEQ ID NO: 693664 - DNA, 394 bp, Homo sapiens
gatcatcccccggcctgttccccttcctcccgagctgcctaacggggagggagccgagggccctcgggcgtggccccagaggagaacccagaggccatgctcttccccttcctgctggcaacagtcctgagcgccagcttcccacctcagagactctgagaaccagggtccacccacctgagggcctccttggctctcccttaccttgtgcccacgggagcctcaggaccaccaagcggagggcggtctgcaaggagatgtcccctctctacctccctgcgaagaataaattcgggctgcagatgcccctcgggctccgcagggaggagcctcactcgccactctagcttcaggctctgccttcctgatcctaacaccctccaccctctgggac

SEQ ID NO: 693665 - DNA, 3196 bp, Homo sapiens
aggccctgtccaaacgggcactaattggccccgggtatttaggcgccccctttttttttttgcagtaagtaactcagaatgactttactcaggaaatatgaccatgactcactggctaggagtgccccatgcccagttcttagagacccttgatagctcctagaagacaggaggctgccgtggtcaagaagggccaagccttgaagtctcacggcaccccctgtggtggaggtataaggctcaggggccaactactgggtcttgcagtccccatcgttgctgtgggctgtcttcaccttctttagttccttctgtagctcagactcggccaccacaacctcctttggcttctggtaagagatgatcagggtgcagttggcgtgggcaaagctcagcaaggcgtcatccagaggtagctggtgtctatctagatcaggaatggagaacttcttgtagtacttcttgttggttgttctgacaatgatgcagcgctccttctggtccacagagacactatagacatccttaggataggggaggtttcgaatccgccactggaaactcatcttggtgtccttgcgcatgaagataggattggcattgctttccttgatgagttcaggccccaggttccctgctcctaggggcgctgggtctcctacttcaagctgccactggcccatggctcccagggcacttttcacacgccactttctcacaagtagttcactcgtcttctcgtcatattcttcagccatttccttgccgtctgggaataaatagtgaaccttccttctccccctccataggcaaaggggttggagggcctcaattctggatttccacgtgcagcagccctgaccaacgctccaataggccgggatccagccatacttcaatggatcccaggggtatcttgaaggcatttcccaagcggcagaaaattcatgctgatgcatcatcaaaagtacttgcaaagattcctaggagggaagagggagaagaagcagaagagtggctgagctcccttcgggcccatgttgtgcgcactggcattggacgagcccgggcagaactctttgagaagcagattgttcagcatggcggccagctatgccctgcccagggcccaggtgtcactcacattgtggtggatgaaggcatggactatgagcgagccctccgccttctcagactaccccagctgcccccgggtgctcagctggtgaagtcagcctggctgagcttgtgccttcaggagaggaggctggtggatgtagctggattcagcatcttcatccccagtaggtacttggaccatccacagcccagcaaggcagagcaggatgcttctattcctcctggcacccatgaggccctgcttcagacagccctttctcctcctcctcctcccaccaggcctgtgtctcctccccaaaaggcaaaagaggcaccaaacacccaagcccagcccatctctgatgatgaagccagtgatggggaagaaacccaggttagtgcagctgatctggaagccctcatcagtggccactaccccacctcccttgagggagattgtgagcctagcccagcccctgctgtcctggataagtgggtctgtgcacagccctcaagccagaaggcgaccaatcacaacctccatatcacagagaagctggaagttctggccaaagcctacagtgttcagggagacaagtggagggccctgggctatgccaaggccatcaatgccctcaagagcttccataagcctgtcacctcgtaccaggaggcctgcagtatccctgggattgggaagcggatggctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactctgggctgctgtgtgtggcatgtggttcataccgacggggaaaggcgacctgtggtgatgtcgacgtgctcatcactcacccagatggccggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgctctacttcaccggctctgcacacttcaaccgctccatgcgagccctggccaaaaccaagggcatgagtctgtcagaacatgccctcagcactgctgtggtccggaacacccatggctgcaaggtggggcctggccgagtgctgcccactcccactgagaaggatgtcttcaggctcttaggcctcccctaccgagaacctgctgagcgggactggtgacccatggctgggggtgctgaggagagccgagttggactggctacccctcctggccacccagtactccctccagcctcagctggctgaacctcgccgctccaaccaccagcttcctcagcgagcagggcccagggctctgggcctgaagcaagagccagcccggctcccagtgtctgcccggctcccagtgtctgcccagccctctcccagacaggagcaggctgccaccccttctacctcaccactgcccctcgaagaattttgcaaatggccccttgccccattttaagcaggagcaggtggctggtttgaagccccaggtatcccccttccctgctatgggaaaggccaagctgctgggtggggacagaagctgcaggggagagggaagcagccgtgctgtcaacatcatccggcaccctctggggtaggagaacagccattccacatgtgttccctctatccgtcctgcttcctgggcagctggtggtgctgggaatggggtgccccagccttggtgaggacagtgttgggaggcccaggggcccagtaaagtgcatttgacattga

SEQ ID NO: 693666 - DNA, 738 bp, Homo sapiens
agcggtgtatatgacaaacattccctatgtaaaatcagctgaagtgtttagtgtgaaatttcagattatttaaagagaagtttcactatgtttaagtagagacaagtcataagaagtgccctctagcagaaatttacctgaacttgctttaatgagcatggaagatgcactacttacacagagatcattcagtccaagtcgtggacctaatcttgtttctagtcaaagtatacctccttttcatcgcaattgtgatatttgatttgcaaggctaattatttcaagatttgtacaaagaacaacataagtggaatgacattatttactgtggattttagtgatttacaatgtgggtggtgtgtgtgtgtctgtgtggcagagagagaaaaagaagagaggatgagaaaggtatggtttcggtttgagaaaaatatatatatggttaataatttctttatgattaacactaacaagtcatacctgtgtcaatgaatataattctaaggcaactaactaactttaaatttttttccactagaacattttgagaattattaacaatactagacattttattctctaattcctttctggtgactgtaattttcgtatctgggattcaaacctcaaacacttacttgattgggcgaaaaaccattcatgaacaattcttcaagccaaggctctacatgcagttgaaactgtaactattggtgcctataacagtgattcgcgggg

SEQ ID NO: 693667 - DNA, 320 bp, Homo sapiens
aaaagtggcttccgggtggcgctctctgcagggccacagcctcagtttggagactagatggaggatgttaggtgttctggctaggcccatcaacctagttgcatttcctcgtgcgcagtattacctttcataatgcttctggggttttttgtttgtttgaagaccagacattagaaatcaaatattttatttgaaggtagacctttcagtgacttttttccactcttacttttgtgtgaaagaaaaagctataaatgcgccaattacttgtttgcccgtaataaaggaaaaagtgtattggcttctctttttatgcaaaa

SEQ ID NO: 693668 - DNA, 664 bp, Homo sapiens
gggggaagccaggacaccttaaacggtcccacatttaggggtccggcctaggtaacggggcacaaattagcttcgagattttcccggacttttccttaagggccttttcttgatggttccaggactggttactgcagaaattcacagggtcactaaccggggcatggaaaaaagggttactcaataaggggatcactggattctgattgaaagaaataggctcatatctgaaattgaccgttactatgtgtaaaagggttaggagaacatggattaaggaagcattttcctgattgacgaaaaacttaactcagaaatggccatctacccttggtacaagtgcccagggtataatgtaacatgcaatgaggtatgaagcgctgaataaagttgagcttaataaaaaaaaaaaaaaaaaaaaccatgtcggccgttttggcccattcgactctagactctatcaaccttatccagctgaccaaattcacgcaaattggggcaatttggcctatagtccgtttattaacaattattggcctaattttcccacgtttacacttggaaaaccttgaaacccccaacttaaaccccttgaagcctatccccttttcccccattggcccaattgccgaaaagcccaacgggtcggccttttctttccttt

SEQ ID NO: 693669 - DNA, 230 bp, Homo sapiens
ggaaacaccagcatcggcagaggtgatagctgaggaggagcggggatttggacgagagacacaggatgagtaccgcggggcagcccgtgatcacaactgctgcagaggcgcgtttgttcgactcgctagtcttctgcggctctatgcggtactaagagcagaggcagagatacacaacacaaaagtagccggcgtgtctgccgtcaatatccagctactcggagctagca

SEQ ID NO: 693670 - DNA, 283 bp, Homo sapiens
catttccaattaacctgctacctgatctggccctgaaccccggccaaagcactcaccccggtcatcttctttaaataagccaatcggaattagtttagcctgtgcgtctaaccctagtcaacaggggaatgacacagcagcaaggggccacatgcatcagggataaagaaccccttcccctcccttgtccaagtgtacgttcaccattgttccatctgtaagggcgcacccttctatacagaagtaacttgccttgctgagagtcgacgcggccgcgaattta

SEQ ID NO: 693671 - DNA, 343 bp, Homo sapiens
cctaacaggcttggagctctgcaagtaatctctagccacactgattactactaaaccagagaaagcatcaaggtgtcttgaacttcctttaactattgagtgcattagaacattcctgtacccacattatactgcaagttgtgtctctctctgtcatgtattccacagcgcttaagtggataagaaagacaacagtgtcagcacagccatcgacattaatgcactgaatgcatgcatctttcctcctgagacagcaatcgattttacaccgttctgagattgatcatccatgacagcacaacatacccactcggatatctaaaagctagggatggcattgctg

SEQ ID NO: 693672 - DNA, 280 bp, Homo sapiens
  misc_feature (26)..(26): n is a, c, g, or t
  misc_feature (28)..(28): n is a, c, g, or t
tctagaggatcccggtcaggcactgnanagcgggcgacagagcgagactccgtctcaaaaaaaaaaaaattaaaaaaagttacttgactcatatggccatattttaacattcttggctctgttatgtgatcaattgtccctaaaaccttgggataggaaagttagttcccctatgtttaagatgtgcttctttacaaagagaaaaagaccaggagacttatttttttatttcagtagggaaaaaattgtgattaaacatcgcgtgggtaaaaatgatttt

SEQ ID NO: 693673 - DNA, 1321 bp, Homo sapiens
gccggcgtcgagccgccatcatggacaccagccgtgtgcagacctatcaagctggccagggtcacccaacggtcctgcgtgcaggatacggtatcatcagggaacagtagcacagcaggtgctgcgtggaattcatgtgacagacaacagagccgatccatcatccgccaatgtaagaagggcccgatgtcgcgattgggccgaccagtggtcagccctattgggaagatcacgagcgacagaatagcccggacggttgtcgctgaggcttggactagttcgctggcgtctcaggaatgatcgtagattcgacccactttgggtcccgcactgcggaaactgcgatcatggtcaacaagatcatgcgtcactattgtaacgttgggctctcgacacaacaacgtctagccatcgacactggctcgcctttaacgaaatcacaagaccgtgggggaagatagcaccaatacggctacaacaataaataggacaattaaagacacacattagaacgccctatccacactctacgcactaaccgcttcgataacgcgacacgccacttgagatccggcaccaacgaaacagacaccattacacggcacagccccaagcatgtctgatcaagaatagagtgattcagataagcgaacccatgggccggagcatggcattatcaattaatacccgcctcataaagcagatgaagcacactggctacactgatacaactcggcacgtcaaacacccccggcacctcaaacaccgtccaaccacaacccacaccaatgggaccctacaaccgcccactaacctacttagcagcgggcccacacttcacttatcaagatcataccagacgaataggaaacagcacacagcgccaccccccacccgtgaacaaggccgcccaaaagataccacccaccgaacacacgacaaggataagacggaccaacacggcggctaaagaccccacatgaacgcgccagagcaccggacacacaagggcagacaacccagactcgcataaaaccccaacgaaaaagactcacggcaaaaagcacaacaccatagcaaccccccacaaggtgtacaacaacgctgagactaaacgcacacgtaacacatcacgcagtccgcgctgccttagctagcacccaccggaacctccaactccgcgtaccaaacaccgccccgcaccacccaccccacatctacccatacacaacaacacgaatgaaccatactcgcaatgccgcacacggcctactacaactagcaccacacaccccacgtccacacaagcaaacataatttg

SEQ ID NO: 693674 - DNA, 747 bp, Homo sapiens
ggacgcgtgggttttttggctggggctgccccaaaggggcagacaggtttattgggcagcagctgtgtgaaaatcggtggctggacatggtctgtagcgcgtgccagcttcgtccttgcttgctgtagatggcatagcgagtctgtggcctcccttggctcgcaactggatcgaccagcgctatctgtcaggctactcaggagtgttctgaagtgttcctggactgcattacttctctgagcggccttggtgcgtcatgtcgacgcccgtagtggttctggtttcatcgcggctctagatgtccggacggatccagagccatgtcgtctcacagtcccggctgcgcccaatgcgtgtggagatcctcccggggaccactgtatgactgatggcgttcaccaggacctgcagagggttctcgcctgtgcaacaggtgtatgatctcgaacggcatgcttgaccgatgcgcacacgtcatgacacttcttgccgcatgtatgcggccgtgcatcatcaattgcacgtaaagtagaaggccgcatccaaccaaatgcggaacacttgacgcctattagaggcgaaagccagtatagagcggaataaaccgacccttggcaacatgttgaagagcagggtaaccctgagcaaatcacatacatacatatcactatgaactgtaacatccatagcaagggcaaactgtaaattgatactagcacaatcaacacatggacaccaactagcaca

SEQ ID NO: 693675 - DNA, 122 bp, Homo sapiens
aggatctctcagaggcgtttagtgaccaccccgatcaggccaacagcacatcgcggcggcaagaaagtagtagacctgttcggcgtccaaatttattccttggtttttcaattagttacata

SEQ ID NO: 693676 - DNA, 471 bp, Homo sapiens
atggagagtatattcctttgtttcaaatttgggtaactctcctgtgtttcaggaacagctctccctattttttcactgccatcttcaggcttcctagccaggctccaaacaaatgtcatataagaaagaaagattaattattacatattgtgtattgagagtttgtaccctgtggttctcatcgtgctgttaattttacttttcttgccaaacaaaaataatttgacattgattatgtgctttttgatattttcaagggcaattattaaggttatgagctctgtcttagggcacttgatgccttatatgttaatagcaagtgtgtcatatcattttaaaataaaactattcaaaggctttattgtgtttattaagcttaatttaaattggaatctgtaatgctgatttggtcttttaaaattatatttgaaattatttgtccaaaaaaaattaaaatgaatatttacccct

SEQ ID NO: 693677 - DNA, 1031 bp, Homo sapiens
  misc_feature (272)..(272): n is a, c, g, or t
  misc_feature (545)..(545): n is a, c, g, or t
  misc_feature (705)..(705): n is a, c, g, or t
gacatctagtgatatatactctctttccacatatctgtgttctatgctcttcaactatcttggtttctcacctcttctttacattcacgaatgccttgtgagtaatatctatatctgtagaacaacatattcttgcggtttgcactaattttttccacacgtggcacattcaccatcactggtggacgcatcttgtggacaaatgctcatggtgcgaaacatagacttgtgggttccacaaatatctcttaaaccacaatatatacccgtgnataggcttccccaagaagttgacttgtcttgaccagtatgcgttgacttgtcagcacagcaagactaggttaggggtagtctttccttggggcccacaggcaacatttcaaacattgtccttgccaactggttcatacccataccatatacctattatattgcgttggtccaagcacagtgggcattgtgcgcagcatattgtacaagcgatatatcatctcaccttcatctggccacttatcttccaagcaagatatgaccctgttgatgcnacgaaagctcatccacacctatgtgaggtcgtcaaagtgcaaagcattgtgggccagtggacatattcttgttggaacaccacgcacaactaaccttgtcagtcacaccttacaccttccttggttcgttgttcgttcaaaacacattagtgttggcacnttgcacgtaccaccgtcatttgcacgcaccacttccaccacaaggcacaaaaccacttcttccaagcctggttatcgtcgtgtggcacaccttgttttacattcccacctttttcctatattcccacttaaggtggcccaacaatagggcataggtggccattaatcctataatttttacatattaccgccctgacatccctattagcaacggaggtaatcacatattacaacagaatgtatacaaggacatctgggaagcagcatcaggacacacttgacgaacgccctcttcacactctgtcaacagtattttacctatcgcct

SEQ ID NO: 693678 - DNA, 252 bp, Homo sapiens
gacgaacgtaagccgacgggcgtctttgacttgtgtcgtacctgggtggacacggtgactttactcggacactgggacggtgacttcctacgggggttgttcgactcccgatttcgatgcaacgacataggacggtggacgtgcttgctacgggctgtcaactacactgacacggtgcacggactgacagtgacccggtacaacgacactcgtgtgacgggatgggaccttgtcgtgctgacgctacgcctc

SEQ ID NO: 693679 - DNA, 274 bp, Homo sapiens
tgtaaatggccgagagaatggctgacgggttgatcttgctgagttccttgaagacctctagggtgcgccgttgatccacacaccaggcttctgcgatttgcgccagcgcccggttgatgtaaccgcgcaacgtgtcataggtgaactgcagctgggcgtagaccagattgtgcaccgattccatgctggacaaatgagttgtattattgtcactcgtacttcttctggtcctatgagtgatattcagactgcttcggtcggccgatcgttccag

SEQ ID NO: 693680 - DNA, 330 bp, Homo sapiens
atggcttggatagtaggtgaccatggcgtggtggtaggtggccatctcttccctgtgtcttcacatggtcatcgctctgtgcctgtctgtgtcctaatttcctcttcttataaggacaccagtcatattggataaggccccaccctagtgacctcactttaatttaattaccccattaaagaccctatctacaaagataattacattctgaagcactggcaggtacaggactacactatttgaatatgaggcagagacacaagtcaacaccttagcaggtaaaacccccataacctgcaacagatccccaaatctcacctgctggcactc

SEQ ID NO: 693681 - DNA, 316 bp, Homo sapiens
cgtatgtgagttttagcttaattggtggaggaagtgatctaaaacactctttacgcctggcttctattgacttgggttaatctgtgtgactgtgtgtgtgctggcactgaaattgaccaaccctgtgtgtgttagtatagcttagttaaactttctgtttattgctaaagtgttaatcactgctgtttcccgtgtgtgtgtgtgtggctaggctaagcgtttatgagcttgattgatgtgtgcttgattgcttgatcccttttgatctgtggttgacttacgaggtgattgtactcacatgacaacggactgggta

SEQ ID NO: 693682 - DNA, 318 bp, Homo sapiens
cacgccgaagtgcgcgcgccggtggacggcatcgtcggcctgcacgacctgcaggtgggcgaatacatcaacgtcggccagaggcgatgccgctggtggccacctcgccgatctgggtggaagccaacttcaaggaaaccgagctggagaagatgaaggtcgcccagcccgcgacgatcgaagtggacagctatccgggcgtgaagtggaaggcgcacgtggcctccatcgcgcccgcttccggtgccgagttcagcgtgtgccgccgcagacacccaccggcaactgggtgaagatcgtccacggcatcccggtgcg

SEQ ID NO: 693683 - DNA, 643 bp, Homo sapiens
cctctgcgggctactgtgctggtcgctctgccgagtgtggcttctatgcctccccaggactgtgcttcccgcacgcttctcgctggacctctctcctcttgcgtattttagtccttgcagaaggaagttaatttctcttggttcctttgaatttcctcccagaaagctcagatttcttgctttttttttccccccttgttcttcagtaatcgctcccctcatggatactagaagagaagaccacaggcatgaggcaagtctctcgaaatacacactgacaaagagacactcctcgctaccggaagtcattcagaatagtcttatactctaatttgcatttctttctcttcttccttccgtaggaattaccttctcttttggtagtccctaggccaaagataagttcaccttaaaacaaatggctagaacttttacacagagacacgcaattggatgcttcttattttaaaatgcaaagataatctaggggcacaaaaatgcagagcgggtacttaactttcattctccagatgtcttcagccaggtccccatccagcctccagtctgtctgtgagggttagaatgtttccttcagtttggatgttggggttgtaggttgtagaaggctttaatccctcatcaa

SEQ ID NO: 693684 - DNA, 493 bp, Homo sapiens
agatgccacagaatggggagacaaacctattcttaagaaacaaaccaaaaccatcatgccaggtgcggtggttcctacctataatcccagcacttgatgaggtcaaggcgggtggatcactagaccccaaaagtttgagaccaccctgtgcaacataacaaaaccctgcctgtcctaaaatttttaaaaagcataaactggtcatgggggctgcgacctgtagtcccagactgacctaggaggatagctggaccctgggaggtgcaggttgcagtgacccatgatagtgccattggactgaagcttgatcaacatagcgagaccctgtctgcggccataacccgtccattaggacctgcgatgaacagtttgtgaagatctacttaccacagttgaactgctggtattttgcaacactctatttataaaatctgtgaggccaatcccctaatattagcaaggacgtcaaggatcttttcatgaccctgattac

SEQ ID NO: 693685 - DNA, 1105 bp, Homo sapiens
  misc_feature (690)..(690): n is a, c, g, or t
aatgagagcgagtctgattgagaaggtccctgttcacgtagccgagatgaagaggatgatagatgagaaagctatcagagatgctctcgacaacaaagtgataagaggaacgacactcttggtcaatgcaagtcgaatcccctagacccacgtgaagcatgccagtttgaatccgtgaatcctttggtccttgtataacgcataggaggaggtggtcagtgaacatacggcaccacgtctgggacaacacacttgcattccgagctgtactgagctcagaagagcaacctacctagaacgacactatggaatcacacgtcaactatgattcgcaagcgctacaagatgacaccctagagtcagtcacggccagaaaacctgatgactattaagtcgttcagtcctcagtagacgagctcagatcctacggccatagtggtcgctgaaattccttgtccatggcaagcattctagtagagttgtgatatcgatactagttgtcagaacggttatacacggatgcctacaatggattcatggagccgcgacgaacgcgcggaactaaaatccctatggtacgcgaattacttgaatcctccttgtctgaaacatagcgtgtgctgagtagacgcaaaagacgaacttacagcgtgaatgttgtgacacatggcttccgaggaatgggagggnttcactgacgggaaggagtgcaatagtacatttttaaccaaccgtctaagctcattcgttccccactgaatgccacaaaaccggggttagaacgaaggagggcaaggtccacaccgaattggggcctgacatgtcggcggtggtcttttctcgttacttcccaaaatgtagaacattatttgagcagggtgcaaagccatttgtaagaccaaaccttttccctccaagtccaattaagacaacgaacatttttgccaatttgcgtcctagagggcatttccttacttgcacgtggtaggggagctaagccaccatttttggacaatttgcttacgcaattgtgtcaatgtcgcgtaaaactggaatttacctcgaatggttgacctggcacccggtaagggggcaatactctaaa

SEQ ID NO: 693686 - DNA, 621 bp, Homo sapiens
  misc_feature (534)..(534): n is a, c, g, or t
  misc_feature (620)..(620): n is a, c, g, or t
tgagacctgtggctcgaccctgctgatagcaagatgtcttcaggaaatgcaaaaattgggtatcctgctcccaacttcaaagctacagctgttatgccagatggacaattcaaagatatcagcctaagtgaatacaaaggaaaatatgttgtgttcttcttttacctcttgactttacttttgtgtgtcccacggagatcattgctttcagtgatagagccgatgaatttaagaaactcaactgccaagtgattggcgcttctgtggattctcacttctgtcatctggcatggattaacacacccaagaaacaaggaggattgggacccatgaacattcccttaatatcagatcccaagcgcaccattgctcaggattatggagtcttaaaggctgatgaaggtatctctttcaggggcctttttattattgatgataaaggtatccttcgacagataacaataaacgatcttcccgttggccgctctgtggatgagattatacgactagtccaggccttccagttcactgacnaaccatggtgaagtgtgtccagctggctggaaacctggcagtgataccatcaagcctgatgtcaataagagccaagagtatttctnt

SEQ ID NO: 693687 - DNA, 1029 bp, Homo sapiens
  misc_feature (1029)..(1029): n is a, c, g, or t
tggaagacaagagtctcactctggtcacccaggctgggagtcacaggggtggggatctcgggctcactggcaagctctggcctcccaggttcatggccattctcctggccccagcctctccggagtagctgggaactacagggtggcccgccaccaggcccagctaattttttctattttaagtcatggccgggctaatttttggtgattttaagtaagagataggggtttcaccgggttagccaggagggtctccatctcctttaccatcgaaatccgcccgcctcagcctcccaaaggtgtggggatatacgggcatgagccaccgggcccggcctatagaaatcaatcttttggactcttctacactttaatctcccaatggcccaaggttggcctgttccataacattcattcccttccccctggctaatcagaagccatctcctctacagggtcggaactcgggtcttcatacatgattacagtcatggggtacacagtgctggctaaatctatgccgtaaatcctaagggggcttcaaatttccagggcttcaaaaaacccttgtaccgtgatgtgcaagattcttaaccagctgaacctcctggttactacagtatatggtattgaccgccaaatggtcttccattcttcaattggtgaataagggatctcacacgggttcacgaaggtttaccttccactaaggctgtgaaaccaaggtaaaaagagggcacacggcaagggcaatccggttacccggactctcgccaccagggcaggctctaatcatacgccacggacagcggacaaccctccgggggaagatcccacattggccaactggggacccaaacaactgggggactcccgcaaccaggagtaaagaaggagctctacaacaattaccccgtgagagacacgtgcacacctaacaactgttaaaccaccaaccgcgccgcacagcacgatcacacaacacacagcactcacctatccttcatgacttcgcatattattttatgn

SEQ ID NO: 693688 - DNA, 451 bp, Homo sapiens
gagccccggagtagctgggactacaggcgcccgccaccacgcccagctaattttttgtattttgagtagagatggggtttcaccgtgttagccaggatggtctccatctcctgacctcgtgatccgcccgcctcggcctcccaaaaaacaggaaagggcaatggtatatgaaatggaagattgatatctgaacaaggagtctaaataattctctgacttaattgcaatatcattaaataaaagggatcaaataaagaggtgataaggaaaacattggccttcttaattctctctacacggaggtcaaaggcgactgagggcagaaaagagagcacagggaatatcaaaacagctatggcccggtatgtgatctctcacgccagcagggatccggcacgtaatcgattattcgtcaattgttcagatacgttatcgaggtcgtatgtaatcc

SEQ ID NO: 693689 - DNA, 177 bp, Homo sapiens
gccagatgttggccagtcatccctgagctgaatgggaagctcactggcatgtgcttccgtggtcccactagcaacgtgtcagtggtggagctgaactgcgtctagaaaaactgacaaatatatgacatcaagaaggtggtgaagcaggcgtcggagaggcccctcaaaggcattctg

SEQ ID NO: 693690 - DNA, 113 bp, Homo sapiens
cacgttctcacactctgaggatgactgtctagcttacaaagttcgaccaatactttaatgtagagcttatccagccgggagcagtcaacggtctacgcctattacaagccggg

SEQ ID NO: 693691 - DNA, 1292 bp, Homo sapiens
tgtgttggaatattgttgttgttgattcgcgctgtgttacgtgtgtttagggttttgttgtgtatttggatgttgtgttaggtgcgggttagtggcttgttgggttaggtgtatgggagatggcgtgttgtttgtgcttgtggtgcacgcagtaggggtgcgcgctggatagtgtgcgggtatgcttttgcgcctgcttggtttttgttttggtgtgttggtccctatgggataatatatgggttaccaatcgtaagtgtaacggtggtggtgtgtgatggaatatttctatatttttggctatattgtttatgtttggtaagagtggttgtcccgccgagtaatgtgactgggtaggaagcactgagctgatcctaacgtgttgttatatagaaatctgttgtgctctaaagtgcagttgtaggtggtaggacatttcactgaagggtccctagttggagttggtgagtgttgcggatggtgggaattctgtttgcggtatccataggggtgtgatgttccggtagcgtgttataacggctgaatgctcttgccatgtgggttcctccatgttgtgtttgttgagtgtggggactgcttgtggttgtgtgagtgtaagtcggcgttgtgtgtactgtatggtcggtggtggcccgcctttctatattgttgtttaattcatgtatttaagttatgttagtggtcttatttgtttgtttttttactatatccgtctgaagaagtgcactattgataagaaggcagtgtaatgtatacaaagtatgtagggcgttggcaattaaatatagggtaagtgtttaattggtagataatggagagttactagcagatgtcttgtttatatagcaatggacgaaatgtatcttgtatacggatgtccttaggttgtaaagtctttctgcttggtcacattgggcacatagtgtatgacgttgtttgcctggcctggataataatgttagtatattatgtatgttttttaatagtgtcatctttgatatgagaatatatgtatttttaagcactgcacgctaataggtaatatgcacacagttttattatgtgtgtgtgtgctatattgttttgccatatagttattgtaatactattgtaactgtaacaatattacctatatatggtattttggttatatgtacttatgagtcaagtctggtttggccagactagtatacctcaaacttttagtataatatacagaaggctatcacacttgtgaaattctgcttatacattatctgggatttgcattt

SEQ ID NO: 693692 - DNA, 128 bp, Homo sapiens
tggcccaagggtgatccctgtttacagtggttcaacttttaagttaagggaaaaactttttctttgtagataaaataaaataaaaacttaaaaaaaattttaaaaataaaaaaagtttttaaaactga

SEQ ID NO: 693693 - DNA, 496 bp, Homo sapiens
  misc_feature (309)..(309): n is a, c, g, or t
  misc_feature (329)..(329): n is a, c, g, or t
  misc_feature (383)..(383): n is a, c, g, or t
  misc_feature (454)..(454): n is a, c, g, or t
tctgattagtttatttgttctgaaatatactatatctggcattaatatagccagtcttgctttcctttggctaaggtttgcatgatatatcttttcccacccttttcatttcaacttgcctgtatcatcatatttgaagttagtctctttgtagccagtatgtagttggttcgtgtccattaacctactctgccagcctgtgtcttgcaactggtatacttaggccattgatatttaatgatattgacatggtagggcttaaatctgccattttatttttccttttctgtttgttctccctggtttcgntttctgggatatgctttctntttcttaccttcctgtcatgacttgaacatctttgaggaatggtgttttgcctnatccatagtggcttttgagtatgtctgtttgtataggccctcttgggtttttccagacatttcgtatatcngtggcatctataatcttaaccacacggtattacgggtggtct

SEQ ID NO: 693694 - DNA, 268 bp, Homo sapiens
  misc_feature (178)..(178): n is a, c, g, or t
tctcctggtcactgctattttatgagtggccagagataaaggtattatccctgtcttctatattcaatgataacatatgacactctgcaagaatatagactaagaaacagtttaagttaaatagtgttttataaaaacttgagtctactaacaagtcgtatgatcataattctagccnagcaactggcatggacttacatatggtactctttatccttactactcttatcttttgcaagtacactgagctctacagtgaaacgactag

SEQ ID NO: 693695 - DNA, 342 bp, Homo sapiens
tccggccgtatgattggctgatgacacatgggagagggttgaagagaatgtgggtggtagctgaggacagacgagggccggagtgcaatggctcgatctcggctcaccacaacctccgcctcctgggttgaagcatttctcctgcctcagcttcctgagtagctgggattacaggcatgtgccaccatgcccggctaattttgtatttttggtagagacaggttttctccaggttggtcgggctggtctcgaactcctgacctcaggtgatcctcctgcctcggcctcccaaagcgctgggattacaggcgtgagccaccacacccagccattgcactccgg

SEQ ID NO: 693696 - DNA, 976 bp, Homo sapiens
gtgactggggagcctttggtgttggggtttcttgaagtgggaggagtgtagagtaagttggtctttcccggtgctatacttgcatcctctccatggaagaattgttcaggagatgcgcttggggtgactgacttccttaaatacacgctgtagcggggtgaagacgcttggagtgaccaggcgctttgattgaccttgagcgaacgggcagttcgtgggctggggtgggaacatgtgatggcgggcacactacgactaggggtaggccgcgatgacctgtaagacaggttgcggggagacgggttctaaatgcagggttatggggcgacactcagaaccaagtctaaagtgattctatcttggtacccaaccaagagtccgcccgatctagcacacatcacctgttgtctcacaacaaagtaggggaaccttgtcagtcacataggacaggatatttactcgtactacttcctttctactgaagccacaggaataagctgctattcttgaggcatcccaagggaaacgtgggctagacacaaacgccacatctcattcttcaaggcgcgcacatgtcttaggggttctcagaaattccatattataacctaggatgctcgtgatgggtgggcacaatcccctgaattcttgtccctgggtatcttacgctaacttcactatgacacaattactcctacaatatccattgcttgggtcaaaccgtgttggacttataccatttagagattactaacaccacagcattctataactactcatatacataccacccaactacacaatacacaatattaagaccaaaacacatccaaaaaatctaacttaatcaaatagtatatcacgacactagatccttataataaccatatataatgaaaaaacatcaaaaacacaaatcacacatcataacaatacacgtttcaaaatatatcactatataaaaaacaacacttaa

SEQ ID NO: 693697 - DNA, 414 bp, Homo sapiens
atggaaagtgaggagctgtctctgccctggccgctatcccatctaggcattgaggagcgcctcttcccggccgccatcccatctaggagtgtgaggagcgtctctgtccgagcgtccagtgtctgggatgtgaggagtgcctctgcctggttgccccatctgggacgtgaggagtgcctctgcctggccgtcaccccgtctaggaagcagggaactgactcatgcctgatcagccatcgtctgggatgtgaggagcgcctttgcccgtgccgccccgtctggaatgtgaggagtgcctctgcccggctgccccgtctgggacttgaggcgcgtctctgcctgagcgcccatcgtctgggatgtgaggcgcgccttggccctggccgccccgtctgggctgtgcggcgttgctct

SEQ ID NO: 693698 - DNA, 167 bp, Homo sapiens
gagccggcccaatgtgatactgtgtcagaccttagtttaaatcttgatatgtgcgtgtcccggatcaggaatggttcatttttcttaataatgtgtgtgtgtgtatgtgtgtgtgtgtgtgtgtgtgtttgtgagtgtgtgtgtgtgtcctaattaagggtgttaga

SEQ ID NO: 693699 - DNA, 566 bp, Homo sapiens
  misc_feature (15)..(15): n is a, c, g, or t
  misc_feature (20)..(20): n is a, c, g, or t
  misc_feature (40)..(40): n is a, c, g, or t
  misc_feature (74)..(74): n is a, c, g, or t
  misc_feature (137)..(137): n is a, c, g, or t
  misc_feature (157)..(157): n is a, c, g, or t
  misc_feature (552)..(552): n is a, c, g, or t
tgctgcttgggagcntaccntgtcttggtacccagtgtancttaaattctgagtgcttcctgaagtgtgcatgnttttgatgtatggattcttttctcctaaactcagcagcacattttagtgacccgtgttggtgnctaacctgatttaaaatggnacagtccttttgagcaagcagcattaggaattttaactcatttggaagaacaatcttactggttgtgggtttttcagcaagtggagtatacagcctgggagagtgtgtatcctaattggggctcagaagatgcgttggatgcactgtcctgcagccacccccacctccagcagctgccttggggaggaaacatcccccctgaactccctgtctctggtcgacatgaggagctttgcttctactgctaccttggaagggaaccatggtggttaatgggactattggtggtggagactggaccccttaagaggaactgccctggttgactgggagctgcctctgacctgcctgtgacttggaggatgagagacagttgacttgggagcctccctgtntgagccccagccac

SEQ ID NO: 693700 - DNA, 144 bp, Homo sapiens
ttgtgcacagataattatttggggtatttgggggtgatggaaatgtctggaattctggataatggtgatagttgcacagccttgatgaatatactaaaaacccctgaattcactttaaaatggtgaataaggtatattaattct

SEQ ID NO: 693701 - DNA, 115 bp, Homo sapiens
tgctgctgtgggggaaaaacgggtcttcaaggctgcttcctgccatctagcgctgcccaatggggaagagaaggggatggcacctaagatggctctgcaactccatactcagtac

SEQ ID NO: 693702 - DNA, 279 bp, Homo sapiens
cgccgggcgactctaaggacccgctgatcgcttagggtaacactgcttcccagaaatcaaatattttcattataagctttaggtactttttatttccctccatctgtttcgaatgaatagataaatcgtcactgacagctccctcaccaaattggtattctctcccaaattcccatgacttccaatgcctttccacttttttcctgctttctgaatttttcccgggtttttttcccattagaagttccgtgggttgcttaagcggatccacgggtaccg

SEQ ID NO: 693703 - DNA, 1521 bp, Homo sapiens
gtgacgcatcatagttccttgcgagaaggcgtactatctcttctcctcatgcctatcaaatgaactctatacacatcatcagcagtccctcactctgtcagtgtcctctctactactggcatgactgatttccgagtatatactgcacagcgtcaaaactccaaacccgatagaactgaactaaacgtacatccaagcgatactccaggacgatctcgatggactatatacgagagagaagctactaaatgctaatcacctgtacgcgcgtctgatgctagtcctaagtgcctaccatacggcccgttgcgcataacccgtaacatcctgccgtgtgtgacctatacctgccatggacgctacgaatgctataccattgctcctatacagtgatgccagaatggattagtgggcgacgcgaatgaggaactctgggcacccttcaccgcaagtaacctagtagcaccttagccgagacgggttagctcaagtgcctctgcataggcttgcgctttacctaggtaagccttttgcgctccccgatcttatattccgctcaatggaacccacgagcgggagccatgtgggacccttaccgtttgtaacctggtagcctagattgccgcattgatacaggagtaagctacgccctgcaatatggaatagtggccctcgcgctaatttccggattcagtaacctttgaccgttatcaagcactttccaatcacactgcagctggtgccttttggcaactttgccactaggaacgcttatgtggtagcacacaccatcaattgtcacgcggagtggtacaccaaacacattctatggaatttgcgcacaatttctctcttgagaaagcaagctcctaacacaaaggcctgaacacaggtcgagatactacactcaagcacaggccggttcatcggagcaaacgacaaggagcgtggaaatatcactaacccgaggggctatcattgccctctctttccaaagggtactttgtctgacgcattggcaaccaaccccattcaggttataaacaagaatgccccacaaaataccgatcactgataacgtacacctttaaggtattgccccggcgaatacatcaagagggtcgttcccaggcacatagtatagggggttacacagatcaattataaggggcgataaataaaggttaacaccacgggacatactataatccccccgggttcgatacagttaaggccgcccggtttgaatacgaacaacacaccaaaagcaaagaaactctagggaacacgcggacccatactagagggggagtagagagatatcagtgagacggaagagtagcgacgacgagaccaaaacgagagcggtggtagcacaccaaataggtggtgcaacaaagggacgggagtaaataccgaggagggaagacgacaggagatagacgacgagtaaccacacaagtgtggtgcacaaacagacagcgaggcgagaggaatacataccccggaactagtgtagcg

SEQ ID NO: 693704 - DNA, 404 bp, Homo sapiens
tctgaatagtggtggatgtaccacatggaataatgtgacaggttcctgacgatcatatccctgtcttacattctgcccgccgagaacacagagattcttcctattttataggggacggggtgcaacatgaacatctgaggctgatctccctctggcacatcattcattcaaatctattcactcctctaatggctgttgctttttttattttttgtccattataggtgcgtgtaggaccgaggctagatgacactgtggtacacccatcacaattacccataggatagcccccttctgtcgaatgcccttagactccataatgcctttcagctgggtgcaatactttcactttacccttcgggcttcactttctattcctacgtttactcccattgcatacatag

SEQ ID NO: 693705 - DNA, 250 bp, Homo sapiens
aaaaaaacaaaggctctctcccccccagccgggtctttctctttgggggcccccttagttattgttgtgagcaatggaagttcaaaggaaccccctctccagcttttttgaatcttgggacccagcctaaaaaggccaaaaagttagaagccagcatagcaactcagctcagggagctaccaaagaaaaaaagcaactgatgggggggcttttttttttttttaatttgaataaaaagaattagaagtga

SEQ ID NO: 693706 - DNA, 152 bp, Homo sapiens
tccccaagaatgttttgagttttttgaaagaccccaatttaaccctggcttatttttaaattatttccatccagtgatgtgggatggagaccaattatttagtaaatattctcaataaattttgagctgtggcctttgttaaaaaacacgca

SEQ ID NO: 693707 - DNA, 272 bp, Homo sapiens
tcagctatccaagtcatatagaggcaggtaaagccgggttaccaggccgggtgtgcggaaaggagaagcgggtcttctggggtcctgtggtcagggagaacccggtttctcaggtccttgacgcaagggtcaatggtttcctctttcactttctgcattccttcttcaactctttccgaaagcttcctgttttacccctctgtagggtccgagtaatacacctgggcgcgtgagcggtgccaggggatggggtctcggcaagtgggtcaccg

SEQ ID NO: 693708 - DNA, 355 bp, Homo sapiens
catttcaggtggagacacagaagggaaaaatccagtaaatgattagaccttgcacagggtcacagattaaattgtccgagtaatttcatgcatctgatctccttgtgcgtaatttagacacttaagtcagcccatgtatatttttaggttaaagagatgctgcttgatagataaatgcccatttgagacccaaattctatttgaacttcccttttaaaagtataaaattctttccatcatcatatacaaatgagagtatagatggaacctctaagccgagtaatttattttaattaggctcattaagatattacacaataggtctccttatactcactcagtatttaagaaatct

SEQ ID NO: 693709 - DNA, 387 bp, Homo sapiens
  misc_feature (5)..(5): n is a, c, g, or t
  misc_feature (30)..(30): n is a, c, g, or t
  misc_feature (74)..(74): n is a, c, g, or t
ttttnccaaaacaaaacggtttaaaattgncctttcaccccaaaccctacatagttaccccttaccctctgccnctttatttccttcatcctggatgcaagttaaatgtctggtgttcctggtcgggcgcagtggctcatgcctgtaatcccagcactttgggaagccgagtcgggtggatcaccctggggtcagcagtttgagaccagcctggccaacatgccgaaaccctgtctgtactaaaaatacaaagattagccgggcgtggtggcgtgtgcctgtaatctcagctactcaggaggttgaggcaggagaatcgcttggacctggtaggcagaggttgtagtgagccgaggtcgcaccactgcactgcagcctgggtgacag

SEQ ID NO: 693710 - DNA, 614 bp, Homo sapiens
aacgatggtctcagctgtagcacagttgcagatggaggggtcctgggggcgttgggagggggcccccagcgagacactctgcgcactgcagacgatacgatgcgacagtgacgagcttccagaggtaccacgaggcctgtaatacacccttcgagctgaacctgtcaggggaacctggaaaccaggggttgcggcgagtggtcatcgatggcagcagtgtggccatggtgcatggcctgcagcacttcttctcctgccgaggaattgccatggcagtgcagtttttctggaaccggggacaccgagaggtcactgtgtttgtacccacctggcagctgaagaagaaccggagggtgagagagagccactttctgacgaagctacactcgctcaagatgctttcaatcacaccctcccagcttgagaatggcaagaagatcaccacctacgattataggttcatggtaaagctggcagaggagacagatggcatcattgtcaccaatgagcagatccacatcctgatgaatagttccaagaaactgatggtcaccgatcgcttgctgcctttcaccttttgcggggaatctcttcatggtggctgatgactcctg

SEQ ID NO: 693711 - DNA, 1003 bp, Homo sapiens
tagactacttgaaaaggcccctaaaattaaaatgtacatttagcatatgcttctcacattcctccagatctcagtggttctagtgagatctggaggaatagtgggaagggtatgctgaaatgaaacttagatcagaaataaggaaatcggccggaacttaggttacagggataaggtaccagcaggcccaagacgtccaggaacaacacgacacagaggaacgagaccatggacagccgagaaagagcagaaaactcgattcaaaccgggacgaaatggaccctgaacgatgaaaagcatatacaagagcaactacagaaaaatggaggtacagagaaaaaacaaagcaagaaaagcacatccccgcaagaacaaacagagagcaaagaagcaaaggcaaccaatcaacgaaggacacaaacacggaaccactaaccaacgacactgcaaaccaactgagagaagaaaaaaaacacaaaagtacacaaaccaacatacacagaacaaaaataataaagcaaaaaacaaagaaacaagaaaatcacaaaagaagaaaccaaacaaagacagcaagcgagcaagacacaacaggcacccaaccacaaacaaagggcatacagcagaaagaaaacgaacaaaagacagtacaaaaacagcaagtaggacaagacaatcaaaaacagaccatgaaataagaagacacacatctaataaatgtcaccacatggggcaccagtgacaggaatcgcaagaagaacatgtcctggatagagctggtctactcaaactacacaagctacgaaacagatcaaacaacaagccaacaagtgcacacatggataggactagacaagaccaaagtgagcacgaaagcagctaggcacagacacaacaagcgataaggagtatcaacaaaaatcacaagaagcacgagatctacaaggagaaccatcacagcatggcaacgcatatcaagagaacaagtcgataacacgaagagaca

SEQ ID NO: 693712 - DNA, 186 bp, Homo sapiens
ccgctggccaatggcataacgggccagaacattggcattttccatgatggcgaggctgagggggtgtgttccccaactcttcagcgacacaactgccactctggcggaagtcgagctccgtcgcttcttgtacttgggcacagcgctcatgacagcccatccaaccacttgggtaggtagtctcgc

SEQ ID NO: 693713 - DNA, 307 bp, Homo sapiens
gttcaatttctacagaccctgaaggctgaaacataagtgaggcgcaatcggcaaaggaagttcgacatgtaggagaaagtgaacgtgtagaaagtgaaccaatttctacacctcccctcagaacttcataagggcaagatctttagttccgttcacttattgctgaaaccaagagcacaatgcccattgagagaaagatctctgtgctgtagactataacaaatagtgcattccttccggggccgtcgtctttgtctgcttattggtcttgaagtgaattttaagaggagatatatactagaaatgt

SEQ ID NO: 693714 - DNA, 1051 bp, Homo sapiens
  misc_feature (140)..(140): n is a, c, g, or t
ggcgtcctagaggcatccggtggcagttggaaccgctgcgtatcgcggaggcggcggccaggccgagaggctggccgggcatggggtgtcgtgatcgcagtggctgctgggccgggtttctggcttcgcgccacaggacntatttcttattctcaaggtgcaactgacaagccattccacagcgtattactgatgttagtccttctggatgtttggggagttgtctcttgaaggccaacgttcttgatgagttaattgacggatgaagcgacgcgacactatgctacgaagttactgactgactacactgcacttcgcctgaacttctgacgcgactgatcaatgggacacgacctctgattacgtgaattctcctacaacgggctcataattcagctgaacgaattgtattgacacgaattgaagaacccaacttggtgcgaaagctttgggcacacgtggccagcgaattgcaaaaaaccgaacgcgacagcgaagacattctctggaaacggactcgcccacgaattaaccccaaagcgcaagcgggcaagcacttacccgtgcacgcaagattggaaaacccaattacttgcacttgaagttgcacagcgcaacacttcctcggaaacgcggctccacttggaacagcggaacaaaaatctgcgaaggaattcgccgtttcctctgtccgttaggccccacacacacacgtttaccacagaaaacccccaaaagattaagaagcggaaacttccgaggttacgcgaaccttgtattatacccccttggtccatacagacaccgccttctgcacaaggcgaaaacgccaaacgaaaccctagagggagtacagcacaagaattactacgtcacaaccttccccttcagcgcaagaaaaattcttcagttcacgggaaatttggcgactcgggcagccttgggcggaattccatggagcgattgattgcgccacatttaactttacattccaacgttgggaacacgcttttacacacaagaattataaacatttctgccgacgcacaca

SEQ ID NO: 693715 - DNA, 635 bp, Homo sapiens
  misc_feature (428)..(428): n is a, c, g, or t
  misc_feature (463)..(463): n is a, c, g, or t
ccgtgattatctgttccgagggctatgaggctcctgatgccaccatttactaagtgtgcttgctgcacagtggccagaactatggatatcatattacgccagggccttcacgggacatgtggacagtctttcagctgatgataagcatgacatgcctatggtcacacttatgattggatctctatacttcagcattcttgtgcactcagcatattgcatctgacatcgaaagatatcactgagacaagatacgatggactctaattggcatatcttgcagcctacataataggcccttgaggcaagatgctggagtctgccataacattactacatgcagcagagaactcagacttgttcaccgagatcggatacatagcaggcttgacaagatgcatgtgcagcatgtatgttagaagtcaatcctncattccaatcatgccttcagatgactgcaggcttngccaacacatggggtacgacttgaccagacactgtatgccatgaacgatcatataacatgcttctagattcttaccctctggaaactgtagactataaatgttcgttgtccatgctgtcgacgtagtttaccaacgtggaactgtgaaaccctggtgtccccaactaattaa

SEQ ID NO: 693716 - DNA, 318 bp, Homo sapiens
cacagaggtgtgcccaagttacattagcagcatgatccaatattatagtgaaggagtgtttctgagaagataaacattgggtctgtttcatctgtaccactgaagctcatataatgaagtgttttatacattagcaatagttctgtgtcatttctaggctagataacatcaaaagacactgccttccatcctcagagggttgacaacatcatagaaaggccctaagtgcaatctgagtgtgccttcaccaatgctggttgcatgatcttcttttctatgatcccaaaggagctccctatgggtttttagcacaaaact

SEQ ID NO: 693717 - DNA, 591 bp, Homo sapiens
cagtgtctctgtgctccagacgcatcaggggcttggtggggtcggagccaggagcgcgggctgctgaaaaagaccaggtctgggcacctttctactggcgcttcagtagaatcgtcagaaggggggcataacctggctcctggggtggagcaccgaggatgatggacaaggtgctcatctatctctgtgcaaccgtacacgagggaggtgctgcagtcactcccgctgacggaaatcatccgccattaccagtggctcacggaggagaatatacctgaaaacccatggtgcttcctctatccccgaatccccggggatgaagctttggggtgctactaccaggagaaatgttaatctccaggaagggaggaaatacctgaaacacaggctcatggtggtctctaatagacgggtggatgaactggaacaaccggtggagcttaagccagagccagagttggagtcattagagctggaactagggctggtgccagagccagagctcagcctggacttaagagcattgctgaaggcaggttggatctggggccagactagagtctgtggggagtcactctgggcctgtgaaaa

SEQ ID NO: 693718 - DNA, 335 bp, Homo sapiens
atgtgtggtgctggctcatacctgtaatcctagcactttgttaggccaaggcgggtggattgcctgagctcaggagtttgagaccaacctgggcaacatggttgaaaccctgtctctactaaaacataaaaaaaatcagccaggtgtggtagcgtgcacctgtagtcccagttacttgggaggctgaggcacaagaattgcttgaacctgggaggtagaggttgcagagatcatgccactgcactcccagcctgggcgagcaccaccaatacagggagcaccaccaatacaggagcaccaccaatacaggtagcaccaccaatacagggtaccga

SEQ ID NO: 693719 - DNA, 1135 bp, Homo sapiens
  misc_feature (1)..(1): n is a, c, g, or t
nggtgggagcttggaaagggaatcattagtgtggtgaacgtgcccttctgggtggggaagttcccacttggatagccccggaagtgtcctcttgtctaaacccccctgtgtactggatgaatccatatgtcacgtcccaagaacaggtaggccgcaatccgaagagtgtccaacaatagaacgttgttcgaatccgtccggtttatacccaaaggggggacgggcggtggcctcttgggtcggtgcacggcgtcgtgtgggccatggaatgttagttcgctgtttggtctccccatttaacccacaggatgtcagcccacatttctggatgcttctcagaccgctgtgatcgccacgctgggttcgcatctctgtaggaatgacgcgtttcatgcttcccgtccatgtcctgtctggaccaaagtcgcaaacccactgacaagatcatgatgcgagcttctccgcgaccacgtggggttccttcgtaggacatgatcagatatccacaccagctacttcaatgcacaccgtggcccccaggtctccatgggacccagttggctgctctgtctgggatgtggacggtgaacgacttggacggctttctaggcgtaggaagcccaaagcagacgaagcttagccatagaacgccactctggacgggtggtagcgtgactagactgcggatagggcgagtacgctggaggtccagaggtgggcatttaccatggcacactggacctcccttgtgtctggaccttctgttgctggattgacatgatgaacacgctagatcctataacccagatcatagtccctgttcgcagcaacagtcgggctggagcatggaggtccatgagtcgtaagcagagctaagcaccaggtaatagagaaccgaatactgcatattctcatctgtacaagtaggagcgtaaacatatgtagatatacatagatactaggaggggaacagcatgacactggggcctgattgggggtggagggtcgggaggagggaggatgagacataaaatacccatcaggtactatgctgcttacctcggtgatgcaattagtctgtacaccaaatccccatgacacagagtttatactacatgaagcaacctacaacatt

SEQ ID NO: 693720 - DNA, 604 bp, Homo sapiens
ggctggggcagtggcagtgaatcggatctctgcagctggcgagagcgtcggcggcagctcagccgtggcagcagccacgcagtcaggcctcggctaacgcccggggctccccccgcccacccacgacaaggctatacagtggtggggggggcaccgggggacccctgtccggagctggtgcgccccccggaatgacaggcacgcatcttccagaaggctatggggaacccctgcgagttcttcgtggacatcatgtgactcgtggcgcatgccccagacctgcctgaggtggggagctggcggtcctgccgcatgcagagctcgcgtgggcttgccttcgtgggggccaggacgggaggcaggtggggggcaggctggaccacagcatctgccctggcagcctggctgctccagctcctgacagcacctgtgtctgagcagccgtgtgggggcgctccctctctgacctcagcgagaggctcggaactcccaagcccttgtgtctggtggggatccctcctgggatgaggaagaccccctcgggtctcggttgaccccactcctgacaggtgtgccaggaccccagggtggtcacgcggggacc

SEQ ID NO: 693721 - DNA, 1187 bp, Homo sapiens
ggcccaattaggcttggcatctgctctgatgccagatggaaaatacactttgcatggcacctgtgagtaatagcatttgctgagtgatactctcatcatggatcagcgcctccttaagttcagttctgcagaatcacatatagagagtaaagctgtctggccttaatgagctttaggcaacgggcaaatactggacaagcatcggaggcaaaaagactcacgagtctgtcgtactatcgtaccagcttggtctgcattggaataacttcaatgcactggacgaagaggggatgtaacgcacagggatgaatagtggtgtgattgtctactatacttccgccgaatgattcactcaatgccacgcagtaagacaagtcgactctcgattgaaacataagtttcaaaaacaaggatcacagcgacttctagctagctttgacctcagtcactaaccttgaaaagcttgtgggaactgttgatactgagtgcgtccgtggacatactaagcctgtgatatgactcgggactaggttaattctagtagttcaaccaaatcgcatcgtctatgctcaatgggggaggttagaacgtaagctaggacatgtaaccaacaggaaactgtcctcgtagtctccgtggaactagtaatattgtcgtctttttcctcagaccatttcatcctatttatttcatcctggaacatccacaggcacgttttcgactcttgggaaaaacagtgtattgtgaaccctgggatgataagattacgtccattgacttcataacaggactccgaccaacagaagggaacagtcaataaaccattcctttcgctcgacatacggaagggttcttaaattggagttgaccttctgatacttagggttggtaaaacttgaacactttggtacaaagtctcagacatgatgcacatgttcattgtaacagttccatttggtagcaaccaccaataaatgggatctggttaacaacactccagtgagtttgcgttacggaaatagaagactcccgtttcttacttccccgagaggcagtaaggcacccaccctggttatcgggagcaacatggcaattccaatatgggccttgggcaaacatctatccttttaaacttaaaagcaatttaaacgttcccagcagcataaactcatttcgcacaagtgtac

SEQ ID NO: 693722 - DNA, 872 bp, Homo sapiens
tactggctaggtagccaaggcctgggtttagctttgggaaaggacaggtgcctgagccctgcatgtgtgagccctcccaccccagcctccagaatagagggaaataaccaaaaaactaccacagcaacagaaacctcacacgtctagacttgaaaccccaaagtggtgtcttgatgggtgggttttgttgtttcaagggtgaaagtgaggcagagtgttctgaaaagggtctctgatatatatagttgttcatgtagaccatagtgcacagtggtagcagaatacttaatgcctggcctccgcgaaatgcaccctgacacacacacttgccacacctgacgcatgattctatgttgtagtagcgtgcacccacccaaggttgtagtaggagtagcttggcattgaaggcatcactgagagacagcgtgaagtgcagccttgtgggaatacttgatgttggctaggatggaccagggtgttgtggagggtagggcggcctctcatgtgcagcacattcaaggaggtgaaagacaaagagagcacccatactcccatagactatctaccttgtataggcaccactttccttgcattccatagagaccacacagcatccttatgacctctttgtggcagccaccctaataatggtcctcattgtggcatactcgtacctatttgtacccacacccaacgcataccaatggtgtagcagtcccccaaacccgtaccctacatatgagtaacctagataacttatgttacacaatagcataaacattattgggaaaacactgttaagccaggaagcaaaccaggtccaaggaaaactgtacacaacacaaggggtcggtttgaccaaacatggtacg

SEQ ID NO: 693723 - DNA, 524 bp, Homo sapiens
gaaataaggatatcctgggtagccttggttagagtagttctggtggaatggtagacatggaagtcacattctatgggttgagaagaaaagggagattagaaagggtaaggagtggatgtttgagtgcaggaaagacctagaaaagctacagagcattttctaaaaaaggggagcattttttagaataaaagagatttgagcactcctttcatttactcattcatttgctcaagaaatctttacaggccgggcgcggttgtcacgcctgtaatcccagcactttgggaggctgaggcgggcggatcacgagttcaagagatcgagaccatcttggctaacacggtgaaaccccgtctctactaaaattacaaaaatttagccgggcgcgttcgcgggcgcctgtattcccagccactcgggaggctgagccaggagattggcgtgaacccgggaggcggagtcatatttagctctttagtgctccacttcattctggcctgggtgaaagagcgagatccgtctca

SEQ ID NO: 693724 - DNA, 654 bp, Homo sapiens
  misc_feature (181)..(181): n is a, c, g, or t
  misc_feature (276)..(276): n is a, c, g, or t
aggctatcaccactactccgtccctagaccctctttctcacacctctcgtccggggggtctccatatgctatcagtccttctgcacgactatgtataagcttatgctgtagtatccccttcgtgtggaatcgtactatagtagtcgttgtagaattcggtgcggtacgctaggtagagttngggaatcatttgcacaagttgcaatccttggctgccaatcatccgtgaggtaggcccctactcctcgagtctcggtgtatcacgctagactacgntcgtttactaatagaatcaggacatgtggtgatgcaccggcaaacgattgctggccgtgactgaacgaatacttgcatagacgattctggtttccagcgccaacatatatatagacaatggctgatcgaccttagatgccgtgacatacgagccggggcgtcactgactgtctggcgcagcgagtcgagtggcataggtcaagcgcatacattcaatagcacagaaccagcagagtcatccccttttcctgagccagagtgcaaggaacactgtgaactgtgctttgttcagactgggatcaggtaggggggcagcccccagtccctgtctgtcccagctcagttttccaaaagacataccacgtagtctctctatga

SEQ ID NO: 693725 - DNA, 231 bp, Homo sapiens
agtagtgacaatacgccagtatttgtccctactaagtagacagccttggtggcatgccatatggatagtaaatcctccgctacactacctaactagagcgggccccatcatatggattgaacagagtcgccttaaataatactagcatagaaatatggcagactactataggggaaactaggacatatagacaagtaagctataggctagatattgtactaatctactact

SEQ ID NO: 693726 - DNA, 450 bp, Homo sapiens
  misc_feature (205)..(205): n is a, c, g, or t
cccttttgagatggggcaagcggggtcgctggtgcccagggaaggaccaacccgaagcgggcgaccgggtaagaagaagagctgactaaaaagttctggaaactgggcgccctctttgatctcagtctctgcaaaagcacatggactcactttcctgaaagtccaaagacagccgggcatcctccacgtgatcttcaactatgtntgctgccttcaattcttccgcaggaacataagctgccgagcgccggggggccggctgcttcctccggggcaggcggctcggccgcggcagccgtcgcctcagccacaaaccggaaaaaacggggcgcggggacgcggggccccgggcgcgggcgcaactccgcggcgcgcccaactttggcctggtccccgcgggctccgggctccgggcgcgccgcggaccgcggggagccgctcgcatggacc

SEQ ID NO: 693727 - DNA, 573 bp, Homo sapiens
gcagtttacagcgcagggaatacagattattctctctgaggcagatgcagtggttacacctgctatcccagcactctgggagaccaaggtaggcggttcacctgaagtcaggagttcaagaccagcctggccaacatggtgaacaccctcatctctactaaaaatacaaaaacttagcctggcgtggtggcagctgtctgtaatcccagctactaaggaggctgaggcaggagaattgcttgaacctgggaggcagaagttatagtgagctgagatcatgccactgctttctagcctggatgacagagcgagactctgtcaaacaacaacaataaaaaaaaaacaaaaacacacacacacacaccaaaaactgcaatggcagagaggtggatatgagccatgactcaaccattaacatggcagggaagcagacaattacctacaaaagtaggcctgtctacctaaacggagaaggtctgtccctaccatagaggacgacaatgatattggtgggcatcaccaaagtgtatgtgtctattggcagcttaccagtgtcataatggctttatgctt

SEQ ID NO: 693728 - DNA, 224 bp, Homo sapiens
gcaaacctccgacactcctgggttcaagccatatcccctacctatagcctcccaggtagctaggactacaggcatgcgccatgatgcccagctaattttcgtctatttactagagacaaggtttcaccatgttggccaggctggtctcgaactcctgatctcaggtgatccacccatctcggcctcccaaagtgctgggattacaggcgtgaggcgcaatcggg

SEQ ID NO: 693729 - DNA, 198 bp, Homo sapiens
gcggattataagcggtcatatcgtattgacctggtgcttgtcaaactcctgagctcaagtgatccacccgccttggcctcccaaagtgctgggattacaggattgagccaccacacctggccatctataaggattctttaatcataaccacaataccattgtcatctgaaaaaagtgaacatcaattccttaataaaa

SEQ ID NO: 693730 - DNA, 222 bp, Homo sapiens
tgaaattataaaagaaacacattgtggaaagctttattaaatacacagtacaagccactctatgttgaaacctatttttccacaactggcactggaagagtgatgtcatggatacataatgtgcaaaggatgagtggtgatgttgggagtgagttggttttcctttgatagaatccattttgaatgtggagcgcggaaatgagggggtacaatggggaaccg

SEQ ID NO: 693731 - DNA, 551 bp, Homo sapiens
  misc_feature (22)..(22): n is a, c, g, or t
ctcttttcaggagaggacacantgtgcccgtgttcccaaattgattttgccccaggaaccctgtgacggttgtggggcaccacgtcagcccccctgcagagcgtggaagggacgttgccctccccacccccaaggctgccatcaaccaatgccatccctactgcccccggcaggacagggagctggaagctgtgacaccccattttaaggggccacccattaattaattaggctccatgaataatgcatgccaccttgggtatattaatagcatatttatatggtgtgctatggggagtatacattctcgtctgaacacctcacaaataattcacgacaccgctccttccccagcctccaggagatcctggccggtgctgcggctggggctggtgggctgcttcccacagccaaattttacatttcattataaatggctttgctaggcatgtcggtaactcgtgcatttccatccactttattattaatggctttgctgaactgtagcagcccaacgccgcgcacagtgcgttataaatatttgatccggc

SEQ ID NO: 693732 - DNA, 413 bp, Homo sapiens
gagtcatcacgtactatgtaaatgtcttgagtacttctatagggatgggcataatgcacgtggctctccctattcaggcacgtctagattcaaagagcttgaatgaggacgtcacaggtttcgtggctccatgttatgacgaaagtggccctttatgaaaagcactgtgcaaaatattaatttttaaatatctttttaacaacataggaaaggcattcttctacttttgcaaaggaggcagaaccaaaatctgtgaagaacctttggctatacagacaccccacagggaccaaatctcctgccccatcacacattcctgggaattaaaaagaatggagaacgtttacaagctgctgtactttataattgttatttctttgaaatgattctttttctttgtgagaggaaaataa

SEQ ID NO: 693733 - DNA, 145 bp, Homo sapiens
cgttgctcggggtcatccgcagtcacgtcggggccatccggcatcaggccgcagcacacagtgttgtgcggcacagcaacagttcagcatttcacgccgcataccatcatgcatcagtgccccatggcattaaggcagtcagtaa

SEQ ID NO: 693734 - DNA, 320 bp, Homo sapiens
acctcctaccccacgttcaagtgattctcctgcctcagcctccagagtagctgggattacaggcaagcgccaccacgcccagctaatttttgtatttttttagtagagacagggtttcaccatgttggccagcctggtctccaactactgacctcaagtgattcacctgcctcggcctcccaaagggctcgaattacaggcatgggccaccgtgccgaccacatgctcttatattaacaaccagtatttactaagcacatactatgtgccaggagatagtctacatattccatgtctattagtattcttaatacttgcag

SEQ ID NO: 693735 - DNA, 477 bp, Homo sapiens
  misc_feature (193)..(193): n is a, c, g, or t
atcctgagaggcaggaactgtgtgtctgatgagatctactgcactgtgatgaaggggaggtgagctcaggcagtactgaaggtgaggggggcgtctgtaaatactgatgaagctttgcttggttgcgggctgctcacctcctgttttgttgcccagttcctaacaggccatggactgttacaggtcccatggnctgggggctgtggagccctggcttagaaggtgaagtctttgggcaggggcagtggctcagacctgtggtcccagcactttgggaggccggggcgggtggatcacgaggtcaggagatcgagaccatcctggctaacacagtgaaaccctgtctctactaaaaatacaaaaaattagccgggcgcggtggcgggcgcctgtagtcccagctactcgggaggctgaggcaggggaatggcgtgagcccgggaggcggagtttgcagtgagccgagattgcgccact

SEQ ID NO: 693736 - DNA, 562 bp, Homo sapiens
ccggaccgaccaaagcccgcgcgccgctgcatcccgcgtttcagcacctacgtccctgctgccgtcgccgccgccaccatgcccaagagaaagtgctgaatggtgtgatgctaagtggagataaatgcaaaggtgaagtgacgaaccacagagaacgatccgcgaggttgtcttgctaaacctgctcctccaaagccatgagcccaaaggccttaaaaaagtgccccttgcaaaagaaggggagagcaagggtacccaaatgggaacaaatgggaaaatgctgattgctgtgcaagtgatggggaataacccttgcagaaaacatgtgagattgccaaatacagaaccaagtggcacatgaaatgcttgaatgtgttgcttgggaagattgccaaagtgaaagtggttgttgcattttttggattaacctgttgtactttcttggtgactgtacaggtttggcaaattactattttttattcaagtttttataagaaaattgccagaatttttgtttttactttttaataaaataattattttaaacaagcgccaatttgtg

SEQ ID NO: 693737 - DNA, 224 bp, Homo sapiens
gggtgacacagcaagactctttctcaaaaaaaaaaaaaaaaaaaaaaaaacattataatttggggctaccccattttcaggggttccttagccactttgtggcaggggtttttggtttggaagggggcgggctcaggggcccggcctgaaagcctgtgcttccccggggggccggagatttctgcccgtctagaggggggggggtgggcgttcagaaaaccctt

SEQ ID NO: 693738 - DNA, 439 bp, Homo sapiens
  misc_feature (292)..(292): n is a, c, g, or t
  misc_feature (396)..(396): n is a, c, g, or t
agaaaagtaaccaaacatgaaaaacaaatttgtagatttcagtattaactgatctgttttgggatgtgggtgacagctttgattttcaggttaccttatgaacacatttgctagcatgggaaaagttcttcactgtccttggagagaactgtatgccttacagtattggtactagccctggagacagacctggatgagcagttccatcatcctgtttgcaggggtgaactacaaatttcatctttgtatcttttggttaacttcttggctaaggtaacagatttatatttanggacaatgaagtcacttttccattttctgcatcccaacacccccagctcacatgttgataagcagcatagtatcaacacagtacactttccttctactggaggntgctcctcctgccccttacgtctgtaggcacacagcttgaagg

SEQ ID NO: 693739 - DNA, 184 bp, Homo sapiens
ctaagatctatctgagtgatggtgagtgattggttttggtggatgatagatatatatgatggtgtgtcggtgggtgaatggatgattagacagaaggatagtgtgatggatggatgaatgaatagatgtgtggaaagtagatgtgtaatgaatgggtagatggatgagtgcatagataagtggg

SEQ ID NO: 693740 - DNA, 932 bp, Homo sapiens
ggagaactagtctcgagtttttttgttgttttttttaaacacttaaaggatggaacctaattcctctcccgagaaccgcctccttgtgtgttaatgcctattcttacaacagagaaacaagttacatttaattattataaaacgagtttgactatactgggggtataaaactcctctatcactcgtgtagcacaaccgctccttccccacaccgctcgaggggttagtgcaaagtccctatctatctatagccatctctccttctcctcctttcaacaagaccagagttttggggggatcacactctttcgtcccttaggggctataaacttccagaaattatggaagcgggcgcaaaagacaccaacgaggaaaaaaaccaacccacacacaacaggaggacaatagtggaaaactctttactccccctatgtgtgggtattccacacagagtggtccccgcggagaaaagagagagagagacacgtgatacagtgtgagaagcacacctcgtgggagccccgggatatacgacgcaaccaatacgcacttcggagaatgtgtggcgggtgtgcgcagcccccgagtgacgttggacccgtggggcgcgcccccttccgagagagttgtctcaccagggtgtccccgcgcaccagggtttgcgaggtgagggtgtgttcgcacagcccgaggggttcacaacgcgtccctctctctttcctcatccctattttcccctcggcttcccattcagtggtagggacctatgtgggaggtactcccagtgtttcccgtgtcttgtgtggctcccttgtcgctccaacgcgtcttggcggcacctccctcacgggggcgtttccagcaatattgtggggctccttgtggagcggccctcccctggtatgggtcccggtctatctgggcgttacacg

SEQ ID NO: 693741 - DNA, 816 bp, Homo sapiens
agcgggggccttcgccggcgccaggagtacgcggggtagctgcgcaacgtcggccctcgctagcgtgcccaggttcggcccgtaggcgtctggctgaccggagccacttcttcatgacgcgtccatggccggagactgcggggcgtcggcagttcaggcggggtacgtgcattgcatcgcgtcgggtgtgccttgtggtgttcctgagtgaaccagagggtcactgacctgggggctggaacagaccctgaatgaactgtttagcgggcgcgaattgtgagaagcgtcatttacccttcagatagtggatctgctgataaacgaagactgcgggaaaaaggttggagaatacgccaagttcccaacagagatgcgaacaaggtggtgcggcaaaggctaacaggactgaggaagaggtggaccaacatttggttatccccctgataaatttcaaataaagaagatgctcccgggaaaaacaagagggcgtggtacaaatcatcgggtaatacaagggttgaccacgggggtgcacaacattggttaacgcaacagagggaagatatgagaaacgtaattcgtgccgggctaaccaaaagacttatttggggcagagccagacaaaacatcgggtgggagtgcaaagggaacgtggtgacacaaggagggaggaattagaaggccttcccaccattgtaagaggaaacccaaaagagaaaataggttgctttacaaagaaagcgggtgcgtcataagggggcgtatggggagaataattacaaaattaaggaagaaaatgaggagaaaaacacttta

SEQ ID NO: 693742 - DNA, 108 bp, Homo sapiens
ggaccagcacaacctgatctttttcaatggttttatttgcttccagcacaacctgggcacaacctcagcacaacctcagcacaaccccagcacaaactggggggatct

SEQ ID NO: 693743 - DNA, 283 bp, Homo sapiens
cggtaccgtgaaatcggggcaggcgacaccctcacgcccgcagcgccttccacatcccccagttcgccaaagtccatgttacgccgcatcaccagacccatgcgcaaacgggtcggaacggggcggtgataaccagtgcgcgagcggggagcggaagatttgctttgagcgtacaagacgtctcctttgtgggtttcaataaaacgacaggtcatgcgacccatgtcgccgaaccaccgtcacaactgatcagaaaaatgaaaatcgacgggatcaatgatcg

SEQ ID NO: 693744 - DNA, 1071 bp, Homo sapiens
  misc_feature (1035)..(1035): n is a, c, g, or t
gcacgagatttgtgcttgtggttggagttgaagctaaatgcgagtttaagtttgagtttgaagttttcttgaacaactttgaagtcttgttagccaaacgatggaaagactcaaatccaggtgagtgtttcgcgggtggtggaatgctatcgtaattcatttgtgatggtgtagatggtagaaagtctaaggagtcatcacttgacctttgagaactattattagtattgccactgaagttgctatgtcgcttggggctttcatcaaacgacgtggacttcttatgggcttttatgaaagaccgcatgatgaaatattccagttatgcgtgtgcgtcttgtgatgcagatccttttgggcaaaaacagttggtttgtgcgaaaacgcaaggtaataaataggcttaaaggaactaaaaaaaaaaaaaaaggaaaataaccagctaagatttaaggtacaagaaagcggttgcacctcaagtaatgatagttattaaaccttggattggaccagatgtttaaaattgttttcaatagtagatttgcagtcgtaaatgcgtgctcagcaatatcatattgtgtttatgaagtattaccaaatgggtagaagaacggtttaagagaatatgtccggataaagcgatcaggagaaaagcttaaaacccaaagtggtcaatctgcagcccatttaggcactctgcatttaactgatacccggattgaagaaagctggcgggtgtatgggtgaaggagaagaaaggaagtgattaggagaaacctcatggagatgagcacatgctacaactaataacgttattctacttaaaacgagaaaaacaaaaaaaaaccaagacaattgaaaacgcaatggatgcattcagcttaaagaaggataatcgaaaaaaatttcaagataaacagaaattgaaaagaaaacatgccacacccagtgatagaaagtaccggctattgaaccgccaaaaagaagagaaagctaccacagaggagaaagagcaagaccaagaacagcccgccngaagtcaaacgaggacaggtactatgaggacccggt

SEQ ID NO: 693745 - DNA, 309 bp, Homo sapiens
agacagaggcaaaaacaaagaccagtgcacctataagtgattatgtcgaatgactatcgggtgtatgacagggaagtgaaatggcaccgtcatggtgtgctgaaatccggcacgttcttgtcacacgtggtgagacagatgacagaggaaggagtagagatgcttgttgagcatggcatgatgtgacagcaatgtgttgtatcaactatgacgcgtatgtgaggcatatcctgtcggggtgacgggcccatggtgcggagctcgtccgcatggtgctgactgtcttggtaccttcccagtctccccaga

SEQ ID NO: 693746 - DNA, 962 bp, Homo sapiens
  misc_feature (1)..(1): n is a, c, g, or t
nccgtgtatggctgtgtgtggtgtgtgttttcgtttctgctcgtttgctacgtccgtgccggtggttcatgttggtctcgcgacggcggttttggtggctgttctcgtgcattatgactgcccggtcgaacttcgggtgtccgtttccggcggatttttgcttttttccgggcagcccttgttggtcgcactccgtccggaccccgctcccgtgtgcctcgtaagttgggccgccctgtgtgtccgcccgaaatcgcccgggtgtctctttgcgagcgacgaccgggggtgtgtacagggtggttcccactccccgctgcgcattggagccggcgtgtgccctctagttcgcgcggcggcggagacccctgcttgttttccagcgcggggccccctttacttcttgacttggcctcttttttttgcggcatttcccccgcccctcagggtgctcccacctgccgcataagtcgtggcccctccctggggctcctccctctgctgtcgccagcgttgcgcggtctagtgaaagctatgatgcacacggcggtccacccatagagtggggggttcttatatactgtggacccttacccgcgcgcgggcactatgcctcagttagctggtttgtcatgcctgccccatgtcttcttaaagttttcccgacagccgtctgggagagagactgggattttctgtggtagcggtacattatgggctattccgtgcaccatgggtgtgcggaaagtggatgtacactgctgtgtcgccggccgacaaccgtgtgtctggccggattccaggatatccttcccgtatgtaatgccttggctctcttttcttctccggctcctcgccacgccaatgttgtgtcttgttcctgattgtggtgtggatccccacggccgggagtttttccccccccataaaacctctttaaaacccccagcccaacaataacg

SEQ ID NO: 693747 - DNA, 217 bp, Homo sapiens
tcagaggatctcgttactggcatttaaaagacacattttataaaatgaaaaaaaaaagggacagcctggccaacatggtaaaacaccatctccaccaaaaataaaaaattagctgggcatggtggcacgtgcctgcaatcccagctacctgggaggctgagggcttcaccatgccggccagactggtcctgaactcccgaccttcaagtgatctgcc

SEQ ID NO: 693748 - DNA, 880 bp, Homo sapiens
tgtatgatgtcttaaaaattgtttaatagatatggccgagcgtgatggctcacccctgtaatcccagcacttagtgaggccaaggtgggcggatcactatgaggccaggaatttgaaaccaggctgggcaaaatcctgtctctgctaaaagtataaaacttagccaggcatgatggcacaatgctgaggtacatagacagctactgaggtggctgagggcacacgaatgcttggaacacctggaaggtacaaggcagcagctgagcacaagacatagataccaacgatgataacaaccagaacactggagactggacaagacggaggacatatcaaagagctagcagccgacatgcacaaagcaccaagaaaaacaaacaaacctgaaatcacaacacaccacagcaaagcgggagacacccacaaaaaaaaatagaccacacacaactatagcccctcaacaaaaaactacagacagagcacagagacgagaaaaccaaccccgtaaaaggccgcaccgagcactcggcgcagccagaccccatagaacgagaaaccacaaagcgacagcttcaaacgcccagcaaacgaacgcacaacagcacaaacatcaacacacagacacacgcgacagaccacaccaccacacactaatgacaactggacaatacacgcgcacaacaacccaccaacccggccacaatcagcgcagaccacgcaagacgatcagaataaaccatgccgagacaacgagagagacacaacaacgagcagagacgataacaaaaagcaacaggagcgagcagagcaaagaacgcaagacaagacaagagcaaacgagacgcaaggaaaaaaactacgggaagaaacacccgaacag

SEQ ID NO: 693749 - DNA, 524 bp, Homo sapiens
agcaggagatgaaaatggcggattcaggcatgcacacgcccggcccggtgcagctgagcgtcgcggtcgacgacccggcccagcgcgaaatcctttcccctgaggccttgtcgatgctggccgagctgcaccggcgcttcgatccgcggcgccggcagctgctggccgcccgccgccagcgccaggcgcgcttcgacgccggcgagctgccggacttccgtgccgacacccgcgcgatccgcgaagacgactggcgcgtggcgcccttgcccgacgcactggtcgaccggcgcgtggagatcaccggcccggtcgagcgcaagatgatcatcaacgcgctcaattccggcgccaaggtgttcatggccgacttcgaggactcctcgagcccgcgcctggacaacatgctggccgggcaggtgaacctgcgcgacgcggtgcgcggcacgatcgatttcaccgcgcccaacggcaagcactacacgctcaacgactccggcctggccaccctgatcgtgcggccg

SEQ ID NO: 693750 - DNA, 528 bp, Homo sapiens
  misc_feature (1)..(1): n is a, c, g, or t
naggcctaaacccaatccaaatggtggtcctggaactggaccctagtggccacccatctagtaagcacaccccctacatgtttggccccgagtccacctgggaagggctttgccagaggggccgcctggcctctcggccgtatgtttcctcgcggcccttaaaacgggcctcccgggcacacctgtgcacatcttcgtgccactctctgaatcggcggcggcaacaattggcgggccgcccggcccatggtaaaattttgcgccggctgcggcagggacttcaagctgccaccctggcgccacggccagccactgccaccagagcgttgccacggagtgtgagggcagctgagtccacagcagggctgcggaggggcgcgctggggcttcgacctggctgcactaacccaggctcctcctcgccccggcctccgggtcgggaaattgaggggacggcaggcccggctgccactggaactgggagacagggagaatccctgcgggggtccttaacagggcacccacatc

SEQ ID NO: 693751 - DNA, 172 bp, Homo sapiens
atgtatccacaggtgcaagcagatctcaagtccagctgctcttgtaaatgctgatggtaacgccctcatcttgcacatgcagcagtgcttttggatacatgccatctgtgggtagtcagctagtgcaagcaaaaacagtcagcaaacgtcaagcatacaaaccacaggcaag

SEQ ID NO: 693752 - DNA, 185 bp, Homo sapiens
  misc_feature (82)..(82): n is a, c, g, or t
  misc_feature (104)..(104): n is a, c, g, or t
  misc_feature (117)..(117): n is a, c, g, or t
  misc_feature (141)..(141): n is a, c, g, or t
  misc_feature (163)..(163): n is a, c, g, or t
tacgtgtcaggattctgctggtacgagaggccttcctctttctgtttttaaaaaaagttttactgccatattggattccatncctgttgccatcctcactgttnctgttttgggttnctggtctctttgactttcaaagtnctccagctcctcatacgcacancttttggatgacctcagcttga

SEQ ID NO: 693753 - DNA, 414 bp, Homo sapiens
ctcagagggtgtgctgcaccggggcctgggcaggagggaggtgcttttagatctgtcaggagacaggttagctgatccccacgtcagctgtgacactccgacttttgtttaccagagctggtaggcagagaggtctgcctttggacttgatccggcacacctacgctagagtgcagagagacaggccctgcaggaggattggaggcgaagcgttgtactcaggctcatgtggtacttgagcttggcacagactgtctgcggactaacctgctgagagttcatcagcttccatcctaccccttgtgccttgctacgccagacttgccacggatcatggagatcccaacatctgtccgcaataagcttcattcctctactgactcgcttctctggcctgaagcttatgccgagtcg

SEQ ID NO: 693754 - DNA, 2243 bp, Homo sapiens
gtccaattccctaatgtgacgggcgcccgcggaaggcgacatgggctccgctccctgggccccggtcctgctgctggcgctcgggctgcgcggcctccaggcgggggcccgcagggccccggaccccggcttccaggagcgcttcttccagcagcgtctggaccacttcaacttcgagcgcttcggcaacaagaccttccctcagcgcttcctggtgtcggacaggttctgggtccggggcgaggggcccatcttcttctacactgggaacgagggcgacgtgtgggccttcgccaacaactcgggcttcgtcgcggagctggcggccgagcggggggctctactggtcttcgcggagcaccgctactacgggaagtcgctgccgttcggtgcgcagtccacgcagcgcgggcacacggagctgctgacggtggagcaggccctggccgacttcgcagagctgctccgcgcgctacgacgcgacctcggggcccaggatgcccccgccatcgccttcggtggaagttatggggggatgctcagtgcctacctgaggatgaagtatccccacctggtggcgggggcgctggcggccagcgcgcccgttctagctgtggcaggcctcggcgactccaaccagttcttccgggacgtcacggcggactttgagggccagagtcccaaatgcacccagggtgtgcgggaagcgttccgacagatcaaggacttgttcctacagggagcctacgacacggtccgctgggagttcggcacctgccagccgctgtcagacgagaaggacctgacccagctcttcatgttcgcccggaatgccttcaccgtgctggccatgatggactacccctaccccactgacttcctgggtcccctccctgccaaccccgtcaaggtgggctgtgatcggctgctgagtgaggcccagaggatcacggggctgcgagcactggcagggctggtctacaacgcctcgggctccgagcactgctacgacatctaccggctctaccacagctgtgctgaccccactggctgcggcaccggccccgacgccagggcctgggactaccagatctcagagccgccagcaacatcatcttctccaacgggaacctggacccctgggcagggggcgggattcggaggaacctgagtgcctcagtcatcgccgtcaccatccaggggggagcgcaccacctcgacctcagagcctcccacccagaagatcctgcttccgtggttgaggcgcggaagctggaggccaccatcatcggcgagtgggtaaaggcagccaggcgtgagcagcagccagctctgcgtggggggcccagactcagcctctgagcacaggactggaggggtctcaaggctcctcatggagtgggggcttcactcaagcagctggcggcagagggaaggggctgaataaacgcctggaggcctggcaaaaaaaaaaaaaaaaaaaaaaaaaaaaaaaaaaaaaaaaaaaaaaaaaaaacaacaaaacaaaaaaaacaaaggggggggggccgcaacaaaaaaaccccacacgggggggagcgccaccccagtcacgcccaccccgcacgctttttgtgtggacaccaggaagggcggccccaaacaaaggggagtgcactaatatataacagaccgaaggccagcgcgggcggcgatataacaaaacacgccggccgagggcagaggaggaaacaaacgtaccataataggcgggctcatctagtcgcaggggagggaacccacacactacacggaggaggccgagcgaacaaaaggggggacaccacacaccaacccaaggcaaaatacataaatggctcaagggacgggagcaacaactcaaaaacgacgccgcacgcggagggtaccgaggtgcggccagcccaaccacgcagaaaaaatacgccgcgggcgaaaaaaagaacttcgggccaccaacggcgcgcacgtagatacccgtaaacacaaccattataccaccgcgggccgcgggagtgcagataaaaacagaagaactggaccgcaagcagaccacagacaaccccacacgcgacgaaacccgccacagacggaccaacaaaaagcaagcccccacagcagagccgaccacgccaagaagaccacggcgagaaggcgacgcagagacgccacgaaatagacagcataacgcaagacaacacgcgagcacggagtcacgcagcaac

SEQ ID NO: 693755 - DNA, 1026 bp, Homo sapiens
  misc_feature (483)..(483): n is a, c, g, or t
  misc_feature (750)..(751): n is a, c, g, or t
  misc_feature (753)..(753): n is a, c, g, or t
ggtggagccagggcagcagggctgtctctgaactcccaggcttgtgtttgagcaaaggaattctctccccctccctctcccctcggggcgggcccgagcctccagctataaactccccggagcttcagtgccctcagcaaggctcagcctcaagattcacagcatctcagacgcagcctaggccgcaccaggatgtcggacaccgaggagcaggaatatgaggaggagcagccggaagaggaggctgcggaggaggaggaggaagcccccgaagagccggagccggtggcagagccagaagaggaacgccccaaaccaagccgccccgtggtgcctcctttgatcccgccaaagatcccagaaggggagcgcgtagacttcgatgacatccaccgcaagcgcatggagaaagacctgctggagctgcagacactcatcgatgtacatttcgagcagcggaagaaggaggacgaggagctggtngccttgaaggagcgcattgagcggcgccggtcagagagagccgagcaacagcgcttcagaactgagaaggaacgcgaacgtcaggctaagctggcggaggagaagatgaggaaggaagaggaagaggccaagaagcgggcagaggatgatgccaagaaaagaaggtgctgtccaacatgggggcccattttggcggctacctggtcaaggcagaacagaagcgtggtaagcggcagtgggccgggagatgaaggtgcgcatcgctcnnancgtaagaagctctgacattgactaaatgggggaggcacagcccggaagaaagcccaggagtggcgggtggatccaccagtgagtctgagaagtcgcggaggcaaggtgaaccagggaattgagatcacgtgtgtaaacgttcagcagccaaagtcggaggggggaaggccgtgagcgtgaatgggatcgcctgagcccggatggggtcccagagggaaagcccaacccaaaaaaaattggcgcgcaatcaatggggcgaatacacgggagcaa

SEQ ID NO: 693756 - DNA, 1464 bp, Homo sapiens
gtccaattccctaatgtgacgggcgcccgcggaaggcgacatgggctccgctccctgggccccggtcctgctgctggcgctcgggctgcgcggcctccaggcgggggcccgcagggccccggaccccggcttccaggagcgcttcttccagcagcgtctggaccacttcaacttcgagcgcttcggcaacaagaccttccctcagcgcttcctggtgtcggacaggttctgggtccggggcgaggggcccatcttcttctacactgggaacgagggcgacgtgtgggccttcgccaacaactcgggcttcgtcgcggagctggcggccgagcggggggctctactggtcttcgcggagcaccgctactacgggaagtcgctgccgttcggtgcgcagtccacgcagcgcgggcacacggagctgctgacggtggagcaggccctggccgacttcgcagagctgctccgcgcgctacgacgcgacctcggggcccaggatgcccccgccatcgccttcggtggaagttatggggggatgctcagtgcctacctgaggatgaagtatccccacctggtggcgggggcgctggcggccagcgcgcccgttctagctgtggcaggcctcggcgactccaaccagttcttccgggacgtcacggcggactttgagggccagagtcccaaatgcacccagggtgtgcgggaagcgttccgacagatcaaggacttgttcctacagggagcctacgacacggtccgctgggagttcggcacctgccagccgctgtcagacgagaaggacctgacccagctcttcatgttcgcccggaatgccttcaccgtgctggccatgatggactacccctaccccactgacttcctgggtcccctccctgccaaccccgtcaaggtgggctgtgatcggctgctgagtgaggcccagaggatcacggggctgcgagcactggcagggctggtctacaacgcctcgggctccgagcactgctacgacatctaccggctctaccacagctgtgctgaccccactggctgcggcaccggccccgacgccagggcctgggactaccagatctcagagccgccagcaacatcatcttctccaacgggaacctggacccctgggcagggggcgggattcggaggaacctgagtgcctcagtcatcgccgtcaccatccaggggggagcgcaccacctcgacctcagagcctcccacccagaagatcctgcttccgtggttgaggcgcggaagctggaggccaccatcatcggcgagtgggtaaaggcagccaggcgtgagcagcagccagctctgcgtggggggcccagactcagcctctgagcacaggactggaggggtctcaaggctcctcatggagtgggggcttcactcaagcagctggcggcagagggaaggggctgaataaacgcctggaggcctggc

SEQ ID NO: 693757 - DNA, 921 bp, Homo sapiens
  misc_feature (378)..(378): n is a, c, g, or t
  misc_feature (645)..(646): n is a, c, g, or t
  misc_feature (648)..(648): n is a, c, g, or t
cagacgcagcctaggttcccatggacttgtcataagacaaaagaggacagctgtgctgagggggcaggttctgcagcctcctggctgtgccaggaccacacctaccaaggccgcaccaggatgtcggacaccgaggagcaggaatatgaggaggagcagccggaagaggaggctgcggaggaggaggaggaagaagaggaacgccccaaaccaagccgccccgtggtgcctcctttgatcccgccaaagatcccagaaggggagcgcgtagacttcgatgacatccaccgcaagcgcatggagaaagacctgctggagctgcagacactcatcgatgtacatttcgagcagcggaagaaggaggacgaggagctggtngccttgaaggagcgcattgagcggcgccggtcagagagagccgagcaacagcgcttcagaactgagaaggaacgcgaacgtcaggctaagctggcggaggagaagatgaggaaggaagaggaagaggccaagaagcgggcagaggatgatgccaagaaaagaaggtgctgtccaacatgggggcccattttggcggctacctggtcaaggcagaacagaagcgtggtaagcggcagtgggccgggagatgaaggtgcgcatcgctcnnancgtaagaagctctgacattgactaaatgggggaggcacagcccggaagaaagcccaggagtggcgggtggatccaccagtgagtctgagaagtcgcggaggcaaggtgaaccagggaattgagatcacgtgtgtaaacgttcagcagccaaagtcggaggggggaaggccgtgagcgtgaatgggatcgcctgagcccggatggggtcccagagggaaagcccaacccaaaaaaaattggcgcgcaatcaatggggcgaatacacgggagcaa

SEQ ID NO: 693758 - DNA, 259 bp, Homo sapiens
ggaaatgttgacaagcaattttcctgggcaagctgcttcaacctgggattcccagtgtatcccgcgtttagcccactggagatagtatggtgggcacagatgtatgctcatcagtattatatgcagtatcaagctgcagtttcagctcagggccacacttcaaattttaagccaaaccaggctactacttcacaggctctaaatttgggcatgttcttggagaagaaacccccaacaaggtccaaaactaattggggcc

SEQ ID NO: 693759 - DNA, 1371 bp, Homo sapiens
gtccaattccctaatgtgacgggcgcccgcggaaggcgacatgggctccgctccctgggccccggtcctgctgctggcgctcgggctgcgcggcctccaggcgggggcccgcagggccccggaccccggcttccaggagcgcttcttccagcagcgtctggaccacttcaacttcgagcgcttcggcaacaagaccttccctcagcgcttcctggtgtcggacaggttctgggtccggggcgaggggcccatcttcttctacactgggaacgagggcgacgtgtgggccttcgccaacaactcgggcttcgtcgcggagctggcggccgagcggggggctctactggtcttcgcggagcaccgctactacgggaagtcgctgccgttcggtgcgcagtccacgcagcgcgggcacacggagctgctgacggtggagcaggccctggccgacttcgcagagctgctccgcgcgctacgacgcgacctcggggcccaggatgcccccgccatcgccttcggtggaagttatggggggatgctcagtgcctacctgaggatgaagtatccccacctggtggcgggggcgctggcggccagcgcgcccgttctagctgtggcaggcctcggcgactccaaccagttcttccgggacgtcacggcggactttgagggccagagtcccaaatgcacccagggtgtgcgggaagcgttccgacagatcaaggacttgttcctacagggagcctacgacacggtccgctgggagttcggcacctgccagccgctgtcagacgagaaggacctgacccagctcttcatgttcgcccggaatgccttcaccgtgctggccatgatggactacccctaccccactgacttcctgggtcccctccctgccaaccccgtcaaggtgggctgtgatcggctgctgagtgaggcccagaggatcacggggctgcgagcactggcagggctggtctacaacgcctcgggctccgagcactgctacgacatctaccggctctaccacagctgtgctgacccccctgggcagggggcgggattcggaggaacctgagtgcctcagtcatcgccgtcaccatccaggggggagcgcaccacctcgacctcagagcctcccacccagaagatcctgcttccgtggttgaggcgcggaagctggaggccaccatcatcggcgagtgggtaaaggcagccaggcgtgagcagcagccagctctgcgtggggggcccagactcagcctctgagcacaggactggaggggtctcaaggctcctcatggagtgggggcttcactcaagcagctggcggcagagggaaggggctgaataaacgcctggaggcctggc

SEQ ID NO: 693760 - DNA, 481 bp, Homo sapiens
  misc_feature (10)..(10): n is a, c, g, or t
  misc_feature (71)..(71): n is a, c, g, or t
  misc_feature (81)..(81): n is a, c, g, or t
  misc_feature (90)..(90): n is a, c, g, or t
  misc_feature (92)..(92): n is a, c, g, or t
  misc_feature (94)..(95): n is a, c, g, or t
  misc_feature (97)..(97): n is a, c, g, or t
  misc_feature (104)..(104): n is a, c, g, or t
  misc_feature (134)..(134): n is a, c, g, or t
  misc_feature (192)..(193): n is a, c, g, or t
  misc_feature (198)..(198): n is a, c, g, or t
  misc_feature (204)..(205): n is a, c, g, or t
  misc_feature (207)..(207): n is a, c, g, or t
  misc_feature (212)..(212): n is a, c, g, or t
  misc_feature (218)..(218): n is a, c, g, or t
  misc_feature (221)..(221): n is a, c, g, or t
  misc_feature (239)..(239): n is a, c, g, or t
  misc_feature (249)..(249): n is a, c, g, or t
  misc_feature (252)..(253): n is a, c, g, or t
  misc_feature (279)..(279): n is a, c, g, or t
  misc_feature (281)..(281): n is a, c, g, or t
  misc_feature (294)..(295): n is a, c, g, or t
  misc_feature (298)..(298): n is a, c, g, or t
  misc_feature (300)..(302): n is a, c, g, or t
  misc_feature (310)..(310): n is a, c, g, or t
  misc_feature (331)..(331): n is a, c, g, or t
  misc_feature (335)..(336): n is a, c, g, or t
  misc_feature (347)..(347): n is a, c, g, or t
  misc_feature (359)..(359): n is a, c, g, or t
  misc_feature (362)..(362): n is a, c, g, or t
  misc_feature (364)..(365): n is a, c, g, or t
  misc_feature (368)..(368): n is a, c, g, or t
  misc_feature (371)..(371): n is a, c, g, or t
  misc_feature (385)..(385): n is a, c, g, or t
  misc_feature (394)..(394): n is a, c, g, or t
  misc_feature (397)..(397): n is a, c, g, or t
  misc_feature (413)..(413): n is a, c, g, or t
  misc_feature (477)..(477): n is a, c, g, or t
gacatctccnttgacaattgtgtctgcatcaaacggagagtccttcgtcctgcagtatgattgttactggnggggaacatncggtgaccngngnngngggggcntgcttggaaaagacctccctgtcatctgcnatactacgggacaaatcagtatctactcaaattcccacttccagaatgagaggactcnncaggngtttannantttgnaaagcnttnaaaatgtatcgtggttgnattttgactnttnngaaatagaataactgacaaatggtcnanaaacaaacttgtnnaantnnnattgggangggtctcggtggagacttggngtgnngtcgacgaggnggggggaatatnagngnnggntcnccgccacacggganaagggagtnttntgtttgtttttttttngcatgcagcatatataaaatgtgatctagaattgaaattgtaaaacagaataatcctcttaaanaaaa

SEQ ID NO: 693761 - DNA, 649 bp, Homo sapiens
ggcgggccagctcgaggacgcatcagactgtctttcagcaaggagcgatctttctagttctctgatagctattacagagattcaccgccactgaacaagatgagtatgcctgccgtgtgaagcaggtgactctgtcacagtccaaggatagttaagtgggatcgagacatggtggcagcatcatggaggtttgaagatgccgcatgcggagtcggatgaattccaaatactgcgttgctggcgtggtttaatactcgatatgcttatacacgttacactttatgcacaaaatgtcgggttataataagtgtgttacatggacatgagtcttctttataattctacttcgagtgctgtctccacgtatgatgtatctgagccggttgctccacaggtagctctagcatgggtggggacttagaggtggggagcagagaattctcttatacaagatcaacatctcggtcagatttgaactcttcagatctcttgcactcaacagcttgttaagatagttaaggcgtggatagagttaagttccaagtttacatactctgcttagaattcggggggaaatttaggagtataatggacaggatgatcggaacttcgtgctaatgaatgggtgcgtcgaagggggatcctctag

SEQ ID NO: 693762 - DNA, 610 bp, Homo sapiens
  misc_feature (20)..(20): n is a, c, g, or t
  misc_feature (129)..(129): n is a, c, g, or t
  misc_feature (176)..(177): n is a, c, g, or t
  misc_feature (186)..(186): n is a, c, g, or t
  misc_feature (218)..(218): n is a, c, g, or t
  misc_feature (252)..(252): n is a, c, g, or t
  misc_feature (262)..(262): n is a, c, g, or t
  misc_feature (264)..(264): n is a, c, g, or t
  misc_feature (296)..(296): n is a, c, g, or t
  misc_feature (303)..(303): n is a, c, g, or t
  misc_feature (348)..(350): n is a, c, g, or t
  misc_feature (356)..(356): n is a, c, g, or t
  misc_feature (364)..(365): n is a, c, g, or t
  misc_feature (374)..(375): n is a, c, g, or t
  misc_feature (378)..(378): n is a, c, g, or t
  misc_feature (387)..(387): n is a, c, g, or t
  misc_feature (389)..(389): n is a, c, g, or t
  misc_feature (392)..(392): n is a, c, g, or t
  misc_feature (396)..(396): n is a, c, g, or t
  misc_feature (401)..(402): n is a, c, g, or t
  misc_feature (494)..(494): n is a, c, g, or t
  misc_feature (496)..(496): n is a, c, g, or t
  misc_feature (604)..(604): n is a, c, g, or t
atagtaaatatttacaaaantgttgataacattactcaagtcacacacatataacaatgtagacaggtcttaacaaagtttacaaattgaaattatggagatttcccaaaatgaatctaatagctcatngctgagcatggttatcaatataacatttaagatcttggatcaaatgnngtccccgantcttctgcaatccagtcctcttagaaattggnttctctctttgggagattcagactcagaggcagncagagggganangtcaagagctgaaataatcacataactactcnaattttnttcattctattgactgtgtcaagttatagacacagccaaagtgtnnntcttcngcctctgnngatttgagnngangaagaacangngcnattnctcanngcttaaagaaaaacttggcacatatagaggctgagtgtaggtagagtatctgtactagaaccataaagttctatctgttggtaaattcatgnanaaaactaagataaaacagataattatgctctatctcatatctactgaaagtagaaaaggaggaagagtgacacttttaaatcaaactggctctagtttttagcttagnggatgg

SEQ ID NO: 693763 - DNA, 2084 bp, Homo sapiens
gtccaattccctaatgtgacgggcgcccgcggaaggcgacatgggctccgctccctgggccccggtcctgctgctggcgctcgggctgcgcggcctccaggcggggggtgagtggcggcgccccccggcccattccccggtcccggccccgcctctgaggttcgcgtccccccacagcccgcagggccccggaccccggcttccaggagcgcttcttccagcagcgtctggaccacttcaacttcgagcgcttcggcaacaagaccttccctcagcgcttcctggtgtcggacaggttctgggtccggggcgaggggcccatcttcttctacactgggaacgagggcgacgtgtgggccttcgccaacaactcgggcttcgtcgcggagctggcggccgagcggggggctctactggtcttcgcggagcaccgctactacgggaagtcgctgccgttcggtgcgcagtccacgcagcgcgggcacacggagctgctgacggtggagcaggccctggccgacttcgcagagctgctccgcgcgctacgacgcgacctcggggcccaggatgcccccgccatcgccttcggtggaagttatggggggatgctcagtgcctacctgaggatgaagtatccccacctggtggcgggggcgctggcggccagcgcgcccgttctagctgtggcaggcctcggcgactccaaccagttcttccgggacgtcacggcggactttgagggccagagtcccaaatgcacccagggtgtgcgggaagcgttccgacagatcaaggacttgttcctacagggagcctacgacacggtccgctgggagttcggcacctgccagccgctgtcagacgagaaggacctgacccagctcttcatgttcgcccggaatgccttcaccgtgctggccatgatggactacccctaccccactgacttcctgggtcccctccctgccaaccccgtcaaggtgggctgtgatcggctgctgagtgaggcccagaggatcacggggctgcgagcactggcagggctggtctacaacgcctcgggctccgagcactgctacgacatctaccggctctaccacagctgtgctgaccccactggctgcggcaccggccccgacgccagggcctgggactaccaggcctgcaccgagatcaacctgaccttcgccagcaacaatgtgaccgatatgttccccgacctgcccttcactgacgagctccgccagcggtactgcctggacacctggggcgtgtggccccggcccgactggctgctgaccagcttctgggggggtgatctcagagccgccagcaacatcatcttctccaacgggaacctggacccctgggcagggggcgggattcggaggaacctgagtgcctcagtcatcgccgtcaccatccaggggggagcgcaccacctcgacctcagagcctcccacccagaagatcctgcttccgtggttgaggcgcggaagctggaggccaccatcatcggcgagtgggtaaaggcagccaggcgtgagcagcagccagctctgcgtggggggcccagactcagcctctgagcacaggactggaggggtctcaaggctcctcatggagtgggggcttcactcaagcagctggcggcagagggaaggggctgaataaacgcctggaggcctggcaaaaaaaaaaaaaaaaaaaaaagaagaaaaacaaacacaaccacaagaaaaaaaggggggggcgacgaaagaaaaatccccgggggggggcccaaattagagcgacacccagatcgtctgtcaaaaaggggggcccacaaagagagaaggacaaaataaaaaaacgcaaagcacgcggcgcccgacgctataacaacagattagagagcgcgtgacacacacacgcgccagcacggggggcgacaatgtgagaggagagggacaacccacacaaccacgcggggggggggacaaaccacaataggggacaaaaccaacaccccaaacacgacaagttacaacgcgccccggacgggggcaaccaaaaaaacaccgaagagggacaccagggga

SEQ ID NO: 693764 - DNA, 101 bp, Homo sapiens
atgaatcaccctgagtacaaatatctttgttgtttagcacttaaatttcccacatttattaaattgatgtaaatcagatcttttctacaaagctcctatcc

SEQ ID NO: 693765 - DNA, 1087 bp, Homo sapiens
  misc_feature (937)..(937): n is a, c, g, or t
  misc_feature (958)..(959): n is a, c, g, or t
gtccaattccctaatgtgacgggcgcccgcggaaggcgacatgggctccgctccctgggccccggtcctgctgctggcgctcgggctgcgcggcctccaggcgggggcccgcagggccccggaccccggcttccaggagcgcttcttccagcagcgtctggaccacttcaacttcgagcgcttcggcaacaagaccttccctcagcgcttcctggtgtcggacaggttctgggtccggggcgaggggcccatcttcttctacactgggaacgagggcgacgtgtgggccttcgccaacaactcgggcttcgtcgcggagctggcggccgagcggggggctctactggtcttcgcggagcaccgctactacgggaagtcgctgccgttcggtgcgcagtccacgcagcgcgggcacacggagctgctgacggtggagcaggccctggccgacttcgcagagctgctccgcgcgctacgacgcgacctcggggcccaggatgcccccgccatcgccttcggtggaagttatggggggatgctcagtgcctacctgaggatgaagtatccccacctggtggcgggggcgctggcggccagcgcgcccgttctagctgtggcaggcctcggcgactccaaccagttcttccgggacgtcacggcggactttgagggccagagtcccaaatgcacccagggtgtgcgggaagcgttccgacagatcaaggacttgttcctacagggagcctacgacacggtccgctgggagttcggcacctgccagccgctgtcagacgagaaggacctgacccagctcttcatgttcgcccggaatgccttcaccgtgctggccatgatggactacccctaccccactgacttcctgggtcccctccctgccaaccccgtcaaggtgaggcgccgcctcccagggcgcagngagaggccggctggagtgtcnnaaggctggtggtcagcgcctgaccctcatcctggagccagggaggcggagctggtggaggggaccccgctgagtcccgctgccctgcaccccctcaggcctgatcatactgtagtgcactggcgaggg

SEQ ID NO: 693766 - DNA, 2233 bp, Homo sapiens
gtccaattccctaatgtgacgggcgcccgcggaaggcgacatgggctccgctccctgggccccggtcctgctgctggcgctcgggctgcgcggcctccaggcgggggcccgcagggccccggaccccggcttccaggagcgcttcttccagcagcgtctggaccacttcaacttcgagcgcttcggcaacaagaccttccctcagcgcttcctggtgtcggacaggttctgggtccggggcgaggggcccatcttcttctacactgggaacgagggcgacgtgtgggccttcgccaacaactcgggcttcgtcgcggagctggcggccgagcggggggctctactggtcttcgcggagcaccgctactacgggaagtcgctgccgttcggtgcgcagtccacgcagcgcgggcacacggagctgctgacggtggagcaggccctggccgacttcgcagagctgctccgcgcgctacgacgcgacctcggggcccaggatgcccccgccatcgccttcggtggaaaggaagccctcccacctgtcctcccagccacctgctcagcttggatgtgcggccacactagcggcctttcccagtgagagctgcacccgcacctggcccagggttggaatttgtgggtctcagaagtgtcgtcctccttgtggcacctgtgggcccctgaggaggaaaagaggaaatggggtgttgggggcagcagcctaaccctgtgtccctcacccagttatggggggatgctcagtgcctacctgaggatgaagtatccccacctggtggcgggggcgctggcggccagcgcgcccgttctagctgtggcaggcctcggcgactccaaccagttcttccgggacgtcacggcggactttgagggccagagtcccaaatgcacccagggtgtgcgggaagcgttccgacagatcaaggacttgttcctacagggagcctacgacacggtccgctgggagttcggcacctgccagccgctgtcagacgagaaggacctgacccagctcttcatgttcgcccggaatgccttcaccgtgctggccatgatggactacccctaccccactgacttcctgggtcccctccctgccaaccccgtcaaggtgggctgtgatcggctgctgagtgaggcccagaggatcacggggctgcgagcactggcagggctggtctacaacgcctcgggctccgagcactgctacgacatctaccggctctaccacagctgtgctgaccccactggctgcggcaccggccccgacgccagggcctgggactaccaggcctgcaccgagatcaacctgaccttcgccagcaacaatgtgaccgatatgttccccgacctgcccttcactgacgagctccgccagcggtactgcctggacacctggggcgtgtggccccggcccgactggctgctgaccagcttctgggggggtgatctcagagccgccagcaacatcatcttctccaacgggaacctggacccctgggcagggggcgggattcggaggaacctgagtgcctcagtcatcgccgtcaccatccaggggggagcgcaccacctcgacctcagagcctcccacccagaagatcctgcttccgtggttgaggcgcggaagctggaggccaccatcatcggcgagtgggtaaaggcagccaggcgtgagcagcagccagctctgcgtggggggcccagactcagcctctgagcacaggactggaggggtctcaaggctcctcatggagtgggggcttcactcaagcagctggcggcagagggaaggggctgaataaacgcctggaggcctggcaaaaaaaaaaaaaaaaaaaaaagaagaaaaacaaacacaaccacaagaaaaaaaggggggggcgacgaaagaaaaatccccgggggggggcccaaattagagcgacacccagatcgtctgtcaaaaaggggggcccacaaagagagaaggacaaaataaaaaaacgcaaagcacgcggcgcccgacgctataacaacagattagagagcgcgtgacacacacacgcgccagcacggggggcgacaatgtgagaggagagggacaacccacacaaccacgcggggggggggacaaaccacaataggggacaaaaccaacaccccaaacacgacaagttacaacgcgccccggacgggggcaaccaaaaaaacaccgaagagggacaccagggga

SEQ ID NO: 693767 - DNA, 200 bp, Homo sapiens
cgccagccagcaatgttgattaagcagattattaaaaaatgagcaggcattttccctcttcgcgtaactgaagcattgccgaacgggttatttttgcttaatctgccagaaggattgatcaattctaaatgttcaataagcgcagccaaaaaccgcctcactatccgccccattttttaacgcctgactggctactgtct

SEQ ID NO: 693768 - DNA, 1473 bp, Homo sapiens
  misc_feature (8)..(8): n is a, c, g, or t
atgtggtnatctagaggatcctggctcccacttggttgcgggggcgctggtgtgcagcgcgccgttctagctgtggcaggcctcggcgactccaaccagttcttccgggacgtcacggcggactttgagggccagagtcccaaatgcacccagggtgtgcgggaagcgttccgacagatcaaggacttgttcctacagggagcctacgacacggtccgctgggagttcggcacctgccagccgctgtcagacgagaaggacctgacccagctcttcatgttcgcccggaatgccttcaccgtgctggccatgatggactacccctaccccactgacttcctgggtcccctccctgccaaccccgtcaaggtgggctgtgatcggctgctgagtgaggcccagaggatcacggggctgcgagcactggcagggctggtctacaacgcctcgggctccgagcactgctacgacatctaccggctctaccacagctgtgctgaccccactggctgcggcaccggccccgacgccagggcctgggactaccaggcctgcaccgagatcaacctgaccttcgccagcaacaatgtgaccgatatgttccccgacctgcccttcactgacgagctccgccagcggtactgcctggacacctggggcgtgtggccccggcccgactggctgctgaccagcttctgggggggtgatctcagagccgccagcaacatcatcttctccaacgggaacctggacccctgggcagggggcgggattcggaggaacctgagtgcctcagtcatcgccgtcaccatccaggggggagcgcaccacctcgacctcagagcctcccacccagaagatcctgcttccgtggttgaggcgcggaagctggaggccaccatcatcggcgagtgggtaaaggcagccaggcgtgagcagcagccagctctgcgtggggggcccagactcagcctctgagcacaggactggaggggtctcaaggctcctcatggagtgggggcttcactcaagcagctggcggcagagggaaggggctgaataaacgcctggaggcctggcaaaaaaaaaaaaaaaaaaaaaagaagaaaaacaaacacaaccacaagaaaaaaaggggggggcgacgaaagaaaaatccccgggggggggcccaaattagagcgacacccagatcgtctgtcaaaaaggggggcccacaaagagagaaggacaaaataaaaaaacgcaaagcacgcggcgcccgacgctataacaacagattagagagcgcgtgacacacacacgcgccagcacggggggcgacaatgtgagaggagagggacaacccacacaaccacgcggggggggggacaaaccacaataggggacaaaaccaacaccccaaacacgacaagttacaacgcgccccggacgggggcaaccaaaaaaacaccgaagagggacaccagggga

SEQ ID NO: 693769 - DNA, 1923 bp, Homo sapiens
ggctcgctcccttggcccgtgtcctgcttgctggctgctcggtgctgcgcgtgcctccaaggctgtggtgtgtgagtggcggcgccccccggcccattccccggtcccggccccgcctctgaggttcgcgtccccccacagcatatcctgaggtcaccgaccggcttcaggacgttctttcgtaggtttgacattctttcgagcgcttgagcacttccctcagcgcttcctggtgtcggacaggttctgggtccggggcgaggggcccatcttcttctacactgggaacgagggcgacgtgtgggccttcgccaacaactcgggcttcgtcgcggagctggcggccgagcggggggctctactggtcttcgcggagcaccgctactacgggaagtcgctgccgttcggtgcgcagtccacgcagcgcgggcacacggagctgctgacggtggagcaggccctggccgacttcgcagagctgctccgcgcgctacgacgcgacctcggggccccgttctagctgtggcaggcctcggcgactccaaccagttcttccgggacgtcacggcggactttgagggccagagtcccaaatgcacccagggtgtgcgggaagcgttccgacagatcaaggacttgttcctacagggagcctacgacacggtccgctgggagttcggcacctgccagccgctgtcagacgagaaggacctgacccagctcttcatgttcgcccggaatgccttcaccgtgctggccatgatggactacccctaccccactgacttcctgggtcccctccctgccaaccccgtcaaggtgggctgtgatcggctgctgagtgaggcccagaggatcacggggctgcgagcactggcagggctggtctacaacgcctcgggctccgagcactgctacgacatctaccggctctaccacagctgtgctgaccccactggctgcggcaccggccccgacgccagggcctgggactaccaggcctgcaccgagatcaacctgaccttcgccagcaacaatgtgaccgatatgttccccgacctgcccttcactgacgagctccgccagcggtactgcctggacacctggggcgtgtggccccggcccgactggctgctgaccagcttctgggggggtgatctcagagccgccagcaacatcatcttctccaacgggaacctggacccctgggcagggggcgggattcggaggaacctgagtgcctcagtcatcgccgtcaccatccaggggggagcgcaccacctcgacctcagagcctcccacccagaagatcctgcttccgtggttgaggcgcggaagctggaggccaccatcatcggcgagtgggtaaaggcagccaggcgtgagcagcagccagctctgcgtggggggcccagactcagcctctgagcacaggactggaggggtctcaaggctcctcatggagtgggggcttcactcaagcagctggcggcagagggaaggggctgaataaacgcctggaggcctggcaaaaaaaaaaaaaaaaaaaaaagaagaaaaacaaacacaaccacaagaaaaaaaggggggggcgacgaaagaaaaatccccgggggggggcccaaattagagcgacacccagatcgtctgtcaaaaaggggggcccacaaagagagaaggacaaaataaaaaaacgcaaagcacgcggcgcccgacgctataacaacagattagagagcgcgtgacacacacacgcgccagcacggggggcgacaatgtgagaggagagggacaacccacacaaccacgcggggggggggacaaaccacaataggggacaaaaccaacaccccaaacacgacaagttacaacgcgccccggacgggggcaaccaaaaaaacaccgaagagggacaccagggga

SEQ ID NO: 693770 - DNA, 284 bp, Homo sapiens
tccgcccaaatggggtatggagattttccaggtgtttgtggttgaagttagttaagaaagagtttaggagcacattacaggagggtttttacttaaaggtccagcctcccccccaaggtaaagcaagaagtaaacatgaggttttgaagagaagtttagatgtatgaggagtcattagaggtgaacagttgcagtatgtagctagagtgtcgatgttagatcttggttccagagatctttacaatgattatgaagatcaaagggcattagaatcaagctataaa

SEQ ID NO: 693771 - DNA, 1878 bp, Homo sapiens
gtccaattccctaatgtgacgggcgcccgcggaaggcgacatgggctccgctccctgggccccggtcctgctgctggcgctcgggctgcgcggcctccaggcgggggcccgcagggccccggaccccggcttccaggagcgcttcttccagcagcgtctggaccacttcaacttcgagcgcttcggcaacaagaccttccctcagcgcttcctggtgtcggacaggttctgggtccggggcgaggggcccatcttcttctacactgggaacgagggcgacgtgtgggccttcgccaacaactcgggcttcgtcgcggagctggcggccgagcggggggctctactggtcttcgcggagcaccgctactacgggaagtcgctgccgttcggtgcgcagtccacgcagcgcgggcacacggagctgctgacggtggagcaggccctggccgacttcgcagagctgctccgcgcgctacgacgcgacctcggggcccaggatgcccccgccatcgccttcggtggaaggactttgagggccagagtcccaaatgcacccagggtgtgcgggaagcgttccgacagatcaaggacttgttcctacagggagcctacgacacggtccgctgggagttcggcacctgccagccgctgtcagacgagaaggacctgacccagctcttcatgttcgcccggaatgccttcaccgtgctggccatgatggactacccctaccccactgacttcctgggtcccctccctgccaaccccgtcaaggtgggctgtgatcggctgctgagtgaggcccagaggatcacggggctgcgagcactggcagggctggtctacaacgcctcgggctccgagcactgctacgacatctaccggctctaccacagctgtgctgaccccactggctgcggcaccggccccgacgccagggcctgggactaccaggcctgcaccgagatcaacctgaccttcgccagcaacaatgtgaccgatatgttccccgacctgcccttcactgacgagctccgccagcggtactgcctggacacctggggcgtgtggccccggcccgactggctgctgaccagcttctgggggggtgatctcagagccgccagcaacatcatcttctccaacgggaacctggacccctgggcagggggcgggattcggaggaacctgagtgcctcagtcatcgccgtcaccatccaggggggagcgcaccacctcgacctcagagcctcccacccagaagatcctgcttccgtggttgaggcgcggaagctggaggccaccatcatcggcgagtgggtaaaggcagccaggcgtgagcagcagccagctctgcgtggggggcccagactcagcctctgagcacaggactggaggggtctcaaggctcctcatggagtgggggcttcactcaagcagctggcggcagagggaaggggctgaataaacgcctggaggcctggcaaaaaaaaaaaaaaaaaaaaaagaagaaaaacaaacacaaccacaagaaaaaaaggggggggcgacgaaagaaaaatccccgggggggggcccaaattagagcgacacccagatcgtctgtcaaaaaggggggcccacaaagagagaaggacaaaataaaaaaacgcaaagcacgcggcgcccgacgctataacaacagattagagagcgcgtgacacacacacgcgccagcacggggggcgacaatgtgagaggagagggacaacccacacaaccacgcggggggggggacaaaccacaataggggacaaaaccaacaccccaaacacgacaagttacaacgcgccccggacgggggcaaccaaaaaaacaccgaagagggacaccagggga

SEQ ID NO: 693772 - DNA, 1610 bp, Homo sapiens
gtccaattccctaatgtgacgggcgcccgcggaaggcgacatgggctccgctccctgggccccggtcctgctgctggcgctcgggctgcgcggcctccaggcggggggtgagtggcggcgccccccggcccattccccggtcccggccccgcctctgaggttcgcgtccccccacagcccgcagggccccggaccccggcttccaggagcgcttcttccagcagcgtctggaccagttcttccgggacgtcacggcggactttgagggccagagtcccaaatgcacccagggtgtgcgggaagcgttccgacagatcaaggacttgttcctacagggagcctacgacacggtccgctgggagttcggcacctgccagccgctgtcagacgagaaggacctgacccagctcttcatgttcgcccggaatgccttcaccgtgctggccatgatggactacccctaccccactgacttcctgggtcccctccctgccaaccccgtcaaggtgggctgtgatcggctgctgagtgaggcccagaggatcacggggctgcgagcactggcagggctggtctacaacgcctcgggctccgagcactgctacgacatctaccggctctaccacagctgtgctgaccccactggctgcggcaccggccccgacgccagggcctgggactaccaggcctgcaccgagatcaacctgaccttcgccagcaacaatgtgaccgatatgttccccgacctgcccttcactgacgagctccgccagcggtactgcctggacacctggggcgtgtggccccggcccgactggctgctgaccagcttctgggggggtgatctcagagccgccagcaacatcatcttctccaacgggaacctggacccctgggcagggggcgggattcggaggaacctgagtgcctcagtcatcgccgtcaccatccaggggggagcgcaccacctcgacctcagagcctcccacccagaagatcctgcttccgtggttgaggcgcggaagctggaggccaccatcatcggcgagtgggtaaaggcagccaggcgtgagcagcagccagctctgcgtggggggcccagactcagcctctgagcacaggactggaggggtctcaaggctcctcatggagtgggggcttcactcaagcagctggcggcagagggaaggggctgaataaacgcctggaggcctggcaaaaaaaaaaaaaaaaaaaaaagaagaaaaacaaacacaaccacaagaaaaaaaggggggggcgacgaaagaaaaatccccgggggggggcccaaattagagcgacacccagatcgtctgtcaaaaaggggggcccacaaagagagaaggacaaaataaaaaaacgcaaagcacgcggcgcccgacgctataacaacagattagagagcgcgtgacacacacacgcgccagcacggggggcgacaatgtgagaggagagggacaacccacacaaccacgcggggggggggacaaaccacaataggggacaaaaccaacaccccaaacacgacaagttacaacgcgccccggacgggggcaaccaaaaaaacaccgaagagggacaccagggga

SEQ ID NO: 693773 - DNA, 319 bp, Homo sapiens
  misc_feature (34)..(34): n is a, c, g, or t
  misc_feature (46)..(46): n is a, c, g, or t
  misc_feature (48)..(48): n is a, c, g, or t
  misc_feature (78)..(78): n is a, c, g, or t
  misc_feature (104)..(104): n is a, c, g, or t
  misc_feature (116)..(116): n is a, c, g, or t
  misc_feature (169)..(169): n is a, c, g, or t
  misc_feature (200)..(200): n is a, c, g, or t
  misc_feature (214)..(214): n is a, c, g, or t
  misc_feature (224)..(224): n is a, c, g, or t
  misc_feature (227)..(227): n is a, c, g, or t
  misc_feature (229)..(229): n is a, c, g, or t
  misc_feature (232)..(232): n is a, c, g, or t
  misc_feature (245)..(245): n is a, c, g, or t
  misc_feature (257)..(257): n is a, c, g, or t
  misc_feature (278)..(278): n is a, c, g, or t
  misc_feature (313)..(313): n is a, c, g, or t
ggcccaatcccttttaaaagcccttgggggggtnctgggggacctntntttgggaacctttttttttttgccatttgnttttttcccttaaaagtcaaaatttncccggctggggnggggggggggggggcccccctcggccccctggggttgtccccctgtttttggntaacccaacaatgtttgttttcagccctggnccccgggccctttntaaaacgggnaancnaantccctggtttggnccccccccctgntttttttttccccagcccccnaggggtgataatttaaggaaaattttttttttccnccccca

SEQ ID NO: 693774 - DNA, 696 bp, Homo sapiens
tggaaacggaggttgggagtttggctcttgtggctcaggctggagtgcaagggcgtgctctcggctcaccgaaacctctacctcctgtgttcaagcgattctcctgtctcacctcccgaattactgaaatacaggcttgccgccaccacgccgggctaatttggtattttgggtagagacggggttccctccatgttgggccaggctagtcttgaacttcccgacctcaggtgactccgcccgcctcggccctcccaaagtgctgggatatacaggcgtgagccaccgcgcccggcccacaggtagcttctcacacccaagcccctccagtgtccttgacagctcacggggcctcaggcatatgcgggccacatttttggagctgacatttttttacctgcctgggggcccagacaattagggactgaggacataagctgtgccctctagtctcgtggggggagggagcagggtccattaggcctctgaaaccttgggcttgggacctcggggggtcagccacccaagatggcatccaacagcctcgggaagaggggcatcagttggggcactcacctgtcagccatctgggggatgatgtaatgcccattctgtgatctgaccaaatataaaattgccaagttcaattcacaatgctggggtggccacaagaagtgggaaccccactctattgca

SEQ ID NO: 693775 - DNA, 91 bp, Homo sapiens
  misc_feature (37)..(37): n is a, c, g, or t
  misc_feature (60)..(60): n is a, c, g, or t
aaggactgcggcctcttctgaggggcagcggggcctngcgggatgggcaccgcgaacttngtaccccccaacccctgaggaagattggggc

SEQ ID NO: 693776 - DNA, 350 bp, Homo sapiens
aggtttttgagtcgggttgttttcttcattggagatattcgagtcatggaactttttcaaagaactgaagggggattcccggtgatttttccaccccatacagatgaagacatcaaagggccccgccgcagtgacgaagactaaagcttgaacagatctgggtccaaagaggctcggcaggtgccgtgggcactagggagcgacccccgggtggccgagggactgagggatgcgcgtccagccccggagggcggagtacacctgtccctgtagcctgagccgccaggcgccgactgccaacacggtctgcgctgtcccctggcggtggggccaggagccattcgagccta

SEQ ID NO: 693777 - DNA, 933 bp, Homo sapiens
  misc_feature (30)..(30): n is a, c, g, or t
  misc_feature (266)..(266): n is a, c, g, or t
ctgccttcaatagctagccgtgtgctcgcnccgattatctcgttgggagagccggtgttctttatgagggacgtggtctctccggtaaaggcgttccgttgggatctcctttcgttgagcacacggaatgtactctttcttgtggtagtatggtcctgtagcgctcctccagaccagaggaaacacccctcgccgcgccgcgcttcttatatagatggcgcaagacatatatatcatgtatgtggggagacccaacgccacatggntaaagtgttgtacgcctcccgtataattgaagctcacacagcttgtccggtttgcatttatgatatagcgggcacttgggtacactcgctctcgtcacgtagctgtgtgtgtatttctcagaatacttgttcctgtttgtctgtcagatacagtggacacacaatgtgggcacacaccaccgttagatgtaaatcttgttgtcataaaagagagttatcctagtcacgctcacattgcctctctcacgagggggcacgcacatagagcttccctattagttggtttctcattgtgggggcgcccccgcaggactgcgctcacactagtgagatacataccgggagggacactcctgcactccccagagacggagctgctttttgagtataatcaggcgccgtgggagctcgtggaccacaagcgagcgaatatcgtggcgtgagacggaaacattgtgttttctgttagttggtgcctaacccacgtcctacttgacgccccatacggtgggtgatccacgagtacgtgacacgcttatggtagccgcccgcacgtagggtcaacagaacaagaggcaacgctgctctattcatacatagctataatgcgaggagctctgtataaaaaacaataaatacgcctttattaaaaagaacaaacaagaca

SEQ ID NO: 693778 - DNA, 935 bp, Homo sapiens
cgtgcgctcactttgagtggcccgggaccccctggtattctctagccgatgtcctccctataggggcgattccctgttccctccgagggggttttctttctctgggggacccactttgtacgcgttgtgcgccacccctttgttgcgtccccctgctctgtgacgtgctcccaccccccgccaccctggggcgtcctcttcttatagaggggggaggaacaccacgaatttttttcggtgtgagaccccgtcggccttggtttagagcgcccgtcactcctctgaaggttggggcctcaggtggcacccccttttggtgaatctccacggcccacagagttctccacaacaccatgggaggggcacttctccctctctgtgctcacctcccgaggcgaggttagtttttttgtctgggaagaacacacagctgggtgaccgagttgtgaccggcccccccctgtcgtgtgatttccaccactcccgccgaagggagatgcccccacccctgcaactcctcggtggcctccccttttttcaagtagagtgggaatatcaacaattttttcgtgagagaacccctccgaactgcgttaaggagaccctaccgcccctccgcaggtgggagacccccgctgcaccacccctctgcagcaatatctatcaaggccccaagcattcccccaatataaggaaagggcaattccctccctcgtatacagcccacgcgacgagtttattctttttctggggaaccaacctgggagaatgggcacccccccttttgggtcacacacaaaacccaaaaaagatcccctttgccccctggtgccctcgctttaggggggggttttaaatttccccctttaagggttccccaaccacatttctcttgccctttcctttccaaaaaaatttttgccattccccccaca

SEQ ID NO: 693779 - DNA, 311 bp, Homo sapiens
  misc_feature (25)..(25): n is a, c, g, or t
gatttggtgcatgttgacaagctgnacttgaagtcccggcttctagtgatacacctgccctcagctcccaaagtggttggaatataggcgtgagcatgcgcccagttaatctgtctttgtacagggtctgttgatacagtgagttctagatttctcttagaggactcagcatgtatgttcaggttcttttattctccatttaactcgtgcatagtttcagtaaacaagcttttccacgcagttttaatcaatagttcacatcttgttccccgtggtcaacttctcctgtcatgaatcatcctggtacctgt

SEQ ID NO: 693780 - DNA, 936 bp, Homo sapiens
ggaactcgcgtcggttggcgactcccggagcgtaggtagtttgtgggccgggttctgaggccttgcgtcctctgtacttcccactctaggccacgatgccgcaggatcagagctgggaggagttcagacggctgcctgaaaagtttatctcgactgacacctgatgtagaggcacgtgtggttttcacatataggtggttgtgatgggaacttgtgtgtgaagtagcagatgattgagatttggtttggtgtataagaaagaccatgataaatgatgtcaagatgattgagagatgctagagtcaatttattgcgactgatgggtagtcaaggaagcccgatatgtcatgagtgggaacttgagtgaatggttcgaaatgaagagtttgttcgtgtacttatggaagtagtatatctctattgaagttaggggaaagtgttgggacagaggagtacttgatgtagctaacgggggttgttcagaagcgtgaagaggtcatgttctgtaatatccatattaacttacttgaggagagctatgtgatgcacatggtttggcatgttaggaaatggcctttatttactgtttggtgatttgcacgacgcaagggcatctgtctttagaaactccgtacgtagttattttgatggttacgggtaacatcgatgtaactggtgttgcctctgggcaagcgtttggatcagtgaatttggcaaactggtgcgtattaggtgataaacccacttcttctttcctttcaggtgcacactctctcttaaagaaccattacctggtaaccttgtggccgcacaagtcctttgcgcgcgtacaggggtccgggtggccccgaattacagtgggggggtagaccccccacattgtcgcgtcacatcggcgccacaatattgcggcggcacaattgacgaggggcgacc

SEQ ID NO: 693781 - DNA, 992 bp, Homo sapiens
gtcaccttccagtagcccatgcctctcagtgtggaggcgcagcaggcaccgcagggcgggctggtaccacactgaccatccacgggacccaccctggacacagggctcctcagcgaggaaagtgcgggtgaccctcaacggtgtcccgttgtaaagtgacgaagttgggagcgcagactcccacgtgttgtcaatcttggcgcccacaaggctgatcacgaggggcacaagattcgctttcatcggacgttctcctacgaggtggtggtctctcaccagttgtccaagccccatggaatcgtatcgttcagcgcatacgcagcgtgaaccaagcccccggtagctgtgatgcctttcagacgccagctcaccggatatggcttttttcgcccaaggtagggttgggcactgctagacaatctacacctgtctactggggtgctcaagagggcgtttcacggctcgtgattcccacgaagagtttttgccccagtgaggtgtgtcgactcaggcgggaggtccccttcttgacaagtttctcttggtcatggccggccgggctgaggaagtgctttgacattctcccttggtagaagacgcctatgtaccgggttggattgagggctactaggactagacaggtcgttttcccaaacgaagagttgatcacccaagatggatcaggtcctgtccgtggtacccgcccgtgtcgtgctgccttgatggaacgcctaggaatgtgcgctaacacacctcttcagcggggatgtcgtggaagtccggaaagattttgacctgtggtaggccgtggggcccctggattccatggaaacatagaggtgccctgtgtggcgccctttccggagcggttaccgtttgccttggaacccaccaaagcttgttgaagcaagcgtttgcaacacgggttgggcggttctaagggaatgacccgtgctccaaatacccagctcagtccaccggtcctgggggtg

SEQ ID NO: 693782 - DNA, 134 bp, Homo sapiens
tctctctacttgacggtcctggtccccacctgacaccgttgcgtgggacctggcacggcctgcagtgacgcttcccgttcacgctccgggctacccttgccaccacgccttgtgacgcgccggtcgacggccgg

SEQ ID NO: 693783 - DNA, 140 bp, Homo sapiens
tctctttataaataaacccatccatgtgtgtccttttccttggctacacgcgtgggatcccagtagcgatgctgtcccctggcctttttcaattaatttatcttgggtgctttccctcattaccccacaccttctagtag

SEQ ID NO: 693784 - DNA, 761 bp, Homo sapiens
ctttcagttcaacaagatggaccactcctgccgaggtagccacagcttcgcctggggttctgtgcccagtcctgggactctgcctggtgctctgtttctctttcttgctctctctctgtctttgcttaggcgtgaccattctaaactgagggtaactggttcttgttattttgctcgtggcaggattgaatacattatctccttggaataatagcattatctttgactggtgcattgctggtctggccaattaaattcacaaggaagacagaatggaatgcctgtggtagcagtgccttttcttttttttccatttaaaggaagttagaaaaattattgttttaattcccaaagctttatctgttgtctgctaatcttttaaagtggaagtacaagcgtggggtcaggcttatatctttcagaggcagctgaggccagagtcagagcccgacatctgcctcactgatcatgtatcaccttgggcaagtcactttgtttctctgagcctcggtttcctctcctgagaaatgggtatggtgatcctctattggatatttattctcaagagttcaaggaaggcagtggatcatagaggccctttgtaacgctgtcagacatctgctcttgtattgggtcccaggttggaggtagaattaaatgagtctgggtcttacagggtctcatgaagtgcttgcagcagcagaagatctcattctactcaccatttaaggtgagcgttaactcattaagtatcaggaaaa

SEQ ID NO: 693785 - DNA, 225 bp, Homo sapiens
gggagttaactgttctgattctccagagtctatagagtgcgtggggacaggagatacaaggtacaactatgtaatcatgaatagaaccttccttggtcacaaaaatgggctgtgatcagtgtgacttcgacttacttaattcttttgtgattttcggagacagagttcactctggttacccaggctgaagtgcaagggtgtgatctcagctcacagcaacttcca

SEQ ID NO: 693786 - DNA, 891 bp, Homo sapiens
gtgtacatgtctttcttctttcctttaagtcaagagacttaaaggatattatctagaatatgcacctatttggatgcagtactcatggtaaaagtaaaacagctttcaggaggcagttacaaatcggagatttggtgtgactccttcgttgtgacgaatatctgtgtgattggtctttctggtgctcaaaacttttgtgactaaatttgcaaactctgtaagctctctaataggtagcccacattgtaagctacttttaactttggaatcttgtggtgataggtgtccacaatatggcatatctctagagaccttgtgtataccgtgcacagacaatttgtccttgtgattaaaatctgtgttctcttccgttgccatgtgcccctggccaagtggctcacaggggtcaccccaagggcttcttcattcccgtgtcaaccttgtaccgccacaccttcccttctttctatagtacctgggtgactttgaacacttcctaaatcctgtagaaaaagttttagacacgaatctatacatggcccatttcaagatgcgtcaaatgctgtatattcaatcgagcccttccctatttaagggctacctttctggggagctgcccaagtttgccaagaaagccagcgtggccatctgacgtgctgtggtgtcgtggcgccgtcagattcatatcgcgatacatagtggaatacggggcgttttgtgcacatcaaacccttgggcttccaaatttgctccttggcctgataagagggggcaaacagttggttcgttaaaaaaccttcgcgccagggtcatcacaccttcaggcccgggaaaataacccaaaggccgtagggcacagtgtttcgcacatacatggggtcccagtagggg

SEQ ID NO: 693787 - DNA, 271 bp, Homo sapiens
acgcgctcatctatcaagcatctctatggcaacctacagaatcttctcgactgtaaggacattggcgagccaggtatcatacgcgtcaacagggatctcaagcgttacgccgcagtgcttggtgatcttggtatcaatgtggagactaaccttggacaagccacgtaagccgcatcaagaccgagaaaaagaaatcttgctggctgcggccgccatcgagaagggccgatccaagattggtgaaactaaggtcagcatctcggccgtagct

SEQ ID NO: 693788 - DNA, 641 bp, Homo sapiens
cttaagaaaccgtgctagccgaaaaagactatttggataacttataggaaagcctagaacctcccagtagagtggggatttttttcttcttccctttctcttttggccactagttaaattagcagtcttagctctgagtctcggttgccgtgttcttatttttttggcgtgttggcaactccacatgctgctgtttttaccagggctcctctttcctctccctgctggccactttctaccagtcccttttctgtgtcctctggggggcttgagctcccactcaacgctcagtgggccttctgcgcgggcctctctggttggcggcccctgccttcccttccctgccttgggccccctcccccctttttcctcctccttcccttttcccctcgctccttttccccccccgcctcctccgtctctgtcttttctgtgtttcatcccctttcctctctagctggggcgcgcctccttcttccccctctttgctcccctctgctcctctcccccttttttcttctcctcccgcctctcgcccctcttgggctcccttttttgcgcctggcccccctcgggcgcccttcgcgccctcgcctcgctccggcccctctcgtttccctgtcttcttataaaaaaacaat

SEQ ID NO: 693789 - DNA, 335 bp, Homo sapiens
  misc_feature (193)..(193): n is a, c, g, or t
  misc_feature (251)..(251): n is a, c, g, or t
  misc_feature (330)..(330): n is a, c, g, or t
ctgcaagtgattctcctgtctcagcttcccaagtagctgggcttacaggcacataccaccatgcccagctaattttttgtgtatttttagtagacatggggtttcaccatgttggccagagtggctctccaacgttctagacctcagagtgatctaccacaccttcggcctcccaagtgtgcgtgggattacnaggaatagacgccattacgcccctggccgccgtcagctgttcttgaaacgcttcctgnggcttccttgacgggtcggagacgggccactgacgtacactgtgtgccaggagtccccccggggcagcacacatttcgngggat

SEQ ID NO: 693790 - DNA, 286 bp, Homo sapiens
acatcgtgaatgttcttactgccactgaactgtgcacttaaaaatggttcaaatggtaaatatagccaggctcaatggctcacacctgtaatcctgacacttcgggaagctgtgtgggagaatcgcttgaggcctggagttctagaacagcctgagcaacacagagaccccatctctactagaaatcttaaaaaaaaaaaattaacggggtacaggggggcatgtctatagtcctagctacttgggaggctgaggcaggaggatcacctaagcccagaagctggag

SEQ ID NO: 693791 - DNA, 1948 bp, Homo sapiens
gtccaattccctaatgtgacgggcgcccgcggaaggcgacatgggctccgctccctgggccccggtcctgctgctggcgctcgggctgcgcggcctccaggcggggggtgagtggcggcgccccccggcccattccccggtcccggccccgcctctgaggttcgcgtccccccacagcccgcagggccccggaccccggcttccaggagcgcttcttccagcagcgtctggaccacttcaacttcgagcgcttcggcaacaagaccttccctcagcgcttcctggtgtcggacaggttctgggtccggggcgaggggcccatcttcttctacactgggaacgagggcgacgtgtgggccttcgccaacaactcgggcttcgtcgcggagctggcggccgagcggggggctctactggtcttcgcggagcaccgctactacgggaagtcgctgccgttcggtgcgcagtccacgcagcgcgggcacacggagctgctgacggtggagcaggccctggccgacttcgcagagctgctccgcgcgctacgacgcgacctcggggcccaggatgcccccgccatcgccttcggtggaaggactttgagggccagagtcccaaatgcacccagggtgtgcgggaagcgttccgacagatcaaggacttgttcctacagggagcctacgacacggtccgctgggagttcggcacctgccagccgctgtcagacgagaaggacctgacccagctcttcatgttcgcccggaatgccttcaccgtgctggccatgatggactacccctaccccactgacttcctgggtcccctccctgccaaccccgtcaaggtgggctgtgatcggctgctgagtgaggcccagaggatcacggggctgcgagcactggcagggctggtctacaacgcctcgggctccgagcactgctacgacatctaccggctctaccacagctgtgctgaccccactggctgcggcaccggccccgacgccagggcctgggactaccaggcctgcaccgagatcaacctgaccttcgccagcaacaatgtgaccgatatgttccccgacctgcccttcactgacgagctccgccagcggtactgcctggacacctggggcgtgtggccccggcccgactggctgctgaccagcttctgggggggtgatctcagagccgccagcaacatcatcttctccaacgggaacctggacccctgggcagggggcgggattcggaggaacctgagtgcctcagtcatcgccgtcaccatccaggggggagcgcaccacctcgacctcagagcctcccacccagaagatcctgcttccgtggttgaggcgcggaagctggaggccaccatcatcggcgagtgggtaaaggcagccaggcgtgagcagcagccagctctgcgtggggggcccagactcagcctctgagcacaggactggaggggtctcaaggctcctcatggagtgggggcttcactcaagcagctggcggcagagggaaggggctgaataaacgcctggaggcctggcaaaaaaaaaaaaaaaaaaaaaagaagaaaaacaaacacaaccacaagaaaaaaaggggggggcgacgaaagaaaaatccccgggggggggcccaaattagagcgacacccagatcgtctgtcaaaaaggggggcccacaaagagagaaggacaaaataaaaaaacgcaaagcacgcggcgcccgacgctataacaacagattagagagcgcgtgacacacacacgcgccagcacggggggcgacaatgtgagaggagagggacaacccacacaaccacgcggggggggggacaaaccacaataggggacaaaaccaacaccccaaacacgacaagttacaacgcgccccggacgggggcaaccaaaaaaacaccgaagagggacaccagggga

SEQ ID NO: 693792 - DNA, 392 bp, Homo sapiens
tattacctcgttgccctgctgaaagcacaatgggtccccagcagctgcactggacccacccgaaaaattcggccagggttccccgctcttgtcgggtcgcgtcacaaaccggccggcctgatccggaaatcatggcctcaatatgtgccggccagtgttctccgtcaggtacgcagaagcgatatcggtctatcattcaaccgtggggactaaatgctctcccttcagccaggattatccgggggcttctatctcaactgaaaacccatagataacttccttcgtatataaaataacctttggcaaaacccagaaaaaacaacaacaaaaactcccacgtttcttatcattattcataccacgacgccccacgatagccttgctcccccaaa

SEQ ID NO: 693793 - DNA, 1933 bp, Homo sapiens
gtccaattccctaatgtgacgggcgcccgcggaaggcgacatgggctccgctccctgggccccggtcctgctgctggcgctcgggctgcgcggcctccaggcgggggcccgcagggccccggaccccggcttccaggagcgcttcttccagcagcgtctggaccacttcaacttcgagcgcttcggcaacaagaccttccctcagcgcttcctggtgtcggacaggttctgggtccggggcgaggggcccatcttcttctacactgggaacgagggcgacgtgtgggccttcgccaacaactcgggcttcgtcgcggagctggcggccgagcggggggctctactggtcttcgcggagcaccgctactacgggaagtcgctgccgttcggtgcgcagtccacgcagcgcgggcacacggagctgctgacggtggagcaggccctggccgacttcgcagagctgctccgcgcgctacgacgcgacctcggggcccaggatgcccccgccatcgccttcggtggaagttatggggggatgctcagtgcctacctgaggatgaagtatccccacctggtggcgggggcgctggcggccagcgcgcccgttctagctgtggcaggcctcggcgactccaaccagttcttccgggacgtcacggcagcctacgacacggtccgctgggagttcggcacctgccagccgctgtcagacgagaaggacctgacccagctcttcatgttcgcccggaatgccttcaccgtgctggccatgatggactacccctaccccactgacttcctgggtcccctccctgccaaccccgtcaaggtgggctgtgatcggctgctgagtgaggcccagaggatcacggggctgcgagcactggcagggctggtctacaacgcctcgggctccgagcactgctacgacatctaccggctctaccacagctgtgctgaccccactggctgcggcaccggccccgacgccagggcctgggactaccaggcctgcaccgagatcaacctgaccttcgccagcaacaatgtgaccgatatgttccccgacctgcccttcactgacgagctccgccagcggtactgcctggacacctggggcgtgtggccccggcccgactggctgctgaccagcttctgggggggtgatctcagagccgccagcaacatcatcttctccaacgggaacctggacccctgggcagggggcgggattcggaggaacctgagtgcctcagtcatcgccgtcaccatccaggggggagcgcaccacctcgacctcagagcctcccacccagaagatcctgcttccgtggttgaggcgcggaagctggaggccaccatcatcggcgagtgggtaaaggcagccaggcgtgagcagcagccagctctgcgtggggggcccagactcagcctctgagcacaggactggaggggtctcaaggctcctcatggagtgggggcttcactcaagcagctggcggcagagggaaggggctgaataaacgcctggaggcctggcaaaaaaaaaaaaaaaaaaaaaagaagaaaaacaaacacaaccacaagaaaaaaaggggggggcgacgaaagaaaaatccccgggggggggcccaaattagagcgacacccagatcgtctgtcaaaaaggggggcccacaaagagagaaggacaaaataaaaaaacgcaaagcacgcggcgcccgacgctataacaacagattagagagcgcgtgacacacacacgcgccagcacggggggcgacaatgtgagaggagagggacaacccacacaaccacgcggggggggggacaaaccacaataggggacaaaaccaacaccccaaacacgacaagttacaacgcgccccggacgggggcaaccaaaaaaacaccgaagagggacaccagggga

SEQ ID NO: 693794 - DNA, 1222 bp, Homo sapiens
cgagggactgcacctccactgtgtgcacactcagtctacgggacacatttcaggtatccaaggcagcagaggtgagtgggtcccccgtagactctgtgaccttatgctccacactaactctggcagagcctccgtttcctcatagaacaaagaacagccgaccatgcaagctctttcctctcgtcttgtgcctggttgcttcgtcagacccatcaggggggcctcccgttcaccggccacggcacacccgcagggacgatgaagaaagagagtctgaggaccgtcctatgtagtgtgcctacggatggcctccctagcgagcagaagggactttatccattcgaaccttcgtactagggtgtttcattgggcattcgcagcatgcgccctcgagtcgcatgaatgatctatcgtgtacgtcccactgttgtaggctagtcatcacaattgcatgactcttggcgacactagtgcttacttctcgcatgggggaggctagggggtccgcatggcactaaaagaatgctatggatgcctaggtagggggccctgtgggccgctccttaagaaccctacgcatgcacaaagaagctccgagaagggatgggacggcttgcgactaggagggacttttcaggcaagactactctttacagagaaatcgtcaactcatggccgccagaagaattggcgttccacaagctggagcgccttcggggacaataatgcgcccgttttgtctacactggacctctagtgttgggtaagaacccatgggcagagcgtagcaaccttgtacgctagattgtggccccaactgcaaaggaaacggcctgtttacccttggcgccaggaacactttttacctcccatcccaaaactttgtagtggtgaccttcctgccaacggggggcccaatggaaagcacgagccaagtgcatttactcgttgcggcgaaacgcaaaaccggaaagggggcaaacgcattgtgctggaccttggcttttaaggaaccctcggataagcaaatgccgggtcgtgatccatcggtggaacttaacatctttctttaaaaggctaaagtggggaggaccaaggctttcaagccacaaagggcaccgcaaagaagccaaagactttctaacgtgaaaccttttggcagaacctgtggggttgcgggggttaccccatttggtggagacccgggagggatccagattcc

SEQ ID NO: 693795 - DNA, 1383 bp, Homo sapiens
cttggagtcagcacggtctctttcccccaggactttgagggccagagtcccaaatgcacccagggtgtgcgggaagcgttccgacagatcaaggacttgttcctacagggagcctacgacacggtccgctgggagttcggcacctgccagccgctgtcagacgagaaggacctgacccagctcttcatgttcgcccggaatgccttcaccgtgctggccatgatggactacccctaccccactgacttcctgggtcccctccctgccaaccccgtcaaggtgggctgtgatcggctgctgagtgaggcccagaggatcacggggctgcgagcactggcagggctggtctacaacgcctcgggctccgagcactgctacgacatctaccggctctaccacagctgtgctgaccccactggctgcggcaccggccccgacgccagggcctgggactaccaggcctgcaccgagatcaacctgaccttcgccagcaacaatgtgaccgatatgttccccgacctgcccttcactgacgagctccgccagcggtactgcctggacacctggggcgtgtggccccggcccgactggctgctgaccagcttctgggggggtgatctcagagccgccagcaacatcatcttctccaacgggaacctggacccctgggcagggggcgggattcggaggaacctgagtgcctcagtcatcgccgtcaccatccaggggggagcgcaccacctcgacctcagagcctcccacccagaagatcctgcttccgtggttgaggcgcggaagctggaggccaccatcatcggcgagtgggtaaaggcagccaggcgtgagcagcagccagctctgcgtggggggcccagactcagcctctgagcacaggactggaggggtctcaaggctcctcatggagtgggggcttcactcaagcagctggcggcagagggaaggggctgaataaacgcctggaggcctggcaaaaaaaaaaaaaaaaaaaaaagaagaaaaacaaacacaaccacaagaaaaaaaggggggggcgacgaaagaaaaatccccgggggggggcccaaattagagcgacacccagatcgtctgtcaaaaaggggggcccacaaagagagaaggacaaaataaaaaaacgcaaagcacgcggcgcccgacgctataacaacagattagagagcgcgtgacacacacacgcgccagcacggggggcgacaatgtgagaggagagggacaacccacacaaccacgcggggggggggacaaaccacaataggggacaaaaccaacaccccaaacacgacaagttacaacgcgccccggacgggggcaaccaaaaaaacaccgaagagggacaccagggga

SEQ ID NO: 693796 - DNA, 815 bp, Homo sapiens
agcggagtggggatagccgcggccgtggaggtggcgtcggggactgtgtgtcctctcggaggccaggagcgagaggccgcgtctgactgaggcgaggcgagcaaggcgggcactcgcgcgacgcatgcggatcccctgcggctgtgctcccgaagccctccggcgcaggccggccgactcgaagagcggcgggagagcggcgcgaaacccagccgcgtgcacgtgcggagcagtgatgctcgtggcggctctcgggaggggcccgtgaggctgatgggcgcggacgtttcccgggaaaagtgctaggcctggagtagaacgaagcaaggggcacgtgggctcgcgtgggctcgtgctggcctggtgtgcccccaagtggcttgtacgtcttctcccagtgccatccagggcttagaagcccgttgataggccccagtggggaccaaccaaaggttggcctggtccgggcctgaacagattgggagatcgatcgccggacgtgcaaagggaagttgtccgggattgcgttacctccatggacttggcgtaaccgtgatgcggatgggcatgccgaaagaagtgttcgacggtccggttacagtggaagcgagacagttatgagcacgaggggacccaaactcccgacttgggggagcatccgagattgcgcgacgtgggttacacaggaggtgcccaaattgcgggaccaggtaccgccaaaagtgtcggagtggggatatatgagggttaccagggccaggtccatttaaccccccttgttccacacctttttaatggacacaagcccgagccac

SEQ ID NO: 693797 - DNA, 113 bp, Homo sapiens
tgattcccacaactcagttggggtataggcagtatatgaatgtatgttgcattacggtgggtggggggggtccctgagccttctcttggggccccaggcttcagtgcctgacc

SEQ ID NO: 693798 - DNA, 295 bp, Homo sapiens
aggcccatagcattcagaatgaataaaaatccacaaactgtctcatctgggcttgtggcccccacccaggagctgactaagctcaagaggacagcttctacttctatgatttcatctccgacccgaccaatcagcactcccaactcactggccccctacccaccaaattacccttaaaaattcccatcctgagttatcagaaagactgattttagcagtaataaaactttgatctcccctacagccggttttgaatgaattactctttctctatgcaattccccatcttggacaa

SEQ ID NO: 693799 - DNA, 341 bp, Homo sapiens
atggaggtataagaaccgtgggtctaagttttgtccaagaccctcacgtgtttcgtgacactccctgccaaacattgtctgatagtagaatggtcagccttcaacacaaaggagtatggtaggtaccccgtacttctatcctcccctgtcaggttaattttccccctccccatcctcccaccggatggggtgtcagtgggtcagcaggtaaaaagtcatcccggggcagattcctcttattctcataccgaaagtatttgtgatcaccggtcacgtttagtctgtcaggtcccttctttgaaaaatttgttactgcattccatggccgctataaaaatttt

SEQ ID NO: 693800 - DNA, 886 bp, Homo sapiens
gtccaattccctaatgtgacgggcgcccgcggaaggcgacatgggctccgctccctgggccccggtcctgctgctggcgctcgggctgcgcggcctccaggcgggggcccgcagggccccggaccccggcttccaggagcgcttcttccagcagcgtctggaccacttcaacttcgagcgcttcggcaacaagaccttccctcagcgcttcctggtgtcggacaggttctgggtccggggcgaggggcccatcttcttctacactgggaacgagggcgacgtgtgggccttcgccaacaactcgggcttcgtcgcggagctggcggccgagcggggggctctactggtcttcgcggagcaccgctactacgggaagtcgctgccgttcggtgcgcagtccacgcagcgcgggcacacggagctgctgacggtggagcaggccctggccgacttcgcagagctgctccgcgcgctacgacgcgacctcggggcccaggatgcccccgccatcgccttcggtggaagttatggggggatgctcagtgcctacctgaggatgaagtatccccacctggtggcgggggcgctggcggccagcgcgcccgttctagctgtggcaggcctcggcgactccaaccagttcttccgggacgtcacggcggactttgagggccagagtcccaaatgcacccagggtgtgcgggaagcgttccgacagatcaaggacttgttcctacagggagctacgacacggcgtcgtgggagtcggcactgcagcgtgtcagagagaaggcctgaccagtcttcatgttcgccgcatgcttacgtgctgcatgagggcttccctaccatgattctggtcctccggaaccgcagggcttgacgg

SEQ ID NO: 693801 - DNA, 1336 bp, Homo sapiens
gtccaattccctaatgtgacgggcgcccgcggaaggcgacatgggctccgctccctgggccccggtcctgctgctggcgctcgggctgcgcggcctccaggcgggggcccgcagggccccggaccccggcttccaggagcgcttcttccagcagcgtctggaccacttcaacttcgagcgcttcggcaacaagaccttccctcagcgcttcctggtgtcggacaggttctgggtccggggcgaggggcccatcttcttctacactgggaacgagggcgacgtgtgggccttcgccaacaactcgggcttcgtcgcggagctggcggccgagcggggggctctactggtcttcgcggagcaccgctactacgggaagtcgctgccgttcggtgcgcagtccacgcagcgcgggcacacggagctgctgacggtggagcaggccctggccgacttcgcagagctgctccgcgcgctacgacgcgacctcggggcccaggatgcccccgccatcgccttcggtggaaagcctacgacacggtccgctgggagttcggcacctgccagccgctgtcagacgagaaggacctgacccagctcttcatgttcgcccggaatgccttcaccgtgctggccatgatggactacccctaccccactgacttcctgggtcccctccctgccaaccccgtcaaggtgggctgtgatcggctgctgagtgaggcccagaggatcacggggctgcgagcactggcagggctggtctacaacgcctcgggctccgagcactgctacgacatctaccggctctaccacagctgtgctgaccccactggctgcggcaccggccccgacgccagggcctgggactaccaggcctgcaccgagatcaacctgaccttcgccagcaacaatgtgaccgatatgttccccgacctgcccttcactgacgagctccgccagcgatctcagagccgccagcaacatcatcttctccaacgggaacctggacccctgggcagggggcgggattcggaggaacctgagtgcctcagtcatcgccgtcaccatccaggggggagcgcaccacctcgacctcagagcctcccacccagaagatcctgcttccgtggttgaggcgcggaagctggaggccaccatcatcggcgagtgggtaaaggcagccaggcgtgagcagcagccagctctgcgtggggggcccagactcagcctctgagcacaggactggaggggtctcaaggctcctcatggagtgggggcttcactcaagcagctggcggcagagggaaggggctgaataaacgcctggaggcctggc

SEQ ID NO: 693802 - DNA, 235 bp, Homo sapiens
gcaccccggctctaacgtgctgggattacaggcttgaaccaccatgcgtgggcccagatctttcttgaccccttctctctgtgtattctataccattgagcaacagaacacacacggagaaacagggcactcgagtcattctggagttaagaggaggtaataactagccatataggaaatggaattccattctttaatccttcctttttgggctttttctaagaggctagagcag

SEQ ID NO: 693803 - DNA, 1176 bp, Homo sapiens
gtccaattccctaatgtgacgggcgcccgcggaaggcgacatgggctccgctccctgggccccggtcctgctgctggcgctcgggctgcgcggcctccaggcgggggcccgcagggccccggaccccggcttccaggagcgcttcttccagcagcgtctggaccacttcaacttcgagcgcttcggcaacaagaccttccctcagcgcttcctggtgtcggacaggttctgggtccggggcgaggggcccatcttcttctacactgggaacgagggcgacgtgtgggccttcgccaacaactcgggcttcgtcgcggagctggcggccgagcggggggctctactggtcttcgcggagcaccgctactacgggaagtcgctgccgttcggtgcgcagtccacgcagcgcgggcacacggagctgctgacggtggagcaggccctggccgacttcgcagagctgctccgcgcgctacgacgcgacctcggggcccaggatgcccccgccatcgccttcggtggaaagcctacgacacggtccgctgggagttcggcacctgccagccgctgtcagacgagaaggacctgacccagctcttcatgttcgcccggaatgccttcaccgtgctggccatgatggactacccctaccccactgacttcctgggtcccctccctgccaaccccgtcaaggtgggctgtgatcggctgctgagtgaggcccagaggatcacggggctgcgagcactggcagggctggtctacaacgcctcgggctccgagcactgctacgacatctaccggctctaccacagctgtgctgaccccactggctgcggcaccggccccgacgccagggcctgggactaccaggcctgcaccgagatcaacctgaccttcgccagcaacaatgtgaccgatatgttccccgacctgcccttcactgacgagctccgccagcgatctcagagccgccagcaacatcatcttctccaacgggaacctggacccctgggcagggggcgggattcggaggaacctgagtgcctcagtcatcgccgtcaccatccaggggggagcgcaccacctcgacctcagagctccaccaaaaaatctgtccgggatgaggcgaaattgaggcccatatcgcatgggtaagagcacgttgccacagtt

SEQ ID NO: 693804 - DNA, 167 bp, Homo sapiens
ctgctgcctaaccagaatcatctgagaactgattgagcgagtgcattataccccagagactagtgcactcttaggataaaaggagtcattcagtcccttacttttggttggatgcagagtgtagttacaataagatgtcactcaacagatttctgtgcccatttcaa

SEQ ID NO: 693805 - DNA, 763 bp, Homo sapiens
gtccaattccctaatgtgacgggcgcccgcggaaggcgacatgggctccgctccctgggccccggtcctgctgctggcgctcgggctgcgcggcctccaggcgggggcccgcagggccccggaccccggcttccaggagcgcttcttccagcagcgtctggaccacttcaacttcgagcgcttcggcaacaagaccttccctcagcgcttcctggtgtcggagtggagacccccggccctggcccgggcgcggccgtcgcaagacgcgaaccgagcacactcggtcaatccgacacccgtcatgcagaagctcaacaacgagaaaaggataaatgggtacacagccgagaagcggaccaacaatatctgcgataacagacgaagtaacgtagaagcaaaagtggtggaacaccattcaacagaaagaaatcagaacttcgatcaacaagtgactaggaggccaccgaaaaaaccacacgacacatctcgcaggacgaccacgcaccacccacggcaaagctagacagaccgcacggcaccccaccaaaaaccacacccggcaccaaaagcgatgcctgcatgcacggcataggagcaacgccccggcaacgacgacaccgagacgcatgacacacacgccgatcacgaaaagagaccacacacgccccaagggaagcgccccgcccaaacgaaccccgcactcaaacataaagggagggatcgcccagggcgcaaacacagcagaccgacagcaaatacacac

SEQ ID NO: 693806 - DNA, 372 bp, Homo sapiens
  misc_feature (15)..(16): n is a, c, g, or t
  misc_feature (19)..(19): n is a, c, g, or t
  misc_feature (30)..(30): n is a, c, g, or t
  misc_feature (57)..(58): n is a, c, g, or t
tagagatatcgaatnntanttatttatttnttttgaggcagagtttcactcttgttnnccaggctggagtgcaatggtgcaatctcagttcactacgacctctgtctcccaggttcaagcgattctcctgcctcagcctcccaagtagttgggattacaggcacatgccaccatgcctggctgatttttgtatttttagtagagacggggtttcaccatgttggtcaggctggtctcgaactcctgctctcaagtgatccacccgccttggcctcccaaagtactgagattacaggcgtgagccactgcgcccagcccagaatggattttctgattcttgctgtgatatttctgacatggttacatattacg

SEQ ID NO: 693807 - DNA, 359 bp, Homo sapiens
ctcccccacatattcgatcgcggagaacggcggagcaaagaactcatcgttactagcaagttcgtagaatggacgcaggctggacaatgatggcatgaatgaggaggctgcaagtgtccctcccgcggtttaaactagcagagacagctactacatggatagtgtcctgcgcgacctgggcattactgatgccttcgagctgggcaaggcagacttctctgcgaatgtcccagacagacctgctctctgtccaaggtcgctgcactagtctatcgctgtgaggtcaatgaggaaggcacggaggctgcagccgccacagctgccatcatgatgatgcggtgtgccagattcgtcccccg

SEQ ID NO: 693808 - DNA, 106 bp, Homo sapiens
cgaagcgtgatagccgcacatactggtggaacttcacatcctccagctccacggatttgctttatgccgcggcccgtgtttgtcaaacgaggaccttgtccgttga

SEQ ID NO: 693809 - DNA, 348 bp, Homo sapiens
  misc_feature (25)..(25): n is a, c, g, or t
  misc_feature (27)..(27): n is a, c, g, or t
  misc_feature (34)..(34): n is a, c, g, or t
  misc_feature (269)..(269): n is a, c, g, or t
  misc_feature (290)..(290): n is a, c, g, or t
  misc_feature (334)..(334): n is a, c, g, or t
  misc_feature (346)..(346): n is a, c, g, or t
gtcgatgggtttgtgggcgcaggcnangagcgangagcggtactggggctagtcctgttccctggcgtctgggcctttctgctctccgcaagagcttgggtcgcgacctgtcactgccagccgtgcgctcgccctctgcgccccgtctcgtggtcactgccgccctccctcccgccacacctgtgatgatcgctatggagccgcgcctcaggtggcattactataaacctaagaggagaggcgcccgttcgaataagggcaaattattnagtattttgtcttcaatgttnctgggcagcttaaagtaccaactgggacacttgtcactagtttngagaagtgcagnca

SEQ ID NO: 693810 - DNA, 284 bp, Homo sapiens
gatctgacgctttctcctccaggatctgtaagtcccaaaaacgcttaagtttcacagctgcgagttgtgtcactgaagccgtggctgaaatctagatccctgagtgtgacggcgggcccaaagggccccaagcaggtagatcccatgctgatgctcttgtatcctggccctctcagcgtgtagatggagagtaattgccggtgctaagactgatacaagtttcaccccaaacaactgtagcctacgtctgcacggacttgcaagtcgcaggctggggagcgcca

SEQ ID NO: 693811 - DNA, 461 bp, Homo sapiens
agtactcagcttacggaatcttgcatctggattaatgttaattactagaaaatcagaaatgtcatctccaaaaaatgtgaagagggttgtaaaaactaatcactttatttgatattatagttgtagatatggaatatcttttcatgacacacactcacaaagcaaacatgccactcaacatcattggtcatagcaataggccagaaggaaaacaaattctgtgatcacacttgtctctattaataccaagacgaaattctagtccaagcttcaatacgcttcctgtttattcactcagatcatttcttttactgctgctctctcattcatttccacatttcatattagaggattggtcacagccttaacaactatcattagacaggagcaaatccagtatccactgattacttctcaaaggcactctaacccatcaaataagaccgaaaattacatttctc

SEQ ID NO: 693812 - DNA, 208 bp, Homo sapiens
  misc_feature (179)..(179): n is a, c, g, or t
  misc_feature (189)..(189): n is a, c, g, or t
tcaggttcacacaggtcaaactgacgctcagactcttggcacataatgtctggtagactgctgtgtgggtggcagtggctgtcactgtgctcggaatcatgattttgggactggtctgcctcctcaggtggaggagaaggaaaggtcagcagcggactaaagccacaaccccagccagngaacccttcnaaaacacagaagagctgtg

SEQ ID NO: 693813 - DNA, 149 bp, Homo sapiens
  misc_feature (104)..(104): n is a, c, g, or t
atgggtgctcatcccccaatgatgaggtgattacggaagtccaggagttttacaaggaccactacaaaaatgctgaaaaccaaggattgagccccaagggaaanacgctgaaaggcattcaattatgcgtttgaacttgcttgtggttt

SEQ ID NO: 693814 - DNA, 876 bp, Homo sapiens
ggacttaagatggcggcgtttgcacggagtgaaatcactgcgtccttacgggggttgcaaggcgtccgaagtatgagtccactaacaaaagtccagaaactcgccagtaatagtatgtgtgtctcttcaaaatatcgggagaataatttcttcctcgcggatcgccataatttcatacggacgaagctgggaagttgcagaagatggagttcgctctgtgtggcccagcgtgcaatgcaatggtatgaccttttggtttcatgaacctctgcctccccgagttcaagtggttctcctgcctcagcctcccgagtagctgagattacaggtatgcgctaccaggccgggtaattggtattaagtagagaggggtttctccatgtgtgggtcagactggtctgtaggagaaatagattcactaaaatattacagccaattagtaaaaataagacagtaaatagtaacacctgtgtcctggagtgatagtagccagtatggtaccatatatcctgacaatgtttaatttcaacaaacaaaaataatgtggagataaagagaagtaagaacactgtgaccttatggggaagaagaactgcaaacatctcaattgaggcatagatgggtaactaagcagacaaattattcaatggcatataaatatttaaaagaatagagggaccaatcctagggggagatatattccacatattggccgtgagattactacgggagcattttgaagaccttggactgggtgtagctaacagcatactcctgagtgacacaagttggggaacactggttgggaagttgataccttaacaaaaggagtcgtcaggacggactatgtgtgtgtgagacaaaaaagcctgctgg

SEQ ID NO: 693815 - DNA, 128 bp, Homo sapiens
cggcacagtaaaaccacatatgcctttctatcaaactgcccagatcctgcatgggcctgctgctttagtgggatctgttggtaaacacaggcaactgcatttttcataacctatgatgtattatccag

SEQ ID NO: 693816 - DNA, 345 bp, Homo sapiens
cagtccaaggtcacacggcagtgcactccgttggacaatgtccaacagaaggaggggcctcgaggttcatgctggcaggtccagcaagtcaccgacgtaatgacgattgctcgacgacaagcacccatgcaaccaacccgtggaagacaagcgcagccgcgaacaggtacggcagaacggcacgctctcgttagcgatcaccccgaagtagcctttgcccggcacttcgtagcgcaccgccgtcgcgtccacaggagcgttggcttgcaggtattcgtgatgctcgccgatcaggctgagtagctgctgcagactgacaaattgctgcagaaacgcgttggagtc

SEQ ID NO: 693817 - DNA, 814 bp, Homo sapiens
  misc_feature (814)..(814): n is a, c, g, or t
ggcagtctgtctgagggcggccgaagtggtggctcatttaagatgaggcttctgggtggttctcctaatgtgcggcggtctttggcagagtgtctctctgcgacgcatgatggcgtctgccggccaaacttcgtggtgcgggtgtcgccccacgaccaacgactgatttacagactgattgcaagtactgccagctgtgggcccttgttttgcatcaaaggtttcgcacgaattttgttggtttccttggaggggtttaatacgggccggggggtggtatggagggacggtaaccattgctgcgcgtttcaattaacgccatgctgtgtaccccatggaacattcctgcattttgacaatggcgacgatgaacactttacctcctccccttcaaagcagaataatattaacgaacaaccagttaaggcagtactttttcacgttgtccagctcttttacaaaatcttaaggtaatttacacttaacggggccttttaaacattaacaggtttagggcttgtggggacaaaacagtgggggaaagttttcgccactttttatattattgggccattatatagcttattatgtgggacgacaattttggcacaaaatgtggttttcccattaaagagccaatttcttgggagacaatggttggggtgggggccaaaatggggaaggaaaagtaagaggcggttataattgggcattgtttattgagtatgcgtgattcagttaattatggaaggccaaacacatttgcatttggaggaaatccaaggttggtattgttcagacatggtttgcaatn

SEQ ID NO: 693818 - DNA, 637 bp, Homo sapiens
tgcattggctcacgcctgttatctcagcattttgggaggccaaggcaggtggatcacaaggtcaggagtttgagaccagcctggccaacatagtgaaaccctgtctctactaaaaatacaaaaattagccaggcgtggtggcgcacacctctagtcccagctactcgggaggctgaagcaggagaatcacttgaacctgggaggcagaggttgtggtgagctgagattgcaccactgcacttcagcctgggcaacacagcgagactccatctcaaacaaacaaacaaaaatacataggccgggtgcattggctcacgcctgttatctcagcattttgggaggccaaggcaggtggatcacaaggtcaggagtttgagaccagcctggccaacatagtgaaaccctgtctctactaaaaatacattagccaggcgtggtggcgcacgcctgtaatcccaactgctcaggaggctgaggcaggagaatcgctagaacccagtaggcggaggctgctggtgtgctgagatcgtgccattgcactccagcctgtgtaacaagagtgcccataaccaggagaatgtttaacctggaagtgaaggtgcagtgagcccgagcccaccattaaccccttggcagc

SEQ ID NO: 693819 - DNA, 181 bp, Homo sapiens
tgtcagaggatcccggaaacgacatagaggcggacatgtctatgtctgattacgagtcctaaatggtctctacctcttctcatatcccactttatgtcttggtctggagacagattccttcatctgttttgggggttctgtgacccagtacagatttgtaacatggtttttctttacagtt

SEQ ID NO: 693820 - DNA, 145 bp, Homo sapiens
  misc_feature (131)..(131): n is a, c, g, or t
ggtacttatggcagtgtcccccccgtgaagttcattttaacaagcatttcataagtagcttctgagtcaggagaactgccacgtttgtgaaatccctgcggttcccgcttttcctgacatgaggagaccanccttgtgacttgtc

SEQ ID NO: 693821 - DNA, 118 bp, Homo sapiens
  misc_feature (55)..(55): n is a, c, g, or t
  misc_feature (73)..(73): n is a, c, g, or t
caactacctgactggtccattccaccccagacaaacctgacatgactgaactacntcatgtgttactttcccnaaaataaagtttaaaaaaaaaaggaactcatgataaatgcagatc

SEQ ID NO: 693822 - DNA, 218 bp, Homo sapiens
ccacgtttaatcacaagatcccaagcccggtccattcaactaacaaccagctctttgcaccctggagggcgaatgagctggggcaagggcagcagcggagggtcacgagccacgccctcagacgcagcatcagaagctgctcgcccagctaatagtactttgaatcgcatctcagcccttcaacaagcgggacccacagaaagcacaagataatagaa

SEQ ID NO: 693823 - DNA, 1028 bp, Homo sapiens
cgtgacttcgttgggcaggagtaccgtcctctgtcaagacacaccaacatttctttaatttatggaccctctatccaagaggatagccagctgaccgtgctagacatctgactggtctactgtcgaagacatcaacgtgttgtgggatggatcgtattcattcttcagaggacagacacaggccaatggggacagagtggcgaccggttgtgtgtccaggtccaatggcccctaggtatcagatgcctgtggatattattagatcatttgcccataagaaggatgtgaacatggctctatgatctctgagtgtgacctttgagcaggtcccgatggatagaaagaccagtcctggctctcggagtctacaactcgcaaagcgttcaaacaagtaaggaacccagcaaccccattctaaagctcatagcaccgctgacggggacgtcgacgaatgcgacctctatccacgggaccagtgtcgctcgaacactcctgcatacgaacacggacacatggcaatctctatagcgaaactaacacgacaatagaggacaggacgcgaccacgcgaccaaggcagaatcgacaacggacaatatcaggcaaagtcccaatcttggactatcgaggcacatttcctagcccaacgaggcatagactgcgagtgccaagcagcctttcacaagcactgcggaggtccctggaaaacagttcgcgcagtaatcccagtgcacgtcgccgatggcagcgttcacgacctgtgcgcattttggctttcgagagatctacttcagagaacaacggggctaccgcaatggaatttaattacgacgcggcagaccggaaacctgcagcgggcctgtcagtgttcaccgaagcagccaaggtaacgccacgcggtttcacgggcagatctattctgtgaaagtcgtcgccacgcgcgacaactggcggggaacacggacacgatgcgacaaacgggggacaacctgacacgcactgcttcgcctgctgcggtgaatatggtcc

SEQ ID NO: 693824 - DNA, 128 bp, Homo sapiens
cactccaccgccgccgccgccgccgccgctgccgctgccgctgccgcacctccgtagctgactcggtactctctgaagatggcagaagctcaccaagctgtggcctttcagttcacggtcactccgga

SEQ ID NO: 693825 - DNA, 645 bp, Homo sapiens
tcctgagttccacattattctttttttttagatggagtcttgctctgtcacccaggctggagttgcagtggcgcgatctcggctcactgataagctccgccacactagggttacacagccatgtctcctgactcagactcccgagtagctgggactacaggtgctgggctttctgccacttgaatacctgtttcttatcgacccgtgtgtggtctgtgtcttatagagtacttgggcgtcactaaaatggtcatctgagtgccagtactcgcgattggattatctgacgaagtaaagaacctatgagaagaccttgtgcgcgaattatcgcccccatcgacgtgaaaaatggctggggttgaagagcttggattagaattatgcgcttgccaccccactgttatcggtccttacaattgcgtccaccaacacacacgaaggaaggcgaggatcgacaccaggggaagaggataattggccaacatgggttgcacgcagcgttccgtggcagaagacccgctccaatacgcggacgggacaggactcaatatcacgctgccaaaggatttgggagggtatggcgaaacgcgtgcgccagacggcctggcacaagaaaggcacagccttgagccggaagtagtagag

SEQ ID NO: 693826 - DNA, 256 bp, Homo sapiens
  misc_feature (183)..(183): n is a, c, g, or t
  misc_feature (220)..(220): n is a, c, g, or t
  misc_feature (241)..(241): n is a, c, g, or t
gacatgatgggctaggctgccgctactttaatactgttagaggccctcaaaatcacaaactatgctcaactcactctctacatttctcataacttccaaaatctattttcttcctcatacctgacgcatatactttctgctccccggctccttcagctgtactctcactttcttaagtcccanaattaccattgttcctggcctggacttcaatctggcntcccacattattcctgatacnacacctgagctccac

SEQ ID NO: 693827 - DNA, 1021 bp, Homo sapiens
ggcagaggtttcactgagccaatattgcgccactgcactccagcctgggtggcagagccagactccctctccaaaaaaaaaaaaaaaaaaaagacttaattacgggcagcagtcagtttcacccagccgggtttggttgaggattaaaccccaaggggctcccctgtgggcattcttgggcccccttcacgcctttcagtgctctctcctcaactacttgaacgccttgggcttaattgcaggacccaattgagatcctcccggaagggggattgccacaaccattggggcccccttgtgtgacccgtggagaggtgtcaccctcttctcaggaattgccacaaccattggggccccccttgttgaccccttggagagttgttccccttcttgttcggggaaatgtgccacaatccttccttcgtgccgggagaccaggtcgtggaagcccaaagtgcctagtggggcttattggcagcttgcctgcgggtgcctcagtgcaggccgtggttcaccggccaacccttcctcctttggtccgtggctccgaagccccgaggagcgccttccgcccactgggggttcctggtggccattgagaggagtccctgctgcgtgtcaggaacagaagaccttcgttgcccgtgaggaccaagcacttttgccaccaaccggtcaacttcagcccgtgggcgttagccgggacaggaggagaagcagttgatgcggaatgggttaccgcggggaacaacaaggcccttcagaagacttgagcttcttctgggcccactgtggaaacctcgaaaccacgaagctccttgcgagaagtggggccctggaaattgaggggtccctgggaactccctaatgggagaatccggggagcatgggatgcggaaccttgcgaaagcgaaacttgaggggctgtgccaaggcagctccagggggtacacggcctgggcttaagaccctccttgtcccgtctaaagggcgataagagtgtcaaatctcagaacagaag

SEQ ID NO: 693828 - DNA, 936 bp, Homo sapiens
agcgggcttccgctcgcgccagcgcgccgccgccggcacagccgccagccgcttcgcgttcggcgggggaggagttggaggcggagcaagcaaggcggtggtggcagggtggaggttcgagcgctgttctcgcatccggagccgcctgcaacattctcggacatcttactagcggcattgtcccatgagtgctgacattacacctcacctgaccatgcacaatctcaatacattcctagctggagagcctcggctccaccacgatggaccgcctggcgccagtactactggtcgaccacgataacgaccgtgggacacctacggacgccccaagccgagcccacatttgggacaccgacacgacattccttcggctccccggtgcctaggtccctggggtccacgaaaaaaccctaagactaagagcacgcggcgataattccaccgcacgcaccactcttaccctaggggcccacgggcaaccgcactaagttcggggcacagggcaacgggaaccactttgccgttctactttggtcccacggtactgtctcaatagaatcccaacgtggcttcatttgcaccccccacggaacccgattggtcacccccgggcaaagggccctcttagtgcttccgacgggccctgtcgggtcgcctttggcacccttaagttgcacatacggcctgggttcgtggcgcaaaacccctacctccaaccttggcacgttggggttttgcccccatccataatggtgcaacgatgacgagagtctgccggcagttgccgaagcgggcttttgccccaacgcatccccccctcatctagggggaacgttctcgaaacggggtgtttgcgcacctttgtcccgttgctcccatctgttttaaacagcctcccaacgctcctatgtcagcaaccccccatttaacctt

SEQ ID NO: 693829 - DNA, 156 bp, Homo sapiens
acctccctgcagcttaatccttggacttggcttgaaaatatggggtgagaatcgtaataaaaggatattgaagacttatcccgtgctcactatgctcattacccattcatggattaatggtttaatggattagggggttatcatgggagaggagga

SEQ ID NO: 693830 - DNA, 293 bp, Homo sapiens
acttgggttttttttttggggggttttaaagggccttatttgcaaacaactttttttttccctccgggactgtgaaggggtaaaaaaaggggccccgttaactaaaaggcccggggggcttggttttttggtttataaaaaatttgaaagcccccctgcccttccttttttttacccccccctccggtgaaagattttttttttgaaagggccagcccggggactgaaaaaagggttggcccttttggggggcccgattttttagataaaataaatattttttcttttggcca

SEQ ID NO: 693831 - DNA, 279 bp, Homo sapiens
ctcgtggactcgtacagcgctaagctcgatgattttactgagtagctaaataaatgctagctttatacagtctacgaaaaaataaccttgtcacagagctgcatcagtattctcacgcagcacggatcataatcttctaatagctatctctcaaaatatctctcggacatgaacatagcaatactaccaatcatactcatcattataatcataatggtatagcaataaactaggaatagccccctttcacttctgagtcccagaggttacccaaggcaa

SEQ ID NO: 693832 - DNA, 824 bp, Homo sapiens
  misc_feature (1)..(1): n is a, c, g, or t
  misc_feature (61)..(61): n is a, c, g, or t
  misc_feature (69)..(69): n is a, c, g, or t
  misc_feature (82)..(82): n is a, c, g, or t
  misc_feature (120)..(120): n is a, c, g, or t
  misc_feature (137)..(137): n is a, c, g, or t
  misc_feature (152)..(152): n is a, c, g, or t
  misc_feature (159)..(159): n is a, c, g, or t
  misc_feature (183)..(183): n is a, c, g, or t
  misc_feature (189)..(189): n is a, c, g, or t
  misc_feature (195)..(195): n is a, c, g, or t
  misc_feature (221)..(221): n is a, c, g, or t
  misc_feature (224)..(226): n is a, c, g, or t
  misc_feature (228)..(229): n is a, c, g, or t
  misc_feature (232)..(233): n is a, c, g, or t
  misc_feature (266)..(266): n is a, c, g, or t
  misc_feature (269)..(269): n is a, c, g, or t
  misc_feature (276)..(277): n is a, c, g, or t
  misc_feature (280)..(282): n is a, c, g, or t
  misc_feature (285)..(286): n is a, c, g, or t
  misc_feature (290)..(290): n is a, c, g, or t
  misc_feature (339)..(339): n is a, c, g, or t
  misc_feature (369)..(369): n is a, c, g, or t
  misc_feature (379)..(379): n is a, c, g, or t
  misc_feature (385)..(385): n is a, c, g, or t
  misc_feature (394)..(395): n is a, c, g, or t
  misc_feature (427)..(427): n is a, c, g, or t
  misc_feature (445)..(445): n is a, c, g, or t
  misc_feature (448)..(448): n is a, c, g, or t
  misc_feature (453)..(453): n is a, c, g, or t
  misc_feature (472)..(472): n is a, c, g, or t
  misc_feature (474)..(477): n is a, c, g, or t
  misc_feature (685)..(685): n is a, c, g, or t
  misc_feature (688)..(688): n is a, c, g, or t
  misc_feature (745)..(745): n is a, c, g, or t
  misc_feature (815)..(815): n is a, c, g, or t
ntggcatatgcattacacacccatcaactctcagctgtgtcttaataatgttgtacgagangccaaaanaagaaggatttgnaacaatgctcctggagtacctccaccaatatctttaancacagtgactttcaggnggcttctcgccaggngcatgcnggggggtgtcaatgcctccctttnctgggngggtcnggagggggtcggggggggggggggcnggnnngnnggnnttggggcgcctggtcactgtgcgctcactcagnggngggtccnnatnnnttnngggngagagtgggaatggctgggaagggattctgtgttcacgggttgtgaganaatattgttaagatggcaataccatctgangtgatctacnggttcngtgcgatanngtcggggtcccagaggggtttttgcggagacngagggactcattctgagntcntacgngggttcggagggtctggcngnnnnaacggtcttgggagagagcattggggagctcacatttttcagtttcacagcctactacaaatctacagtcatcaagagagtgtggtactggcataagaccaacagacttttagaccaatacaatagaacagatttgagatcctacaaattagtcctcacatatatggtcaatgactgttcaacaaggtggccaagtctagtcaagggnggnaagaacagtctcttcaacagctggatgtcagtgcacaggagagaaattagacccctnccttgcagtatatacaaaaattaattctaaattaataaaagacttaaatgtaagggctaaaatatgtaantcttaggag

SEQ ID NO: 693833 - DNA, 880 bp, Homo sapiens
cactaaagattctagtagtcactcgcagtgcccaagaattatcaaagtacctgagactaggcaactttaatatgactagcttgacacacagtagctttgatagtgaaagatagcctcgtttaggtgagctccacgtgtatgatcatctcgcataaagcctgatgtctgaaagccccgatcgctgggtcaagtagtacttgcctgacagatactcttgaaacgtaggcggctatggtataatacgcctcacactcattctaaacccccgtgatcaagagcacatagtcgtaccatttccttggactatcccctatgaggcatatttataacctaggctccgatcgtgcctacggatagacaggagctaaagatgagctcatggcatatctcttacatagtcagccagtatagctcctcggtatggaaccagcgatgctgatccaaacttccgctgaagcttggaccgggcgcagtcgattcttcatgaatcgcccacggacttacctactcctcgatgtattaattctgcctagaaagtcgaatctaggaatcgcatgcacagtcagcattcatggatcgtctctcaagggagttccagaacttctagctcccagtagataagcttttcgattgaacttgctagcaaggccttggggttagagcgtcgtccattgaccccgccattgattaaacctacgtgggacgaaagttctgcgtgtaggctacgtagcccacaggttcgccctggttcaaaatatccattcctcctgacttgcgggattcaacataatgagtcacaggccttttaatcccttctacttgtttccacagaccatggggtccatcaacccccgttagaataaagcgcatacaggggaaa

SEQ ID NO: 693834 - DNA, 176 bp, Homo sapiens
tggttagagctcatgcaactgcctgatgatgtcccgtgaagaccccaatggattccagtggctgctcttcttgagccagacaaggtgctgaaggcatttgtcctgccttatcttgagtgtatagatgtagcagaggtagacctcagtctgaggatcttcatccagactctagaggc

SEQ ID NO: 693835 - DNA, 883 bp, Homo sapiens
gaggctccgcttcgcgctatcgcttgcgatggttgaattcccctcctcacgccagcctaggagaagaagttcgtagtcccagtaggtacgaggagttgttccgcattgtcaagtagtaggttgcacggtcatgtcttcaattccgtctagtttgtggatgatggaattgagcttaaatcgaactactattggaatgtgaactctgtcctgtcacagaagtcatatgtcccaatctgatgagcaaatatgcttgccatcttggttgccagaatcagctgccatgtcgctgaactgtagacaagaacaacttatgtccctgatgccaatattgcacctactctttcctctaactctggtgaggtcattcttggagtgacatgatggactccgtgacagagcttcataacctctgtcatggacttttgatcttcaagtccgatgactggaaaaactagttgatattccagtctaagccggacatccagtacgcaccacatttggagcaggagcctacatattctgagagaatcttctctaagcataatgtcctagtctgcagatgatgagcattcacgagcgcacgggacatttcttgaagcatggagaacgtgatggcgtttttaaagatgcctctctcttgactctgggtggatttttgactacgactctttgtccatctcggatgatcggctataggctgttggatttgtagtgcaactgtttgctaccagctcgtgggagccagtatgttcccctctgagaagctgagtatctatggtgaccttgaagttcattgacatgagcaaaggctaaaagatatccagttctccctggagcgtaagtctaactgaaatcatgacaggcggcctctactacaagtatc

SEQ ID NO: 693836 - DNA, 455 bp, Homo sapiens
cagtgctaatctcagcataacattttgtatttgtcaggccgagcgaggtggctgatgcctgtatcccagcacattgggaagttgagggaagcagatcacttgaggtcaggagttcaagaccagcctggccaagatggtaaaaccctacctctactaaaaatacaaaaattagccaggcatgggggtgcacacctgttatcccagctacttgggaggccaaggcaggagactcgcttgaacctgggaggcagaggtcgcagtcagctgagcctgggcaacacagactccatctcaaaaaataaaaaaaaagtttgaaaaaattttttttgtatctgttcaactggcttttttttttgggggggggggtactgggtattcaggttataaatacaagtgaacaccggaaacactttacaaccagtattcaaatgacaggccctgtttggactctgggg

SEQ ID NO: 693837 - DNA, 184 bp, Homo sapiens
tgattgcattgtctaaccatacaggcatggaatataataaaactctaaaaagaaatgatacatccagccatgaaaatgaaatagatggaaataaaaatagcatatatgctaatgtagaaatgaatgccaatcttagaaaatgctacctaacagtatagatatacatataatatagacacatgtg

SEQ ID NO: 693838 - DNA, 350 bp, Homo sapiens
gcgagtatgtctgtaccgaatacatgaaaggtgataaagccatctggtgtagagggaaggggacaagtgtacgcccctaactcatttggctcatcttcttccaataagtggcatcaacatacaatgaggcattaattgatccactttggtggacttcaggggctcctagactcaggtacagagatacgtgctactagggccctgttttttactgttgttctccactaaatgtgctccagttagagcaacaggatgttgggggaatgaagggaaagagttggtatcaatggagtgggagaggtgaggagatcacaagaggaatttggagcccagggtcagccctctcatcc

SEQ ID NO: 693839 - DNA, 878 bp, Homo sapiens
aaaagtgtaattccaggtaaagagaacaaaaacaaaacttaaacggaaacagggaccacagtatggggtgctaccagactgctccaccttcctgggcatcttcgtggccatgatcctcttcccctttgggttcatttgctgatctgacttgaggaagcgacgcatgccccaacgtgcggagccaccttcgctaagagggaacaccaggcccggctgtcctacacccagctgtcttttcctaatgtaaatgttcgtgtacaataattatatttttttaagcttgaggacgtgtatagcaaagccaggagcgaccgatgtggaccacgccagctgcgggtacccggagcgtggagaggcagtgctgctgctcccgcccaaagctcatgacacctcaataaagcactgcttatattgtcgggcaaacctaaatctgagaaacgctgaaaataagcgttccaacaaatgagagtcataccatgggtaaaaataatccaaaggctggcctcggtgggcctcacgcggtggaactatgacgccgcttcactcaagcgagggtaaattctggatactgcgctcaataactccaatggccacgtatgagcggtgcctccaagcggcccacgcccactcaagggcagcaatacctgtatccctcaaaatcaggggatgacccaacgaaaaaacatgtaccaaaaccgcaagaaacgcccagaaacccgaatagggccccgtccttggccgaccttacatgggcccggccccctgccgagcatcacgaaattggagctcaaagcaacggtgtcaaatcccacgggacttcttaataccaggcggtcccccgtgaaacccctctgtcgcccacaacaccaaccagcctt

SEQ ID NO: 693840 - DNA, 464 bp, Homo sapiens
cctagaggaccccgactagtccaaccataccattctggctaacttaagctcgtgaaattcacactaagccactgagcgtcatcttgtaaaaagttgcattagaagattttcagctgttccaaatgggacttgtaagtggaatgtgttgtacaggatcatatcagatgaatgaaaggtatatggtccttcgtttccttaataataaaatgatggttggggcagaataggctagagtctaaacacagagctattatgaggctttattgttacacacgaggtctaagcctaagtatgtcaatacaacacatacttactgtttcattactagtaatgaaaagaaagagcaggtcttagtggcataaggatgatttaaatctggttattgggcaacattgtggcctgataaatttacatctactaagaacatttctataggtatggtagggacctagacggagaaccga

SEQ ID NO: 693841 - DNA, 472 bp, Homo sapiens
ccagagctcttgagcgcactttcgccatctcagtcacagatccagacctccggagcccactttcccgatctcatcaccagtgatgacttgggatgagatgtcggaaggagggatgagatgttggaaggagctatgagatgttggaaggtgccatgagatgttggaaggggcaatgagatgttggaagggggcatgagatgttggaaggcggtatgagatgttggaaggagagatgagatgttggaaggagagatgagatgttggaaggaggcatgagatgttggaaggagtgatgagatgttggaaggagagatgagatgttggaaggagcaatgagatgttggaagggggcatgagatgttggaaggagcgatgagatgtgggaagggggcatgagatgtaggaaggagcgatgagatgttggaaggagggatgagatgttggaaggggagatgagatgttggaaagaggc

SEQ ID NO: 693842 - DNA, 469 bp, Homo sapiens
gacaccagttggcgctccgaggcaacctttcagttcactgtggagcgcttcagcagactgagtgagtcggtccttagccctccgtgttttgtgcgaaatctgccatggaagattatggtgatgccacgcttttatccagacagaccacaccaaaaaagcgtaggattctttctccagtgcaatgctgaatctgattccacgtaagacagtttaaatgatgcaactacaaacccccacatcgttgtatttcattactggaagccaaatttgatcagcctagtgcaattttatcttaagttatttgctgcctctacatagccttttgattttaaattagattaaatacgtgtttctctttaaaacccactggtatatgtataatatccaagctagaaaagtatatttttatcttgtaagtgaaaaaactaaaaatagtttgttagaatctccagcatcccccctcaaacct

SEQ ID NO: 693843 - DNA, 110 bp, Homo sapiens
aggcacacaccatcagccgcagggcgtctttgcattgtagtagtcaagggtggccaggtgcattttcatcggcacatgggcaggtgcatacctcagggggcttgttcgca

SEQ ID NO: 693844 - DNA, 699 bp, Homo sapiens
gaaccatggcgcttgtcccctgcacaggtgctgcggatggcaatcctgctgtcctactgctctatcctgtgtaactacaaggccatcgaaatgccctcacaccagagctacggagttagctggccaattcctgacgtacacttgatctggtatatccaggctgtctttccagggcatctgtgtagctgactgatcttatccagtcttctgcactcgaggaagtgggaaccaaggagcaagagcaggcagctcacgaagctcatctcctcatccgaggacctggcactgctacgcatgtgtgcggccatctcccttgtcggggcggtaccccacgttgtaagccacgctgtccatggatcactcaatgtctactcgacagaggaccacctgatataccccgaaagccttcgctggcacctacaattatcactcccacgcgcccgccctgacaaatccaccgcacattgcacactgacggcggctactgcccatatatagtacaaatcccgagcatgcacgcgacactgccaaccactcagccaatccccccagcacacgtccctcagccgcacactttaccgtgcacaacgtcacctctccgtctgatgggcaactactactaatcggcctggatcatgcgaggccctaaatggtacactggcacctgctcgctggcaccccatttaccagggaacaaca

SEQ ID NO: 693845 - DNA, 147 bp, Homo sapiens
tgatatgtgaaacttgagattactggatccatcatgatagactgaagctgaaacccattgataagtctccagaacccaaaccccatcatgactgatactccaattcctcgcaactctcaagatatcacaccagattgacaactccat

SEQ ID NO: 693846 - DNA, 1331 bp, Homo sapiens
  misc_feature (446)..(446): n is a, c, g, or t
  misc_feature (525)..(525): n is a, c, g, or t
  misc_feature (528)..(528): n is a, c, g, or t
agcgggatctcaggtagcattcagattaccctgcctgctctgtgcttgtgctgtcagtaccgatttcgaccaggaacgtgtgcagcgtcagcccagaccacagagactggaacttcttgtcatcgacgacacggggagaggcagtggcagtctgagacgtttgctgagcaaagctgaccgtgaacgctcagagcttgctcgcttaggagagagcatcatggagtgcgcaagacataagggggcaattgcgacttggtgcagccaaagcacgcgtcgggcgtcaccaaggtgtacttgtcgcgtggccgatctagcgactatcatttatcctagaacacgcaattcgaataggcgacgaatgcctgttgtcatgattggggtctccattagttgcgattggaagcttgcgaagtccgacggaaccattcgagactggtctcatgagngagaacgcgttgactcgagacgcagtggggatggggtacatggtgatactatcgagtacatcgtgacaggatacaatgnttntactccaccatcctcgcagtgtaaaggtcccgtgatcctttgggaagagttccagtcgtgcttgcattgcatggtaggacaaggagtacttttcagtcttaaaaatgccaagtgtgggcatgactccaatgagtttgtaagggtggggggttgtggtagctaggactacgcacttttgggcaatcaccattcacaaactttgtttctttgaaatttgggtaatagatggattacgagggcagggacgaaggagtagagagaaatttggtttgttaggaagtttgtaagtggttcttaggacaaaggaaaacggggatgctctcagcgctttgctccccagatcccacttgaggtgaacggttggatattccttttgggcaggatccacggcaacatgatccccattatagataagggcggtgaggtattatgtgaggcgaacagtggttaaaaatccctaaggttctagaggcggaaaaacatctttttgtgataatcatcactaacgcacctaccgaacacttcccacatttttcacatcggcgggcgggacaccactttctcgtttttatccctgaggcgtaggaaaaaccaagtacacaaggggaaactaggtaacacctactgggacagcattccgtaaattgcgttttaggaatgccaaaggataggtgtatttcctttccaatacacattggcgtgcagagttcccacccagcggggaacgttgtgcgaaaaagaccaaatttccaagggccaattggagcgcctttggggtgccctttgggggagacacaattggg

SEQ ID NO: 693847 - DNA, 1044 bp, Homo sapiens
gattgccaagggcaaacagccctcttgacaatctctcagcggccatgacgaatgctgggagcagcttatctacagtccctcgccaagcactcttcatggccgctgagagattgccaagggcaaacagccctcttgacataaaacctgtggatcagccgacactatgtccctttactgacaggagggactctaattccaaggacaagctggctaggctctgcgggggcccaggagtcagccagcatccctgaagtgaggcgggcccgtctgtgcgagcctggtccttcccaggcctgcctgttttatgatgcaggtgttaggaccagatcagatctcgtgcctcagtcacagcctggaatcacaatggaggcttggtgacagtgtggggcgcctggagctgctacagggcagggatccaggtggagagtgggatccagacctaaggtagccaagccttcaaggacctgggccgtgggtctgcgtgtgtcaatcacagggacccgggacagagtgaggactcagctcggtctttccacagagagccaacaacatctctactgtggaatgccaggctgctcctggtaaggggccctatagccacggccatctgcatgagctgccccagagaagggaccgtcccttgagctgggctccagtccctcttctgagatgagggaaacgttggtttgaaaactggggtggggcggaaggcctcgcgaagggacgatgtaacccgcttgttccctttcccatggggtcctttattggccggaaacccgtaaaccaaacattgttgccctccaggggcaggctgatgacaaagggcccccgctttggtaccccaatatggaaacccgcccagggtttgaaagccacgtttaacaagccggagttccctgacaggggggaacggcacacaagggggcacggttctagcaaatcagcaacgatagacagaaacacacacaagcggccgccatcccgacaaaagcgttcaaagcgcgacctcacacacgacacgacttgcagtaccacgggaaagac

SEQ ID NO: 693848 - DNA, 358 bp, Homo sapiens
gcacattggcttaggcatttgaggcagagccacagacccaggaatggaaaccaggagtcctgactcccaggccactagccttcactcagtgggtgcaaggcagagagccaggcctggtggtttatggaggccatgggctagagaagcctcaagggaatagaaaaaaccctgtgctatctgaggttgtgcagctcaccccatagaaaagggacatttttaggttttaaaaggatgacctcattttatccttatatacatagccctgtttgtttatatagccctttaaaaaatagcaagtgtgtgctaagcttaatgctcactgcctaagagagacataggactataatggctgctgaga

SEQ ID NO: 693849 - DNA, 238 bp, Homo sapiens
attctgagagatttccttcccccatcccccctttttttgaacaaaaaaaaaaaaaaaaacaaaaacccttttatacaaaactttcacacacaaaaacaaaatagtgtaataaacccaattttctctaaaacccattttaaacagctacacaaaatgttcaccctttctggtttaattccattctcccctctctttgtgtttggaaagtgctcagagattacgggaatccctcttaaag

SEQ ID NO: 693850 - DNA, 960 bp, Homo sapiens
  misc_feature (941)..(941): n is a, c, g, or t
gtgccagatgattgagggcgtcggtgtgtattgacatcatcaagcactgagatggtcatggagccatcgttccataatgcccaggggttccatagctgaatgcgcaactgtatgggagagccctcaggacagccctggagatgttgaccgcatggagacaactgaacatgaatgcgatgtctggataactgcacaacacgtgttgctccgtgcttcttgattgccggtatcatgatcttttcgtgatgataataaaagctggttggttccgagagaagttcctttgtcttggttcatattaagccgggcgtgtacccgaaactttcgaggtcgattgtgaggtaattatctcttccttaaattaacttatatagagcctagtgagactgtctaaattgctgttccagttctatgcaaaagtctcttattttatctgtctggaatatttggatcgagggcaaagtgatactcctgtgcttaagaaatatggggcagtactttaatttctgaattgattcagtgctggaacagatgggttgacctggtatactctctggcggctaaactttgggattgtcattgtaactgtggttggcacaccatttggatgggaattaattaaggggatagtaattaatggacgaaaattcttgtcggttttaatgggttctataagcgatggtgccatgtccattttccgtattgaacaataaaaggaaatttcacattttttgaagtgggtttacacccctagatttgttttggggtccttagattccctaggtgggatatttttggggagacgacgccattttcaccatattccggttatgttcgcatgaataggttggatcccaaatttaattcctttttgaaccagttatgtgacggataggattgggaaccatttatagggttccataattgcggatttacgatanttgccaattttagtccatt

SEQ ID NO: 693851 - DNA, 1373 bp, Homo sapiens
agtactcaaacaactttatttcactagccaggagcaaaaaggtggaccggcttccaggggatttttccactcctgggccctcttcccggtcgtggtgtggcctcccagtgagttgggaaataacctcagtgtttccactgtggcaggtgccgtggctttgggtgcacccacagtggtttgggcctgtgggtctcccaggtgaaaatgtgggtccttcacctgtgggcgtggggaacatgtgggttcgtgaagaggccccttggactctgtgccctgggggaccatgtggtggtggccagtggcttaggggcccgtgcccacctttcacaggtgggagtgtgggccaaccttcgtgcccagagggtgtgcgagggaagcgtccttagccgtagtgggagaaaatctctttcaagggaagaggtgaagctttctcccacccaacctctccaaatacccaacaattctcctcagaaaaacagaggaggttaacgagggggaacacccaaagaagtctctaagaaaagaccacgagggggctgtgggtaaagcggtggcctataacgaggccaaaattcgtgggggaaccattatacgcggagaaaggagggcgaggggaacacagcaaaagagttaactcccaggaaagaggggagacaagaaactggtgggggccgcggcacagtggaacaatagggcaccacagcacgaaagaacccggaaataaaggggggcggggaaaaactccagagaaaaccacccagaaaggagccccaccaggttagcgccattcacaggggagcaccacccaaacacctggggggctcctgggccaccaccaggggcgaaggttcataaaggggtgcccccgtgaaattccccgtggaaccctaaaaccctggaagggagatggagaaatcccggagggtaaaaaacccgaagggcacacggcatggcgcacaaagggggcccgaaccaggggccaacaaaaggtcggagaaagggcaaaaggaccacggaagggcgagacgtgagaaggggggttcggcacacagaaaactcgggagaggggagggaggggcgcccaaaacgggtgttatgcccccacattgttctccagcctacgcgaagtgggcgctccaaaagggcccccgggggaaaacacaatatcggggggggttgccccaccctcctttgatagaaagccacgagaaaggcctccctaacagagggagcaagaaaccgggcgttactgggtaagacgaggccacaaaaaaaggggaaggcccacccgacgaggtggaaacgagcggcagagcaactgtagccgacctgagacaaaaggcgggtagcaaacacaatcacaccagaggagg

SEQ ID NO: 693852 - DNA, 643 bp, Homo sapiens
aggatgagaggtctgcagtgagctatgatggcgccactgtagctctggcctgggcaagtagcataagacctcctctctaaaagagaaatgataaaaggccaggtacagtggctcatggctgtagtcccagcactttcggaggccggggtggttggattgcttgaggccaggagttcaagaccagcctgaccaacatggcgaaacctgtctctactaaatatacaaaaattatatttgtttaattacataccacggatgtggtggcccgtgcagacgtcccaactaaatggtagtctgagggcaaggggagcaaggcctgggtacagaaaagccttgaaaagcataaaaagaggccgggcgcggtggctcacgcctgtggtcccggcactttgggaggccgaggcgggcagatcatgaggtcgggagattgagaccatcctggctaacacggtgaaaccccgtctccgctaaaggtacaaaaaattggccgggcgtggtggcgggtgcctgtggccccagctactcgggatgctgaggcgggagaatagcgtgaacctggaaggcgagcttgcagtgagccgagatcgcgcactggactccagctgggtgacagagcggactcgtctcaaggaaaacaaaaaac

SEQ ID NO: 693853 - DNA, 416 bp, Homo sapiens
tccatgaataggttatacctctagtctccgactgccacagcatgggcatgttcagcacaattgatccgccacctgcaactagaatcaatagtatagatattagtttcagacggcttgtgcaactaggctcagtaatatgtatccacatcgccaatgatgactctttagaacgtttaagaggcatgtttagagggctccacttcctcaaagttcgcagaaccgtcacttacagcttgtccccaaaaatcttcttcccccacagatttctctcccacaatttcggtctcttggtacaccctgcgggcgaggttcagtcaggtgctctctctggagttgagcttatgattctcctaaactgtggagacatctcggtcagcgtacaagagcttgaacatcgctactcggcaagacatatg

SEQ ID NO: 693854 - DNA, 400 bp, Homo sapiens
gaccttggtcgacccagtgtgggtcgtgaagtgaaaccacccgggcgtccatcattgtcagtcacaaagttgagcacacagaagaatcaaccaactacatccagacatcaatcagtaaaaggcagagcttggatctcaatcaggcgacatggctcagatatcagttttagttactacactctactgtcaaagatgtgtaaccactttgacaattgcatgccacatttcaagctatgaagaatcaaagacaagtctttcacaagatctctcatatctaatgggtcctcactatcacgattaaattccaggctgatgacactgtaaggccacatggccagctgtgctggaggcctggtcaaggtcagagcctgggtttgcagagaagcagacaaacaggcaa

SEQ ID NO: 693855 - DNA, 530 bp, Homo sapiens
acctgctgtactaatgctgtctctaacacttcacgttatctaacatctatgcggatctactagaatttgtgtatgcattgatcagtattgttgatgattcatcaaaaacttcatcatagcatgggattgtatctatgaaagggaagttggtgtcctgcgtacctcaaaaaataatccaaaggataaaatgaaaagtatgtgagaaacctgctttaattataatgtgctatgtataagcattattgttttactctatgacaagcaacagctctgtcctaggtccaaattagaaaaacacatattgatatttcattcagaatctcattaattggaagctagatctgattagctagagagaatgtgacagatttactccttatctcccagtctgcatatagtgaagctcactaatagattaatggatgatattaatagcagtgatctcagatgacaatgctaaaactgactcctgggcatcccctcacatcctgctgtcatacattcactaatgagcaacgccagctgaagtg

SEQ ID NO: 693856 - DNA, 565 bp, Homo sapiens
cacaagtcaaggcacaggttcaatcatcacgcaggctagtgaccttcagtatacctgcctgcttctagctgtgtcttgaatgactgtgtagtggttccaagggaattaagggaggaaggggtgacagatgaaagccatctatgacctctatggcaaaacaactcataacctatagagcacaggtcagtagtggcgccttttaaggaaaatcagcacatggagcttatgccaccaggaagagtcatgtgcttataaactggatcatggtaaattttcattgaaagtatgcattggtactaatgctaagaatggatgcaaagccagtcaacgaagcagcagaaaaggtgacagtctcatgttggccatggggtactctctgcgtcatgctagaaagagtttatggtcccacctgcatccatgagaaagagaaaacaaagcttcaattttaagtccttggaaattccatgccattaagaaactgctactgccagctttctggcgttattcaaaggggtaaaaagttcattacactagtgttcttataagtgtggattatttcatatta

SEQ ID NO: 693857 - DNA, 1593 bp, Homo sapiens
  misc_feature (9)..(9): n is a, c, g, or t
  misc_feature (170)..(170): n is a, c, g, or t
  misc_feature (201)..(201): n is a, c, g, or t
  misc_feature (219)..(219): n is a, c, g, or t
  misc_feature (229)..(229): n is a, c, g, or t
  misc_feature (279)..(279): n is a, c, g, or t
  misc_feature (292)..(292): n is a, c, g, or t
  misc_feature (295)..(295): n is a, c, g, or t
  misc_feature (544)..(544): n is a, c, g, or t
  misc_feature (552)..(552): n is a, c, g, or t
  misc_feature (1015)..(1015): n is a, c, g, or t
  misc_feature (1020)..(1020): n is a, c, g, or t
  misc_feature (1023)..(1023): n is a, c, g, or t
  misc_feature (1046)..(1046): n is a, c, g, or t
  misc_feature (1153)..(1153): n is a, c, g, or t
cagacaaantctaccacagtttgagccaaggcgacactcggggctctggccatccccaatttgtcccccatcaataaccaaggacaactgaggccagagatcctgaactcctcgacattcagagaactggcctgggagctgaggttggcactagtgagagcaagcgaccntcaaacatctgagccaagtcttgcataaaanatgatcagaatccgaatnctacaagagngtaaaaggtttagtccttgttgatctcctccgagcgttccatcaccaggntcactgttccttncantagttctttcaggagcccctcaggtactctcacacggcagtatctgtagacgtcggccacgcggccgaggcatacggccagaggcttggcctcgctgtgacccttgaggcggtacacagcgcgcagatccgccgagcagttctccgcccaggccaggccgtacagcgtatcggtggggacggccaccacggcgccggcgcgcagctcggccacggcggccctcagcgcctcggtccagccggcgcgctncgggctcncggcctgcacggccccgctccccgggagccgcaacagccgggcgccgggggccgccggagcgggactcggcgggcggaagaggcgaccgctccgggagccagcaggcccctcgctcaaccccacgctggcagccaccgcggccctcatccccctgcaccgacgcgccggagacatccgcccaggcccgcttccgggaggaagtgacgctcccagccagcttccggtccaggagactcggccccgcctctgcgccgggcagcttaaagggaccacgacccccaggaggattgaaggagaccgggaggctgccggcgtggaccgcgggaaggcggggctggggctcggcgggaggccacccccacagccgccccgggaggagcgcgcccagcagctgctggacgcggtggagcagcggcagcggcagctcctggacaccatcgcagcctgcgaggagatgttacnggcangcntgggccgccggcgcccggagccnggctggtggcgggaacgtctcagccaaacctggagcgcccccccagccggctgtctccgccagaggcggctttccaaaggatgctggcgatggagctgcggagcccntgaccatccccgagcagaataccctgacttctctccctccccagtgaccggtggctggacttctgaacaagttcccttcagtaagaaggggccaggtcttcacttggcagtggctggtaccttggctctcagccttgagtggcagctctgcgtagcagcttgggttcactcccacttcatccttgcttgaaagcaggtgctgtgctttggaaatgcagccaattgaatacccagtctgattacccagaatttgggcagaccagcaagtgctcgccagagttggtctggcctgctatgggggatccaggtggtgttacatgtccatttcgtgtatcggggggcctttaggccccacaaagacacctttcggatagagcccttggattaccgagtgagacctgagacgtctcaagtagcgtctgtcacgtcgtaaacagggc

SEQ ID NO: 693858 - DNA, 354 bp, Homo sapiens
ggctctgcggggcggtgctagtgctcgcccgcccgaccccggcggctcgcgcccgggagcgccgtagggtcgctggagtcggccgcgtcctttgtgtggcgctcaggctgcgccgcggagcggggggacggaatgtgggcgctgcgggggcttttctctcctacccgaactgtgggaacaatggactgaccgggggaagatggattgagggggccgagcggggaagcgagctgcaccggggaatcatgacttctgcagccgttcaggagcatcccaggaggaacagaatgatcttggtctgggtgacctttccctctgatgaggaggacatcatcaacagtgctgatgaagatg

SEQ ID NO: 693859 - DNA, 440 bp, Homo sapiens
  misc_feature (17)..(17): n is a, c, g, or t
tgaacagccttcagccntagaccttccctctgacagagcctacccaaatgaacaaaccctggtaatatgacaaaacaagacgcttcaacaccccccaaaaaacatactagttcactggcaatggatccaaaccaagaagaaatacctgatttacctgaaaaagaattcaggaggttagttattaatcagggaaggaccagagaaaggtgaagcccaatgtaaggaaatccaaaaaatgatacaagaagtgaagggagaaatcactcagggaaatagatagcttaaagaaaaaacaatcaaaaattcaggaaactttggacacatttttagaaatgcaaaatgctctggaaagtctcagcaatagaattcaacaagtagaataaagaaattcagagctcgaagacaaggtcttcaaattaacccaatccaacaaagacaaa

SEQ ID NO: 693860 - DNA, 867 bp, Homo sapiens
  misc_feature (21)..(22): n is a, c, g, or t
  misc_feature (46)..(46): n is a, c, g, or t
  misc_feature (50)..(50): n is a, c, g, or t
  misc_feature (95)..(95): n is a, c, g, or t
  misc_feature (289)..(289): n is a, c, g, or t
  misc_feature (294)..(294): n is a, c, g, or t
  misc_feature (297)..(297): n is a, c, g, or t
  misc_feature (320)..(320): n is a, c, g, or t
  misc_feature (427)..(427): n is a, c, g, or t
tggggcgtgggcgcagccttnngaagccctaacgcagcgctggggngggnggcggccgaaaggggggcggtggtcgggccgcgcaagcggagatngaatggggcccgggctcagactggtcacggggggaggctgccggcgtggaccgcgggaaggcggggctggggctcggcgggaggccacccccacagccgccccgggaggagcgcgcccagcagctgctggacgcggtggagcagcggcagcggcagctcctggacaccatcgcagcctgcgaggagatgttacnggcangcntgggccgccggcgcccggagccnggctggtggcgggaacgtctcagccaaacctggagcgcccccccagccggctgtctccgccagaggcggctttccaaaggatgctggcgatggagctgcggagcccntgaccatccccgagcagaataccctgacttctctccctccccagtgaccggtggctggacttctgaacaagttcccttcagtaagaaggggccaggtcttcacttggcagtggctggtaccttggctctcagccttgagtggcagctctgcgtagcagcttgggttcactcccacttcatccttgcttgaaagcaggtgctgtgctttggaaatgcagccaattgaatacccagtctgattacccagaatttgggcagaccagcaagtgctcgccagagttggtctggcctgctatgggggatccaggtggtgttacatgtccatttcgtgtatcggggggcctttaggccccacaaagacacctttcggatagagcccttggattaccgagtgagacctgagacgtctcaagtagcgtctgtcacgtcgtaaacagggc

SEQ ID NO: 693861 - DNA, 104 bp, Homo sapiens
cacgaaggacttatgacccatgtgtactctgcaatatctttaactgggtcatggcttctttgttggatcccttcccactatattagaagactcagatgcttcag

SEQ ID NO: 693862 - DNA, 318 bp, Homo sapiens
cacaatgttgtgtttatttctatttcatctaatcttcattgttgtctctcaatgatacagtactccataaatgagtgagaaacgtttcatcaacatgtatgtacatgttcagaaacagctcggtttcaaaaagctgtcagctcaggtagcacgccttggtcttgaattcggtgctacgctgactgctctccttctgaaagcaaaggcaccagtccatgatcaagtccacgccgcataccaggagagaggagtcttctctccaaagtcatcccaagatagttgaggaaataattctatctaatttctgtgcccatttca

SEQ ID NO: 693863 - DNA, 812 bp, Homo sapiens
  misc_feature (179)..(179): n is a, c, g, or t
  misc_feature (220)..(220): n is a, c, g, or t
  misc_feature (224)..(224): n is a, c, g, or t
  misc_feature (263)..(263): n is a, c, g, or t
  misc_feature (318)..(319): n is a, c, g, or t
  misc_feature (325)..(325): n is a, c, g, or t
  misc_feature (334)..(334): n is a, c, g, or t
  misc_feature (337)..(337): n is a, c, g, or t
  misc_feature (340)..(340): n is a, c, g, or t
  misc_feature (350)..(351): n is a, c, g, or t
  misc_feature (359)..(359): n is a, c, g, or t
  misc_feature (369)..(369): n is a, c, g, or t
  misc_feature (373)..(373): n is a, c, g, or t
  misc_feature (383)..(383): n is a, c, g, or t
  misc_feature (398)..(398): n is a, c, g, or t
  misc_feature (406)..(406): n is a, c, g, or t
  misc_feature (415)..(416): n is a, c, g, or t
  misc_feature (425)..(425): n is a, c, g, or t
  misc_feature (427)..(427): n is a, c, g, or t
  misc_feature (495)..(495): n is a, c, g, or t
  misc_feature (543)..(543): n is a, c, g, or t
  misc_feature (549)..(549): n is a, c, g, or t
  misc_feature (661)..(663): n is a, c, g, or t
  misc_feature (667)..(668): n is a, c, g, or t
  misc_feature (677)..(677): n is a, c, g, or t
  misc_feature (679)..(679): n is a, c, g, or t
  misc_feature (681)..(682): n is a, c, g, or t
  misc_feature (684)..(684): n is a, c, g, or t
  misc_feature (695)..(695): n is a, c, g, or t
  misc_feature (697)..(697): n is a, c, g, or t
gctccacttaactcgcgccgccgcggcagctcgagtccaccagcagcgccgtccgcttgaccgagatgctgcgggcctgtcagttatcgggtgtgaccgccgccgcccagagttgtctctgtgggaagtttgtcctccgtccattgcgaccatgccgcagatactctacttcaggcagntctgggttgactactggcaaaattgctggagctggcctttngttngttggtggaggtattggtggcactatcctatatgccaantgggattcccatttccgggaaagtgtagagaaaaccataccttactcagacaaanntcttcngacatggtnctnggncctgcagctnnataatgtnccattgccanaganctcgattcantcgggtccactaaanatctctantgtatcagnngtactgacnanactctaaacagcctgcctcacaactccaaaaacacacagggagatactccagcttcagcaacagcacntacagaagcggctcaaattatctctgcagcaggtgataccctgtcggncccagnccctgcagttcagcctgaggaatctttcacaaactgatcaccctgaaatgggtgaccggaacacccacacctgcactttcagcaagaagcatcctcatctttctataagggnnngcgnncacctgcanancnntngcagctcgccntntgcacaaccaggacaacactacgcacccaccgtaaaatggcagtcctctagcccaatagcttcagaagcatgctctgaggcaaactggcaagtcgcccctctgcagggtatcggc

SEQ ID NO: 693864 - DNA, 132 bp, Homo sapiens
gcatttgacggatgtttgagtctggaaggtcaagcgctgagctgtgatcacaccactgcactccagtctgactgaatgagaccctgtctcaaaaaaaaagagaaagaaaaagaaagatgatgtaattttccc

SEQ ID NO: 693865 - DNA, 197 bp, Homo sapiens
aaaaattgggcccggggatttttaacgggctttccccccgggaaatttaattttccccttttttttccgggccaggcgggccccccccggccccagttttgttcgggccccttcaggtattcccctttccccttccacccccgggggcggccccaagccccaggggaaaaaaagttttataattttggggggggcca

SEQ ID NO: 693866 - DNA, 1399 bp, Homo sapiens
tagatcgcgagcggccgccctatttattttttttggtcttatttctgcccatctgtctacctacatacacactgtgacacataaaactaccgtgtatggctaccttcaaaaacaaaaaaaaaacaaaaaaacaaaaacaaaacacaacacacaaaacaaacaaacaacaaaaacaaaaaacacacaccaaacacacaaaccaacaaaaacaacagcacaggggccgggcacgacgaacacccacccgagaggagcagacaacacagataccgacacgcaccaccacgagcgagagcaaccaggcggcggccaccacacagaagagaacacaaaacaagcaacgcaccgagaagcaacggcggcacgcccacaaaccacgcgcacacgaccactcgggcggcagacacacaccgcaaccagatcgaggcatctctacagcgaagaacaaaacaaaaacagaaacacaatcaagagcgcaggaagaaaaaacaagagagacagacaacaaaaacaaacataaacaacacagaaccacaacaacaaaacataaactacaaacaaactaaaaaaataaacaataatataccaactacataaatcaaaaaaatataacaaataacaaaataaaatacataaataataaaactacaataaaaaataaacggccaccacaacacaaacacacgctttaatcctccgacaaattaggagacagtacgtcaactccaaccgacaactctgcagcaagtggacacacgcggcgcgcggcgcggagggagacacgagcgaggactcgatcggagagacacaggagagaggaaggagcgcgcgtacgcggaagcgacggcgacgaaacacagacacaagcgagaccgagcccaggcgtagccggggggtggacagaagacgaaggagatagaaagagacaagagcgagggagagaaggcagtcgaatgcgaggagagagagacagaaaaataaaagaacagagagactgacagagagaaaagacgaagcagaacgcgaagataaaaaaaagcaaaaaaaaggaagagaccgaagcaaagacaccagacgacacaaacgacacggcagcgggcgcggcagagcaaacgcaaaccaagacaaagacgaggaacgaaaaagacaagaaccaacaagcgatagaaagacacaagaacgcacgagcgagcaaaccgatgaggcggtgcacgacacagcaacccagaccaagacacagcgaaggcagacagactctcagacagaacatacgcaccgagaggcgagtgaaacgcagcgatgcggagaagaagcccagagaagaggagagagcgaagtacagataaggaaacgacaggaaacgaaagcagctcacagagcccgcgacaggaaaccgtag

SEQ ID NO: 693867 - DNA, 221 bp, Homo sapiens
cccccccccccaaaaagagaggggccgtttttggccgggggtttttttccccttttttggtaaaaaattggggggttgggtttcccccccttttgggggttggggggggagaaattttccccgggtttttaagggggcccccccccggggcttccccccccctttttttggggggttttgttaaattttttacccccccttgggggggggggtcccttcca

SEQ ID NO: 693868 - DNA, 155 bp, Homo sapiens
ggatctcccccgagtagccgacagactttgtggtccggggcgagataagggaagagggttgtatgggttcggacggaccttgctctgacctgtgagagaacgtccgtatacgcacatctgcctgtctgttgcctcgtctttcccatttcactgtg

SEQ ID NO: 693869 - DNA, 982 bp, Homo sapiens
ggtggctccttgcacagcagctgcgcgcgccggtggctccggatctcttcgtgcctttgcagcgtagcccgagtcggtcagcgcctggaggatctcgagtcgagtccatgtcgaagccgccactagtgaagaccgggactgccttcagttcagaccgcagacagactggcagcgcagtcatggctgcgacattcctgggagcacatgtgccggcctggacattgattcatcacccatcacagcccgggaacactggcatcatctgtaccattggcccagcttcccgcatccagtggcagacgttggcacggcagatggcattaagtctggacatgcaatgttggctcgtctgacacttctctcatggacactcatgagtacacatgcggtagaccaatcagaggaaactgtgctggcacagttgctagcggacacatgcgttctgccttcgtcgtagcacccgagtccttcgtacctcgggcgccagattagcttcggtggctacataggacgacttacaaggacctcttgagaatcccgtagaccctgggccctcatacacaatggtgccagcggagcacatgcacgacaggtgtgggagcctgacagggaagcgggacagcgctcatcttcgacaacagtcaccggcatgggagtacacggccctagcacatggcaccagacgtggtgaccgcagacacactcccctgcatgaccgtggggaagcttacgaacacgaaagcactccttggcaaaggggttggggtaggggacactgttggggggcacagacaaacagaattgcgtagcgggttgggaggtggcaaatggggagagcttggtatttaatacatcgcggtacccaatgggcgtggaaaattggcaaccgaagaggagggagttgtgccccgagaaactttaccccggtggagataggtaaccggtggagaggtgattgggacgagaacagaaggagtagagg

SEQ ID NO: 693870 - DNA, 377 bp, Homo sapiens
atcctagaaggataaaggacatcttggggaaagtcagtattttatatagcaaaaatatgaacctcaaactgaatcctctaacggccccatacaatgaagtagacatgggtggaaacatttacacccagtcagctatgaagagtttcaaatggaccctaccactgagaaatcaggatggcagcctactgatggggaatggaggaaaagtggataaatacaagagtcctgtgataatatgcaaccaagacagggttcttttagcatggatgccatgcagtgaatgaagacataggtatcttacccaacacaaagtggacagtggatttgcacttctaaagacttttggggtggacatttggacagtggggagaagaaag

SEQ ID NO: 693871 - DNA, 128 bp, Homo sapiens
gagggagtctcactgccacccaggctggagtgagccaagattgctccactgccctccagtcggggcaacagagcgagattctgtctcaaaacaaaagaaaaaaatgatcacccttctgtcgtcttctc

SEQ ID NO: 693872 - DNA, 191 bp, Homo sapiens
gtcgatctcttgaggatcccccatttgatgccccttgatgctgcagaggagtgaaggacaatgggggctgacaggacataacggtttcattcagtgactcggaaacaacagcagtgacttcagcagagggcaattgccaaagagaaaggtgagagaggaagctatattacgaactgctgtagaagcatatg

SEQ ID NO: 693873 - DNA, 394 bp, Homo sapiens
gggcccagcgacaaaagccaggcagccctacaaaagggtggggaggtggtccccccccccatgtaccagtttagccagtaagtgtgtcagcagacaggcctgcagataccccagctcccagcccctccaaaaattttctttcccatccgtgactcctggaatgcaggcatcatgacggtaatgtaggtttttttggtggccccctccaaggcccgcgagtactccaaggaggggtgggagtatgtgaaggggggccccaagtaacgagtcagcaggggccgcctgccccggccagaacgggcaggggtgcccctgacctgaaaactccgggctgggacccccctccgagggcagctcccggccttgccggcccaataaaggacttcaaaagtta

SEQ ID NO: 693874 - DNA, 152 bp, Homo sapiens
atcggctcgtgagaggatcccgtacatgagctaaccggcccatggactcagttagtaacaaactcctaccaacactgaccaataaaaaaaatgtgggttcttttttttttttttttttttttttatttttttttttttttttttttattttt

SEQ ID NO: 693875 - DNA, 181 bp, Homo sapiens
tatgttacagctacctcttcacagtcagcaatgctttcccgggctgttcatttttttattcctgtgtgttttatctagaaagactcaagaagaatattacagattgttcaaacaatgtcccctgtagtactaggatgtttaatggtaacacatagcagaatggtaggatacattcacaaca

SEQ ID NO: 693876 - DNA, 185 bp, Homo sapiens
aacaaattcacgttctccccaataggacggcgaactcttctgaagtaattgaagccagaaaggtcggaactgtgtgggcagcgagtgcactttggtcttgtcacctgagggttacttgtccccgtgtccagtggctgaggtagcgtgatggcagcgcagatcggcagacctgtgcggacatgcaa

SEQ ID NO: 693877 - DNA, 260 bp, Homo sapiens
tttttaaaaaaaagggggccttttttttattgggttttcccacggggtattgggaggggattttttaaaaagtggggtttttaaacaggtgtttttggaaaaaaatttttggccggggggggggggttaaaattccagtcccccccctttgggggggttaaatgggggggtccctttgggcccaaagggggggggcccagggccccaaaattgggcccccgcccccccgccggggggaaaaagggggtccccttttttta

SEQ ID NO: 693878 - DNA, 739 bp, Homo sapiens
gggagaccagcagatctggtctgtagctaagtgaattttctaagactcattgattcacacgccatcccttgtaggtggctggtgtcccgcgatggccacaggcgccctcctgtcgtgctcgcgcccgtgcccgagtgtcccggctggacttcctcaaggcctcgcacttctcgctggtggcctgaccttgcggctgcacgagtgtgcgaccgattgcgcaccgatcgctctgcaccggtgcatctttgcctatcccggtctgcctacctcgctgtggagcctgccgcatgcctgtcacgccgacctgcccgcgctgcttttcccatatggatccctgggcgctgtggaccgggaatgagcgcgtgtcggaatcgcgcaccgtggcgtttccctgggcgtccatccatcagccgccgtgtgatgctgcttgcaagcgcaggctctgggaactgcagcgctcagccatgcatggcccggtaatctgccccgtgctcgaggacgcgcacgccgggactcggcctctccaagcgtcgcactgccgcctacggctgttgcgccgagctgcctggcgcgcacctcgagagcggatccgcggcggcgcgctcatcatcttcgactcgcgaggtccctgacctcctggtcgaccgcgtactaagttgctgcgatcccgctcataccttacgctccaagctgctctttccagcccattgaggcgcgcccgtatacatcgcgcggccca

SEQ ID NO: 693879 - DNA, 301 bp, Homo sapiens
  misc_feature (103)..(103): n is a, c, g, or t
  misc_feature (105)..(105): n is a, c, g, or t
tgtttttccaggcccggggttgttggggaaaaaggcaaaggcagctggagccccgttttttcctgctgggaccccgcttgggctttggtattgaatgagtggntnacagttattttccaaccccaactggcttgggggcaggacaagggttaggtttaatggtggccaggcttgcctgctccccccctgggatgcccctgttttggccctttcattttttttcattggtttatttttcaaagcatttttaatttgtaaaaaaataaaataaattaaaatgtaaccattaccctcattttta

SEQ ID NO: 693880 - DNA, 334 bp, Homo sapiens
cttatacctgtaattttttcactttggaaggccgaggcgggtgggggagccaaggtcaggagcttgagaccagcctcgcaaacgtggcaaaaccccatctctacaaaatacaaaaattagctgagcatggtggcaggtgcctgtagtcccagctactccggaggctgaggcaggagaattgcttgaacccaggaggtggaggttgcagtgagttgagattgtcccactgcactccagcctgtgtgacagagtgagactgtctcaaaaacacaacaaaacacatgaatgtaaaacatttagtgaagtgactggtagctagtgagggttcattaag

SEQ ID NO: 693881 - DNA, 186 bp, Homo sapiens
cgtctcttagaactggaaaggttttgttaaccacaagtccaggtgctcagtatagtaatttatagtctatgcttctatgttttgctgaaaatatgactctttatcactctttaaaaattatatgtacgtgtgaccaagcatggtggctcacacctgtaatcccagcactttgagaagctgaggcgg

SEQ ID NO: 693882 - DNA, 160 bp, Homo sapiens
ttactcacacaatcacacaaggctcagaacttatcacgcactgagttactcgggaagctctagaaacgtctacatcgccggtgcttacagcactcgagcaatatagctcagggacgccagcacagctaagggttctctggggcgcttccaagcacgagac

SEQ ID NO: 693883 - DNA, 464 bp, Homo sapiens
ttcaaaacttaatggaaaaaatgcctggcaaaacttgtttggagctttattgaaccaaaacactttagaaaccgttggggaagctcagtgaacccaggctgtggtccagccccacgctttgtctagggcaggttccgttccctcaagcaggtgatgggaatcccggactggagcctgaggctgagcagccagaggccacaccgccagggccaggccacaccaccagggccaggccacaccgccagggcaggccacaccgccggggccaggccacaccgccggggccaggccacaccaccacggcaggccacaccgccggggccaggccacaccgccacggcaggccacaccgccggggcctgcctcatcgccccacagtccggaatgctctgcacacgcatcagaaggagagtcgctgagcatcacaaaggaaaatagaaagcgcagcctcactgcccaaggcc

SEQ ID NO: 693884 - DNA, 1148 bp, Homo sapiens
agcagtggcgcatgcagcctgcgctcgctcgcggtgagggcatggctgtgggtgcctgtgccgggctgccatcatggacgaggactactacgtggagcgcggccgagatggggctgacgaggcttgactggcgtgccagcaggaggatgattctggagaaggagaggatcgatgcggaggttcatgcaagaatgcctgcctaaattttccacccggggattatatcatggaaccctcctatcttcaacactctgaagaggtatttcaaggcaggagggtctccagaagaatgttaatcccagctcttaatcttgacaagagctacacctgatgtggcccaggactgtggaacccttgctggccgagtggctcattcaggacaggtgttgaggccacgtgcatggttcaggaaactgtggaaaaatcaacttgaaggaagtttggctgagttcgcagcgttgttgagcccccgggaagaggcaggattcgtacttttgagcgtgagagagcggaagagacgccccgagcggtgggctgggacagcagcgatgaattgcggcataaccaacggttgcactgggaaccattgatggatagagcctgggccttgaacggtgcccaattcccgaggaacgtggggtataggattggctttgcgaactttccaaccgggtagaaggggtcacggggaaggaggttacctaagaaggtttcaaggggcaggaaccaaggtggttgaagttggacagttggtttcaactatcgaaggaggatggtagggggcgtggtgaagcgtacggaacagggtgtcgacaacgttgtggcagttagtgtaggatccccacataaaaacggggattctctgtcacatatgggacttgagacatcactaaccagttaaaaggcccttatagccgctcgtggacagacaacaggacaacaaagtatgggttaccacgcgcatgcttggtaatatccatgactcaaatgaaggggagctcacgacggcggattggaaccatgggtcagtttaatacgtgggcattatatacagacaagggcgacatacccaagtgtaacaatacagccatatgaggggaacagtagaagagggccagcctactagcgtgacggatcggcgcagcgct

SEQ ID NO: 693885 - DNA, 313 bp, Homo sapiens
ggcttgcttggggggttggggtgcggtcctccggtggggtgggggttctgggagggtgaatgcacgggaagggagccctttgggagcacgggttctgccggggtccctctgtgcctaactctccttcccggctcctctctttctccccttcacaggggccatgtaccaggagccttctctctacagggtccccgaggcctccccttccagtcccccggcccccggaaatgtagtcccgggacgggaggttcctggcactcccagtgagccagccaccaccacaaccggtttcccagctggctcagaggggtac

SEQ ID NO: 693886 - DNA, 238 bp, Homo sapiens
  misc_feature (218)..(218): n is a, c, g, or t
ggtatcgatgggcagtgaggcggcgcatatgcatctaggcctataaatatccggagtatacgtagccggtaatgtacacccggtcctctagaatatagctagcatgcgcaaatttaaagcgctgatatcgatcgcgcgcagatctgtcatgatgatcattgcaattggctccatatatagggccggggttataattacctcaggtcgacgtcccatgnccattcgaattcgaaatcat

SEQ ID NO: 693887 - DNA, 295 bp, Homo sapiens
  misc_feature (10)..(10): n is a, c, g, or t
cccgacgtancccacctgaaggaaagatgaaatatgccttacagccaaagattactttataatgtggttcatctcgtcttgaacaatgttgcttagaagagactgaatggggttttatttgcttttgatatccaaataatgtttgtcagttttttattgcctttataagtggaactaacattacagatcttgtggagaaaaagtcactttccttctctttgcctcgtgagcccattctaaatacgaacaaatctctatgctttcttacactttgaggaaaggaatcactctcaat

SEQ ID NO: 693888 - DNA, 235 bp, Homo sapiens
ctagaggatcccagctacccagcaccagtggattcctgacatgttcaattaaaacaaagcatcgcgaaggcccgcggtagggttgttgacagcgatgtgatttctgcccggtgctctgaatgtcatagtgaagaaattcaattgaagcgcggatcaccggcgggagtatcatatcactctcttaagcgtagcccggatgccctcttatctacatttgtgacgcgcatgatatgga

SEQ ID NO: 693889 - DNA, 205 bp, Homo sapiens
caacgagtgatgtgtagtgagatgtagtatgcaaaccacatttgattcatgttgttcacacaatttcatcttacaatctaatctacaaaacatattaacacatctattattctcttgcttcatgtcacgttactcgacacttaactctctatcaatactcaagttaccattcttctacgctttaactcaaccataacaacgacca

SEQ ID NO: 693890 - DNA, 219 bp, Homo sapiens
gagtcttccgaacaccaggtggattctgagacccattgtcatgcagaaaggtgcttcctctcttggttctgcgtacgacttactgtctcctaacacaaaggtacctacggtcacctcggtacaacatcttggacgccctgtgcccacgacttgtgcagagcgagtgtaggccgagtttcctgagccatggcacaggccaacgtagaattctcacgcatc

SEQ ID NO: 693891 - DNA, 298 bp, Homo sapiens
tccgctcagggtgggcaggtgcgcctcgccacagaaccagattggccacaggtgccaagccctcgccgtggcgctcggcgaggggcacgtagtcgatggaacgggtttccagattcagccgtccgttggcggaggcagtcttgggagctgacatggggttcgcacctttattgatattgttgtgagcacagcaaagtcgtcgcttcccgcgactaggcccgtttctcttccagggcttgatgcagcagcgcttccaggtcttcgagactgcttgggcgcggtttggtctgccgcgcct

SEQ ID NO: 693892 - DNA, 879 bp, Homo sapiens
tcccattgggtcttttcccattctcttttttcccataaacccctattttccagttggcccaattcaaaaaataagggcaaaaaggggtttggggaaaatccttgtggatgtggtgtggtggcgacgggaggaggagagagattttaggaacaaggcctgtgctctccttccaacagccctatagatggggcttagggcccctctaagtggggggcctcctgagagaacgagtgtggcgcaaaagactccaagggaaagctatgaggaaattgatagggggccccttaaacccagagtgtcacccacaaatagtgcgtcttgtgacccccttacacagtgcactagtggccgaggagatcataggatcgggggacaaagcggggtgccagcgagtggttttatgaacacagagtgctactctgtgggcaagaacatgtggcaacatcaacgccaactcttcatcatcaaacaatgccgagaaagggacacagagactccatccacaacggcggcaagaaagccacagggaaatatatatcagccaaacgcgcaacatgggtctttggcacacagggtcatcgccctggcagaagggatgttatccactcgtgatggagaaccccccccgtgagcgacaaatgtactgcgtgagaacacggaagcatgcgcccaaaggtcagagagttaaacaatgataacacagctggagggaccacgagggagaacaactccagaagcaagagaacaaagacatctataatcaacaagcgggagaagaattagatttaatggcacaccgcacttctctcgaagagcttggatcccaacacagaacaagaggagtctaaggggcggacccagggcggcgcacaactacac

SEQ ID NO: 693893 - DNA, 128 bp, Homo sapiens
  misc_feature (2)..(2): n is a, c, g, or t
cnccctccctctggcgggaggaatggggctctcttcctcccccactgtgcccgtccgcggacggggacccttccccggcccaaccccctccctattttgattggtgtctgtgactatttcctgttggg

SEQ ID NO: 693894 - DNA, 545 bp, Homo sapiens
  misc_feature (507)..(507): n is a, c, g, or t
  misc_feature (525)..(525): n is a, c, g, or t
ttcctcagaataagatgagagtaactagaattactatagtaaggaaaaaaaaaaaaaccaaaactttttaaacttattttttgacatagggtcttactgtgtcacccaggctggagtacagtggcgtgatcttggctcactggagcctgacctccctaggctcaggtgatcctcccacctcagcctaccgagtagctgagacatggtggcacaggccacatggcgggctaatttttttatttcttgtagatacagggtttcactatgttgcgcagaatagtctcgaactcctgacctcaagtgatccatccgccttggctcccagagtgctgcgattacaggcatgaaccacagcgcccagcaaaataaactttatttattttcaggtctagaccatccagatagatttactcaaatattttctggggaacctttatgggtagaacattttaatactgtttagaagacttttagggatacctatagatttccaaatgcatccatttnaaataaattaaattccanttttctctctcctaaaaaaa

SEQ ID NO: 693895 - DNA, 349 bp, Homo sapiens
ggctcggtaccggctccaggctacccagaggctgtgagggtctcgggcatggtcatggagttctggtcatagctgtgcctcgtgtcttactgagaagaccaccggggtgggacgagaggtcccggctgagttataggccacaagggccacctcctgggcttctgaaggcaggtggaaggtgcagctgagctctgtggtgttgcagaggggcaggatggccccagcctggcctgagggtctccaagaaaccacataaccttggatccgtccgctgtcttcctccaggggcactggcttccagaacagctgcactgtcctggggtccagctgcctctgccgccaccatgtg

SEQ ID NO: 693896 - DNA, 144 bp, Homo sapiens
cgtacaaactaggtagctagcgagaaagttggcagaatccaaggcaaaatgtgcaggagcttatcacagagaaaaaacaaagaataagctccatgaactaagagagagtataatgacttatagctctgaaacggaaatcacaca

SEQ ID NO: 693897 - DNA, 231 bp, Homo sapiens
acacgcacagtacacgcgacaccattcacacacagcacacacacatagcacacagcacacacacaaagacacagcacacaacactcacaacacagcacacacacgcgaacaccgcaccactacgactacacagaacacaaagcacacacacaaacacagcacacacaatgcacacagcaaaagcacacacatgcacacaaatgaacaacagcacacaagcacacacatgca

SEQ ID NO: 693898 - DNA, 100 bp, Homo sapiens
tagctggacctttcaaagcggagatctgcaacgtcttgatattgccctatagttaagttttgtaagcggaccctcagagccagcatctccgctttggaaa

SEQ ID NO: 693899 - DNA, 133 bp, Homo sapiens
tcactagatcataggctcatccatctcactgcttgtgcttctctatcttttctttttcttcttttcttacatggtgtgggatacatcacggtacgagctcgatcgtatcatgtcatactgttctgtgtgaatg

SEQ ID NO: 693900 - DNA, 188 bp, Homo sapiens
ggcagacgtccagcatgttgcaacatcaaactccatggctcaagcatcctcccacctgaccttcccaaatagctgggactataggtgtgcaacacaatgcctggcttatatttgctgggctttcttaagttattctttattctttggtagaaaacgcggtctcacatatatttccataggctgaatct

SEQ ID NO: 693901 - DNA, 758 bp, Homo sapiens
  misc_feature (324)..(324): n is a, c, g, or t
  misc_feature (366)..(366): n is a, c, g, or t
  misc_feature (368)..(368): n is a, c, g, or t
  misc_feature (370)..(370): n is a, c, g, or t
  misc_feature (380)..(380): n is a, c, g, or t
  misc_feature (426)..(426): n is a, c, g, or t
cttctgtaagtattcaggagtaacacagtgtgggctgcacctaccggacggtccatcggctagcaaggcaggctcaggttgcaggctttccgcaggagccgcctttgcgtagcacaagttcgacatggacacagatgcacgtatgttcttcactgacataggggacttaaaccccaactcgtggcctcttaagcgtaagctttatgttcttccatctattcgacttgctgctccttctctctttccccctccagctacaggcctgagagtctgagaaatcatcacctgaatagacatgtgtgtgtccatcatctcgattcccanccccaacttaatattaaattaacaggcaagccggcccccacntntncctgggggtntcagggagaacctttcacggcaccctttccctaccttttccttctntaatctcctggtttaccattgatgacttcgcctctgcatctactgacttgatttttcattctgccactccatcttcaaaccccctaccgtttcccatcctactcctgccatgcattgaagggtcaatgcattttggggtgagctctgggtttaggggccccctccatccctcagctatcctggatctttgcccacctcttcctcagagccacccactgaggggcacgtagccctatctagggctagtggaaggagcagactcgcttcctaactctctccctcctcctgcccacacacatcaaaagaatcttccctacacccttctcggctta

SEQ ID NO: 693902 - DNA, 621 bp, Homo sapiens
  misc_feature (6)..(7): n is a, c, g, or t
  misc_feature (9)..(9): n is a, c, g, or t
  misc_feature (35)..(44): n is a, c, g, or t
  misc_feature (65)..(65): n is a, c, g, or t
  misc_feature (70)..(70): n is a, c, g, or t
  misc_feature (72)..(72): n is a, c, g, or t
  misc_feature (82)..(82): n is a, c, g, or t
  misc_feature (89)..(89): n is a, c, g, or t
  misc_feature (95)..(95): n is a, c, g, or t
  misc_feature (114)..(114): n is a, c, g, or t
  misc_feature (134)..(134): n is a, c, g, or t
  misc_feature (148)..(148): n is a, c, g, or t
  misc_feature (152)..(152): n is a, c, g, or t
  misc_feature (161)..(161): n is a, c, g, or t
  misc_feature (167)..(167): n is a, c, g, or t
  misc_feature (187)..(187): n is a, c, g, or t
  misc_feature (229)..(229): n is a, c, g, or t
  misc_feature (231)..(231): n is a, c, g, or t
  misc_feature (233)..(233): n is a, c, g, or t
  misc_feature (243)..(243): n is a, c, g, or t
  misc_feature (289)..(289): n is a, c, g, or t
aagcgnnangggctgggggacgaaggggggagggnnnnnnnnnntggccatccagggacctgagnattgntnttcccgaaantcccgcngttatnaatggtgagggctccgggncttcagcctttcttgtaaangatgagaggttganaaanaatcccctnaataantttttcctctcgattcccanccccaacttaatattaaattaacaggcaagccggcccccacntntncctgggggtntcagggagaacctttcacggcaccctttccctaccttttccttctntaatctcctggtttaccattgatgacttcgcctctgcatctactgacttgatttttcattctgccactccatcttcaaaccccctaccgtttcccatcctactcctgccatgcattgaagggtcaatgcattttggggtgagctctgggtttaggggccccctccatccctcagctatcctggatctttgcccacctcttcctcagagccacccactgaggggcacgtagccctatctagggctagtggaaggagcagactcgcttcctaactctctccctcctcctgcccacacacatcaaaagaatcttccctacacccttctcggctta

SEQ ID NO: 693903 - DNA, 803 bp, Homo sapiens
tatctgcggcagctgcaggtcctggattatatttctcgattcgctgtcggaggacaatgagaccctggtggacgtttgttatctggaggcctgtgcaagctgtgcccagacatgggccaagaaggagcacatcctgcacgccaggaggtgatcccatgtcgatcatcaatcttgccttagtcctagccctcaatgcatgagacggtgcttgtcatgccgatctagcgcgagcgtctcatgcacgctgagccctggcggtgccgcagcgtttcgtcccagagtctgacccgcgatgcccgtggatgcaggtgcaatgcttacgcattactcccgtctcggactcaggcgaccaggcctccgggagaacctggccacagatcttcctgcgaggtactttctggatactcgcgccacgtcgcaggttggccgagggcccgacagggcgggcaaggcgtcaactctgaccctgggtatcccatatgccgaggagcgtggcccccccggcatcgctgactccatggaagactgcgagaccgtggcaccctactgctggggaccacagtcctgatgtggacgcagggaacggggagcacatactggcccattggtgccttttcagcccattctgacacggcgggtgtctattcagcagtgcacaggcattttacacttgcatgaaaacgccactgggagctgaggaaagccagactccagaagaccacggcaggaagatcaaactgggagcttgggtccataagggctggcactcctcaaatcctacattcagggtgcaaccacaagca

SEQ ID NO: 693904 - DNA, 481 bp, Homo sapiens
caaagcaataaaaattgggggatgacatcaattcttggtgcaggacataaaagtgggaggagaggtgagggaagaaagaaagatgagaaggacctgaaaatctgacaagagatctcttctgtggctgttgttaaacatatagtaagcattcatgaaatttggcatttgttttcttttgcagcaagctgaagaaacaaagcttagtggaaattaaacaaattaacagaagcaagtgcagatgggcatcatgctaaaaagaaagaaaaaagtaaattgccttcatttctattccatgccctctaacactctggtgctttccaatcagcaacatgagttgtgttattactggcaaagatggacactatatcctagcagaagacttttacaaggaggtaaaaatatatgaacacacttaggtaaattgacttaggccattcctttaagcaaatgtttgggtccttccagatcatggtaaaaagat

SEQ ID NO: 693905 - DNA, 391 bp, Homo sapiens
cacgagggtaccggcctcggtcaccgacccggtcgagcgctccaagcaggcgtgggtcgccttcgccgcggatgcggccggcaccggccccttcaagatgagccgcttcgtcgcgcgcgagcgcctcgaggtagtgaagaacgcccagtactgggacgcgaagcgcgtgccgaagatcgacaaggtagtgatgatgccgatgccggaggccaatgcgcgcaccgcagcgctgctgtccggccaggtggactggatcgaggcgcccgcaccggacgccatcgcgcagatcaagagccgcggcttccaggtctactcgaacgcgcagccgcatatgtggccgtggcagctgtcgttcgcgccgggctcgccctggctggacaaacgcgtgcgg

SEQ ID NO: 693906 - DNA, 386 bp, Homo sapiens
tagagtctcaagaccccgtgttccccctgtgtaaaccaattgtaagcttccaagaaggttgaattaagagggaagtggaacacagcctgggcaaaaatgggtgctgggggtaacaagcttgttaagggccaatccagaccccttacccctaagtttggcaagtgtggcaagcattgcaagcttccaaaggggttaattggtctaccatttaagtaagtggccaccattttaaaattgaaaaattaagctgggtccagtggttaaggccggaagtccaagctattgggaggcttggtgtggaaggattctcttgagcccaggagttcaaacccagtctggacaacatagtgagactgtgcctcaaaaaaaaagtgtgtgtgtgtgcg

SEQ ID NO: 693907 - DNA, 395 bp, Homo sapiens
ctcaggcagtgagagaagagaagataatccctgtcagattgtatctcaggcagtgagagagggggagataatcccggtcagattgtatttcaggcggtgagagaggggaagataatcccggtcagattgtatctcaggcagtgagagagaggaagataatcccagtcagattgtatctcagtcagtgagagaggggaagataatccctgtcagattgtatctcaggcagtgagagaagagaagataatcccagtcaggttgtatgtcaggcagtgagagaggagaatataatcccagtcagattgtatctcaggcagagagagaggggaagataatcccagtcagattgtatctcaggcagtgagagaggggtagataatcccagtcagattgta

SEQ ID NO: 693908 - DNA, 429 bp, Homo sapiens
ggcacgaggaaaaataataaatcaacaaccacaaagcgggcccgaattactgggaagacaaaaaagccaaagaactcagcctcctgaatagttgggattataggcatgcaccaccacgcacggctagttttgtatttttagtagagatgaggtttccccatgttggtcaggctggtctcgaactctcgacctcaggtgatccacctgcctcatcctccgaaagtgctgggattacaggtgtgagccaccacgcctggccagtcttttgactcttaaggccctcagccataggaagtcccaccaagggacaggatggatgggggacaggcagccacgccaccctggcaatgctatgggacaaaataaagatttgatggcctttgatgttgcctctggtaaatattggccagaagggggagaatgtaaacc

SEQ ID NO: 693909 - DNA, 1172 bp, Homo sapiens
  misc_feature (355)..(355): n is a, c, g, or t
  misc_feature (357)..(357): n is a, c, g, or t
  misc_feature (931)..(931): n is a, c, g, or t
ggttccatatctatataaggagctagaagcattatagctagtgttgattcactagtgcttacaaagttgcccccatgtgtaggggacacagaaccctttgagaaaacgttagactttaagtctgtacaaagatcttagccatttgttccgtgtcttcatgtttttgtccaggtacagttaaagtttgtcaaattatcatcttatgagggaaacctgattagatgggtcgtgtttgtgttctgatggagaaaacagaagcccaaggactcaagaagatgattttaacagttcagaacagatgtgtgcaatattggtgcatgtaataatgttgagtggcagtcaaaagtcatgattntnatcttagttcttcattactgcattgaaaaggaaaacctgtctgagaaaatgcctgacagtttaatttaaaactatggtgtaagtctttgacaagaaaagaagaaaagaatcaacacgcttctttccgatcagtaacacgtgtgcaagtctgtgccttgttatacccaagctctcccttcagggatcggtactctgagaagacgaactaatgtgtcggacccgtcttgagattcgttttaagtgtaagttccataatgagcagaggtgtacgcgaaatggtgttactgacttgatagccttgagtctaacaagaaagataggattgagcgggtttagagtgtctatttggtaaatcattccattgtgagtctttctgatgaactgtgtggtatacttgagaatgctgtgattgaagtgaggctccaagaatgagcagaagtaggccggattagagtagagtgactattaaaaaagataggtttctaggagctagtaaatcgaccgttttcagaaagatgtccggctatattgtggcggtattcgcgattcatgaaaacagaaagtggcccttgcngtactacaagggactgactgatggggaacttactgccccgggctcaactccaggggtttaatgccgacgaggcttgtcaaaagactaacgggctctcctggatatatactggacgttaaggacctgatcctcctttttccacgtggctgacacacccctggtgtgggaactttaaagcggtggaagaaaaccctaatccacaggggcccgggatactggggagaaaaatcccaaaagggtt

SEQ ID NO: 693910 - DNA, 1048 bp, Homo sapiens
tagcggcgggtcggcccgggacgctgcgggagcgcgacggggagcgcgcctggccgcgggactggcggcggcccgccggagagctggggcgccccgagaggagccccacccgggtcgctccgcaggcctgacagcctccgtccacctcctgtcctcggggaccacctccctctcatgctgagcttgctgcctaaggtggcctgctgcccatctacacctcacgagggcactagtgagcacggtttcctggatcccaccaacatacaaagcagtccactcgactgacccccattgaccaggatggcaaaggatgagatgatggaccggaactgatcagccagctgtccctcttacctaaagacttaaaccaatgcccttaatgagggggcattgggcattaagcccgtgacctttgctatgctcatacttgtgactctatgagtactttcctataagtcgtttgcttgtgttcacctgctagcaaactggagtgtttccctccccaagggggtgtcagtctttgtcgactgactctgtcatcacccttatgatgtcctgaatggaaggatccctttggcaaattctcaggaggtggacctgtagccaatgggcttggccatgcatcctgctggcaactccaaggccctgtgttggcttctggaatgagcatgctactgaatcaccaaaggcacgcccaactctctgaagatctttcctaatccttttctgggggacatgggcgtcgcatgagagcaacgtccttagggtttgcatgtgaagaaattacatgcaggatacaacgaaggctccatggcaggatctgggcataaacggcatgtgatccaggcaaacttgtcgggtgagcaaaagggtttgaccagagtacagcccttttccaaaccgcagtcttggatttggttctaagtaggagctaaatatatatactcacaacgtaaatcaacgggagaccctgtgcacggtgatctccattggattcgcaacttttttgaaaggactgtttaaacatgtatggtatccatatccacct

SEQ ID NO: 693911 - DNA, 159 bp, Homo sapiens
ctaggtgaactctttgggtgtctttgcaaagatgcgatgaagagacattgcagccctctgattactcatttgggggaagtagatcaaggctatgatgttgcctgacagtgatggttgaaggcagctgagtcctgtcatggaaaatgtaaaggccctccc

SEQ ID NO: 693912 - DNA, 454 bp, Homo sapiens
agcttatttcctttccaagtatttcacagcaacactctacttgacgcaactaggtccagattgaaaagagtcctctggctgagtggacactaggcccagacccagcccagactgagtcccaacatattttccctcactgtactccaaacaatgtacacaggacttctctaattgaaaagtctccaaccatacacaaggacagaacccaccaccccaacccccaaccctcagacagacttatacacccctgagtgaggattacatgcccatcccagtgtcctaggaccttttcccaatactagccccccagtggtgaacagaacctcccaaatttgagttgcaccttccctgtggctatgagctcagcctcgctttgagtaccacgccctgtcagctctgactatgagctggcgcttataggaaaagttggagttaaggaggaatagcatcctta

SEQ ID NO: 693913 - DNA, 392 bp, Homo sapiens
ctgcgagcttggacttctgctaaggtctcatcattcctagaactgagaagagtggctccctttgcctaacctgtttgtacaagctaatttggtttatgctgaaaacctgctttccctctgggactctgggattttggcagaggacgcctgcatgaccagcccccaatagaagtctcgggttctgagtctgtaatgatcttccctggtagacatttcatatatgttgtcacagaccattgctggggggattaagcatgcacatcctacctgactctattaggagaggatccttaaagcttgtgcctgctttcctctggactttgccccaagtatattttccttttgctgattttgttttgtacctttttgttgtaataagtcatagtcatgag

SEQ ID NO: 693914 - DNA, 903 bp, Homo sapiens
aacattttaatgttaatgctacctatttagtctcaacaaaaagagtcaaactctgtaaaatatttcaagagatttattctgagccaaatgtgagtgaccagtggcctgtaacgcagccctcaggagatcctgagaacatgcgcccaaggcagctgagctacaacttggttttatacatttcagggagacataacacatcaatcaatatatgtaagatgtacattggttcagtccagaaagctgggacaattgaacaggtgggggattttccaggtcgtaggcagattcaaagatttttctgctgggtgcaatggctcatacctgtaatcccagcacttcgggaggccaaggcaggcagatcacttgaggcaaggagttcaagaccagcctggccaacatggcaaaaccccatctctactaaaaatacaaaaattagccaggcgtggtgcgtgcacatctgtaatcctagctacttggggggccgaggttgggagcaatcattttccatgcaggaggcacgaggttgtactgagccaagatagcgccacttgcactccatcctgggtgacacagtaggactccaatcctcaacaaaagcacagcgcgacagacaagacacaagagaccatttcgcggcagccccacaggaccgagaacagggctcgacaaacacatcgctcggcgccgcacgggccccgaacaggcacagggcgaagactgccggacacagcgcgggaccccctaagagaagatctggcgggagagacaaagggaacagagcacgtgcacccgagcgaagaaaaagacccggcggcacaccaggcggttttggaacaacactcagagaggggcaccttaaggacacataagcggcgaaacaatacaggggaaaacaacagaact

SEQ ID NO: 693915 - DNA, 424 bp, Homo sapiens
  misc_feature (262)..(262): n is a, c, g, or t
  misc_feature (352)..(352): n is a, c, g, or t
gcggaatagccgctccaggccaggctgtccctactgcctggtggagggggaacttgacctctgggagggcgccgctcttgcatagctgagcgagcccgggtgcgctggtctgtgtggaaggaggaaggcagggacgaggtagaacggggtggacggagtcagagaggaatatggccgcagacagccctggcaaatgatcaggataggcaggcagtgtggtgcagtggctgcagtgagggccggtgagggctaatcttcaacnttgtccatgccagtcagccccctttttttccagtaccaaggtgctgtgaaccctgtcctggggatgaggcctgcgtcttgtggaactganacttagctctgacggggcatgccgctctgtgcccacgggtggtatgtaattttcgctcggcctgggacgggg

SEQ ID NO: 693916 - DNA, 877 bp, Homo sapiens
aataatttcttacaaacacaatattgccacaacatgaacaccgctatatgaccacagctgcagatcagttcttagtcaactgactgtcgttttctttctgctttgcaaggcgctagaactcttttactttcacgttcactttccctcgaggtggagatctcgctcgtgatgcccgggctggagtgcaaatggtgagatctcaactcactgcaacctctgccctccaggttcaagtgattctcctccctcagcctcccaagtagctgggattacaggcacccacgagcatgcccggcataatcttttcgtattttcagtagagatgggttacaccatgtaggccaggctggtctcgaattccaaacctcaggtgatccatccgcctcggcctcccaaagtgctgggattacaggtgcgagccaccgtgcccggcctcatggtaagtatatgtgatatcaaacttcaaactgggggcacaaacagaaagggaaagatccctataacctctatcatataacaatgtaaccagtatactgtgcactagtctaatcacaaccctgtcaagaaagtaaaggcctacacttgccccaactaaccaagtctgcactatttcaaatccatgggaaatagctgtcacgctgcctgaactggatttgcctgacataaccctgcaactcggcatccaaagcagtacggcgctcattcctgaacacaattatcgctccacagaatacccacaacatctatgggcaagaaatacatctgcccatgtataaaaacctcatcatcctctcaatccaatccctcatcataaccaatctattcgcccttgtataatctcttactctctgtcaccacagtggcaacacgtcatgca

SEQ ID NO: 693917 - DNA, 698 bp, Homo sapiens
  misc_feature (117)..(118): n is a, c, g, or t
  misc_feature (174)..(175): n is a, c, g, or t
  misc_feature (180)..(180): n is a, c, g, or t
  misc_feature (239)..(239): n is a, c, g, or t
  misc_feature (482)..(482): n is a, c, g, or t
  misc_feature (676)..(676): n is a, c, g, or t
  misc_feature (682)..(682): n is a, c, g, or t
gatatcagctcggtcccagtgttactccacaaacagacacacacagtaacacatcccacagggacagacacacatgcacggagaacacagctggtggaacacacacacacagacacnnacacagcgtaacacatcccgacagggacacacacacacacatgcaccgtggacacnncccantggggacacacacacacacacacacagggtgaacacatcccagcaggggtgagatgcanctgagtcaggcaggaaagctgacccccacctgggcaggtgacccagggcagccgacccccacctgggcaagtgagtagcgtcttcccaactctactggaagcgggatggtcagaaacctgggaagcgcaaggatcgcatgctggaccccagcttaagagactgctggtggggtgggggtcacccaggaggaggatttggctggggcctgcaggggcaggtggggttacagccggtccaccgcntaccctgtttgttggactctataaactgccccgacctaatctttaccagtttaagtctctccaagggcccggtgtgaatctcgacacagataaagcctcaccgtcctcccgactcctactggcgtgtgctcccagctcacctgggcaatccgagaaggccgctttcccttctggccccgcaaagaccccgtacnttaagnatgttctggtttgatt

SEQ ID NO: 693918 - DNA, 330 bp, Homo sapiens
ctagaggacccgctgatccgcttaagaaatacctgaaacactgatacacctgtacatcctgcagggaatcgcttagaaaatcatttttctcgggaggcgaggcaggtggatcacctgaggtcggaagttaaagaccagcctgaccaacatggtgaaagcccatctctactaaaaatacaaaaatttggcgggcatggtggtgagtgcctgtggtcccggctacttgggaggctgaggcaggagaattgcttgagccggggaggtggaggttgcagtgagcgagatggcgccactgaactgaagcctggtgacagagggagactccatctc

SEQ ID NO: 693919 - DNA, 767 bp, Homo sapiens
attgtctcttgtatgcagtaacgtttatttttgaccgtcactctgtgtcagcttcaaagtcagatagatttttcttcccagcatgttctacattcctgagtgcttgttgtgcctgtatgtggttctgctggttatcctattcaccaatgcagcaatttcctgtatggacactggttagagcaagttgacagctgcgagaatggccccctgggaactcccgcaaactattcgcaactggtgactaggtcacttttggtcggcaatgggaccatttgcctggcgaccttgatgcggcaacgccaacctgcgctgcccggcttccggcgctggccggcctcctctgggaccttcctggctcccatacaaccttcaccctgctgttgcgcaccaaccggaactacgggcttcaagcaattgatcccatggttatcacttcgcgtttccccctatcgtgggcatggggccaattccgggtaaacaggcggaacccaattattcacactggacgcgcgaaacgatacgagaatggcctttgtgacctctgggccccatgcctgtttccctccggcaacttccttgaatgcaccccaagcctccctggacttgataaccaattaactacaccacggttaattcaaaaccccctggcgtttaacagtggcacacccaagcgcttgctcgattgggcaggggtcacttgtgaacaagcccttccacacaatttggcactacgcgcaacaacttcctaataacaaactaggaatcga

SEQ ID NO: 693920 - DNA, 256 bp, Homo sapiens
ggctacgaggtctgtaagagcaatttctatatattgtcttcgaattaaaagatatttcccggccgggtgcggtggctcacgcctgtatcccagcactgtgggaggccgaggcaggcggatcatgaggtcaggagatggagaccatcctggctaacacggtgaaaccctttctctactaacaatactaaacattagccgggtgtggtggtgtacgcctgtagtcccagctactctggaggctgaggcaggagaatgg

SEQ ID NO: 693921 - DNA, 1007 bp, Homo sapiens
ctcaccagggtgtgaatacttgtgggcccctaatctcctcctctttaaggggggggtgtctcctccccccccgtgtgttcccccgcccctctttgggagacatctgctggcccttggggggcttaacaccggggtgtgagtatgtacaacacaccgcgggcttgttcggaacacccccttctgagcgtcgcctcgtgcaaatgctgatggacaacccgcaacagggcgttccaacgccccccaatgtcgccaccgaaattgccggcggtctatataaaaggaggatgcccatgggaggactcgtctcccttgtgcgcccgtccactccaaaaaggactcgtcgagcgtagggcgatgtcaaaaaaagacgccacctggcgctaggaagatttctgtgaaaggctccccttaaaaggcagtttgtttaaaaaacgctccccatgaaacaccccgatgtgagtagtaattcttgctccacctcttccaaaggaagggcactacttattatgtgcggtgattctttattgacaacaggcggctgacacagtatgggtgtgttttattatgagcatccccccttgcggaaccattaacacgagaccattaataaccctcggctcttcttcgcccgcaagtctatgatggggtgtatcttggaccctggaaccactacttgactgagctatgttctgtcctgattagttttccatgcccattatactctcccgtgcgacacccaaacatacatatcctgcgagatagtataatagtccacaacgtactggtcttatcacaagtgggccttgtaacataactaaatagttgcgttccgcctttacctatcctctctgtattgccacagtccacatttccccttattttctgttaagaattgttttacttcgccctacataaaatagtcatggacacccaactagaaatatttctttataggaatatgcttactttgaaacccacctaacaaattctacgtcccaacaaaacaa

SEQ ID NO: 693922 - DNA, 327 bp, Homo sapiens
  misc_feature (23)..(23): n is a, c, g, or t
  misc_feature (44)..(45): n is a, c, g, or t
caggcagacacagctgcaggtanctcaccgacagtccgcagganncaaagtgaaatgatggggctgctcgatggggctgcttaccttacccacttgggaagagtaagagagacaggtgcctagcactttccatggtggagggaaagatgcatgtttagacctagctcctgcaggtgggaaggtcagctggcgcaggtgctccaacagcaatttagcaggagtgcccaaggccgtaaacacctttgctcagacaaatctacattttggaattgatctgaaggacataattaaggatgtgcagaaagacagagatccaacaatgttaca

SEQ ID NO: 693923 - DNA, 122 bp, Homo sapiens
gggggggttttttaaacccttttttttaaaaaaaaggttctttttgaaaaaaccaaatggggtttgtaaagtttggggccttccctctgtacccttgtgaaaataacctttgtttaagttga

SEQ ID NO: 693924 - DNA, 113 bp, Homo sapiens
gaacgtctgaaggttatcaataagctcctagtcccagaacgccatggggtcatttcacagaggagggacaggctgactatgcacagctgtggggcaggtgattgtggagatgt

SEQ ID NO: 693925 - DNA, 838 bp, Homo sapiens
  misc_feature (1)..(1): n is a, c, g, or t
  misc_feature (309)..(309): n is a, c, g, or t
  misc_feature (317)..(317): n is a, c, g, or t
  misc_feature (330)..(330): n is a, c, g, or t
  misc_feature (394)..(394): n is a, c, g, or t
  misc_feature (754)..(755): n is a, c, g, or t
  misc_feature (759)..(759): n is a, c, g, or t
  misc_feature (786)..(786): n is a, c, g, or t
natccagcttgacctccatgaatttggggaacatcctggaaaatctgggacacatggtttggtcaccattattatactatgtgctttttctcaatccaatagggatttcttaaaatagccttgcattccaacaggatataaaaccctgttgaagatgccccaatctggaatcaaagagtcagactggctagaaacagatctggttcatttcaccctccaactaaaataggatgcaaaactaaacagctgtcgttagagagacagaacttcatttcccccaaacagtccttttaacctagaaagcaagangccctggnccattggcaagcngaacaatttcttgctattttgcatttccttcctcagaactatctttaatagtttgagccatggnggagaaagagaacaaactaaaattaatttttaattgaataaaacaacaaaataaagcacaggcagaagctccctaagccccagaattctacgtgctgtgagtccagggctcagttcatacagacaaaaggaatgaggagattcgagctctgttctgcctgattaatccaacattgttcagcaaaggtctgtcccaatggttagaacaatgactagatgataatccaaagccctccgtgagcagttaaaaatgaatttgtctgaaacgttctcagtgtctactgagcaacatcaaaggagctcagggcacagccgactttatggagtaacaggtttaaaaacgaacatttttcagcttgcnnactnctaaaagcccaatttgtgtctcagaancaggagaataatcaccaagcaaagaaataatataatgatgcaatatgatgaa

SEQ ID NO: 693926 - DNA, 220 bp, Homo sapiens
aaggtcaggagattgagactatcctggccaacatggtgaaaccccatctctactaaaaatacaaaaatcagctggggtgtggtggcacgtgcctctaatcccagcctcctgaggaaactacaggtgtgcaccaccacacccggctaattttgttcattttttgtagacgtaggtctcaatatgtggcccagactaatttttttatcagtgtatttttcag

SEQ ID NO: 693927 - DNA, 272 bp, Homo sapiens
ccgagatcacgaccactgcactgcatcctggccacagagtgagacgtctgtcacacaaacgaaaaaccaaaaaaaccaatgaaatagcaaaagaaaaagaaagacacccgcaaaaactagattgcccaaggtgaagacatcatttttttcctatactcccagtacccactgactccctctttatcctacacgtctaatgaaatggaccacgtctgtcttcctcagtcccatttctccacctcttcctcctcccctccacaacctctacaagt

SEQ ID NO: 693928 - DNA, 1300 bp, Homo sapiens
ttttatgtggttgctgtggcgtctgctcgttgctctgttcgctcgctgttcttttctttctcgtttccgttctccaagttttcttgtgttgtgttttcttctctggttctatttggtttctcatgctctttgttgttgtgtccatggttgctgtggttgttctactttaccctttttcttcggggtcgtttgtcgcctgcttgtgtggtattcttgtttccttttgggtgttccccttgtgttcttttttgtattttatggttcctgctttggtttttctttgcatcttgtggtctacttttgtccccctttcccattttcggggtcttgtccccttcgttggttcacgtccgtggttttgtctcccttacttgtcattgtatctaggtcctccgtcttttcaccgtgtcttgatttttcctggtgatggtcctccatgtgtcttctccatgtgtgtgaccctcttgcttttgggttccttgacccttaattgtgttccccttccccttgtcccgcatgtctgcatttttcggggtcgttatcctgtttctgttggcatcgttattttgtactaggtcggactgctaccttatttttgctggtcatttcccgtaattggatgttctatgttatatatgtgtggtgtctcattagtgtcttggctgtacttggcccctgaattctgacgggtcccttggtatgtctcaatttgtattctatgtaattccctaagctttgcactccatttgtgtacgcgcgcaccggtgtacaggtgtctttaatcatgattacatttttatatacagtgtcccccctgtcaacgttctcctgaactagtggactggtgttgtgtgaccctccattgttccactgttttcaaggttgtttgcatcaatctgatgtggtataagataacggctttggcttgtccagcattgtaacttgtttgttgaccgttcttaaaagtgtcttcttatgtctatgcatctgatagtctggcactgtatctggtgtgcttaacgcatctgtgttgccagatccgtgtctgatctctacgtgtaatcctaggatgattcttatacgctctttaatgttgtaagtgaaaaccctgagttgacgcacatgcagtgcgggagatacagcgtcttttacctgtcaccgaagctcaggaagccccgtttgtaagcgctgtgattgtggtgcgtttattgtacatccgacagtggtcagttcatttttactctaatgttcttttgggtttcccccctcagatagaatcatgaataagcaacagacctaa

SEQ ID NO: 693929 - DNA, 165 bp, Homo sapiens
tttgatggcatataattagactgttacaaatttaacagcgatacaaagagatcttattattaaaagcagctgatggtttggaaatgagagaactacagaggtgaagagaccaggaggcagctctcagatgaaaccaaagattgcggcatgccctatcgtgagacc

SEQ ID NO: 693930 - DNA, 422 bp, Homo sapiens
cccttgcgtctgaccctccgctccctcttataaggacacttgttatgacactgggccatctggatgatccgggatcctctctccatctcaagatcctaaacttcatcgcatctcgagagttccctttcccaggtaagtcaacacatcacaggtcctgggggtcaggatgtggacatccttgtggggcacattattctgcctagctcagttggcagacgagtttaagttgagaaataacgtatggagcgaaatgacaggtaatatggaatctgctttaaaatccctccctttgtctcttctaaaaaatgggcaaatggggaaaagaaggtagataaaatatgtgacaattgttgaaactggagggtcatgatggtttgccatatccctctaggtaagttttaagaatccctaaatggctgagt

SEQ ID NO: 693931 - DNA, 1061 bp, Homo sapiens
gtgacgagaattcccagacgcaacctggtgccctatccccgcattcacttccgctctggccacatatgcccctgctcatctctgctgagtaaagccataccatgaacagctttctgtgcagcagagaatcgacgcaatgcttgcttgcgagccagataaccagatggtgcaaatgtgaccctcgccactggtcaacatactttggcttgctcgctgttgtaccgtcggtgacgtaggattcccatagatgtcaatgctgccatagtcaggacgatcaatgaccaatgcgtaccatccgatgtgttgtgggatgggtgccccagcgtaggctttcacatggcttgggcaatcagccgtacacaatcgtcgcacatctgttgggatggcctgcgtcggatgatccgtgcgccaatggtaaccatggagacgctgctggtagcattgcgtgtagcgaagaaccactaggccactagactgagtgcgctgggcttccgtccatggatcgcacaaagtgttggacctgcatgtgatgccaaacagttgcctgtagtcgcactggtcacgtaggcgagaggaggcatgagagcgacaggtagacgttccttgcaagagacggccccggggcagcgacacttgcgcttggcacgcaggagagcacaaggcactcgcatacagaagcccggcaaaggagccgagaatcaactcggtaacggccatggcgcacctggccggacgtcactaggacgcggcagcagggacagcaacataccaaggtcacagcacagcccggacaaaaccagcattggctcccatccgagtaccgcaagggcgaacgggcccacgagaacagacactgacgaacggaacacaaccaaagtcagaccacaacgccacgggggacgccgccaagccgagcaaacggcgcaaccgagccccacattccccaaacaccacgcgacgaaacagacccgccgcactaaaaccgacaaccacacgatggaacccaccaatgacaccataaccaccactccgaagcgcacagcaagccaagcaaaaacgca

SEQ ID NO: 693932 - DNA, 1192 bp, Homo sapiens
gctgtcctcccgcgggtcgagggcgctggaatacccagcggcggcgaagcggagagtgatccccgctgcgtctccgcccgcactggtccatgtctgggtgtctgctgctggagccgcgcggtgcataggccgtctctgcagacagccgctgcccagctcccggaccgattcggagtcctgctgcgcatggcctggtccgacaagccatgggctactggcctcggggtctcggtttggctcctgtgggcatgtcgccggcggcggtttgctgcgttgcttgcttgctgcgtgatctcgtgcttgcgagttggcccagtggcctcgagagcgcatgagcatccgtctaatttggcagcgggctgttctgccgcattatcagatgaggatccatccggagccctgtagactcaacctgtgtcatgactccatgtacacatcatccatttttcagaggttgtccagtgtctcagagctgtgctgaaagtgtgggattgacagtaaactcaggatcatttggagagcaaatctgttgggttcaaaagcgcaagatcatgtgaatgaggtatgaaggcttgaaggaatgggcaccccgcgtccttggacatagtggttaaggagcgagaggttgcatgacgttgtcccctggcagaggaaagatcttggaaagacccagggacaattggtagcgtaggtatacgccaaatggttgttagcggcggatttccgagggttggaacggaacgaaggaccaaaagggcattttaactacaaggataacacatggtgggagggtgacctttggaatagccttaccggacgcaatccttttaaagcaggcttgcgtggttcacacaaatccgaaacgggttgaacgcgttagctttttccccaggtatctggaatttaaccccaaaggacgtggtaaagccaactgaaaaaggttaacgggggtaccctggggtttccttaaccgcagtaacacggcccgaaacacattccgagcctaggggtcccatgggaatccgggggtagtttcaccagttgacgacgcccttcgaactggagcactacatttcgggcggaagaggaccagggcgaagttgggagccaattcatagcgaaaacgacgcccacgggtgtacgacacgagcgagacacgtcacaggtaccaacgttggttgccacggaacac

SEQ ID NO: 693933 - DNA, 1016 bp, Homo sapiens
ggtctcgtcgatcggcacagccttgccgcagccccggagaaaatgcttcggttaaccaacagtctatcgccagatgagaccgttgtcctttggtactggcatcctcatctcactcggatcttatgcccaaagatgtcaaatttggtgcatatgcccgagccttaatgcttcacggttgtatgacctttggagcctgatgctagtgtgctcgctgacgagaactggcgggaccctagatatggtgaaatcaatcagtgaattatatgagtcaggatggttgggggtaagtccgccaatcgttaatcaaacagagacttgggtgtcgacatgctatgcaaacacgtgccgaagtatgacttagccatccgtagcatccctcagaacgttgggcccggctacacgctgggttcagatgcatggttgccacatatgaccatatcgactaagctggggagaggcgagcataccaacgtgtgtacttgctagctggacagcgcatctattaagtccaacggaagggcttatcgcatgaagaattatgtcagaaggattgctattaccaagatgggaatcaagagactgacgcgtgtgacagtcaggcttgcctgaagcaggtaagttgctgacagcgtttaccaagccttcctttgctagatggcctgggggattcacccgccctgagacaacagtgtggccgggtcggcattcgactatctgcctagaacgggagaaccagaggaagggtatggtgccaaatacttcaaagctactgggactcgccggtgcccgccacctgtgtggaaatgcaaaatgtgcgttgttcatcggctgtcaaccgcgatgtgaataaccgtgtgtactggtttgtatttggacccccttctttgaagggcactcaacctatggctcgggggctatatttgggccagactcaaaaacgtctcaacagggccacgttctaccttccgcctgcactgtctttcggctgacggaattctgcgtcatcatggtcgctt

SEQ ID NO: 693934 - DNA, 113 bp, Homo sapiens
ccagtcacacagctctggtatcatcagcagtaggggtcatcttcatcaatacccagaccaagttcgatcatcgcgtctagatcctgtaagcatgtgtctggggatctatccag

SEQ ID NO: 693935 - DNA, 485 bp, Homo sapiens
aaaaaccacattggagaagggccctatgaatgtaaggagtgtggcaaaggtttgagttccaacacagccttgactcaacatcagaggatccacactggagagaaaccctatgaatgtaaagagtgtggaaaggctttcgtagagtgcggcatacctgcagcatcagagattacacacgggagagaaactctataaatgtaaggaatgttggaaagctttcggttgtaggtcactttttattgtccatcagagaattcatactggggagaaacttatcaatgtaaggagtgtggcaaagcttcacccagaaaatagcctccattcagcatcagagagttcacactggggagaagccttatgaatgtaaggtgtgtgggaaagccttcaaatggtatggaagttttgttcagcatcagaaattgcaccctgtgggagaagaagccagtcaaggtccttgggccatccctggtcagtccccagtgtga

SEQ ID NO: 693936 - DNA, 149 bp, Homo sapiens
  misc_feature (110)..(110): n is a, c, g, or t
  misc_feature (127)..(127): n is a, c, g, or t
  misc_feature (141)..(141): n is a, c, g, or t
tggctcgctttcagttctgaatatagcattttcaaacaaggggtttctacaatccaggaaccaaagcgaggcttcatttcctttatcttcttcttctacttcatcctcanttcctaacaacattggngggctattaatganggaatgat

SEQ ID NO: 693937 - DNA, 130 bp, Homo sapiens
atggggctactaaaaaatttaaatcattaaatttaacattacatttaaggccttagcacaaaaaaagaatcaaaatatctcaataatttttatattgattacatgttgaaagatttttagatatattggg

SEQ ID NO: 693938 - DNA, 128 bp, Homo sapiens
gccagcttttccagataaggttgtattgcgaagcgcaggtaacaaaaaagatgtggcagggctgggcacggtggctcacgcctgtaatcccagcactttgggaggccgaggcgggcagatcacgaggt

SEQ ID NO: 693939 - DNA, 182 bp, Homo sapiens
acatcttcttttcagcagcttcctccaaccctggcgcaatatcccctggcctcaccgtcacaaaatctattacactagccactcagcctgagctatattttttgttttttgtttaacatttcagttgctgttcccacactgtcagtagctgaatgtcatcacttgacctccatcctaacaat

SEQ ID NO: 693940 - DNA, 1086 bp, Homo sapiens
accaagtaagacgtgactttgctcctcattcaccttccaccgagattgtgaggcctccttaaccatgtggaactgtctctcattccacctaacgagaaacgcccacaggtgtggaggggcaacccaccccttcaatcaggaacctcagaatgtgacatttggaaattgggtggttgcagatgtaacgaattaacttggcgacatactggagtaaggtgggcccttcacaccatatgactggtatccttataagaagacaagaagagactcagagggaagacagctgtgtgcagctggaatgatgcatctgaagccaaggaaagccgtgcattgccggccaccatccaaaactagaaaaagtcaggaaggattcttccctagaaccttcaaaggcagtacagccctgccaacacctgcattcagcctctggcctccagaactgtgagcaggatgaatttctgttgttttcagccacccaagcttaggaaatgggttgcagcagactgggaataagacaggcagccagtcagcctccgtggaattcccaggcagcttgcaggagccagagtgggccctgggctctgagaaggtctgaggcccagcaggcgcaggcgcctaaaactatttctccggcaaggagggaaggagggttcatccagaacgtagatccccttctccttctgacactcacgaggtcacagcgagtggctgggaggagagccaggaagtttcacttgagcgtgtgggagaccgttggcagcctggcacccgaagggaggacgcggtcgtaacgagggaacatcagaaactccacagtctgttggacgacgggtgggaaggcatccccgatagggtcaagcactccaggaacatatctcagaaaccggggcccagtagcagccgagaatccagtacatgatgcagagggggagacaccgccaggggttagacctgtacacgacaagactatcccggtagagacacaaaggaggcgctagtagatacccaacaggggtgcacagatactcaaaagacaggagcacagtacagcaacacagcggacagcatagaccagaaataagacga

SEQ ID NO: 693941 - DNA, 354 bp, Homo sapiens
aatctacatgggcctggactttttttctttaggaaaaaaaatcaccattatctggccaggcgcgatggctggtgcctgcagtcccaacactttgggaggccgaggcgggcagatcgcttgagctcagaagttcaagaccagtctggacaatatggcaaaacccggtatctacaaaaataaaaataaataaaaataaaaattagccaagcatagtggcactgtgcctgtagttccaactacttggggggctgaggtgggaggatcgcctgagcttgggaggttgaggtggtggtgaacagtgattgtgccactgtactccatccaggcgacagagtaagaccctgtctgaaatta

SEQ ID NO: 693942 - DNA, 618 bp, Homo sapiens
gaaaaagtcttcccaaggtatattatcacttgaggagcatttcagcttataactgttgaaagccagacaaaaaaagaattctaaaatcaataagagaaaagtgtcaaatcacatataagggaactcccatcagactaatagattcctcagcagaaaccttacaggccaggagagaatgtgataatacattaaaagtgctaaaggaaaaagaaaactgtcacgcaagaacactatactcggcaaagttgtccttcaagaattaagagagtaataaagtctttcccagccaagcaaaaactgagggcattcatcaccactataccagccctacgagaaatgcttaacatgttctacatctgaaagcaaaaggctgatatttgcatcatgaaaacatgaaactcactggtggagcagatacaaatgagaaaaagaaaggaatcaaatgttaccactacagaaaaccaccaaaccacaatgataaccaataagagaggaagaaatgaacaaaggatgcacaaaacaagtagaaaacaattaacaaaatggcaagaataagtcctcacctatcagtaataaccttgaatgggaaccgatacatttcccacttgcaagatatag

SEQ ID NO: 693943 - DNA, 112 bp, Homo sapiens
ttgctgcttctgcttctgcgcttcctgcttctgctgcttcctgcttctgccctacaagaccctgctccaaaaatccatttaatatattgtcctcggatggcagaagcaggaa

SEQ ID NO: 693944 - DNA, 355 bp, Homo sapiens
tccaacgtaatacccaatatgtgtagaaataatgttctgaacaatgtttacatgtttatttattgtaacaagatggtgtacttcttgcttcctccgtgtgatttccgaagcaaagcaatgggaccctacgctatcagagtcttaatggggctggggcagtgtccattgaggtgtcctgtcgggaatgacaagtccctggcagattatgaggcaggcatcctttggagttcttctctcaggtatattttaactaaaagctatcatttaagttgaagaaatcaagtcttgtgaattgatacgattgtacttctagagtctttgatgataagttgtctttgggtactacgctttggca

SEQ ID NO: 693945 - DNA, 324 bp, Homo sapiens
aaatatttaaaactaaatctaagccacttttaaaatgcatgctggccgggcgcagtggttcacgcctataatctagcactttgggaggctgaggcaggtggatcacgtgaggtcagaagttcgacaagcctggacaacatggtgaaaccctgtctctactaacaatacaaatattagccagctgtggtgcgcacgcctgtaatccaagctacttggaaggttggtgaggcacgagaatcgcttgaacctgggaagcagaggttgcagtgagtggagatcacaccactgcactccagcctgggtgacaaagcaagactccatctc

SEQ ID NO: 693946 - DNA, 969 bp, Homo sapiens
aaagtaagaagttgcatctttacatagagtgatcaaggtataatggaaagaatatacctaattctttgaagtagtgttaattatagtttttcaaagtctgatttataccattattagatgctgatgtggtctgcgtataacaaatatgtaatatgatcgaatgattgtaggaacatagatattgctagaatggtgggtaagtatatactttcaaataatttgtcttgaagtaaattaacgcatgttcgcgtagtctgcaacatgggtgaccacgagtaacttgttaaacacttgtgaaaaactctgcttgatgtcctcatctttcctacacttatgtccctgcacgatgtacctccactgatatactaggattccttgattgcccattatagtgagcaatcagcgcggaggcggtacctgtgaagcattcagacgagtggcgtgaagctgtaagattaagactccggtgaggatggaaaatccttaagtacagtaagaaaatacagagcattgagaagactaaatgcaagcgtgctagcctcacctagtcatttccacctagtaggaagcacttattctcgtcagatgctctaaaatgtacttgttctcacctgtgagatctgaataaagcaagtctctatttactggtggacccataacaaccaggacaaagaagatgattacaatacccagtaagcaggggctacttctgcacttggaagagttttagctgaagacatgtgatcagtggggaaaggaatagcaccaagcgttaacgtctgggtaaagtagtaaatgcttgtgtaaacattccagttgtactctcacatttaaactatctgtattcccacatctggattgtgcagatacttaacaatatttccaccttaacattgcctgtaccacatttggtgttcacttacggcatggtatgccacataccattgggtgaaactgtttctgtggaac

SEQ ID NO: 693947 - DNA, 153 bp, Homo sapiens
gttatgcagaaaaatgagctgcactgggaaacaacagagtggactggatggggagagaactgaccaaggctggcaggaggaggagagcagcctgcagctctggacacggggtccacaccgccagaaccgaggggaaggacggggcgtgggccc

SEQ ID NO: 693948 - DNA, 1235 bp, Homo sapiens
ttagaagacacgattaggtgcatgaagcttccaggctgtagaggccctgtttcccttctctgacctcacaaagataaacatccttcacctgagttcgtggccagtccagcgtctgcgtctcccagacccagatgcctgtgacgttatgagtagttagttctaaatgtggtgacaaacaagtcatatctgtaagcacatgggtcttcactttcatgtccatttttagtcaacagaacttgcaggcacagcatgcaagcacaatgtgagtcaatcccaagccaagttgctcaactgtgcgttactcccttcattagaactgaccactgtctcccaccaacaatctggctggacacccagactatcactctgttgactacccatatcaaggaacaactgttatcttcttggatactacggtattccacttgcatgacacagttagacaacacaaagaatcacattttcaagatgtgagagcatgtacactatcatggcaatatgaactatactacatctgtaaaaatggtaaaacatggattaatacatacatggatcggtataatattctataattaaaacataaggggagtcaacaagggtcacattgcccttttgtgtaccatgactccattacttcatacccctgtgattggacaatactacatagatcacatcttccattaccatggcagcttgggcacaaataatatgcaatacaacgtggacaacatcactcacgagggacgaatccattaccggatcaaaacactgggcgcaaaaacttggagcactccacagagaaaaaagaggcccacagacagcgcagagcgcacacaaacagtgcgaaaagacaaacacaaacaccagaaacactgacaacacactcacgacagacacagatgtcgacaggaccacacctccagagtccccaagcaccacaagcacaacaaaacgctggcgaacaagataacgggataacacagcctacggggccacttaacaaacgcaccacacgaacactacccaagggaaacacacacaacaacacacaaagggaacaacacgtgaaaaaacaaacacaacaaaaacaaagaggcgcgcagaataaaaacatccgacaggacggcaccacacacacagcgcaacgcccaacacctggcacaaactagccacacaacaagaggccaaaaagaagaaggaagcaaattaaacaatcatagggatcaagaccaaaa

SEQ ID NO: 693949 - DNA, 136 bp, Homo sapiens
cagcaatatcccctccggtacccctatctatcactttcatgtaacattggacttagtgtccattaaactgcctgagcaagtggttgtgtagcctgacatattcttcctgtagctaataaaaggaaaatgtacctac

SEQ ID NO: 693950 - DNA, 661 bp, Homo sapiens
  misc_feature (8)..(8): n is a, c, g, or t
  misc_feature (33)..(33): n is a, c, g, or t
  misc_feature (41)..(41): n is a, c, g, or t
  misc_feature (50)..(50): n is a, c, g, or t
  misc_feature (52)..(52): n is a, c, g, or t
  misc_feature (62)..(62): n is a, c, g, or t
  misc_feature (82)..(82): n is a, c, g, or t
  misc_feature (104)..(104): n is a, c, g, or t
  misc_feature (106)..(107): n is a, c, g, or t
  misc_feature (111)..(111): n is a, c, g, or t
  misc_feature (114)..(114): n is a, c, g, or t
  misc_feature (141)..(141): n is a, c, g, or t
  misc_feature (150)..(150): n is a, c, g, or t
  misc_feature (158)..(158): n is a, c, g, or t
  misc_feature (165)..(165): n is a, c, g, or t
  misc_feature (170)..(170): n is a, c, g, or t
  misc_feature (179)..(179): n is a, c, g, or t
  misc_feature (190)..(190): n is a, c, g, or t
  misc_feature (206)..(206): n is a, c, g, or t
  misc_feature (209)..(209): n is a, c, g, or t
  misc_feature (214)..(214): n is a, c, g, or t
  misc_feature (219)..(219): n is a, c, g, or t
  misc_feature (223)..(223): n is a, c, g, or t
  misc_feature (226)..(226): n is a, c, g, or t
  misc_feature (229)..(229): n is a, c, g, or t
  misc_feature (242)..(242): n is a, c, g, or t
  misc_feature (255)..(255): n is a, c, g, or t
  misc_feature (268)..(268): n is a, c, g, or t
  misc_feature (276)..(276): n is a, c, g, or t
  misc_feature (282)..(282): n is a, c, g, or t
  misc_feature (284)..(284): n is a, c, g, or t
  misc_feature (295)..(295): n is a, c, g, or t
  misc_feature (320)..(320): n is a, c, g, or t
  misc_feature (324)..(324): n is a, c, g, or t
  misc_feature (326)..(326): n is a, c, g, or t
  misc_feature (330)..(330): n is a, c, g, or t
  misc_feature (332)..(332): n is a, c, g, or t
  misc_feature (344)..(344): n is a, c, g, or t
  misc_feature (352)..(352): n is a, c, g, or t
  misc_feature (374)..(374): n is a, c, g, or t
  misc_feature (396)..(396): n is a, c, g, or t
  misc_feature (402)..(402): n is a, c, g, or t
  misc_feature (406)..(406): n is a, c, g, or t
  misc_feature (409)..(409): n is a, c, g, or t
  misc_feature (448)..(448): n is a, c, g, or t
  misc_feature (460)..(460): n is a, c, g, or t
  misc_feature (462)..(462): n is a, c, g, or t
  misc_feature (583)..(583): n is a, c, g, or t
  misc_feature (618)..(618): n is a, c, g, or t
tagttcanagaaccccaattctttattaatcanagcttgcncacaatgananaaaggaaaanagcactaatgaagagtaaanatgcagggagcaaccttcaggngnngggngtnggggggaaacgacttcaaaactgcganagggacttntggggggnatctggngattnttagttggnacaaatgcccngcctagcccccttaantgngttanttcanaganggngtnttttgttgttggngttgttagtaggnaggattgccttanactggggnagaaanancagcttgagtnaaagtccgcagtgtttttgattttntttntntgtntnttttaatgcaanaaccagcncacagtttccaagtggaaaaanattcagtagcatcatgtacttntactanaggnaanagcttaaaatgaacatcatcaatcatggcatccacaaanaagccacctgananattaattaattcattccatcaaaagaacttaaactagagaattaagcccactttatgaagagcgatttcacggctgcttgaaccattcgaatttggatttgtgttcagcactttaaaaggntcaactttttgcttctacccagattggtctcaggnctgttttctcatccatccctttctaaagccaaagcacatttgt

SEQ ID NO: 693951 - DNA, 1334 bp, Homo sapiens
  misc_feature (234)..(234): n is a, c, g, or t
  misc_feature (320)..(320): n is a, c, g, or t
gtatggttggtgactctacaatgggtcggagttccgggctgactcagacgttcatgagttggtccttgcggcctcgggagatcatatactctacctatctaatgctctgtgtatacttgtctgcgtcttctcacgaatgctgctaagctagtaatggtaagcataacacaagagaactaacctgtctgaattcctatagcatgtgaaagattcgtgtaggttatgtgatcgctnacacttacgctgatgagtcgacttcgccaatggaattactcccctcgttacctcacatctcattcctagaaacgctacatacgttnacgtacctcatgtgaatgcttcatcaatgatacttttttgtgcaacgaaacaagtcttttagccatttccacatggtttgaacatacacctagataggaacagttcaagcaccagtttcaaaaccgatgccggcattacaatagggcaactgctcgaaactacgacgctataatcaactgccgcctagaaatgcatagtctctatttcagtagcacaaccccgagaaatcaattgtagtcacggaaactgccttcgtctgtctccattatagcacacggttacccaaggagaaactacaatggttttacgacacacgcaccaagtatactgggtagagagttatttggacgacggcaaattcggaactatggtgtgcataacgcatctatttgcaacataccagggggttagtttgcgtgaggttgagcttttaggccacactgaaataacttagtcactaggagttacaaagatgtaaactacaaagagatgagttgtggtctcaaatcggtggaagaaggaagaatacggttaggtacaacaaggtttgtgaaaaggggatctagagggctcagggggatactcttggtctataaggaatcgaaatggggatgccaaagtatccccagtggaagtaagacaactgtgtggggaaacaaggagtttggctcgaagggatcagtttgggccgaagataaagacggggtaagcactaaaaagcagtaggacggggtgacttttgtgacacttttttgcattattacacaagccgttgttgcacaaagggggtagagacaaagaccaaaatatctagatggagttgaacctggtcgaaaacaatacggaatgcgggagtccttgaggaacagctgggggatatggggaacatggagggtagtatatcaaggaagacgagcggaacatttgaggtggcgacataggggatatggcagtgatcagacgcaacataaggttgggaagtgtaggacatgatcaacggaagagaggaattg

SEQ ID NO: 693952 - DNA, 235 bp, Homo sapiens
caatatcttagctagtatctccagtgactgggtgagctgttgcaggcgtcactggttcctaaacttggtggctgtgataatgtcccaggggactcaggaggaatatggtgagttctgtagtttcgagagttggctggtagagccgtctagaggttcagaatattagcttcaggatcagctgggggtatgggattggctgaggatcacacgtatgtaggtgaaaggataccaggat

SEQ ID NO: 693953 - DNA, 131 bp, Homo sapiens
cattgagcccgcggggggagaaaagaaggggatgaagatacaaccctaccattgccccaggctctactagcgtgctgatggatgtggtagagcctgatgtcttacaggactcactgttatatatttagttc

SEQ ID NO: 693954 - DNA, 348 bp, Homo sapiens
tgtcagagctccgttatgactagaggcggtggtcactgagtaggagtcgaacagcccgtcacatggcgaaacgccgtctctaccaaaaatacaaaaattagccaggcgtggtggcggatgctgcaatcccagccactcgggaggctgaggcaggagaatcgcctgaacccgggaggcagaggctctagtgagctgagatcgtgccactgcactccagcctgggcgacagagtgagactccgtcccaaaaaaaataaagacacaaagaaagaaaccttaaattcggggggggtttttttattcccccactttgtgcccgggtatattcattttcaccacattttccctt

SEQ ID NO: 693955 - DNA, 203 bp, Homo sapiens
gggttaaatcattcaaccttttaggcccaacccaaagcctttcccccctgggaattttccttgaaaactcccccagctccccagagtgatgcagaaaagcccagtttgcagtggttcctgttcctgggcccagtaccgctcaccccttttttgcaaaaggtaagggaaaaaaggcagggagtgaaaagagggagtcagcttca

SEQ ID NO: 693956 - DNA, 183 bp, Homo sapiens
  misc_feature (135)..(135): n is a, c, g, or t
tgggacatgtgattgagtgtatagcaggagaatgggtaagtaggaaatgggatgtacaaggaagaagagatggagagaaaagtggatgagggttacggattgggtgtacgaggctagagggctcaggagtcctgngcagggatctgcccgagttctttcggatcaatgaagttgatcttgcga

SEQ ID NO: 693957 - DNA, 118 bp, Homo sapiens
ggggacggaggtcgaacccacctccgtgaatgtcatcgaagccctaggagggtgctgccatgggcgagcactagatatgccagcccggacgaccctttccccaagggcacggccagga

SEQ ID NO: 693958 - DNA, 532 bp, Homo sapiens
  misc_feature (436)..(436): n is a, c, g, or t
aaccctacaggaggaggagcacagagacaggcaggggcaggagcgggggcaagctcttttaggctctggccccacggtggcatctaggggtgggtgcctgcagctcccgaagccccatggggcatgctacagtgctcttttagctggccatatgcagatgggttaagtgttaaccagctcagtaccttctgggtattggggttctggtccagcatccaggaagaatggggtcacacatggacttgaaggatggtgtattcgggattttatgggatgatggaggtggctctcagtgggatggatggggagctggaaaggggatggagggggaagatgatcttccccgggagttcggcggtccggtggccgatctctctgaccatccccagctgaagggctcttgacattcagatgctccttctcttctctccttggncacgctgctcttatgctcctctgcacattctggttgtctgctcgtctgcctgtggaacctggggtttggggtcatatgtgtaccggatagcctggt

SEQ ID NO: 693959 - DNA, 473 bp, Homo sapiens
  misc_feature (447)..(447): n is a, c, g, or t
aaaaaaaaaaaaggtttttttcccccggggtgtgggtgtcccccgccacaaaataaaaaatggccgccccccccccccccccaaaaaagaagaggtgtttcccccccccccctcggggtggaaagcgcctcttttttaaaacaaaagactttttttttttttttttttctccccaaaaaaaaagaaaaaaaaagggtggggttttttttttgaagggggcccccaaagggggtgggaaagacccccccacattatttgggtgttttaaaaaaaaggaattttttttttttttcttccaaaagaggtgggggcccccccccccccctcctttgggggccccaaaaaggcccttttttccccaaattttgtccccctgtgggaaagatgccccttcggggtttccaaacttaaaaggggggggtaaaaccttttttaagttatcccagnccagtttaatttgcaagaaagccagg

SEQ ID NO: 693960 - DNA, 165 bp, Homo sapiens
tcattataaggtatttgtactaccaaaaagttgtatagtatcatttgaaagtggacttggattagttattaaatatgttttcccaactctagggcaaccactaaaaaaagtaaaaataggagttaaactgatatgataggaaaggtaggaaataggataatataa

SEQ ID NO: 693961 - DNA, 312 bp, Homo sapiens
taaaatagaaggcattatctacaagaacagaccaaaacacaatttattaataaacaagcccttcatgaatatttgtctcaagaatctaatctgaaaatagtgtctttgattagatgaatatatggagaccttcggattatcatcactatagaaagttgagcaactgcacaaaccatatagatttaaaccactgggttaagcagacgaagtaacagacagacatgtttcgggggatcatatctcagattcccaagctaaagctattgctcaaggtgcatggaaatatgtagggggcattaaaccatttagtca

SEQ ID NO: 693962 - DNA, 121 bp, Homo sapiens
aggtctgacagtgaggccatgatggagccaccgatcacaccgagtacttgcgctctgtgggtgctgatgatcttgatcttcatgtgtgctgggcgccaggtcggtgatctccttctgcatc

SEQ ID NO: 693963 - DNA, 662 bp, Homo sapiens
  misc_feature (1)..(1): n is a, c, g, or t
  misc_feature (553)..(554): n is a, c, g, or t
ngtaacctactgggctccctcagccctatacctgtggggctccccagcctgtacctgggtcttccctgacctgtgtggtttgaccttataaagaagcatcctgagaagccctgaagacacagtgtgcctgacttgaggtcagatagcttccgatgcaggcgcccttggtctgaccagaagtgagggaggaagacaagtggtatagggactttctcttgaccctgattttattaaatattttttcattctggaaatatatcaagcctcatttttatttgagccttggcatttctccattctttttgttttatctgagctctgtcaccattattacatctgctactaatggctaggaacctcatggggagggcaggaaaagcacatcgccacatgcaagccttttcctgaaggccttccacaccccacaccccatactccctggcttttcatcaaatgatcttttaaaagtgaatctttggagggctggagagatggctcagcggttacgagcactgactgctcttctcaaggtcgtgagttcaattcccaagcnngacatggtggctcacaaccatctgtaacaagatctggggccctcttctggtgtgtctgaagacagctacagtgtacttacatataataaataaataaatcttttaaaa

SEQ ID NO: 693964 - DNA, 252 bp, Homo sapiens
  misc_feature (17)..(17): n is a, c, g, or t
agcgaccaacctcatgnaattccgaaggaccctgactgaccgctaccacccgactgaccactgcaccttgattggccacttcccactgactggccactaccacctgactggatccccgctgattgaccaattccacctgactggcagaacctgcgcccctcacctaacctgtgctcttcttccaacttgcgtgcctcacagaacccgggtgccgcacaaccccaaaacgcacacctattcggacgggtgggt

SEQ ID NO: 693965 - DNA, 511 bp, Homo sapiens
acatcattctagaaaggaggtaagtaatctatggtgaccgaaagtagatcagtggatgtaaaaaacagaacaaacgcagatcatgggttatctagtgaccacgggatagcggtaatcacagtgccgactgacaaaagagcctgaccaaacttccagagatgatgaatatgtccactatcttatttatacctcccaaaactaggggtgaccgttggaccagtatccaccatatgtcaaaatgggccaaagtgatatcctgcacaattgtgcacgttactggtactgtgacttactctcaggttatttaaccaaaattatccttataatggctcctacgctcggcacctctgatcatggatttagggccaattatatgacatcacaccacaaatctcattcctctgcagacatcttggctttggatttttaaaaactatatacacttacaacggggtgatcccttagtaaggccagcccgcatgtctcattcagggaggggatcctctaagac

SEQ ID NO: 693966 - DNA, 184 bp, Homo sapiens
gttcggccgagatgtctcgctcgtgccttagctgtctcgcgtactctctattctggcctggaggctatccagcgtactccaaagattcaggtttaataacgtcatccagcagtagattggcaagtcaaatttcctgcattgctatgtgtctgggttccatccatccgacattgaggttgactta

SEQ ID NO: 693967 - DNA, 212 bp, Homo sapiens
aattatcgggcagagagtgaaagtttagactcttcctaggccgcttcttatgcagtgtctcccgtccagtgtgcctttctaaatcccaggcgcatgcagggtgcttgacagtgctccaggtcaccacattagccttggtgcctagctcttcttcccaggcatccagctgtgtatcgtttaccgtggtacctgcagctctgaattcgtacatc

SEQ ID NO: 693968 - DNA, 300 bp, Homo sapiens
  misc_feature (18)..(18): n is a, c, g, or t
aggtcgttcactagtggntccaaagattctggcacgagccaaaggggataagataggaaagaaaaaagaccccaatgctccgaagagaccaccgtctgccttcttcctgttttgctctgaaaatcgcccaaagatcaaaattgaacacccaggcctgtctattggagatactgcgaagaaactgggtgagatgtggtctgagcaatctgccaaagataaacaaccgtatgagcagaaagcagctaaactaaggtggagtttgaaagggtattctgcattccctgccaaggaaagttaagc

SEQ ID NO: 693969 - DNA, 802 bp, Homo sapiens
catgtggctcccgcctgtaatcccagcacttggggaagcccaagtgggtgaatcacctgaggtcaggagttcaagaccagcctgaccaacatggggataccccgtctctactaaaaatacaagccgggcgtgggtggcgcatgcctgtaatcccagctactcaggaggctgaggcaaggaaaatcacttgaactcgggaggcagaggttgcagtgagctgagatcgcgccattgcactccagccggtggtgacagagcaagagtctgtctcataaataaatacaaagcccattcttccagagtcttgtgccttaaataaaatcacagctctctgctgtgggaggactgtgcaatggcacatgcgctaagagctggtggggaggttgaagatgctctggggagaagttcgtagatcatcctcagaaaagcttgccttgtgtgctaccagaaaaactgtctcccaatcacccgaggaaagctgtcacagtagtccccccttatccacggtgttccctttccaggggttcaggttatctgcggtgcaaccaaggcctggcaactatcaactggaaagtctttcaaacagtaaataaaccatatccatatgaataattttgttggggggacggcctcagaaaaagttttgataaaccattggtggggggggcccgaaagaaagggtgaatggtaaattggtgccaaagaaagcagcgagaaagggggtggttctctacagtagaaggcggggagggaggttggagaacaaaggattgggtagggttacaggggcaggattatagga

SEQ ID NO: 693970 - DNA, 731 bp, Homo sapiens
gagtgcagtgggcgacctcggtcactgcaagctctgtctcctgggttcatgccattctcctgcttcagcctcccgagtagtcccaggagtagctgggactacagtgtgcccactcaccacacccagctaatttttctgtatttcctacgtagagatggggtttcaccatgttatccaggatggttgttgatctcctgacctcgtgatccgcccgccttgtggctcccaaaagtgctgggattataggcgtgagccatcgcccgggcaaatttttgtatctagtagagatggggttctcaccgtgttggccaggatggtctcaatctgaccttgtgatctgcccacctcggcctcccaaagtgctaggattactggcgtgagccaccatcctagccttaaatgcatattcttaaattatcaacaggtagatggttatgaaaatgctttggggctctaataacctaccttttacagaatgagaaactgctgggcttaagggagtgcagtatgaatccacgatttgaccccattcacatgtggcttgtgatttcgtgcatatatcatagatgggatccttctgcagaatacgtggaataggggcattaaggacacccaagccaattcagttgtgaaccttattcttggactttcttttcttgcgggaatttcagggagcaggctaggaaggctgccgggtaggatgaactgtttcccctactgttgcaccctgg

SEQ ID NO: 693971 - DNA, 337 bp, Homo sapiens
atctggagaggtgggcgctgaatgatcatggacttgactgtctgccatggggcagctgtactagagttacggtgggagcagatgacttgcatgagctgctggcatagatacctgggctaatgtggcaatctggtggctgggcttgaacggtcattggtgggttttcagcttctgttacagctgcatctccactctgctggttctcggctccagattccatggtcatttagttaccggtggtacaagctcctccgtcactgctttcgttcacggcccggatctcgctggagttttattctctcccccacgtaacacaccgcgtcaaactacacctccg

SEQ ID NO: 693972 - DNA, 189 bp, Homo sapiens
accgaggtctgggaggaaaggcgtgctgctgaaactgtaaccacaggaggcatcatgcttccagacacatctcaaggaaaagtatagcaagcaacagtcgtcgcatgttggatcgggtcctaaaggaaagggtggagagactccaagccacgttagcgtgaaggtcggacgactagggtactcctccca

SEQ ID NO: 693973 - DNA, 170 bp, Homo sapiens
  misc_feature (2)..(2): n is a, c, g, or t
  misc_feature (50)..(50): n is a, c, g, or t
tncgaggattcgatcacgtgcatgtggaagtgggtggcgattcctcaggnatctagagctagaaataccatttgacccagccatcccattactgggtatatacccaaaggattataaatcatgctgctataaagacatatgtttattgtggcactagtcacaagggcacg

SEQ ID NO: 693974 - DNA, 278 bp, Homo sapiens
cgccagagaatccgtaattttggtccttgctgccccctgtacgtgaaaccgaaggacaatttataacgacagcggggaattttcagaacagtgttgcaaaaccccctcctaagacctggcaaacatgggcataagtgggtttagctccactctgaaggccattcacgatgaccaggtctttttgccctttttggggagggctcgaacagctcaagcccaaaaagatgcccgttttggagaagcagagcccaaaagagacagtggttccaagttgcggg

SEQ ID NO: 693975 - DNA, 211 bp, Homo sapiens
ttagatgaggaagaagaaacagagaaccaaaggggcaagaggttggtccctatactttcactctcctgggaggagagatgggtacaccacacagttggatggtgcatctttgcctgtctgcacctgcagctccactggcaccatggcacccatgtgtacaatctttcagatgctatctgggtggcgcgcctagatgctcttgacctctctg

SEQ ID NO: 693976 - DNA, 288 bp, Homo sapiens
  misc_feature (50)..(50): n is a, c, g, or t
  misc_feature (161)..(161): n is a, c, g, or t
gtgcaaaagtgcctcttctatatctacttaatctaatttatataattacnatgttatttgtaagagctacaaaggaaaagtaaatgaatttattgaaaggagactttagaaagagtgacttaatttacaccagggaaaggttttagagaatgttgcccccnttttgggaaagttggttttgggcttggaggcctgtagtgaaaagcaaattacccagagcctctagaagaaacagacatgttgctttggccaaggaaaccccccctggttcaaggtcaaagaaagttt

SEQ ID NO: 693977 - DNA, 1432 bp, Homo sapiens
gctgtgggtagtagtagggagtgtctcgtcggtgtgctgctgttgtagttgtttgtctgtattgatttgtgatcctttgtgcttttgtggttgtttgctttctcgtggtggccttctcttgtgcgtcttctccttctgctgcttcgcgtggtttttcatccacttttgcccctcttatccggggcgcccctcccgctgttttgccccgccttgagagcaccgggggtcgcgtgttcctgcttccgggtgttttttcccttagcccccggggctctgtgtatcaccaattgtttcccaccgaggtacctagctgttttgtgcccccttctagtcccttattttttatgggtgccaccacttaatgtgggcacacagggtgtggtggcccgcacaaagataagacgcatggtccggtgggttcccgtggtccccagataatttccccccggggattacttcgttctgggcactacaccggctgggtccttctctccccaacgaacgtccttttacttttccccctttttcgatatggaaagagcctttattccacccccttttcatgggttctaccctccccttctagataaagtccactgttctccccctagttcttggctgttcccttaggttcccctcggtatacgcccgccttttgtcctaaaccaccgtctatcactacccataacgtttacctatagtatcgtaaccatttctccaaacgctcttcacggaatattattgtgaaccccttcttgaaacatattccttggcccccccacatcacatcctatgtccctcatttctgcccccgtcccccaatctcctatacgcacatccctgttaacacatataccacgacacgaaggttcacaacgattccctctccctgtatccacaccaaataccaattggccccaccccataggttactggaacactttacggagttaccaccggacttacggccgggacttaatattgtccaacatccttacaataacattcccccccatattatattccttaggaaccccgagcggacactgccggacatccctgtggacaggttggaccacatcggagattagtacatccccggattggaagccccccatatctgttataaataaatataccatccaccaagaacagttttgcgcacatccatggagactgtctccccaccatataggcgttataaaaccagaagccaattctcccggacagtcttataacccaaacccactttctacccgctacaacagacccgggggtatacataccggtccaatgcttcttgaaatcttgtggagccaaacaccaccagtttctatgccccatctcgtcctagaattaattccccttaaaatttttgtaaatagggcccgtatttaccctatagcaccccctctaccccctttagagccca

SEQ ID NO: 693978 - DNA, 151 bp, Homo sapiens
ttcagggtttcagaattttaaaaggcccaaattttttagggtcttttgcatgtggtaagcccgaaaatattcaaagggattttggaaccccattggttttaccccgccccaaattgggcccccctgagggataataaagaatttggaccca

SEQ ID NO: 693979 - DNA, 934 bp, Homo sapiens
cttgtttcccgcggcgtggtgggccacgttttttccggacaccgttgtttccggggcctgaagtgggcgcaattttggtcccttggaccacgggggtgaacttcaagtcgcgaactttggggcctctcgcaaggaggagatttggtctttatgggaaccgcggagccacgcaacacctgctgtgggaccccggcagtttcgtggcccccctggagaggttttctgcgcggcacccctgtgtgtccaccgccgcagcgtcgtttgagactcttgttgggggagcctcggggtggttgtcttgctgttttacgaggaatatcctgtgcttggcgaagtaccccccactcttccccccgggagttatttaaggaaggagaggttctttctcgacacacgccagtttgttttccaaccggccagagtgtttttctcctacacccgccgcgctttccctctttccggccgggaagcctcacttcgggcactcctcactaggataggggcttgctcttcgtcgcgagggggacccccccgcggacccggagggagcttggggatgctactcgcacggagagaattccgcagaagatgtggagaggacacacgcgccctttttgcacggatatcctggggtcggggaacccctccttgggccccgcgcctctgcccccgcccttttgtgcgccccccacttgtcgtcggccggccacacgagcgtcgtgcacaactttcgacgcagcgagttttcaccccggggggccccccctcctgagcccgccccctcgaaggcggcgcccttacaaccccggggcagagcaaccttcctggaatttgaatttttggcccgggggttttaaccccctccccttcccctgcccctgcccctgcccgaggaagtttttatttttaaaaaggcccttggggttttcccgga

SEQ ID NO: 693980 - DNA, 142 bp, Homo sapiens
tctatcagtgtgccactcatgtgcttctcactcatccccaacttccactgtgtagtgagtaaattctcagtgtggccatggctacagaccctctctgctctggtcccatctaatactgtgaccagagcagcagggaaagaca

SEQ ID NO: 693981 - DNA, 283 bp, Homo sapiens
aagagtgctaccaaagaaaacatggacaagagcaatgaggagctgagaaatctaatcaagccaatcagaaactttttgacccaggatagtgctgctttggacagcattgaagcagttgctaatgaagtattgaaaatggagatgcctagcaccccacacgcacgttacacgacaccttgacagaccgactactaccgtgacaccgagttgaaacgcctttctcaagtagaggttattcttcacgcactagtgcttgctgacattgccagagcctgagactgtt

SEQ ID NO: 693982 - DNA, 946 bp, Homo sapiens
gccggagttcaccggggccgattaggcgttccctgtggcgcagtgcacctgaaagcctacgtatcgtgtaggtggtggtggctcctgcatcgatcagtggatgattgtgggatactcttgctcatgtgtctccatcattgaagctcaagaatatcgcggagatgggtactggagatcgatcattgtgaggtagcctgaagatcagacagagactgtctctgaattgaagcaccgagtttccctgatgccaggcttctaccatcgggtccatatggaccttcgatcgggtgtgttgactaacgaagcatgcctgctgtgtgcgtctacaagtcgtatcccctggggacaactgtgtggatacactggactgtaacagaatgggctcgagaatgagtatcccactagaaaggtgacgggtgtcttcatatgagtataaaagttcgaacgggtgtatcttaagaatgaggattgactacgtttgagtgtggaaaaaggtccggtaaggtggactaacgatattaaattcgggaggggagagtcttagtggggagagagagtcagggttcgagaggtgctcagagaggaggattgaggtctatgtagggcagtgaaagtgagagtcattgtgtggcttagtgtagcgcttttactaaatctagggacgactactggaatcgaattggattgcgccgtggtggggaatggagaacaggttctggagacaacgcattagaggatttagaccggtggaagaacttggggaggcttgaaagtacgacggaatgggagtcgagaccagaatttgggaacgcattggggccctgggaaattcatgaccacataatttttgaaggaggcctgattggtttagacctgaaaatagaaagcaaaaaaaaagtttttgttgggagataggaaaaaaaaaatttaaaaattttttggccga

SEQ ID NO: 693983 - DNA, 100 bp, Homo sapiens
tagctacttctctcgggatgtagcaagaaaggtgacgggggaagtgacagatccatcaggaaaagtccactttgctcttctggggacgtgggatgagaaa

SEQ ID NO: 693984 - DNA, 1562 bp, Homo sapiens
gccacgcgtccgcccggccctgccacagagagggaccccagcccagtcaggggacactcggcagggctgggcgacttccaccttcccgctagaagccgtagcgagctgtggatgcagtggacatactgagcccagcattcctggcatccctcacgcatggctcctcaccaacctcacttcgacacaacatgggttgtcggggacagtatgggtatccacctttacatcgtgccaccaagcgaggcataaagcactgtcacatctcgccccgtactctgggacacttatcaatcatgagctaaactacttcggcgtaactctggactaacctgacacaccatagcgactcgctgatctgacacgctgatggcccactgtgcagcatgcaccctctcgtagagcacgggctaagcacacactcgtgattcacgtggtaggacagcagcacgtagagggtcactatgtcacactacaccttggagcatgagacactcgcctcgacgctggttccatatctgcaatcgtcactcgctcatcctagagagaggctcacaggccattacacacagtctcaggatcatagacaagccgtcccgcgattcaatgcatcacatctcgacaccagggcactaacttcgcagaccccatagggcactgactgggtggtttcgccactaaaccacaacaagagacacacgacaacccaaccacaaggcgggacgacgaagcagcagcagcgacagcaagccaaaaagaagacgccggtacagacagcacacgcaaactacgaagagaaggatgacgtcgggtgcccaccacacacacgtgccgaacgcctcgacacgcgcgcacgacgactgaacgccacccacgaacgacgcgacgatcagcaaacacacgaagcgggggaacccacacaccacaaacagcgcttgacgcagcggacacccccaccgactcgaagtcacgaacaccacacgcaggcacgacgccacgtcgcagcgcccaccactcctacacaaactaaaagacacggcccccacaagcgcgaggcaccaccacagacgtgggaagcacccgcgcacgacgcaagcgtagtcaccatcacagcaacacaccgcccgaaacacccggagcgagcgaacacacgtagggaggacaaacagcgacgaccacccacccgggcgcgaccatccgacccatcacaggggacggacacgacaacatcccaccgaccgcacggcggcgcgaccaccagcgtaggagcgaccgaccccagcgctaagacacaaaccacatcgccacaggccggaccaccgcagacgaggcagaggaccacccgccacgcacacccaccgcacggggggcccccaccgacaaagccagacccaccacacgcttcacaccgcactgcgaaggcaccaactaacgcactccgagcagtagctactacaccaaacacgctcgcgcggccaaacgagcaaacacatgctcgacaacgcaagagactgcgcggccacagccacgcccgagtagtagccacaccaccaccccactggatg

SEQ ID NO: 693985 - DNA, 134 bp, Homo sapiens
taggtagcctcagcagttcagggcaggagacgaggccaggtctccagctaggggtaggacgtagcccaccagctagccgaaggccaagacgccaggtccggtaggacgtgacaaagcaggacatgacatggtcc

SEQ ID NO: 693986 - DNA, 479 bp, Homo sapiens
ctcaccaggccctggaagttgcaggctgcaggtgggcaagggaggctgccaccactgcttgggatccggtctcctggtggctgcctgcagagaccgcccagataaggggacgaggagttggtgtcctgtgagacaaacttcagtcaatggcagacaagagtcagtggatgaagtctgccttccttcgtggactgttttatgatactgtttatagtttagtcagcctctccggagacatcctgtaaggcagaaaaatcacggttttgtgaggagctcagcaatgcacttgtgtttgctctccctccttccctccttgctccttccttccttccctgcttcctccttcccctttcttccttttctgcttcctcttttcccccttcccccttttttctttcctcttttctccttcctccttccctccttccttcactgatactttttgggattgctctccctagtaaagcataagcacaaaa

SEQ ID NO: 693987 - DNA, 384 bp, Homo sapiens
  misc_feature (328)..(328): n is a, c, g, or t
  misc_feature (337)..(337): n is a, c, g, or t
aacgggtgatgcggttgacaggtggaggtagggtccttggagagggtcactcaggacgctctcaaaggagcaccccacaaggttagggccacaaggaggcaggcactgctctgacacagccgcgtctagtgagcagatgaacgagaaggattaactgctcatccctgaagacagcacggcatgcaagcggcccaccggaagggagcccaccggaaggcggcccacttgaggcgacggccgagctccttccgatcgcttcacacgattcaaagattgaggccaaaccggggatgccctgggtggtcatctgctgagcccaggagactgngagggctgnggagaccagaagcagaggggaagggatggggaagggagtgaggatgg

SEQ ID NO: 693988 - DNA, 1691 bp, Homo sapiens
ggcgccatttttttgtgacacctctgcgccatgagagccaacgtggagtgaagaagcgaatgcgcaggctgaagcgcaacaacgacgaaacgatgagtgcagacggtccaatgtacaacccgctacgcttgatttgcaccgtggacgtgccacacggacgcacgacacacatggacactgccagaccgcatggggactgcttggtacacacgttgatgggacctgtcaattgctacctcgtcgtagacgacttgatctcaaattggaatcgtagacacttcactcgacccgtctgactcgaccgaatcacacatactgaggacaccacacattgacgtcatacgagaagaatgcccaatgtatgagtcctactgacccatggaacctgatgaccatacatggacctacttactagatgatataaatacagatagagcacgacgtgttaacacaccaatcattaactacaattcacacatcatatccggccatgatacttcaagccgtgcacacgcacatttcaagacaaacgcacaacaaagccaacgcgagaacacacagaggacaaacaaaagggcagaacgatacaccacaaacaggacagagaaagagacaacaggccgaagagacgaagccaaaggaaacggaaaagaaaacaaaacacaaaggagaacacaaccacagacagcaaaagaacccagaagaaacaaagacctcaacaaaacgaagagaaaaatacaagaaacaacactaacacaaaaagagacggaaacaaagaacaaggaaacacaaaacaaagagaaggagcgacgaaagaacaaagagcagagcacacagcggagagatgcagaaaaagacagcatgcaagcagcgagtgagtgagacgaacacaaagacgactacgggagaacaaccacgcacagaacccagacagcaaagagaacacgacacaaaaacagccacgaccgaacaagaaagaaacaaacaaacaaacaaaaacgagcaagcaggacagacagacacgaccagagacgacagaacaggggaaagatgcaaagaaagaacgagagaacaggcatgagcgctcagaaggcgcaaagcgacaaggtaggagacaagacaaccgaagaccagtggcaggagagcagcgaacgggcagaaggcgcagagagagagaaacagagaacgagcacccggagcagagggacgaggaagagtagagagacagaagagatgagacgaagagcagaagtgaagagagaagggtcgagagaagaggaacaggaggaagcggaacgcagagacagagaagcagagagacacagatagaagacagtagagcaggcacaagaagaagcacgacgtagcaaagcacgacgaaggagggagaagaaggacgagccagcagagagaaaacagggagtagagaaagaaagagacaaagcgcgagaggacgggcgagcgagagagagcagacagggatacgaagagaagaaagaaaacaagcagacagaagaaaggaggaaggaggaggaggacgcgaaggacgcagaggacgacggcaacgcgcatgaaggagggagggagacagaggagagcagaacgcaggaaagacgaaagacgacggagacgaacacaagcagaagccaacacagagagagagaaggacgcagcagcgaggggacggacag

SEQ ID NO: 693989 - DNA, 156 bp, Homo sapiens
tttagcctggaacagagtcaaagatgtgccaagttctaagacaactggagactaagcccactctcatacaagagagggttataacttcttgtttctgtagcacaagaggagagaagagcccctaagacagagctggaaggtctgacctatacaaat

SEQ ID NO: 693990 - DNA, 292 bp, Homo sapiens
aatatagtgcttctctcaattgagcagaggcctctcgtgaatgtaacaagcttgggaaccgttatacaaataccactccgagtataaagttgttgtcattaacacaaatgattccgtaaaaagcaaaacattttttttcaaaagcaggatttgttctaagtctaggttcacaaaggtattcatttctataaatatcaacttaagactgtgagaaatgacgtattctttttcacacgaatatgttccaggtaagtaactaaaaatgtacgcttttattgaaccggatagcttg

SEQ ID NO: 693991 - DNA, 274 bp, Homo sapiens
aataagtatagaaaagtatagaggagaaagtataaagctatgacatccccagcaccagcagaaacgtgaggaagatcagtgcaactaccattcacccaacctaacaaccatacattaaaaggattacaagctcctacttgagctggattttgatatgtccaattataccctgaaaaggaactattatggactgtacctattcggaaaaaatgaaaaataattctccactgcccaaggtacttatctagattgacagccggtccaaggtcgacgc

SEQ ID NO: 693992 - DNA, 326 bp, Homo sapiens
  misc_feature (287)..(287): n is a, c, g, or t
aagactgcctatcatcatatcaaatatgccaatttcttaaaaagagcttaacattagaatagtatatggtagaattactagttcagaattggcatagattctggtgttaaaatagactggatctgtattatctgaggggtagtaactaatgcttagccaggcctgcttcaaaaatgttgctaccaggagtattctttggtaagcaaatgctaccagcatttttttaagcccagtaagggctaaagtactaattatgcaacttaacgtacttcgtaccccagggccanttcaatcaccaaattgcctgggagccctggttgagagag

SEQ ID NO: 693993 - DNA, 858 bp, Homo sapiens
ggagagaactagtctcgagttgttttttgtttttttttggaaaaagtccgggaggccagggggtcggcttgaacccagcttgggggggtccgatcccttcctttttggtctagatttatgtatacgggttctccgaaggtgtggagggtggggggcatccatatggtccctccaggtttatgggagggtcctcctactataacaggacttgttcgctatcgaagcgaaggcttctcaaaatcatgaaatttatcaatattcactggctgttagagaaatggattgagcctacagatgataggatgtttcattgttggcggtactgctatcggggtacggccgagtaacgtcggggctatacgcggataggccagagaacagtgtggtgggcagcacaagtctacgattgagcgccgataaatcatgatagtcgacactgggattgtgggcgtaggttcagggtcacagggggtcagcctgagaattggggagactccgtgaatgacgcctcctatgtgggcacatacgggtccccattggatcggactgcgggaatgagacctagaacgtaatatgtgtccgtgtcacacaggagcgccacgaggtcagaacgcgtgagacttcgtccggcgggggagtgccgccgtagatgtcgactgactgcgctccgaacagggggggcctggggggcaattcttcccacaaggcagggacatcagaaaacttggcacgggggcgatagagcggcaaagacgctaagcaggtatcagggccgctggaacaattgggacgatccggtatgcagcgcagacggggggcggacgtcagccgcgccggggcgcccggagaaagcacggc

SEQ ID NO: 693994 - DNA, 1196 bp, Homo sapiens
gcacctgtgtgcccatgtgtgtgcatggtgcaacatgtcttaccaccggaccaatgagtgacttcaacctgtggcgaatctggagcagttcagcatgtgagagcccatcagccagcctgtgtgctggatccccactggacttttctgaatgtggcctgtgatttttagggcggtgatggtggccaatgtgtgtggcccctcagtgatcacccacaccttcaaccaccagaacttgacccactgttcccgcacactggctcagggacctaacatacatcctcacagcgggactcctctcacatggtttactactaatggagatttgccacgcatgccctggaacggacgtgcctgtgcttttgagcgtgtcagtcagcttgcgacttggacgcctagtggctatggagctacgacccactcgacgctgccggcactgggacggccacttgggacccaggaaccgcggctacaaaaactgcttgacctgaacctccttgtatagcccctgagctgccctagaataccttgcacgcatttgcaccgagcatccactatccctccatcctgtaacccagcgctttcccccaaatacacactctacacccccatcaattcatctccaaatcattcctactaacccttagtagcacaccacactacaaccacacaactcaactaaaacaccacatataactcccaccttacactcaccccttctccgtagcgatcctaccaagcaactcccccctcccgccctcccacccacgctaccctattacccctccactccccccccccctcctcccaaccaccctttcacccaccatatcatatctagcaacctagaacacaaccacgccaacctctcctatctcccctcccatcttcccccttctacactctctcttctaccacaacgataccacatagaccacatacctctcgcacgatcttcctccatccacctcacgcaaaattaccaataaacaacacaaaataacacatacaatcctctacaccttctgcatactaccttcctcacgcacactcccaccaacaatatcaatcgatatctctagctatgaaactcgtagatacaactacacatacacattactactacctattcgctacgaagctaaacactatagacataagccataactcacaaagaagccacacgaccaatatacaga

SEQ ID NO: 693995 - DNA, 776 bp, Homo sapiens
gcggggactggagcaggagggctgcaccgggactccgggacaggcccagttgaaaacggcggggcgagggggtggggtggagacgcccgcgacgccaaggctggggtcccggaaagcgcggggaggagggtggaaggcaaaggcaacttctggggaaactgggaaatggctggcctgtggacctcggggacacttgctgtaccaccctggctgcacagcccctcccgctgcaaaccctgagccaaatggggctggtctgagctgtgctgctctctggagcggagctcagtgggattggtgcgccctggcacttattgcttgggcacagcccagccccagcccaggacctgctggcgggtgcgaacccagcctgggcggggtgcaatgctgcggtggcatgtggcctctgctgcccggccccctcccctgagtagaaaagcatgccgcaggctgtggcgctccaccacggccgtccggggtgggcctagcagtcgctccatttatcgcttgagatctccatgccttaccgtggctcgaaatggaccccaactgctcctgcaccactggtgtctcctgcgcctgcaccgtgctcctgcaagtgcaaagagtgcaaatgcacctcctgcaagaagagctgctgctcctgctgccccgtgggcttgtgccaagtgtgcccacggtgtgtctgcaaagggacggttggagaacttgaagctgctgtgcctgatgtgggaaccaggtcttctcccagatgttatagaacagctgacaactga

SEQ ID NO: 693996 - DNA, 500 bp, Homo sapiens
  misc_feature (108)..(108): n is a, c, g, or t
  misc_feature (112)..(112): n is a, c, g, or t
  misc_feature (138)..(138): n is a, c, g, or t
  misc_feature (144)..(144): n is a, c, g, or t
  misc_feature (148)..(148): n is a, c, g, or t
  misc_feature (178)..(178): n is a, c, g, or t
  misc_feature (185)..(185): n is a, c, g, or t
  misc_feature (220)..(220): n is a, c, g, or t
  misc_feature (224)..(224): n is a, c, g, or t
  misc_feature (450)..(450): n is a, c, g, or t
  misc_feature (476)..(476): n is a, c, g, or t
  misc_feature (480)..(483): n is a, c, g, or t
  misc_feature (485)..(485): n is a, c, g, or t
  misc_feature (487)..(489): n is a, c, g, or t
  misc_feature (491)..(492): n is a, c, g, or t
  misc_feature (494)..(494): n is a, c, g, or t
gtaccctgtggagacgggttctcaggccagaatcccgccaggaggaaactgcagaaaagagctcccagaaatctgcaccgggttctcttgagtctgtactgaggaccngccngtacatgtatagaagaaaactccacnaagccnggcnaagaggagaaaggagcatgtaaggtgaacnacttccngacctcgcacacggtcatgacatactgaagctccngccngggggatgggtccccagtgatcactgtggacattcagtggagactcaggaggagccacaccgtgggaacagggctgatgctgtctgcagtgaaggctcgtctagaacctgcctgagaaactgcagctacagaaatccaaggcctggcatggcggctcacgcctgtagtcccagaactttgggaagccgaggtgggcagatcacctgaggccaggagttcacaaccngcctggtcacttgtaaccccgtctcnacannnntncnnnanntngtcagg

SEQ ID NO: 693997 - DNA, 258 bp, Homo sapiens
cgctgactcaagttcatagcacttgcttcacacggttatccaagacttgggtgccacccagtgcttgccgtgttagtagcaaatgccatgctctggacggcgctgacttacctactcttttgccagccccactttcgcctgtcttactgctgccgctgctagatttcccagatgattgtgaagagacgagtctggtcatgaactcacaaacatcaggcccctcatgagttggacttcaggaggtagtccgcgacttga

SEQ ID NO: 693998 - DNA, 114 bp, Homo sapiens
tctaggttgaccacatctatggtccaaataccaatactgtccaagataggagcctatcacatcctgggccatacgctgcccttccagccatcatctcttaccactatgtcttct

SEQ ID NO: 693999 - DNA, 157 bp, Homo sapiens
ccgccaccacacagacagagcatgtcagacgccccgactcaatttagcaaacacaacctatataaccagtccggtgctagggagctagctgggacccttaaggagaccccaacctgggagaagacataaaacaggacagacagagaacagcgggttt

SEQ ID NO: 694000 - DNA, 167 bp, Homo sapiens
gtatctctaacattaggtacgacaacaattccacgatgccaaattcatggcagacactgatctggatccaggctgtacatgaataaaaggattcgaaatgcacagttagcacagtataacttcattttagttgttggtgaaaaagagaaaatcagtggcactgttaa

SEQ ID NO: 694001 - DNA, 131 bp, Homo sapiens
  misc_feature (84)..(84): n is a, c, g, or t
  misc_feature (86)..(87): n is a, c, g, or t
  misc_feature (90)..(90): n is a, c, g, or t
  misc_feature (98)..(99): n is a, c, g, or t
  misc_feature (105)..(105): n is a, c, g, or t
  misc_feature (110)..(110): n is a, c, g, or t
ggtttttgcattgccggcctttttgccttcccctttttttttccccgccccctgcacattgggggtttcagcccccaggttgtngnntcnttgggggnnggcccncaatnaatgtgaattgttgttgccca

SEQ ID NO: 694002 - DNA, 729 bp, Homo sapiens
tagcggaaaaaagtatcctcgtcataatgtgatgttcctcataagcgataaatgcctggacatagctcgttgtgcaagcctttaaataacatgtatgagtgtattatggagccccagacaacataatgtttcaaaggttgatccccttgctacttgtactggatacctttatcattccatgagactagtttgctgaatttgaaagaatgtaggcattccattgtgtatgtaatttctctcccttgccaaacaagattttctaatactggctggtaaccagccgagagaaagatccaaaacagctactcagttctctgcacctgaggaaaagttttgtccccctacggttggactcctgggcctacaatcagtccaagacttaaccactgggatggggctctggatttgattatgccaaagttagttctggtgctggattgcaaaagaagtgatatttagatggtcttgttaatattcaggcagaatgtgtcttcctattatataggtgtgcttattaaatgtagcagtgtttgcgtatatgttatcggcctgagtttatagcctcaggatatgataagttctgctgatgtgtagttatgtggggcagacatatcttcattaagagttgtttggaaaaactcaccaaattgcgatgaataacattttccttcttaaaccattcgggaatttatttcctaattaaacattgatatatcggaaggaaaaaac

SEQ ID NO: 694003 - DNA, 370 bp, Homo sapiens
  misc_feature (14)..(14): n is a, c, g, or t
  misc_feature (250)..(250): n is a, c, g, or t
  misc_feature (260)..(260): n is a, c, g, or t
aatccgaagctganaaaattaaccatgcttcaacttaagaaaaccttagtgaaatcgctcacagtaagcatgcaaaaaggaaacagtatccttttgcaaaaaaaaaaaaaaaaaaagggttgaaaaaaggttctttatgattctggggatagcccattccatgtcataaagaggccctagatttggtttccggtccaggggttggtgtggatagggtgtgcctaaagagccattttcccaaaagccaatnttgtcttttncataccctccataaatatgaggccataaaaatggccccctttgagggagagatgggatttggtgggctccgggaaaggaggcgtagatctggcaggtgaccaacacaggg

SEQ ID NO: 694004 - DNA, 124 bp, Homo sapiens
ctgtcataaagccatttcttggtagtatgggaaagaggcatatgggatttatacagattcacttgtaaatagtaggataggggattattgtgtaaattttctcaaataaaggctagcagaaacc

SEQ ID NO: 694005 - DNA, 170 bp, Homo sapiens
caaaaaaaaaaaaaaaaaaaaagcccggcatggtggtgggcccctttgatcccacctactcggaaggtttaggtgggaggatccctggagcctgggaagtttaggctccagttagctgtgattgcccccctgctttccagcctgggggacaaaacccccccctgcctcca

SEQ ID NO: 694006 - DNA, 131 bp, Homo sapiens
tcctcggaggaatactatttgctgtagggtctgcaggcaacagatggatgtttctcgcctgagagctgtgggtaggtttactttattcttcttcctttttatttttttttgagacggagctctcgctctgt

SEQ ID NO: 694007 - DNA, 1183 bp, Homo sapiens
  misc_feature (215)..(215): n is a, c, g, or t
ggagagaactagtctcgagtttaatagtgtatatttctctattttttaaaaaagggccaaaatggcttttttttattttaccaggggcccacccggggtcttaattacaaacgaccaaacaacaaacacaacaaatccccacagaggctcagagaataaagagacagctcctcatacgagaacaactccacacaagagagcgcacgagacacgcnatcactaggcgcgaacaaattacacacaccgcagcggcaccacagaggcacgcgcgcgtagggccacgccgaaggcgctccgagggagccactcacggggagcgtgaggtgacaacccgtgcgctgaaagagagcagagctgcagagaactgtctcatgctgagcgagagtgtccacctctgcctgataagcacagcaggagcgccgctgggggcgcggagtgttataatcaccccgagagagacgccgcggcgagacagaacgaagagtgagtgtgaatcaacagagggggcacaatatcaacaaaagagagtgaggagtctcccctcacaactagcaaagagagacaactcgagagaagaggagagacacagcgaacaaagagggggcccgagaacccacaatccaacacacgaggggggaaaaaaacaaacaccaatacatgaccctactcgaggagaggagcacccgcagcgcaaaaaagcagtgcacaccccccgcagggagagtcgacgcacgcagaaacagaagaggcgcagcacaaaacagcacccgggtagcacgatcagcagagagaaaacaaacacaaacagagagagggcgcccccccaatggagcaaacgcgaggggaataccaccacccagcgggcgaggcaaacaccccaccacaagccgcaaacactagaacctacatcgcgccaccaacaacagggggcgacatacactccacaccaactaatgaccgcgggtacacacccacagcccagacacgaccaacacacccccaccacagagcagagaagctgaagacaaacacagaacagcaacaaccccacctgattaaagacaaacgaggagcgtgaagagagccgatgaacacctccatccacaggaagaaaaaaggaggagcgcagcaaaacaccacagcacccaccacaaatgaacaccgcagcgcacaacccgaaaca

SEQ ID NO: 694008 - DNA, 402 bp, Homo sapiens
ttccccacaacccccaatttctttttttcagggaaaaccccaactttggggccccgtggccctttttttccccccctaaaaaaaaaaaggcccctttctaaatgtgggaaccacccccttttttatccccctgggatagtggcttctgagcaaaggccaaaaaatttttttccctgaaatttcccgggagaattaaaaccgcctgaatttcccatgaaaattttttttggggggggggttttaaatacccccccaaaggggccccacccctcttttaataagcattttgtaaagcttgggggtttttttttgggggtggccccaattttgcaagaattaaatggtttcataaagatggggggggcgggtttttttataaaataaaatttcttgaaagcttga

SEQ ID NO: 694009 - DNA, 599 bp, Homo sapiens
  misc_feature (506)..(506): n is a, c, g, or t
  misc_feature (509)..(509): n is a, c, g, or t
  misc_feature (525)..(525): n is a, c, g, or t
  misc_feature (588)..(588): n is a, c, g, or t
ggctggcctcgccgggaggcccgaggggcggcgccttctgcggcctccccggcggggggatgtgaggggcggcccgcggccatggagacgggcacggcgcccctggtggccccgccgcgccgtcatggctgcccccgcggccccctcgccgccgccccggggttcccgggccgggcccgtcgtggtggtggctccgggacctccagtgactacggccacttcggcccccgtcaccctggtggcccccggggaggcgcggcccgcctgggtcccggggtcggccgagacctctgctccggccccggccccagccccggccccagccccggctgtcacgggcagcacggtggtggtgctgaccctggaggcctcgcccgaagccccaaagccgcagctcccctccggcccggaatccccagagcccgcggcagtggctggagttgagacatcgagggctctggccgcaggggcagactcgccgaaaacagaagaggctcgaccctcanccnccccaagaccaggganccccaccgggacccctaccaggaccccttccaaaacggctcctgggtgccctgaccgccaaanccccggcttgc

SEQ ID NO: 694010 - DNA, 1085 bp, Homo sapiens
actgcagtggtttttttacatttgctgggtttgcctcaccaggtcagcattcagcattcaattcattcactcatgtcaattgccaagtcaccagattggagtggcacacagcttcagtgtcagcatcatcatttattattatgcacacacacgtgttgcgttgccctatttatatgcgcaatttcatcacatgcacacacaattgcactttgctaccagtctgttgcatcagcacaccagcagcttcttcacttcccatcattgcaggtcacaagcagtgcacagtgggcacttttaccacatatatccacaagtggggcacaccacagcccccattccacctccattcccacagacatcccagcatgccaattggacacagcggcatggtcacacaagcacacaccattctgcttccccacaccacaattgcaagcaaccacacaacatgagcagatgatatacaagtaggtaactactgcttctgtctctacacaatgacgccacctctcaaccagctctacaagtggtgtcgcctcaattgatgcccccagcagcacaccttcacataaccgaacaacaacagcagttacgatttgtttcacgaacaatgcaacacccagcgccccagcttgccattactatccgcacctgctggccaccacattattccccaggagttggcccctactttctcaccagttgtgttcgcgagcaacagtttctctcacaacaacgagacccccgtttcaactagtgggattgtatgacaactagtggacgccccacaattggcttcaggcgccacccattatgaaactagtgagcaaccacaaccacatttcaaacacattatatgccgttctactgccagtgatcacgctcgtccccctctctacgcgacaccacaccttcagcgtgtcggcatcaactcattggcttcgtgtcccaggccccacacacgtactcgttggtgctcgcgacacagttgggcgaagcgcactgggcaccccagcagcacaaccacccagatgtccccaattgtcctcacaattcccatcagatgcccaattgcacggatgtca

SEQ ID NO: 694011 - DNA, 602 bp, Homo sapiens
  misc_feature (509)..(509): n is a, c, g, or t
  misc_feature (512)..(512): n is a, c, g, or t
  misc_feature (528)..(528): n is a, c, g, or t
  misc_feature (591)..(591): n is a, c, g, or t
gcttagtgaatctgagggcccctcggcgtgtgtatgtccggggcaccgagggggacggtgggccggcccgctgtaccgatggaagactggggccagcgggcgcccctggtggccccgccgcgccgtcatggctgcccccgcggccccctcgccgccgccccggggttcccgggccgggcccgtcgtggtggtggctccgggacctccagtgactacggccacttcggcccccgtcaccctggtggcccccggggaggcgcggcccgcctgggtcccggggtcggccgagacctctgctccggccccggccccagccccggccccagccccggctgtcacgggcagcacggtggtggtgctgaccctggaggcctcgcccgaagccccaaagccgcagctcccctccggcccggaatccccagagcccgcggcagtggctggagttgagacatcgagggctctggccgcaggggcagactcgccgaaaacagaagaggctcgaccctcanccnccccaagaccaggganccccaccgggacccctaccaggaccccttccaaaacggctcctgggtgccctgaccgccaaanccccggcttgc

SEQ ID NO: 694012 - DNA, 168 bp, Homo sapiens
tgtaggtgttggcgtgcgtgcggcgagattgacactcccccgctctcggattcggagtcggaaatctttgaataccctgttacggacagagagttgcaggattcttttaacgagggctaatgagcaggccacaatgtcgtgctagagggcgaagaagcgtgaacgacg

SEQ ID NO: 694013 - DNA, 319 bp, Homo sapiens
ttatatactagttaacacagtgttcacaccaaggccatgaaccatccatcgtctatatactagttaacacagtgttcacaccgaggccatgaaccatccatcgtctatatactagttaacacagtgttcacaccaaggccatgaaccatccatcatctatatactagttaacacagtgttcacaccaaggctgtgaaccatccatcgtctatatactagttaacacagtgttcacaccaaggccatgaaccatccatcgtttatatactagttaacacagtgttcacaccaaggctgtgaaccatccatcggtagacgc

SEQ ID NO: 694014 - DNA, 262 bp, Homo sapiens
atgcaactgctactttcatgtcagagtagagtcctgctgtaatatccaacaagcattagacttgtcttgctagataagtgaactatactagtgtttcgtcaattgaccagacgtatatcgtgctcagggtatacgcctacgtagtgatggcaaccttctttatcttctatccggtccttggattcaaaagaagaggtagaataatctataaggggtgaaaatgaggctgaacctcacgaaatagttcttaatggacaccata

SEQ ID NO: 694015 - DNA, 452 bp, Homo sapiens
atgctggaccccatagaccctgtgtctcgtgactggaactgactcggcgtatagttgcgcttatcaggctaggggactagtcacagaccactgttggggaagagctttaacttacctgagaccagaccttggcatgagctaacagagcacaggagatatctatgacttggtactggacgacgacatctaatacgatgatgaacggagagcctaagagagactctggtctagtgcctagcagtgtcacgaaagagagatgatggactaggagaatggccgcagaccaatcgctctggcttgagatagggaactcaaatcctgaaattactgcctgcatttctgacctcacatactggttggatgacgcggattagtagcttagagtaatactatggagatattacccaccgttcagatttttcgcagatggcccctatacacagtggcgctcc

SEQ ID NO: 694016 - DNA, 318 bp, Homo sapiens
tttttttctgacacaaaatcttgctgtcacccaggctggagtgcaatggcgccatctctgctcactgcaacctccacctcccgggcccatgcaattctcatgcctcagcctctagagtagctgggattatgagtgcccaccatgatgcccggctaatttttatatttttagtagagatggggtttcaccatgttggccaggctggtcttgaactcctgacctcaagtgatccacctgcatctgcctcccaaagtgctggaattacaggcatatagcaccactccccgcctcttactgtcatttttaaaaaaacaggac

SEQ ID NO: 694017 - DNA, 285 bp, Homo sapiens
tcgcagcatttataactttcggctatcatctgataacagcctgattgagagtcatagagtggcaaagtgccgttattcttcaaggttgtgagtgtagtctcgcgggtgtgtgtaatcatcacagtctgttttgcaatattttgatacctcccaaaaaataatccatgccttttagcagtcactccttccccattttcccccagctctttcaccaccagccctcggcagcaattagtctactttctgtttctatagatttgccttatctggacattttgtataaat

SEQ ID NO: 694018 - DNA, 195 bp, Homo sapiens
  misc_feature (175)..(175): n is a, c, g, or t
catgccccctaatttggaagcccccccccctagcaatttcaaccattaacccttcccttacccctttttctttttcccaattttaatttcttactgactattcctaaaaatcgcgtgtcgcccttaatcccaaaggcctaaggttttcacccctttttaagtgaagccctcttancctggcgggacaaccccata

SEQ ID NO: 694019 - DNA, 114 bp, Homo sapiens
gctctagaggatctgcccctgttatacccacctacactgtaaatcaagatctaacggacgtgcgacatggaacccacaggaagtctccttaagccaagacttgcaacagaatgc

SEQ ID NO: 694020 - DNA, 226 bp, Homo sapiens
cgcgcccgatggtgagcccgtgacaggcgggattggtgcgattgaaccactcggtgcagcggaagaccgggctggggaagaccggcttgggccttccagcaccagccgcgcgcccctggcgcgaggcgcccggtgattccctgggcctcgcgagcccgcggcggaaaccctgtcgtcgtgcggccggccaggtcgcggtccttctcgaactggttggcgagccgtg

SEQ ID NO: 694021 - DNA, 440 bp, Homo sapiens
  misc_feature (9)..(9): n is a, c, g, or t
  misc_feature (26)..(26): n is a, c, g, or t
  misc_feature (42)..(42): n is a, c, g, or t
  misc_feature (48)..(48): n is a, c, g, or t
  misc_feature (67)..(67): n is a, c, g, or t
  misc_feature (149)..(149): n is a, c, g, or t
  misc_feature (170)..(170): n is a, c, g, or t
  misc_feature (212)..(212): n is a, c, g, or t
  misc_feature (231)..(231): n is a, c, g, or t
  misc_feature (236)..(236): n is a, c, g, or t
  misc_feature (290)..(290): n is a, c, g, or t
  misc_feature (390)..(390): n is a, c, g, or t
  misc_feature (433)..(433): n is a, c, g, or t
cccaacccnccccacttccgaagtcncccaaagccccagganatcacncctgtatgccctttgccanacacatagccttagccccccacttacaagtgagaacatacggtatttggttttctgttccctgagttactttgccttagaanaatggcctctggctccatcanagttgctgcaaaaagacattgtttctttttttatggctgaanagtattccgtggtgtgtanatatnccacactttctttgtccactcattggtcagtgggcacttaggttggttccatanctttgcagttatgaattgtgctgcaataaatatacacatgcagattttttttgatatattgacttcctttgggtagatacccagtagtaggattgctggntcaaattctatccagtagcatttgaaactgctttaaaaatatnaatgagg

SEQ ID NO: 694022 - DNA, 704 bp, Homo sapiens
  misc_feature (1)..(1): n is a, c, g, or t
  misc_feature (14)..(14): n is a, c, g, or t
  misc_feature (21)..(21): n is a, c, g, or t
  misc_feature (24)..(25): n is a, c, g, or t
  misc_feature (27)..(27): n is a, c, g, or t
  misc_feature (33)..(33): n is a, c, g, or t
  misc_feature (35)..(35): n is a, c, g, or t
  misc_feature (37)..(37): n is a, c, g, or t
  misc_feature (41)..(41): n is a, c, g, or t
  misc_feature (179)..(179): n is a, c, g, or t
  misc_feature (189)..(189): n is a, c, g, or t
  misc_feature (206)..(206): n is a, c, g, or t
  misc_feature (208)..(208): n is a, c, g, or t
  misc_feature (215)..(216): n is a, c, g, or t
  misc_feature (218)..(218): n is a, c, g, or t
  misc_feature (234)..(234): n is a, c, g, or t
  misc_feature (265)..(265): n is a, c, g, or t
  misc_feature (277)..(278): n is a, c, g, or t
  misc_feature (300)..(300): n is a, c, g, or t
  misc_feature (484)..(484): n is a, c, g, or t
ngctccccccgatncccaacnctnngngccttnancncctntatgtttgggtggcatgttcatgaaaaagccatacttctagcaaatcccccaatgaaccttttgtctgtgggaaaagcaggagacgcatcgatttccctgaacctgaccacaacaggacactagtcccccaaacctcngctcttcacngcaccagaacttcccancnaaatctnncncatgttactattcacnatatatagtatttcgtcactgaagactttantcagaaaagaannacctctttttaattggatgganactttctacctgcttggcctggggcctctggaagtctgctgtgaatttgtattccctttcacctcctggaaggtgaagtacccctgcatccctttgttactaacctcagtgtattgtgcagtaggcatcacatatgcttggttcaaactgtatgtttcagtattgattgactctgctattggcnagacgaagaaacaatgaataaaggaactgcttagataatgtgccaagcaattatttcatgggcaactttaccagaacttgaagaaagttgccagtggcatcagccaatttgtctcagtagaactgttcagagcaccattcttccacatattggtcttgcccagcctagcaaccggattgtcaccatggtgagaagccattaacctccagagcactgaaca

SEQ ID NO: 694023 - DNA, 122 bp, Homo sapiens
aatttaaaaaaaaaaaagggtttcctcccaggaacttttttttgggggggggcagatggggtgggctccaaaagcacagggtgggagggggccctttgacccagcattcccccccaacccta

SEQ ID NO: 694024 - DNA, 728 bp, Homo sapiens
tgctgggagctggaggcggaggagctggggaggtccgagcgatgtgaccaggcgccatcgctcgtccttcctctctcctgccgctcctgtctcgaaaataacttttttagtctaaagaaagaaagaaaagtagtcgtccgccctcacgccctctcttccttcagccttccgcccggtgaggaagcccggggtggctgctccgccgtcggggccgcgcgccgagccgggcgccgggccgtccccgcacgcgccccatgcatcccttctacacccgggccgcaccatgataggcgagatcgcctgcgccgctgtccttcatctccaagtttctccgcaccaaggggctcacgagcgagcgacagctgcagaccttcagccagagcctgcaggagcttgttggcagaacattataaacatcactgtgttcccagaaaagccatggcagggggatcgggtaccgggtgtattcgcatcaaccattaaaagtggatcctcgtgatgcggaccaggcagcaacaggaggatggggactgagccagtcaaggagcgtgtaccaggcttctcccaaggtgaactcaccactctgggtgggacccctatgaaggtgtcctaacagaatgtgagaggaatggctccatctaggggtgcggtatgaagcctcaccagcaggaggtagcatcaaaacagcaccaacgtgcaatgggtagacaggcgaatcaggtgtaagg

SEQ ID NO: 694025 - DNA, 864 bp, Homo sapiens
  misc_feature (181)..(181): n is a, c, g, or t
  misc_feature (668)..(668): n is a, c, g, or t
gaaaatcgaacaaatggaggagtttgcaccagaacagatgaaaagatatgatggagtatggtaactgaaattcctcaggaaatgcacctgaagtctgcaggtcttgtgggcaaccccgagcacacgtggttgtgacagtagtgcagttctagtacagcgaaatgttgggtatgcatctggngtgtgatgtgaagcccttcctggtctctggatctgatacaacggagtctatattatggtatgagtggctagactaagtcttggcaacctgccaagttgctagagaggctgatgcacctgatggaatacatggagaaactaagggagtgggcaggttcgtggttgtcattggaactttatgggaatgtgcccataggatacaccttgtacttacatgtaagaatgtagcctatgtcattccaaaggcctttaatattgtatacaaatgagagaagagctattaattgattggcgatcatatgcgcatagattactcgaattcgtatttcgcaacactttgtactctacaacaagaacttcaaggtgatatcttctctctctttttccctgtttgcaatgtgagaatgttgttaactgtagcatctgacttcgtatggttattttcatcgcactttagaagagatctcaatgtggcatatgggagaaanggcctgtggcttacgcttagataggaattatgagttgccttttgtattatgaatgacaagtaggatacttgggatttagaacgtagtcttatagatcgttatgaacgtggtgttccaatttcattcattaatttgatttggtggtaaaagctatggagaagtgggaatcttaaagagtctatgtagtgtgtaactc

SEQ ID NO: 694026 - DNA, 825 bp, Homo sapiens
agcgtatcacagggctgcggccgagaaagaagccttatagagctgctcaagctgcagccctcatctccgccggcgagtagggccaggtgtagggagctcccacgtggacaagatggtgtcttcggcgcagatgggcttcaagctgcaggctctcctggagcagctacagccaggatgagattgagcaagttcaagtatctgatcacgaaccttctccctggtcacatgagactccagaaagatccctgcacataggaggtagacaaggctgatgggaagcaaatggtagaagtcctcaacatccattgtgacggcctactgtggtggagatggagagccttcaaggtcttcgaaaagatgcaccgacatggatctgtctgagagagacaaaggatgaagtcagagacagcagcattagacaatcctttaggtcacacggaaacctctctcattaaggaataacacggtaatgaaacgagcacctcttagaacgatggacggcaaaatgccttggcagcggcttccatatgcactatcagcgcaacaacggcggtgagaagagaaaaacgaaaagggataatggacatcttgccttgggatacaggaaagttattcaaaaggaaagagtaggccaagaggcaaaagacccgaccaggacagcaagggcaatactaaccgacagcgacggacacgacacccgagcaaggataggagcaagaaacacgggacacgggcgaaacacgcgccaaagcaacgaaccaagataatggggcgagacaacgatacaaagaaaggcaagaaaacaccaacacaaagcacacaccg

SEQ ID NO: 694027 - DNA, 601 bp, Homo sapiens
gcatacgtacggtgcgcgagtcgttgtagataagcttatcattggtcagtagctgtgacctagtgagatctaggctcagtgcacgagcgccgtggattgccatcaattccatacaacgctccggcggcgacccggacgcgttctgaacggaaatccgagaatggattttcagagcgtcattacgtggactctatcgacactgcgtaggctccgaaggtccgaaacttcagattattcatcaattgtacgtccccctgtcccctgaccgcggggacctgaaggccaggacgcgcacatccgaatgccgcgaaagtgccacataggaacacatagttcaaacaaagtatcgccgacgacaggaacatccatacaatgatgaaaatccattgaaccatacacgagcagcaacaaggacagagataaaacaatacacacacatagacaggacgcaaaagagcagcatgacaacggaaaaatccacaagagagggaaaatcacgaaaatagacagaaaacacaagcgtgacctaaggaagcaagcaaaaaggaaacagaagaaacaaagatcaacgacaataacggacatgagcaccgaagacgaa

SEQ ID NO: 694028 - DNA, 357 bp, Homo sapiens
attgttataactgtgcaagaatacaaacttacagatataaggaaatacatctgaggatctactgtacatgcttggctgactgtattaaaaatgccaccatcatatactaagaagtgtgctaagcattggcatcaccaaagaaaaagaaaaaaatcgtatttatgtggagtgatggatgtgtcactcagcctgattgtgataatcatttcataatatatgcatacatcaaatcgttacattgtatactgtaaaaatatgcaattttgtcaattatgccttaataatgctgacaacaaaacacataaacaaaaaactttccctgctttaacgggtggctaagctagccctggtcacatt

SEQ ID NO: 694029 - DNA, 147 bp, Homo sapiens
agggagctcgcgcgcttccacccggtgtggcccatgtgaagccacgtccttcatcctcagggctgagcggccccaagccaggtactacgtccaagtggctgctcatgacctcacaaactacggtgaactgagggactgtagtctccc

SEQ ID NO: 694030 - DNA, 660 bp, Homo sapiens
ggctgcggtgccgcgggactgtgcagacgtgtgaaccgtgtgagaatccctaaggcggggaagcgcgatcgtcacgtgacagtgcgagaaccccggcgcggccttgtacctttgcattgcagactgtaattaaagaatgccatctcgtcatactgtcgctgaagagccaaaccttagatgcagaaacagatgtgttatgtgcagtcctttacagcaatcacaacagaatgggccgccacaaaccccatttggccctcatgacagggttgagcaagtgtttaaagcgttctgcaaaaataccatgaattctgcgagggctcaacttcaagacctgttacgaggtcgtcatatctgcccaactgaagaatcatgcgccttaaactaccaagagtcatgtgtatgtccccgagtcgagccaggtgggtgcgcagttgggtgtcgtagtgaagcgtttattgcgagacgcctgacaagttctgttgactccgccttgttgtgactgcttgctcgcaaaacctttatctatcttgacgtgtcgacaacatctagagtattgcaacgagttgcacttattttaaaccttgtgatggttgggctggtgagcaggttatgggttctctataaaggtgtcttaaaaaggttgattctgttatatgagcc

SEQ ID NO: 694031 - DNA, 170 bp, Homo sapiens
aagcgttggtccatccatccatattatgacagagctcgttgatctaggtattcctctactagtgctgcctacgtcttactttctcactgtgccctctttcgccatataccccccttaagtgtaggggtgccaaggtgtgctcaggcctctccttgaacaacactcatccc

SEQ ID NO: 694032 - DNA, 179 bp, Homo sapiens
tcctggggggatagagtctttctctggcacccagggcgggagtgcaggggggcgacctcagcttacgggcaacctctggctccgggggtccaggtgattctccgggctcagcctcccgagtagctgggattacagtcaggtgccaccaggcccagataattgcgggactctaagaagag

SEQ ID NO: 694033 - DNA, 1704 bp, Homo sapiens
gcttgtctttagtagtctctcttatctgcttgtttgttttgtgggtggtggttggtggatggtgttggttgtgtggtaggctctctggtagcggtctctcggctttgatctagctttgttgtgtttgtggttgtgtatgtgtgctgtcttgagttggctgtggtgtgtgtgtggttgttttttgcgggcgtactggtgcttgtgggttgttggttggtcgtaggcggtcgtcggtcgtgggtggtgcggttttgtttttagttgtttgtgttgtttgtgtgggtgttgggtttctgtaccttctgggttgtgtcgtagttgtttggtggtgtgtggtggggatggagggggttgttgtatgcgtcgtggggtctgttccggcgccgtccgtcggtcagcttgcttgatgcttgtccacggcgattggcgtgtgtggggaggatcttctcgatcagcgtccgacagtcgtctgtgttgttggtggtggtgggtggtgtggtgcgttcgacaactaccgacaacagctgcggcatcgtcgtcgaggatggagggcgacgagggaggacgagtggacagggagcgtgtgcatctgtgtctggctgcaacaccgacaccatcatccacatcctcatcatgagcaggtggggtggcgatcgtgatgatgttgaggttgaggagtggcacgagcatcaaccacatcgactaactactggtgtataggtctagtagtagataggtgttgtggtggttgttggtggtctcgtctgggtggtggaggaagaagcagcagcatcctcaatcatcaactccatcagcagcgtcgtcgcggtggtgttggtgggtgggcgcgcggtgtggggtgtccgtcatgtcgtgctgcgctctcgtcactctctgcgtggtgtgctctctgtctcgttgtcgtggtgtggggcacgcggctcgcgcggtgggcgtcttgttgcgtgtcgtgttgtttttgtcgtgtcgtccctgcaggggagagaggtgagtgtgttgtgagagagagataccatctcttgtttttttttctcgcgcgcgccacacacacacactatatatatagtgtacacacacacacacacacacatatatatatattgtgtgagagagagagagtattgtttgttgtatgtgtgttgttgtgtttgttgatatatgatagagagagagatgtgggatgagatatatatagagagatatgatatatatatattgttttgttcatcacacacactctatttctgtgtgttgtctccgaccgcgcgcgctctctgtgtttgtctcacacacccgcgcgttgtgtgtgtctctttgtcgcgtggctgtgggggtgcgccgccctcggcgggttgttgtgtgtgtgtgtgtgtgtgaggtggtgtgtgtgtgtgtttctctgtgtggtggttgctgtgttgtgtgtgtgtctctgtgtggtgcgcgcgggtatagtgtgtgtgtgttgtttcacctgctgttgtgttgtcgctcggtgtgcgagctcagtgtccaccgcccacacataatgtataatatagataatatatatataataagatatatatataatatatatatatatatatatatataaatacaagtaagtttagatgaaggggtataattaacgatcgaaggctagtgtaagctcgatggacggagttagagtattgtgtccta

SEQ ID NO: 694034 - DNA, 363 bp, Homo sapiens
ccatgttactagtatcttgtactgtaggcatttttaccatgtgtatggattatacttaccaaagaaaagaacaacataaatgaaaataactaaaagttggaggaagtaaacgacaatctaaacagcagacctcctcagcctactttctccccactggctaaattccacaacctcccagaacaacgccactgtcctgggggcaggtggatggtcacctccttcccttggatgcaggaagttgcccaaaacaggatgggcatgagcgggacacttacgggcctcggggcagcagcacttgtcttgggccgcagagggacctgaacgtaacaacagccagtgtgcggggcagcactggcaccagca

SEQ ID NO: 694035 - DNA, 563 bp, Homo sapiens
tggattcaaaaagggcctaacctttatggccaaccggctgccaacatttggccatacgttaaccctacctattaggcagatttccacttttaccattaaattcttccgagaaacaaatggggaggagcggtacaattccatttaggacttataatttatgtccaaggtggatttggataccccttttacacattcagcgtgcaggtgtccctttatatatcagtgctagttgtgtgagcacatatttgaactacctggggaccagttcgatatatggacacccgtcaatctataagaaaaatcaacagttttgggccccaggtccaaggtgaactttctcagggagttgcagaattcctcaaagtggccaaaattactgtggctctttttaaatatcctgaacattaacttatttagctacatattgccggacaacgattctctctgggcataacaatgcctctgcttcaaaccttcatttcaggaggcttccccttccccacccatcattaaccttctcaaaagctactccctccctctaagtatcttcacacagatattct

SEQ ID NO: 694036 - DNA, 714 bp, Homo sapiens
gaaagaatctactgttagaagaagatacagtgactttgaatgtctgctaagtgacattagaatagagagagctgggtcgtagttcccccgcatccctggtgaaacgcgttattgtgctgtcagcttccattttagacgtgagtatgatcgtgagatattgtgatgactacaattttagttgcacggaataaggaatataacaagggcttgtgcagacagattctaatataaccaatatgtgtcagcctgagtcaatctctctgggactaccaagaacgaaacctgttgtccattccatccattgtcttcctgtagccacagggaaaatgcacagcactacatctacgcactcaaacgacaatgcataggttactctttccgcgaatttccttaatacccaccatttttaacagggggaaaccattgggcccctgaacacatttttgcgcggcacacggaacaggcggggggcaatttacacagtgacccttattacatgcatttggataatggcaatccagttgatatgaaagtttctacatcttttatggcatgctgctacaggaatattgctataaagcatggcctttcagctatttctaatcactcatgatgctccaggttcgagtttgggttctgggccagttccgatcgaaaggaaaggctcttaaaattcttgggggctttttttaaaggctttaaaggggaaacttc

SEQ ID NO: 694037 - DNA, 424 bp, Homo sapiens
ttactctgtccatttatccacaggaaagtgttatttttcaaggaaggttcatgtagagaaaagcacacttgtaggataagtgaaatggatactacatctttaaacagtatttcattgcctgtgtatggaaaaaccatttgaagtgtacctgtgtacataagtctgtccatacactgaaaccttatctgaacttatttatgttaaaagattttttttaatctagacgatatacaagccaaagtggcatgttttgtgcatttgtacctgatgcgttgggtagaataggttttcccctcttttgttaccccctatggctatgcttccaaggttgcatactgagccaagtatttttttttgtgatgtgtaaaaaacatgcccattattgtcccacattaagtaatcaataaagaaaacttccatagat

SEQ ID NO: 694038 - DNA, 1135 bp, Homo sapiens
gagaacttgccggacatcgccgtcatggactatccgtgtgatggatgatgcagcaatagataatggtaagcgtctgcatgattcgtgtcgaagacgatgatgctgataacctccaggagtccctgtcggctagctagacgcagctagtcgagggggacctcgcacgagcttccgcagcagcttcaggaacatgcaacctcacacggaccacagcacacaccatacacacaacacacgctcacaaccaccatcagaccaacaccaacaaccacaggccacacagcaagagacaatacccagaaccccacgaacaacgaacaacacacacgcacagtaaccgacagggcaacacaagccacagtctcgacaccagtaacaagacacgacacagtcacccgcagcacgcaacccaccacgccgagccaccacggcaccacaccacacgcccaacgcggccccacaaacaacacaacgcccagcccacaagagcacagcaaggacccaaacatcacagaacaagcaggaacacaaaacacgacaaacgaagtccgacagcaacacaacaaatacaagcgacacacccagacgcccaacacacaccacgacgagccccacagcacagaccacacaaaggccaccaacaaaccaccagacacacgccacgccgcccgccccacccgcgcccgcaccagacaagacaagccacagcacacaggaaccacaaagcagagacacaacacaggcacaacgcacccacggagccacgcagccacaccaagcaacgatcaaagcagccaacccccgaaagacacagagccagcacagaccccgaacaccaccgacagcacagaacccccacacgccacacacccaacacgccacccaaaccacacacaccaacaccacgggaaaccgcccgaccgaccgaagcagagaacgagaccgacacaccacgccgcaaagagcgagcgaacaaacaaacgagaacgaggccagacgggaaagaaacacgaccagcccaagagacagacgcaagaggaagacccacaccgaacaagaacagggaggagcaagcaacgacaaccgaacgccaagagggcatcggaacaaagaaagaacacaaagaggagaaaaa

SEQ ID NO: 694039 - DNA, 105 bp, Homo sapiens
gtgaggtgcagccaacgatgcggatgtgctacacgtgctttctctcaagctcttgcgtaattgcgtccaggaccaccttatggtatacaaatactaaaaacttct

SEQ ID NO: 694040 - DNA, 427 bp, Homo sapiens
ctagaggatctccgcagaggcacaagggaggagaacaagatcagcaagcgggaattggaggtaggctatcgtgaatggaatccaaggaggagacgccaggcacagagtgggataaggtggcccagttgtgtgagttcagccccaagagcagaatgcagatgaaagatgtgtccggcttgggctcggtgtctcatgtccctgaagcagacgccactgtccctgtagttgcctgttaggtgcatggccacagagcatgggctggtcctgggcacaggaggagcagctgcttgggtcggggtggagactcgcgaggagctgctacccatagcctattccagtcgtccccatctccaggctgctgggaggtggtgcctcacccgatcaaggcctcgtttcccctcctggccctctggtccagcccctcacg

SEQ ID NO: 694041 - DNA, 207 bp, Homo sapiens
cactactacctgagagacatgctactcccgagccggagacggacccacgcgtgacccgggccacagtacttcatatcgagatgcgttatctgaggctcagcactgccagtggagatgggcgtcactactgctaccctcatttcacctgcgctgtggacactgagaacatccgccgtgtgttcaacgacctgccgtgacggtcattca

SEQ ID NO: 694042 - DNA, 419 bp, Homo sapiens
agtgagaaaaatgtttagctgtgaagaaaaatgcatgtcattaaaaaaagtttgataaatttaatcccattccaaaaaattatccccccttccctctggaaaaaaactataaagaaagtgggctgaggctgtgcaaggtggctcatgcctgtaatcccagccctttgtgaggatccgttgagcccagaaattggagaccttcctaggcgacaaaaagagaccccatctctcccaaaaaaaaaaaaaaaaaaaaagaaagaaaatgggctagagataaaaacagccaattcagagaacatataatgtaaaagtacccttacttaatctcttgttcccaaaaaaagaaatgtaattaaaactaccctgaggaattgttgctcccttatcagatgggaaaaaaataaagatgtttgccccca

SEQ ID NO: 694043 - DNA, 166 bp, Homo sapiens
tttggggcactaataaatgtccatgaaatcttcacttgagcctgggaggtggaggttgcagtgagccgagatcaagccactgcactccaacctgggtgacagagcaagacccttgctcaaaaaataacactaaaaagtctctctggtaataaaatttgtctggagt

SEQ ID NO: 694044 - DNA, 384 bp, Homo sapiens
ggggcccagggtcaaacagcggcagaggctcccgggcctgggagtgggtcctgcctggccccgtgaggctggggacggcacagtcagctgcctcggggacatggggcacaggggtcctctccgccgccactactggccctgcagctgctcccaccgccacggcccacgacctccttccgccacagccagcgtgatggcagcagctgctcccaccgccacggcccacgacctccttccgccacagccagcgtgatggcagcagctgctcccaccgccacggcccacgacctccttccgccacagccagcgtgatggcagcagctgctccgggctacaaagaggcgatgctgccagcattgtgacttttagaaagggaaaccaaaa

SEQ ID NO: 694045 - DNA, 497 bp, Homo sapiens
  misc_feature (7)..(7): n is a, c, g, or t
  misc_feature (9)..(9): n is a, c, g, or t
  misc_feature (25)..(25): n is a, c, g, or t
  misc_feature (31)..(31): n is a, c, g, or t
  misc_feature (53)..(53): n is a, c, g, or t
catggancnccccttggatagaacnccattngtatcggtcagcgcgccattgngttgataccccggaattcggccattatggccggggattcctgttgctgacagcttttcggccgagatgtctcgctccggggccttagctgggctcgcgctactctctctttctggcctggaggctatccagcgtacctccaaagattcaggttaactaacgtaatccaccaaaaatgggaaggcaaaattcccggaatggtatggggctgaagttcattcattccacattgaagttgacttactggagaatggagagagaattgaagtggagcattcagacttgtctttcagcaaggactgtgctttctatctcttgtactacactgaattcacccccactgagatgagtatgcctgccgtgtgaaccatgtgactttgtcacagcccacgatagttaagtgggatcgagacatgtaagcagcatcatggagggttggtgccct

SEQ ID NO: 694046 - DNA, 141 bp, Homo sapiens
tggtttgtttttttaggggcccccccccccctttcccctaccctaagcccccctaaggccttttcccaacgggagggggttaaaaccaggcctggtttttttaaaatttcttttgtaaaaaaaaccctttttagtggggga

SEQ ID NO: 694047 - DNA, 143 bp, Homo sapiens
  misc_feature (1)..(1): n is a, c, g, or t
ntcgagctcggtaccagcaggggtggcgtggtgtgttgtggggtggacagattccagcatcacccccaactggagatgtacaggatctcagacatatttccatgggctataaaatgaagctgtacttctcagtactaacccct

SEQ ID NO: 694048 - DNA, 361 bp, Homo sapiens
  misc_feature (260)..(260): n is a, c, g, or t
  misc_feature (340)..(340): n is a, c, g, or t
  misc_feature (347)..(347): n is a, c, g, or t
ggggaacggaagtgtcccctccttgttgcccccaggctggagtgcaaatggcgtgatcctgggctcactgcaagccttcgcctcccgggttcaagtgattctcctgcctcagcctcccgagtagctgggattacaggcatgctcccacccatgcccagcctaattttgtatttttagtagaaacggggtttcaccatattggtcaggctggtctcgaactccagacctcaggtgatccgcccacctcggcctcccaaacngctgggattacaggcgtgagccaccgcgcctggccagggactatactctttttaaaatagacatttgtggggctcacacnatatatnttatagtaccctct

SEQ ID NO: 694049 - DNA, 860 bp, Homo sapiens
  misc_feature (46)..(46): n is a, c, g, or t
  misc_feature (259)..(259): n is a, c, g, or t
  misc_feature (266)..(267): n is a, c, g, or t
  misc_feature (564)..(564): n is a, c, g, or t
  misc_feature (765)..(765): n is a, c, g, or t
  misc_feature (786)..(786): n is a, c, g, or t
  misc_feature (788)..(788): n is a, c, g, or t
  misc_feature (792)..(792): n is a, c, g, or t
  misc_feature (848)..(848): n is a, c, g, or t
catttttagcctattatccttacttatgcgttaggctgctacattnttgtgtgcgacaatttaacttactacacacacctggtgcgagatcacaaaccttctgatacatttatgagctttagaatgtaactgggaagtgtagcacagccctttgtccctctgctttgcatggtgagagacggctaaagcaaccatcgccgcattctgttttatgagcgcaaaggaacacctattcttatctgggccacgcgcccgggtncttaggnngatgccagacccccctgggatggcaatggcagaggctgcgcagcttcctgaagatgtggtccacagcaccagccccgggcagggagcgagggcaagggcgaacgacagattcttccggagacagcgcagcaacccactgatttgtgtgctcccgcacccacaaccgtgttgcactgggtgcatgtgacgcccagggtgagggaagtggaggcctggtctcacagtgtggaccggctgcgggacaagaacacagttaactttggctttgcttgggaagctgcttcagaaacataactnccggcccctcctgaaaatgatcgttttcttagccggggccctgttctttaggagaggtttactgttagagcttgctgttcttttgaaactgggccacttggctgaggacctgctcagaggctttgatgatcttggagccgaggtaggaggtgctgttggggcccgttttctccagggagttgcggtagttggccatcaggncgcagaggcgggtgatgcttntnaggntcacatccgccatccagttgaagcgccacaacaccgccccgttctgcaggtggganttgggcacgggg

SEQ ID NO: 694050 - DNA, 217 bp, Homo sapiens
agaggaccccagtgtgctgggggctagaagattggagaagaaatactccggtatggagtggtatcggggggggtattttttaaaaaatttaatttagcattcatattttccatcttatccccaattaaaagtatgcagattaatttggcccacaggtggtccttcttcttcagtattcagacatttggttcttgtgccaatccaacggggtaccgga

SEQ ID NO: 694051 - DNA, 860 bp, Homo sapiens
ggtgttaccggcctcaaaagtgacagtaactgtgcccgagcatatgcacagggtatgaggccgaagcaagtactgggagttgatttatgaagactctatggatctagatcgccaaagctagccttgctgttgcacgctagaagatctaccgcaaatctctacagagaaggcatgcggtacttggggccatagactctaacctggactggtctcacaatttcaccaacatgttaggctatacgtgatcatcagttcagctgagctcacggcgcctgtacctcatccagtccacacgatgaccattgagggtgcgcaatgataagtgcccagtaccagctcgatttggatgggcagtgcctctttccgacctctttaccctgtcctttgcaaggctagccagtgaacgtgtgctgtgcagggccatcgtccatcggactggcaaactcgaggagagctgcgttgtcatggcctaacacagacgtgcagacacggaagtgggccacaacgatgtgctcagactgagaacgtcagcgagcatgtatcactcgtgggacacgacacgtcaagctcccggtacggcgcttagtcccagggctatggccattgcacgtactacacggaatgacgtgaatcctgcgataataccttgcacatgctgatgacgtttagctcctgaaaacaccgtgacctgagattgaagcgccaatgtctcaaaggttcgggtgagcatcaggcctgtaacaaagaattgggtgtccacaagaggttccgtctcaagaagcaagggggataccaagccaatgcaatccgttggacccaatctggtaggaatggctcacagtagggggttggctggtctc

SEQ ID NO: 694052 - DNA, 1128 bp, Homo sapiens
gggaggctgaggcaagagaattgcttgaacccagggaggcggaggttgcagtgagccgagatcacgccatgcactccacctgggcaacaaaagcaagaactctgtctcaaaagaaaaaaaaaaaaaaggtgtgccagggttttgaggttaatttagattgggttctcttctccagaaggttaaccttgccaagaaagagaagtgctattagcattgtttacctccttattacgtggtaaaaccattgtggtgaacactcagatttacgtttaaactgtgattgtttttcccaaagtttattgccaaaaaagcaggtgtggtgacttattggaagccccaggggctttattattccccaaagcctctgtgttcttataccctataaatatatgtgggttcacatgtgtgtttctcccactctctgtggtccatataaaatgtgggagaggcataatatatttctctccaagaccctgtgtgtggtgccctgtgaacaatgttgcagtgcggtctagtacgggggatttaaagacgcagaaaaacaatctgagtttgtggtaaacgttatattgtccgtgttacagaaagcacaaaacgcgtggcgtgggtataaaattagaagggggggacctaaagttgtgagcagaaaaaattagaattttgttgtaaaaagaaacccataaattacagaaacgaacacgttcttgggtacactcttacataaacgttcgggtactttcccaaggattacaaaagggatttgtttccaaagaaagaaagacaaagaagaaaaagcggggagggtggcgaccgcattacatgaaaaagattaatctcacccacagtaagaggggggcgcccccagacggacatactcgccggcggttaccccccagaggtattatagtctgtggtctcacccaaagagggtgggtccccccccttatattatagagggaacaacgaacgtatacaataagacggcagaggagcgcgacagaggagcaagcacggctattttacaaccaacggtgcggtgaccggtgggacgaaaacgccaggcaaagcacagtgggggaaccacgatgagggagaagagaaaaacaatttacaatagtaggcggacgt

SEQ ID NO: 694053 - DNA, 216 bp, Homo sapiens
cacgaggattcgggccggtcagggaaacaagcaggtgggaaaggcgggccaggaacaggttgaacagtctaccctcccttagcaggaactactcccaccctggagcctccgatagacctcaccatcttctccttacacctagacaggtgacatcctctatcttaaggggccatcaatttcatcacaacaattatcaatatgaaacccccagaccta

SEQ ID NO: 694054 - DNA, 546 bp, Homo sapiens
  misc_feature (6)..(6): n is a, c, g, or t
  misc_feature (112)..(112): n is a, c, g, or t
  misc_feature (125)..(125): n is a, c, g, or t
  misc_feature (135)..(135): n is a, c, g, or t
  misc_feature (153)..(153): n is a, c, g, or t
  misc_feature (253)..(253): n is a, c, g, or t
  misc_feature (304)..(304): n is a, c, g, or t
  misc_feature (412)..(412): n is a, c, g, or t
  misc_feature (496)..(496): n is a, c, g, or t
  misc_feature (503)..(503): n is a, c, g, or t
  misc_feature (506)..(506): n is a, c, g, or t
  misc_feature (539)..(539): n is a, c, g, or t
gtctangggagaccctgggcccagtctgggaggtacagggctctgggaagggggcagtcctggcggcagaacccggcctgcaggggcactgggcttagaagaggactctccnagcgggagaggcngggaggggcngcatcaggccgtggagcnggttgcggtggtcatcagtatggctgcctgtccaggaagcgggaaaacatggggaaggcagccaggggcttgtcggtgggaaccatgtggccggcgcccntaaacgtgagaaaggcgaggggggagaactcctccacgaagccggcaatcngccccccgccgtccccgtatttcactaaccagggccggcgccgcacccccatctcctggttgagggaatccacaaaccactaaacccccaagaaattgcaggccaagnctacatctccattatataataggatccggtatttctgtaaacaaagcagcatcagaaaccgggagttcatgctttggtagaaanggcggtnctnttagtttaccagaaagttgcacatgttccattnttgcagc

SEQ ID NO: 694055 - DNA, 930 bp, Homo sapiens
  misc_feature (87)..(87): n is a, c, g, or t
gattctatggctagtatttggcacagtcgggagcggtttctggtggagccccaggaagacactcggcttgggccaagaactcagaanggtcttggataggttctatgacacacacatcaggttctcgatgcggcctgagactgggcagttgatcatcatggagacccgcaagaaagatggcacttggcccaggcacagctgcatgtcatgaacaacaacatgtcggaagaggatgaggacttcaagggtcagccaggcatctgtggcctcaccaatctgggcaacacgtgcttcatgaactcggcctgcagtgcctcagcaatgtgccacaggctcaaccgagtacttcctcaagaatgtacctggaggagctcaattccggaaaccactgggcatgaaggggtgacgatcgcagagggcctatgcaagacctggtgaaagcaggcgtggtctggacaccacgttcccattgtggccacaatgtgttcaagaaaccaaggtgggccattttgatcccaaatttctgggtaaccaacaagcatgatactcaaggagctggctgtcatttcctccctggacgggttggattgaggaccttatccgggttgaaggaaagaaaggaggtatgtggcacgctagtagcggacgcaagatgcgcgaaccggaactccagaacggttggaccaacggacggacggtgacacaacaccacagaaccggcggcagcaacatctgcgaatcgtgcccccattcacaggacattactacaaatcacaaacgagtatggccccacatgggcgcaaaggcccacggagaacagcacacagtgggataaccacaagacaaggcaatcacacacaaaggcagcgacagccacaacaccccagaccgcgcaacacaacaacggcgcggccccaaaggcaacacgaa

SEQ ID NO: 694056 - DNA, 426 bp, Homo sapiens
tgtctagagttcccaagcttacgaggacataaaaagttactcacagaagtatttattactatatggggtgggaatcaccaacttttgtgcaaacaatgctagccttcttttaagcattaagagcataactgcttaagaaatgacataagcaataattctacacctacatctcccctaaaataatctttttttttttttttacttttgtgcccggttttagaaatttaaagcccgagataaaggctcgagatctattatccaggggcaaaattcagagtttactagcacctcatcatggggagagcttaccattcagggcatctgtaatgaagcgcggcagttcccctctttcctatttttttaaaccacaaaattcaagtgactaagactttaataggggagtgacaattcacattcaacacaatc

SEQ ID NO: 694057 - DNA, 220 bp, Homo sapiens
taaccttgtctctgtcttctctcatgcttctgcgctctacttcgtttcctctctttcttcctttttcttctttccttttgtttctctcctttctttcttttctttcttctctctcttctttcattctctcttctttcattctctcttctttctctttctttctctgacttctttctttttctttctttcttttccttcctggtaggtatgatgaaggacg

SEQ ID NO: 694058 - DNA, 326 bp, Homo sapiens
aaaatccatctggaatcagaaaacggtggattttggcaaaagggccctgtgccctccccactcatccctggtttggtcccctgttggccctagccctttaccctaagcaccacccccacagactggggaccagcccccttgcctgcctgtgtttctcccccaacccccttaaatggggaaggaaaaggaggaaaagggagggggcctgcccccccctcaggcatttgggagggccccgcccccaagggctttacccttccctgcggggtctttccccgacacatttgttaaaatccaacctgaattaaactacaagtttcaaatta

SEQ ID NO: 694059 - DNA, 327 bp, Homo sapiens
gggggaggggggggggggaatttttttggggaaacggggccccttttcccccccccccccttttttcttttttccaaaattttaaaaccagggggggggggtttccccgtggccccttttcattttttaagggccccccccaaatttatttttttttttttcccccccttccccgggtttttggggggggggaccccccgccccccggggaaaagggggggggttttctttttttttggttggcccccccccccccccccttggttttgccccccccggggggggtttgttttcccccccctttttagggggttttttgggggggta

SEQ ID NO: 694060 - DNA, 109 bp, Homo sapiens
aggaaagatgggaaggggagagtgggcggaaagaggagagtggggttacgtgccctagcttcagatcagccgaagatggtacatgccattctactgtctctaggtcaag

SEQ ID NO: 694061 - DNA, 647 bp, Homo sapiens
atgagaattcagagacgtttgaaggctgctgtgtgcatgttggggggtctgaaaagacagttgtgtgcagtggatgtgtgcgtggaggagaaagaacgtgggtaagatgtcccttcccagtccctgatagcactggtcacagttggccacctccaagcgggagaccttgtccttgtggctagagtcctcccacccttggggggctcctgcctgaggtcctcagaatcccactgcaatggagcccaggcagcgccggcaggaagccatgctgggtccccggcagggactatcccataagcagtggggcacgaagggggcgacttgcctgcccctgtaacccttgttccgcattgtgcccagtttgcattctgcaggttttctcatttaagtgggttctgctttctatatttgcagagacagagcatgtgtcttctctgatccgtttgccaataggtaaagccagtatcagttagactgcaatactttaaaacacgaagacaaaacaatccatatgtgagggaaccaggaaaagtcccgctggttcgtgtccctttcttggggggaatgcagggcctccgaacagtgtccagttcccttgaacgtacttttcctccccgagaaaaagacaataggaacagggatcaaca

SEQ ID NO: 694062 - DNA, 363 bp, Homo sapiens
agctatagagggtggcatcgcatcatggaaattttatcaactgaaatacaaatgtggaagtcaagtggaagagatcagtggtgtggctgtttatattcaaccaaaaattgttcgcaggaactgagaggaaggcacaggattggtgtaagatgtatcgtggagccctatggctagaaacttaaatagtccctggtggctaatgcttgggggattggtggggtgagtggccgtcggtgtccctcctgcactgtcttgccctcctgctctatacactcctgttccttattcctagcgcattgcttcctgcagaatttgtctcctcctcttgtattcttaacctcctcacagtgactggggggatct

SEQ ID NO: 694063 - DNA, 1530 bp, Homo sapiens
  misc_feature (1530)..(1530): n is a, c, g, or t
agcgtgtggggtttgatgccgagccgggcgccgtgagcgttggaggcggcgtataagccgactcctggtgctctaggatgagctcgtggccaggcatgccagggactcgcgggggcgtaacgaggtgcctacatctcatcgacgaagtgcatcggggaagtacgacggatcgagctggtgatccttgcgttgttccctgcgttggtctggtgatacgagggacgccttcagaacaagaacgccggcattccgaattctctcctggtgcgtggaagaacgcgataccatagctactcgaaacttgcaggatctgtatagacgcattgtgtacgcgcggtcaatcttgctttaaacacacgagcgattagacgcatttgtgcttattcgatcccatgcagatttgtaaccgaacgtaaacgatctcgccgaagccatgaattagcgtggcttgggatatagccccattgagaaatgcccctacccaataggtagattcccgattccccgcggttttgcttctcatagagaagcagttcccccaatccaagaggtatgtcacccacggatagtttgatcggcacgggtcgacaatggaaagcatctcgtattgcgcttgacgtgcatcgagcgcactgggggggcgacttgggttctacgttgggtctgtaacgtacccgtagcggctaagaggggagcgtcggtttcatgattgcaccatcggaaaagggcacttccgccgtccagattgggtcccaagggcaaacttcgttcgtgcccaaagggccactttaggccccatttcgaaaggagccggtggtcgattttgtatcgttctttggggaagccccagtttccttggaagttttggtaccccagcacctctttcccacgttggccgtacataattttcggcgaaacgattcctccattctaaaagagtggaatcgggtcattaaggagggtagaaggggggcagggccggtttttcataaaggggattaggccatgggggagtagcgttcatttggaaagagagggtgttgaaagggtgaattatagactgggggaaaggtgctcatttcgaaacacgaagttctttgcgcgacacgtttcgcaaacgttagggcgttgcatgtatatcacctttgggtggctttggtattaggaaaaggagggtatggtacgattatttggctagtgagtgggttttcacaaaagttataaaagagaggtttcacgttaagtttccgttaaggggcagtattcattcttggatcgaataagagcttatggcaggaatttaaacacaagtaggcttgtttgacaaggccgaagcctagagggatcccaggggggtaatacagaggtggggagacgaatagatttgtctgtaatcgagaagataagagagttggcggagcggatatgatgataagccacacatggagatatgtgggtgatgagagcaggcatgtagtagctttcaggagagaggatccaaactgaatcgcatatagattgggtggaatn

SEQ ID NO: 694064 - DNA, 269 bp, Homo sapiens
tgactacaaaatgcgtctggctgcatacgtgagaacctgcatgtaccggggggggggccagcggaccatccagctgtgtttccagagcagtgagctggtgagctgggcagactggggcccagcgacagcagcatccacccgagcctgaggctacaagctgccctataccaccccaatcccccaggcaggaccaaaatacctccgtcgagcaagaacccaagcccacttccaaacctgcctgtcccaaaccatttactccccggtacatg

SEQ ID NO: 694065 - DNA, 606 bp, Homo sapiens
  misc_feature (568)..(568): n is a, c, g, or t
  misc_feature (582)..(582): n is a, c, g, or t
  misc_feature (597)..(597): n is a, c, g, or t
cacactgagctgcaggagagctcatcttaaaatcaaaaaggtttgagcaaaggatgaacacaatctacagtcagattatgtcactcctttgcccagaccttcttgattgcttctaattgcacatagaatgcatcatccttcatatggtttgtaaaaaccttaaatggtatctggcttcatacttattctagtaccagtacatttctgtttcctttttaccacaggaagtcctttctttccttggacatgttacatttctttctttctgcagtgtcctttgcctggaattcttttcttccagcctttagctgattaactgacgatcgttcttcagatcttgatttaaatgtaactttctcaaagaggctttcccagaccttccccagtttcagttgttttatgttatactttctccctgtaattttttttttcaaattattggatcacattttaagattgcatttattgaataaatgaaagaaacttggaagaattttagaactgaactgaaattagacaggctagcatttggacatgactcctaagaatgaagttgtggattttaganctttggtggcttgnttgaagaatacaccncttgtaaat

SEQ ID NO: 694066 - DNA, 371 bp, Homo sapiens
  misc_feature (46)..(46): n is a, c, g, or t
  misc_feature (60)..(61): n is a, c, g, or t
  misc_feature (72)..(72): n is a, c, g, or t
  misc_feature (74)..(74): n is a, c, g, or t
  misc_feature (76)..(76): n is a, c, g, or t
  misc_feature (233)..(233): n is a, c, g, or t
  misc_feature (254)..(255): n is a, c, g, or t
  misc_feature (259)..(259): n is a, c, g, or t
  misc_feature (263)..(263): n is a, c, g, or t
  misc_feature (307)..(307): n is a, c, g, or t
actacatacttccgactacatactccggactacatactttcgagtnctaagggaccatanngagtattcctngntncacaccaggaccagccactgttgcagcatgagttcccagcagcggaagcagcctgcatcccaccccttaagtttaagcagcggcaggtgaaacagccttgccagcctccacctaaggaaccatgcatccccaaaaccaaggagccctgccacccaangtgcctgagccctgccacccnnaagngccngagccctgccagcccaaggttccagagccatgccaccccaaggngcctgagccctgcccttcaatagtcactccagcaccagccgagcagtagcccaaacaatctcat

SEQ ID NO: 694067 - DNA, 953 bp, Homo sapiens
tgaatcttttactgtatacttgcagatcagatgtggaagcaaaatcttgggaagtttggggaagccctgaggcccttgccagaggagagaaaaattgcgtaaggaagcagaaatagaatacagagacaggctatggtagaaaccaagacaaatataaagagaatacagaagattgcttgggaaactaccaagccacgctccagaaagagcatcagtgttttttaagggaccaggaaaagtggtgatggttgcaatttgcgtcaatggattaaactgcttctttaaattgcttgcctggatatataccggtatcagcaagtatgtctcagaagctatacactcattatctgatacttgtaatcagggtttactagcatggggcatcagctaagtctgtgcaaacaccagatccgttctcatccgtcacggattttgcaaatatgcgctatatttcttcgactaatgagtggtgtggaattcccatgatgggtgcaggactatcttggtaccatggagtcagtgcgattgcttcgatcctcaaccaatagaatcccttctatgggcatatcgtatacttagcaggatcatcagtatctgaaggaagcaacacttcttgttgctgtaaatgaacttcgtaggaatgctcggctacaggactgtcactttacccccggtctgtaattggaaaggcgggaatcctcgaccaaatgtgatattaatggaggagtcaggctgaccttagaagtattaacgccggccctggaagggctcaaattataagggacccaggtttgaaaccagacttggggtgggccaaaaagagtgcgcgccccatacatgcaagggcggggggacaccagacagacgacccctgagacccagagacagtatgacatgcagaaagtacaacaaggatatacaagagaggaccagaaagacagaatcaccaagaa

SEQ ID NO: 694068 - DNA, 203 bp, Homo sapiens
gagaagaatccaactattggaaatttccctattacaaatgtggagctgagaggatacttgtctgacgaagtacaagcagtacacaagaataccacctatgacctcattaccaacatcgtgcatgacggcatgccctccgaggttcgctaccggtatccacgttgcttcatcatggttacaggcaaatggttatgaattacaag

SEQ ID NO: 694069 - DNA, 123 bp, Homo sapiens
atatagctggctccatgtatgaaaaagaaacggtcgcgatcttctaaaaaaagaaccgaaaacggagtgggagtggcaacttcccaatatgagtagactgtgccggcaaagaggaaagagaga

SEQ ID NO: 694070 - DNA, 397 bp, Homo sapiens
tggcccgaggaaatgccagcgtcctagcaattcccttggttttgggtcagatgaaaaagcttggtttttttttaggaactttggtgcctgaacattataagtagatcactgctttatttttgagctgttccccctccatgaagctttcaaatcctgcatcctgaggatccagatggatgacaaggacacagggctgccattgagaaatgaaaatgaactgtgtcacaaatgcagtggattaatgactgcccttgtaatagtccattttgtatttgttggtaattcattgaggcatttttggttttttaagagtttggattttttgaattcaagaattgtaacatcactgttagatccctccttatttaatgagagaaataaaatatttggcccggga

SEQ ID NO: 694071 - DNA, 287 bp, Homo sapiens
gcgtcgaccattgattgtgtcccaatagatttcatagaggagcagccagctgagtaggcatcctttatggctgtggcctctgccgctgccaatgaatacctcccctaccacggtcctggcagactctgtcctcccatttgggcctccctggaaggccacgccccttgaataacaagccacgcctcccccattgccagtccttgcccatcctcaggccgagcccctcatttgcccattctctcagtcagaagcttctccattaattcactttagcaggccgtcgacgc

SEQ ID NO: 694072 - DNA, 267 bp, Homo sapiens
ccccccttttttttggggcccgggggcaccggggggggtttttttttgggaaaaccgccaattttggggggttttggggcgaatttttttctccccccccccttccccccccccccctttgggggttggccccttttttcccggggggccccccccttttggggggccccgggtttttttttccccccccccccccccccccttgggttttttttttttttttttggggggggggggattaaaaaaagggtttttttgcccggggta

SEQ ID NO: 694073 - DNA, 151 bp, Homo sapiens
agagatctgtaaaatgtgatttattacttccactatataatacttgtgacttggggaggattgtgcgcaattcaattatgatgaaaaacctatctattatgtaatgttggcatacttgagggaattatagtggcaaatacattccccagac

SEQ ID NO: 694074 - DNA, 114 bp, Homo sapiens
acccttgcccaccgagagcgtcgcccgccgaacaacgtcgcatcgccgccatcctgcgccgtcgcgaccgcggaaatcaccgtccacagctgtgactgattccgcctattccgt

SEQ ID NO: 694075 - DNA, 148 bp, Homo sapiens
ataaagggcactccatagcagagacagactcctgtatttttattccagatgcattgtcttggtgattattaaattataggaaattgagtacaatagatcacggaaaaggcaatagacagggtaagccattctagattgttagacgtac

SEQ ID NO: 694076 - DNA, 479 bp, Homo sapiens
  misc_feature (224)..(226): n is a, c, g, or t
ggccttcagtatcgcggacggaagatggcgtccgccacccgttctcgatccagcgtgcatgcgagtaactggcgcgtccgggtgcatagaccgtgctaggggcaagcttgcagcttacgtctacccaggatgatctcgcaagcgaacttcagccttccttcccaaaggctccctgtgttgaggtccctagccaacaaagcttcttccaacaaatttaactatgnnngcactcgcgattggccggccggcggacatctggtggcccccttttccattcattcaatgtcggtcggcaagaaggggcgctggttgtcaggggcaaggcacagcaagaagacgctcgtgctggatagctggccactggacgaagacaggcgggtgaactccaggttccttcccattaaagcaggtggggagcctgtcctcgggaccaagccttacctggtgaccactggcacctctcacggccacccgactta

SEQ ID NO: 694077 - DNA, 348 bp, Homo sapiens
  misc_feature (160)..(160): n is a, c, g, or t
  misc_feature (246)..(246): n is a, c, g, or t
  misc_feature (304)..(304): n is a, c, g, or t
ccaactgatcacaccttggtacaagaagcgtatattagagcgacgtgtagtctaactgaaacaggctttacagagcaaataggggacgccaaaccaggcagtgtacaccacacccatgctgcctacagagaaagttaaacaccaccaaaccggggtagcngtatttaaacaaacatagaggtatggtaagccatggtatgggttaccggcctatgagcactgcctatatacaacatccatttaaanagctgaactaaaaaaaccatgatggtgcttaagcctaccgtgttgttgcggccgtctntagtggccatccagagccaaacttggccttataataccgatgat

SEQ ID NO: 694078 - DNA, 297 bp, Homo sapiens
gtcgacgcgtgactaatccatcagaagtatactctaggggtcaggcgtggtggcttacgcctgtaatcccagcactttgggaggccgaggtggatggatcacctgaggtcaggagtttgagaccagcctggccaacatggtgaaacccgtctctactaaaaatacaagaattggctgggcgtggtggcgggcgcctgtagtcccagctactggggaggctgaggtggagggatcgcttgaaccaggaaggcggtggttgcagtgagctgagattgtgccagtgcattccagccctgg

SEQ ID NO: 694079 - DNA, 995 bp, Homo sapiens
ggtgccggagctgctgctgctgcggcgcggatcggaggcgcacctggtgaggtgtccctgaggagagggaggtgggtgcgcggtgccctgcggaccatggggcgctgacatcccctcacttggaggcgccctgcgtccggcagaggaggcgagcataccgctcagtgtgatgaggaaccccatcgctgcacccagcgcagaagtgctgctgcctggccggacgcctccattgttatgagccagaacaatgggccgggtattctcacccagcaggatcctaaggccatttgtagtccttcagccactgtgggccctgcctctgcctgtacttcatggaatagtcgttgggggtataggatcctgtcactagtggacgcaccttggcgtgcgaagtcctaacaggggaccaccagtgtttgcacagaggatgagattggtgtaatggcaggaggatttcggatggtgctttgaaggaaggcacgtatagtggctggagcaggcagagaacaccattgctctgaacggagcgagaaggagttgagcaggctatgcgtgccatgtggggaaagtcctttgggacggagttgtcgtgagttggggaacaaagggtggttcttagctgtgcctcaaggtgatcacaccggggggactggcgcaaggggtaccttcggagcagccggcgctgagcgagatatggcaccccagggtagacccccagggaaagccggacgggatggggaacgaaaaggcccgccgcggggaaagggaacgacgcggagggtggcgcccaacggaggacccccccgatagtagcgcacctcaagaaaacaattggggtaggggggaccaaccgttggcgacttaagtagggaagggggcagaacattgggcaagtgtaaacgaggcagctttgacatgcacggatcgacagatcggacctgagagcaacgggcgtcaccttgcgaagggagcaacacagggaccagccgaacgat

SEQ ID NO: 694080 - DNA, 1035 bp, Homo sapiens
  misc_feature (640)..(640): n is a, c, g, or t
caagaatcacatacatttactttaaatatagttgcctttttgggtcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggggggggggttttggggggagacaagaacaaagaaaacgaccacccagcggatagtagagaaggagggggagcgccccagacattagggagttgatatataaaaataaatacaagagagccgccgaggcgagcgttaaaaaacaaacaaccgaatgggacgagagaacaaaaacactgatccggtggtaatcttggatggcaagacacacacacacacctcggggggggggcgcgcgcgaagcaaagagcgaggaccaccactaactcacaagaaagtaggtaaaaccgcgccgcgagggagacaatacaacaacagcaggaagaaaggaagtgggggaaacaccacccgcgatgctaagttgtggcgcggggcaagcgacgaaacaaagggctcgacgcagaggcaggtaatcatgcaataacaaacttttctgccccgcggcggcgtttgtaatactatcanaacgggacgaaagagcaagacaagcaaacagcaggaagcatgacaagcacgatagataagacaacaaagacgagctggaaaaagcacaagaagagacgtcagagaagaaaaaaagcaaaagcagagagaggagaagagaccaccaaagagggcggccgggacggctgccgaacgcgcgcggggagggagacgaagcggcagagatagcaaaggactacgagagagagaaggaacagcgacagaaaccgcacggcgacaggatcagtcccaacccaccgcaagcgcaccaacagagtcacgcagccagcgcaccagaaagcaacaaaagaaaagaaaaaagaaaaaaagcgagcgcgcccgacacgagagacaaacgcccgcacacacaaagagcg

SEQ ID NO: 694081 - DNA, 171 bp, Homo sapiens
gacaacctaagccaaaccatttacctaaataaagcatagacgatagacattgaaacatcgcgcaatagatatagtaccgcaaggaaagatgaaagattataactaagcatagtatagcaggactaacctctatacctatctgcatcatgcattaactagaacactatgcaa

SEQ ID NO: 694082 - DNA, 154 bp, Homo sapiens
ttgcagactcgggtatggatgtgtcacctttgtctctagctctacgttgcaacggaagtaacatctgtcgagaagtgcaccatgaacctttgattgaagctcttcctgaggacaatgtgggctttaatgtctagaatgtgtctgtcatggatgt

SEQ ID NO: 694083 - DNA, 119 bp, Homo sapiens
ggtgctgacagaacaaacaaataacaaaaattttttggggaattttatttaattatcatgaactgtgtagatcaactgagagagaagtggcattgtgtcttactatccatgacctgggt

SEQ ID NO: 694084 - DNA, 257 bp, Homo sapiens
  misc_feature (10)..(10): n is a, c, g, or t
ggcaagaggncaaagagggtgccggttttaccgccttttccttccggtcctttacctacccccttccctctttttaccttttcatttactccttgtttccgtgctggtggggttgacctttgaccgtgtggggggccttgttcccgccaggattcccagcgtcccgttccttgggaagttcagcccgaatttttgtctttcccccggcagccccgccttgcccacttttcttccctaaagcaagctcacccttggga

SEQ ID NO: 694085 - DNA, 528 bp, Homo sapiens
aaaaggtggagatggccctcaattcttgaagtttggggaggccgcccttgtttatatggttcccggcaagcccctgtgtgttgagagcttttccaccaatccccctttgggtcgctttgctgttcgtaaaataccacacccgttgcggtgggggtcatccaacccgtggcccaaaaggctggtggggctggcaaggtcccccagtttgccccgaaaggtcagaggggtaaatgaattttttccctaatccccgccccccccctttttatcagggggggaagaacggtttccgaactgtttgtttccattggcccttttagttttgggggaaaaggcggggttatgatacccatgccttgttaacccctccgaaggaaaggggaatgttttggggccccctttggttttttttttgggggggggccgttttaaggtttttgttttttaaacccggccttttttatgggacccccttgccccaaaatttgtccccgaattttgggccccctttaaaaagtttaatgggga

SEQ ID NO: 694086 - DNA, 172 bp, Homo sapiens
cccccccccccccccccccggggggggggtttccccccccctggggggcccccccccccctttccccccaattggtttttttttttgggggttttttaaaactctcccccctttcccccggggggggggggtgggggggggggtttttggggggggttttttttttttttta

SEQ ID NO: 694087 - DNA, 203 bp, Homo sapiens
ttgaaccatccttgtatttgagggaataaattccacttggggccaggcacgcctataatcccagcattttgggaggccaaggcgggcagatcacttgaggttgggagttcgagaccagcctggtcaacatgggagaaccccgtctctactaaaaatacaaaaattagccagtatcgtggtgcgacagagcaggaatctgtctc

SEQ ID NO: 694088 - DNA, 1013 bp, Homo sapiens
agatgtgttgcccctcccttttaaaattttattttcgtttttctatgggtattgttatgtttcttgatactttttctctctctcctgccccccatcccgcactcccggcgacccaaaccgtcatctaccactaggataagatcaccctcaggacagacagcgcatctccatgccccaggcactaggtacgagaggcccaacacgatggaaaggacactccagtcaagagatgtgctgaactgaaaacatagtcgactgagaactcaaatcagagtgtctacacaaacgcagactcataacccactgcccatcacttaaagaagacgagcctcatagaaatactacgatggatactgcacaagaaacacagaaaagcagaggttgatatatcagagatgtcatataaatactagaattcaaaaaaagcatcgtgaaatgagttggcacacaagagcccatctactaaatggcaacaaagaggatagcattgtgaacctttaccactcgtacaacggccatccctcgacacgacagtggacatcaagaacaacgacacagttaggacaaacaaccaacaagatcgaatgagcaaaatgcgtagggacaagtactttaccgatgcccgaggacaaagcacacaccatggagcaagcaaaggaacgagagaacacgacgcaaaagcgcactggagaagagccagcaggacaacacatggaaaacgctagtgcccccacagacgcacggattcacgcactgaacatggggtctggcaacaagtcgaccacggagcatagcacccggtgtggccagcatcgcctacagcccacaggatggaggcaacgtcgcaaccggtaccagcgcaaaaagaccccggcggaacacacgccgcgaacagcaccctaccaccacgaacgacaggagaggcaacaatgaacgaagaacaacagagcaggagacacgaaaaaaaggactgccaaaacgtagcaagaaaggaaccgagcacgcagaagaaa

SEQ ID NO: 694089 - DNA, 330 bp, Homo sapiens
agtagctgggcattacaagtcgccaaccaaccatgcccagtgaatttttagtagttttagtagaaacggtattcaacaaaaatggccaagttggcttcaaattccctgacctaaggggaccctttcccttggggttccccaaaggtttggggatttacagcattgaccctttggggccgggccccttgtttctcttttcaacggggtaaaaatggggaaattttttctacaacaatactcaggatgtttgttagacgaacagttcacagttctttttcacacaacgccatgcgggacacaaaggagacatagggtttggaaaacagtatg

SEQ ID NO: 694090 - DNA, 219 bp, Homo sapiens
ggatttgctggtgcagtacaactaggcttaatagggacatgctgtccaggatggctttgaatgtggcccaatacaaattcgtaaactttcttaaagcattatgtgatttttctgtgacttttttttttatatatagctcagcagctattgtcagtgttaatgtattttatgtgtggcccaagaaaattcttcttctaatgtggcccaaggaaaccaaaa

SEQ ID NO: 694091 - DNA, 299 bp, Homo sapiens
  misc_feature (7)..(7): n is a, c, g, or t
  misc_feature (12)..(13): n is a, c, g, or t
  misc_feature (19)..(19): n is a, c, g, or t
  misc_feature (36)..(36): n is a, c, g, or t
  misc_feature (138)..(139): n is a, c, g, or t
cacaaanatggnngtgccngcacctgggactcctcnaacactgtgccccgcttcctgttcaaaaccccgtagatgccaccgaccacctgctctggacactggatctccacaaggtagatgggctccatgaggctgtgnntgggcggtcagcacacttggctgtagcaggcagcgcctgtgcttgtggggcatgatcttggcccccttccggcggtggataggcgtcggcgatgcagggtgactgtcgtggacgtcggaagcgcacaccccggcatgttctcctcacacagtgcgccctc

SEQ ID NO: 694092 - DNA, 145 bp, Homo sapiens
ctggcgtggccaatcatggttactgcagcttggttccttgggctcaggtgaccctcccaccttagcctcccaagtagctgggactacagatgcacacctacatgctcagttaattcttttttttttttttcaagaagggggggtt

SEQ ID NO: 694093 - DNA, 429 bp, Homo sapiens
taatatattaatcacttcacgtagttactattggagtgtgtgtgtgtgtgtgtgtgtgtgtgtggtgaaaatttgtaagatcaactttcttagcaacttttaagtagcaatgcattattattaactatattcttatgttatacattagatctccagaacttattcattctacatgatcggcactttgtaccctttgaccaatatctccccatttcctccactcccacacccctggcaaccactgttctactctctacaactatgagttctagtttaatttagaatccacatctcaattagaccatgcaacacttctctttctctgtctggcttatttcacggtatcatgtcccccaggttcatccatgttgttacagatggaaggaattctgacacatgctacagcatggatggactttgaggatatgc

SEQ ID NO: 694094 - DNA, 512 bp, Homo sapiens
ggtcttagggagacttcacctaagaagtaaagaaaaaaaaaaagaaaaaagtctcaggctatgtctgaactaggagggtagaaagaaaattcatttgggttgccacaaaccatcgaaacaaagatgcaggtcattgatgtaaaaatacagttagtccctactgactccttttcagcttctcttcatggctatgagccagcatctcctgtgtcaggtttcagtctatggcctcccagttccaagtgcacctttcaatatgtccactgtgataaactgggaagcacttttcaatatacctcctggaagtgaacattctgcaggcatctagatagagggtggagggactgcagagggccttgatcaggtccaagccccaaacacagacctaggcgtggtccctcagccaacttgcagccttggcctgcagcatctcgacgaggaaaccaaaatgcagcagggcccgtgtgatctgaaggtccctgaaaagttgtccgggcctccctaagacccta

SEQ ID NO: 694095 - DNA, 521 bp, Homo sapiens
  misc_feature (512)..(512): n is a, c, g, or t
gtcgatctagaggtccctgtggagagggggttcatatggtgggccaggctgggtctcaagctcctgacctcgggtgatctgcctaccttggcctcccaaagtgctgggattacagcgtgagccaccgtgcccagccaagattctggatctaatggagaatttggaccttgtttggacaagcattaaaccgggtggggttcaggccacaagttccaaccagtctttttggatttcaaggtcagtttcaaaggcttttcctttctaggcagatagatctcttggtaggcggtggtcttttccttagttcagttctcaaagtcttgggtatgctccttaggattagatccacatagttacagttgggagggggagcccagcagttcataagcaacttaagggggtcactggcccaatctcctccctctcggtgatgtccccagtactttcctgttcccgggggctccctatttagttctctgaccagaaagtgaggtttacttatccaagtctgncaatatctc

SEQ ID NO: 694096 - DNA, 528 bp, Homo sapiens
ctgagagggaaaaatttattgattgctatgacatgggcatgatatgatatggtgacgcctgttcatacagatgactttttagggccagaagagaattttttttccttttacaaatacatttgatcagcaggaaaaaacattttaaaaacagagcattttcatattaggtggaaactaaaaacaatggctttccccccggcaactcatgaggaatagggctggtcagcaatagatctctgagtgctgccaatgtgagtgcaggccactggccccagtctgttccttgtttttcacagagagtccgtccaggggcaaatgaaattagaatctcaccaaaacaggtgcctaaatgcagctcgagaaatatgagcgcgacacgactgtaacgctttaacttatttggctgactgtgcaagaacatttaatattcaaagtttacagcgggattgaaacaattgtttaaacatcaataaaacaattgatgtgctaaatgctaacaccttagagatgcctataccacagttgact

SEQ ID NO: 694097 - DNA, 506 bp, Homo sapiens
agcgagtggtaagaggctgctgagtagcttttttccccacagtaaccgtagaggcaagaactgatatatatatgtcacttttactaagaaggggggaaacatttgctattaatctgtaaagagaagtcatttggcatgctagttacgtggagtaacagggaatagtatttacacttcactgcctcaaaaaagtgaagaccagaaaaacattgtttcagacaatggagagcaagaactgatacggtgtgagtaatacaagaatggcgtcataaacatgactggggagcaagtagcatagatgtgtctcaaggtaggagatcgtacagagacatacaaaaacagtaagaagcgaaaatttacttataagttacagtgatactataatgttagcatatgggctaaaattcaaagaaacttaagagccaagagaactcggttggacatgagaagggaaaaggaggaaccaattccagggcaacagaaagtactcgaaaaaccaagaaaaa

SEQ ID NO: 694098 - DNA, 622 bp, Homo sapiens
gtcaagcccatgtgtgttgagacgcgtctcagactatccagctttgcgcggtcgcttggctgtgcgctcggatatgagacagacgagttgcggtgggtgtcgatcaaagcagtggacaaaaaggctgctggaactggcagcgtcaccaagtctgcccagaaagctcagaaggctacatgattctgtaatgcctaattactctgccatgcccacttcttacctcatggctgggtggatacaacggttctcagaatctgtgttgtgtcaagttggacatttacgtttaaatacctaaaagactggttaatgaatatataagtgcatcgtagaaccttcacaaggaccggagaaatgtttaggtggaccactttgccttctgtctgtgtaatctgcggtgtgcgtgagtgttaaaaggttattagtttttaagaatcagtacttatgtgtatagtggagacaacttgacccataacattggtcacagaagtttggcagaccctagttgaaagaaagttaacatgagagcaagcaccctaaggatggggcaacaagacttgatgcatctttgtcccccaagcaaaaaggctacatgtacctccttcattgataataaaaccttctg

SEQ ID NO: 694099 - DNA, 103 bp, Homo sapiens
agcaccaccgaaagcggcacgaggaggaacagcacgtccacggctcagccctccatggccaccgccgcatgcggaatggcttgtgcagatgcaggggatgcat

SEQ ID NO: 694100 - DNA, 349 bp, Homo sapiens
  misc_feature (162)..(162): n is a, c, g, or t
ttgttctatgatggatccctgtagaggtgatgtctccagcacgcagctggagatctgagaacgggcagactgcctcctcaagtgggtccctgaccctgacccccgagcagctaactgggaggcaccccccagcagggcacactgacacctcacacggcaggntattccaacagacctgcagctgagggtcctgtctgttagaaggaaaactaacaaccagaaaggacatctacactgaaaacccatctgtacatcaccatcatcaaagaccaaaagtagatataaccacaaagatggggaaaaaacagaacagaagaactggaaactctaaaaagcagagtgcctctcc

SEQ ID NO: 694101 - DNA, 260 bp, Homo sapiens
cagtaaaaacagtcctcgctggactgctcagagtgccagacctacatccattccaaaatatgcccgctacttctccaccgccaagcgcaaattcatcatcgccgacacccctgtgccatgagcagatacacccgcaacatggccaccgagtgcgtccacctgatgacctgcgcgatcatccttgctcgacgcccgctacgcgcgtgcgagacccatgacccggtcgtcacagactacatcgcctcgattgctcgggcatc

SEQ ID NO: 694102 - DNA, 514 bp, Homo sapiens
  misc_feature (35)..(35): n is a, c, g, or t
  misc_feature (40)..(41): n is a, c, g, or t
  misc_feature (50)..(50): n is a, c, g, or t
  misc_feature (66)..(66): n is a, c, g, or t
  misc_feature (69)..(69): n is a, c, g, or t
  misc_feature (81)..(82): n is a, c, g, or t
  misc_feature (93)..(93): n is a, c, g, or t
  misc_feature (152)..(152): n is a, c, g, or t
  misc_feature (190)..(190): n is a, c, g, or t
  misc_feature (193)..(193): n is a, c, g, or t
  misc_feature (327)..(327): n is a, c, g, or t
ggagggtattggtcatgatccatcctctctccagngaganngagcctgtngtgtaccaattaggtnagnaaggtctggtgnnggtatccctantcaaaagacttattatatggaagtaccactttttaagtaggcaagataccttttaattncattccacagaagggaattttttggttccaggtctcanatnaatttggtattcctttttaaccactctacatttcccctggtttttaacctcaggcacatgtgctcttggtacagtttaaaaaggggtattaaattcggccttggtcatggtgggcaagtttaattcctctggtntggcataatggtgtatgggccggaggtggtgggctctggcaaagggggaggaagggattggcgattccttgtaaaaggtccccagacatgggtataattttaatcatgaattcaggtcttcctctgatggtccggaaaggtcctaaatactctaatttggatggcccaaaaggacttaacccattca

SEQ ID NO: 694103 - DNA, 534 bp, Homo sapiens
  misc_feature (70)..(70): n is a, c, g, or t
ctacagagttccggcgacggatctggatatatgcacagcaggcctctgtctatattaacattattgtgcncacagacacttcaaattttaataaatataatacaaagtagcaggcatggtgatcacgctgtatcccactactcaggaggctgagcacatgattgttgaacccagagcggagttgcagtgagccgagatgggccactgcactcaggctggcgacaagcgagactctgtctcaaaaaatagataagtaaatatcacggtgacattcccaaatgtttaacagtggtacctctaggtggtaaaattacagggttatttttctcttccttcgtcctctgtataataatttccaaattttctagttagtaagcatatgttacttgcatcggaagaaaaaagcacttgggctggggggcggtggctcacgcctgtaatcccagcactatgggagggcgaggcgggcagatcacctgaggtcaggagttcaaaaccagcctgaccaacatggagaaaccccgtctctactaa

SEQ ID NO: 694104 - DNA, 213 bp, Homo sapiens
acttcaggaagcttttcagctcaagctgaattaaccaggaatccagcagggactggagttcaggagaaagctcctcaaaggcgaagcttccttggtgggggttttccaaagggccccttggggttgagcgaagggtgtatttctatacatgaaaaagaggaagtttctccatcagccgctctcctaccctagtacagcaggcgcgcttggggc

SEQ ID NO: 694105 - DNA, 105 bp, Homo sapiens
ctactgggagccttaaccctaactacgttcagtaggggagcagggcgtattcacggttcacagaacaagtccaggtccctttaccttgttccaaccaggacgtgt

SEQ ID NO: 694106 - DNA, 183 bp, Homo sapiens
cgagccggtccacactagaggcaggaaagagatgggttcagaaaataataaaatatcaagctaggagcgttggctcgcgcctgtaatctcagcacttggggaggctgagtcaggaggatgcttgagctcaggagttcaagaccagcctaggtgacatagagagacctcatctctactagaaat

SEQ ID NO: 694107 - DNA, 825 bp, Homo sapiens
  misc_feature (760)..(760): n is a, c, g, or t
gagacagacgagtggaagaactcatgacatcacggaggccctgccaccgctactacttcgggctccgccggcaccgggacctgtctggtgatggccggtccaggcgttgttcccagcccagctcaccctgagggactgggagctttccatgcagttgattgcctgccttcatgtggtttctgagttcacctggctgtgttcctcctcctcctttcttctgtaaatggcctgtccgggcctcagttcctgtggtttgtgggctcacctggctgtgttcctcctcctcctttcttctgtaaatggcctgtccgggcctcagttcctgtggtttctgagctcacctggctgtgttcctcctcctcctttcttctgtaaatggcctgtccgggcctcaggccttgaacggtcccttggcaaccttccccatcaacaggaggcagcgggtcagttagatttgggcaatgtagattcccagatttatctccagcccagaccgctctggacctgctcagcccttgtgcccacagctgaggccacatcttgcccatcgggatgtcagtggcacctgtgcccctctatttgcttgctgtctttccggacccttctttctctcacatggcacctctggtccatcaacagtccctgtggctttattttcacagcacgtctcaccacttccctcccctccctgactacctggcggcttcaggccaccagtgtctctcacaggagtctcccaagtggtcccctccttcaccancccccaacagtctctcgtgagcacagcagccgtgtaatcgccttcagtaatcgccttcagcccgt

SEQ ID NO: 694108 - DNA, 129 bp, Homo sapiens
cggctgatgctgatgtaagccatccaccacgacggaaatccccggagaatccatggctcatgaatggacactggcaccagctggaggaagaagcacctcctgggtcctaataatctttctgggcctctc

SEQ ID NO: 694109 - DNA, 266 bp, Homo sapiens
ccctgttgagtggcatgtgatcagacatcacctgggagtggtggagggggaggaacccaatcagatattgagtgtgatcagatatgagggtggggggtcctatgctaaactgacttagccagggttctttgctaaaactggatcttacaaggaagtgcacagatggacctaggagaagtttcaggggcttgactaaagttcagccaagcaaaggatctttgtcaccgtgtcttagcaaatgcttgacacttcccttccccacaacc

SEQ ID NO: 694110 - DNA, 384 bp, Homo sapiens
gcacgaattccgacatccgcgttttgttccgcaaagcgcagctcggcaactcgggaagcgtagcgtacatgttcgaccgcgtaggcctcgtggaagccacgcacgccgaggcgagagatccggaagaagccgcgatcgaggcgggcgcgcagaacgtggagccgatgaaagagctcgataaagacgccaagagcggcgccatcttctacaccgagatcagcgacctcaacgccgtgtcgaacgcgctcaccgcggccggctggaaagtaaccacgagcgagctcggcttcaaggccaagaatcccgtggaactttcgggcgaccaactcaaggagacggccgagttcctccagtcgatcgacgacaacgacgacgttacaccgg

SEQ ID NO: 694111 - DNA, 147 bp, Homo sapiens
tacaggatcttccccgactagccgacagcccgagtatccgacagccccgactagcccgacagcccacgactagcccgacagtccccgactagccctcgcgaacgtgttatccccctgtcgggctagtcagggggggtaccgtagctc

SEQ ID NO: 694112 - DNA, 134 bp, Homo sapiens
ccaaattggtaagcatctatcttcgtaggtccactctacctgagctaaattatagatccagctatgctatttattaattatttcttgatggataaattttcaattctcccttgaccattcagacacttccatac

SEQ ID NO: 694113 - DNA, 684 bp, Homo sapiens
agcggggcgggagttcgagacaagcctggcaacatggtgaaaccctgcctctagtaaaaacacaaaaattagccaggtgtggtagtgcgcacctgtaaccccagctacttgggaggctgaggaatgagaatcacttgagcctgggagacagaggttgcagtgagccgagatcctacctctgcactccagcctgggctacagagtgagactccgtctcaaaaaaaaaagaagaaaaaattcagcaacaagcaaaaaagaaaggtggaaatataggtagggggttaattaaattgaatgtaatttcttttggagacaagatttggtttggggacacaggttgggagtgcaggggagtgatcaatagtttaattggagattggaactcctaggctcaaggtggatccttgggtaatcctccggagtgggtaagcctatagttggggtgccaccaagcgggacttaattttgatatcaaggtaattctaaaattcaaaaataaagataaatatagttgtacaattaccattgcacttgggtggggcactttggaacaggatttacctagtagttgaacaagattggcctttggagcttaaccaattgtatataggttaaggggcccctaaaggtggctttacaattggcggaaattatacatttcgctatcagagaatcattggatag

SEQ ID NO: 694114 - DNA, 413 bp, Homo sapiens
aacggcctcatagcttagcatagcctacttcaactgctcagagcactaacattagtctgcagctgggaaaatcaactaacacaaagcctattataatcaagtgttgaagatctcatgtaactgaatgagtactatactgaaagtgaaaaacagaatgggggtaggagtacctgaagtacggtttctactaaatgtacattgttttcgcaccatcggaaagtcaaaaaatcattaagtcaaaccatcctgagttggggcctgcctgcatatagagatagagtctggttgggggggagaaaaaaagaactagattctaggccaggcacggtggctcacacctgtaatcccagcactttgggaggtcaaggcagatggatcacctgaggtcatgagtttgagaccagcctggccaa

SEQ ID NO: 694115 - DNA, 82 bp, Homo sapiens
gcggccgcctactactactactgctcgaattcaagcttctaacgatgtacggggacatggattaaataatattctttatgac

SEQ ID NO: 694116 - DNA, 1228 bp, Homo sapiens
cctccgtaccccctaacaagcccacctcctaatactaactacctgactcctaccccgtcacaatcatggcaatgccaacgccacattatccagtgtaaccactatcacgaaaaaaactctagcctctctatactaatctccctacaaatctccttaattataacattcgcagtccacaggaactaactcatatgtttatatgcttcttcggaaagccgacacttatccccaccattggctatcatcagccgatgaaggcgaagcagtgcagaacgcctgatgcgcaggcatcgatactgtcctgattgctagcactcgctaggtaggctgcccttccgcctactcatcggcactaatttacaatcgcaagaccctaggctcactagaacacttctactagcttcgagcccgtcactgccgcaagagagctatcagaacgtcctgaggccaacaagcttaagtatgactagacttacacaaatagcgtttgcactagtacaagactaccgtcgtttagcggagctcgcacttcagtgactcgcctaaaggcccatgtcagaatggcaccccatcgcgtgggtcagatagtacttggccgcagttactctatgaaagctaaggcggctactggtataatacgacctcacactcaattgtcaagcccctgaggaaaaacagatagcctatcccttccttggtacttattccctatgagggcatacagttattacagagctccatcctggccatagagcaaccagaccttgacagcgctcactgggcatacttcttccatccaggcccgtaggccctcgtagataaccagccgatcccagtcaaacccctgaaggttcccgggcaagtaattctaaaaagacggccctaggaacattactatcctcccatcgcattccgggcatacgaagctcacattagagagaacaccccgagtcggcattacacacccaccttccgaggggtgaaacctaaaccccccgaataaattgtgagaagtcctaagacggccgccagacctggatattcccccgtaaatcacactgggggcacgctcggtataatcatacctcgtgcgatcacgacaaacaacgatcagtcacggcctgactggaatagcaagtggcactgcatactaacattggagcagtggcagctccgcaggggtaagagatactgctagatggtgtatctcacgcgcacatgcatccca

SEQ ID NO: 694117 - DNA, 113 bp, Homo sapiens
atttatttatttttgggacaggatcttgctttgtctccctgtgagtgcagtggcagtgagctgagatgtgccactgcactccagcctgggtgacagtgtgagactccatctca

SEQ ID NO: 694118 - DNA, 149 bp, Homo sapiens
tcctaggcagattgtagtggtgagggtgtttatccataataatgttatgtagtatatcggctcatgaagaatagtggcgaaggggcctgtgtgatattcgatgtttgaagcctgatgactagttctggactcccctatcggcaaggtcg

SEQ ID NO: 694119 - DNA, 1078 bp, Homo sapiens
  misc_feature (1)..(1): n is a, c, g, or t
ntttggcaatatttcgggggcgaaggccctcatggtgcgggatatataaaagaagatctcgaaccggggggggcccccttgaagtgtatgatatacgcgtctgttgaaggagtttctccgtgccgggggcccgcaacagtttttagacaagcacagagattaatggggcgatatgtattgaaccaccccctcccgcggaggatatttctttctcttctatagagcgcccacacagcaggagttatgttcccccagaggctagtttgcgcctctttacggcggggggctacattgagcgtcaacatcatttgggagagaaagccacacagacgctgttcgtgtgggagatacttctttggggagaaaaaatccggtgtgtagcccccaaacctggcgctcaaacttgtgggagaagaaaatatgtgggaggaaagatttttttctgaaagaccgcgcagagcagtgggttttacacaggaggatggtggaaacagatcatttgttgtgggtgccacaccacgccgcattacagagagattgtagaacaagaatgagtgatacttggtgtttctaccgaccaagggatattcatatgtttttctgccacacttttttattatatgcgttcgcgcataaaaaaaccctttggttatatccctatatatccccacaaattacaatgagatttaaataaaatgtctttgaattgctttgaaatttgtggaaaagttacccccgcgagatgttcccccgtattccacgggaacaattaagggccacaagcacatgtccaccttacccacttaatattcccctacttaagaaggtgttcaaccacagatgaattaattggggaaaattgctttcagaaatttattaaagccacaagtgtcccctcacttatagtgaaatataatgctccaccgaatcacaatactgagattttttaaaaaaaggaaaatttgaagtgggaattttttgcttagaggttttataaaacctagttttgtgtgaaaaccgtttgtggggatacttttccccccacccccccattaatttttaattttaaaccccccca

SEQ ID NO: 694120 - DNA, 109 bp, Homo sapiens
ggtcgaccagcataacaatagcatcagtagtcttacactatatgatcggtagtctcttacattagcaagtatatgagtagaaaagacctccacatatattcaagattca

SEQ ID NO: 694121 - DNA, 104 bp, Homo sapiens
  misc_feature (19)..(19): n is a, c, g, or t
gtatcatcaccgatagcancagcagaacgctgacgcaggccatacttcctattctacacctagtaggctccttccctactcatcgactattaactcacaaacct

SEQ ID NO: 694122 - DNA, 138 bp, Homo sapiens
tgactctacaggatcttactatacacctacactccccaccttcacctatttacagttaagaaaagcactacctccatgagaattcactgtgtgtgtatagctgtgtggtatagacgtggtatcaagggtggtatcaga

SEQ ID NO: 694123 - DNA, 635 bp, Homo sapiens
  misc_feature (458)..(458): n is a, c, g, or t
gcaacttggaggatgatctggaactgggcaagtccctgtgtctggggcgctgactgatcacggacaagtcagagtgcactggtcttccatcacatgtatcatacatggaatgggatccgacacttgatgcggtacctcagacactgcctgatgatctctcaattatactagtccgaactggttatgctgcatggtactgcgtagccctctatggggctggaaggcatgtgccgaacggaggctgagaccgtcctctgactacacagtagagaattcacccacttctctgaccgtcatgcgaatctcctgcccgggaactgttctgataatctgtctagactctctggaagataacagatctccttgacacacatcactacctgtgagaccagtctaatagcgagcgatccatttttgcactcgactctacagatgcagtggttgccctgactccattntctgcgacatgtagccgactatcgagcatgaagcatatagccactatccataacgtactccgactagtgctggaagtcagctcagggttcatgtaacttgagacagaggtaactgccagcttgtatggtttttgccatgtggattggcctatgttggatgggtagatcttgtctttg

SEQ ID NO: 694124 - DNA, 618 bp, Homo sapiens
tttaatatagcctgattggggaagacgggtgtggtgggtttaatcccagcacttggaagcccgggtggcggacacctgaggtaggagttcgagaacagcctgaccaacgtggagaaaccccatctctactaaaaatcaaaaaatagccggacttggtggcacatggctggtatgccagctactcgggaggcttgaggaggagaattgctttaactttggaggcggaggttgtggtgaagtgagatgacgccattgcactccagcctaggcaataagagcaaaactctgcctcaaaaaaaaaaaaaaaagttctaaaggtttaagttttgatgcggttccttgaattgctcttttttttttttttttttagaaaaggcaagggattttggccttggttttttagttggattcttagagatttaattttaagggtgtgttcctaaatttgttttgcccgctttgccattcgatttcttgcagccggggggttccttgtttttaggggggcggcacggggtggagtccgctttgttcccttgagtgaggtattgggcgttggttattctgtctagtgttctgtttgtttttccttttatgcggctctgtttgtgccgccgg

SEQ ID NO: 694125 - DNA, 484 bp, Homo sapiens
  misc_feature (49)..(49): n is a, c, g, or t
  misc_feature (60)..(60): n is a, c, g, or t
  misc_feature (67)..(67): n is a, c, g, or t
  misc_feature (91)..(91): n is a, c, g, or t
  misc_feature (112)..(112): n is a, c, g, or t
  misc_feature (120)..(120): n is a, c, g, or t
  misc_feature (180)..(180): n is a, c, g, or t
  misc_feature (244)..(245): n is a, c, g, or t
  misc_feature (248)..(248): n is a, c, g, or t
  misc_feature (262)..(262): n is a, c, g, or t
  misc_feature (290)..(290): n is a, c, g, or t
  misc_feature (309)..(309): n is a, c, g, or t
  misc_feature (312)..(312): n is a, c, g, or t
  misc_feature (316)..(316): n is a, c, g, or t
  misc_feature (350)..(350): n is a, c, g, or t
  misc_feature (369)..(369): n is a, c, g, or t
cagaggtcgctgcatttagaaaggagacggggtcagaggaatagaaagngatagggctgnagaacanaggtcgctgcatttagaaaggagncggggtcagaggaatagaaanggataggnctgaagaacacaggtcgctgcatttagaaaggaggcggggtcagaggaatagaaaggganagggctgaagaacacaggtcgctgcatttagaaaggaggcggggtcagaggaatagaaagggannggnctgaagaacagagntcgctgcatttagaaaggaggcggggtnagaggaatagaaagagatnggnctgnagaacagaggtcgctgcatttagaaaggaggcgnggtcagaggaatagaaagngatagggctgaagaacagaggtcgctgcatttagaaaggaggccggggtcagaggaatagaaagggatagggctgaagaacacaggtcgctgcatttagaaaggcggtcacgcca

SEQ ID NO: 694126 - DNA, 950 bp, Homo sapiens
ggtgctgcgtccgaccccggctttctttcttagacgcgcttttcatgctcccccgctttggcccttttcacatattcttcgccctaatcggtcccttcgggccccggttttccctacgggtgggccagccattggctggaccaccctgtgcgcgtgatagctccccaaccgggcttgggtccccgaaaaccttttgtttgacctgcctcttggaagctttgttttctcccacagataagccttggttcctacccggggccacttggtgttcctttaacctgccccgcttgggcaaatctgcatcccccagggcgcctgtgcctcggtgcccgccgcggagacccaaggtggtactcccttcgaccgggtcctctttggggaatttcttagatcccgccgttccagcccgccctgcggtctcctccccccgggacagaccctggttcggccgcgacacctcgtccccctcctgtgacggcggtcggactcttcaccgagacactgcggccattctccgacccgtcccggcgagcaagttcattgctcggcgatattcgggcctccttgcgcagaacgggcgaacgatctttccccggggcccgctccgtttggtactccccggggaacacaggccctgcccctggaggacctcaacactagtggcgaggtcagtaactctcccacgaaagacaatggtggcttgtaggcgacggccgggtgcacagcatttgttttgcccccacttcacccgccgctggtttcttagacatctggccgcacgcctcaaggggggtccgcaccccgccagtcttgcaccgacagttcgcggcccccgccacttgatacttcccctgcggtccccccccctcagaccaggcagttcttccgaccagttcccccccctgaggggggttgcccctctcaaaaaccgccccccgcccaaaataaca

SEQ ID NO: 694127 - DNA, 197 bp, Homo sapiens
cattgtgtgtttgcagctgtccaatgtcaacaggaccctcattctattcaatgtcagcaagaaatgacacagtcaagctacaaatgtgaaacccagaacccattgagtgccaggcgccgtgattcagtcatcctgaatgtcctctatggcccggattcccccaccatttcccctctaaacacatcttacagatcagg

SEQ ID NO: 694128 - DNA, 102 bp, Homo sapiens
ggatcccctaaattgtaatagttcattaatgtaaagtacggacacagtcttccttttccttcttagacctgtttcaatatggccacgaaacaagtagtctct

SEQ ID NO: 694129 - DNA, 532 bp, Homo sapiens
tctagaggatcccgtgggagagggggtctcaccagcgtgggcgggctgggtctcgaaactccgggcctcaggtggtccaccggtctgggctcctagggggtggggattacaggcatgagccaccaggctcggcccagtccagacttttaaactaccgggccccattgcagacacagttccctctagtccttcccagagttacaagaagagaactccagtagccttattcggtcagggacgagtggtttaccccatgataaggtaggatatcataaattcttctgcaaaggtttaagcctgtaattggtaaagtacatggagttctgagatcctctccaaagaagcaaggtatcagtatgtccagctcaccggtgcttggtccttcattttaacttttaattccctcattctttatgtctcctggcccctagtttcagtaaacaatcccctcctagcctcggtcaccggctcggacctgagtcaccttaagtcaccgggtccgaaaccatctgtccggtctaaatttctcacc

SEQ ID NO: 694130 - DNA, 182 bp, Homo sapiens
ccccgtgacccagggatactgagtttggttttaaaagtgaaagccaagtgggggtatgtaaagggatttccatgtagctgtggggcgagttattaccggctacattatatgctaagggtattggtgttccccaagtgtacaagccgttctatcaaaagtatgcggtatggctcagcgcgggg

SEQ ID NO: 694131 - DNA, 340 bp, Homo sapiens
actctagagggtccccaccacacttatttaagagcatattccaatatcaaacggcaaatttcaacagtgcaaaaaccacaattacgtttgcaccaaccttaatatttatttttatacctgtgaattaagaatgcataagtaaaaataatagcaacaaaacattaaaatattagtgatcatgtatttcatgtaactagtccatcaatataggacagttaaaagtggttttgcactagctttaagatctttggcaaatgctttgcctaaattttcccaaagttttaaaatgaagtactttttactgagatgtgattggtatagctgcatttctaaaataaca

SEQ ID NO: 694132 - DNA, 284 bp, Homo sapiens
ttagtttgctaaggataatggcctccttaaagaatggcctccataaagaagttgctttatgaatgccagctccacccatgttcctgcaaattacatcatttcattcttttttatggctgcacagtattccatcatgtgtatgtaccacattttcttaatccaatctgtcactcatgggcatttgggttgattctatgtctttgctattgtgaataatgctgcaatgaacatttgcctgcatgtgcccttaccacagaatgatttatactcctctaggtacatag

SEQ ID NO: 694133 - DNA, 781 bp, Homo sapiens
gtatgttgggtaggctaatgtaagagttccaattctgggaaacaatgaactaattgggtcatgggacgaacatttgcttagattaccaatgtctggttgaggcgtgcaagatttgccaacttttgatgtgacagtggtctcagaattaggtaataggtccggttacttaagataatatagcatgtgtttcaactaatatgaagtacttgagactcttgaagaaaattcagaatgaagttatggagaaaggtatgttactgtgagtaatacgtgctttgaacaggttttgtgttttgtcattagtctgctgcccttgtgtgtaatgtaaatatttatggttcatggaccaaagggtttactcgacaaactagtgtgacagactccgaacaattccttactgacgaagtataatttataaaatcaaatatacccattttaagggtacagtctgatttttgaccagtgaaactatgatcccaatcaaggtatagatgccgtcacgctcgaaaaagttccctcgatatgccctttgcagtcagttcatccgtactctggcacagatgatcactgatcttgtcatatatagatgagttttggccagttcagagaatttaactggcaatcagatattgtaagcattcttgctgtaatacttcattctctctcacttaatgagattcatccatacttgttgaatgtttcactagttaatgtttacttgttcaataattttgtatatacattttagaagcctattcactaactccattggctttagatt

SEQ ID NO: 694134 - DNA, 222 bp, Homo sapiens
actgcactccagctgggcgtcagacccagacccgttcaaaaaattaaaaaaccaaaaaaaaaaagcaaaaacccacacaatgaaaaatagaaaacttataggtccgcaaggagcacattaggtgaacgaggaagcaggtggctgtatctggggcggaagctgggaggtcactgggtttcagagacatgccgcatgcttatctacagactatctgagtcttgg

SEQ ID NO: 694135 - DNA, 362 bp, Homo sapiens
tcgacggtaccaacaccattggagacttgttagagcttggcagcttgggttggcgcatctccttggggtgtctcggtactgcaggcagagccggttggggcccagacctggagcatcgctcgggtcagtgcctaattagaaaagttgcactcgggccgggcactccgctcgttgtcccggatgcccttggacacctgtgtggccttcagtctttcataccgattgctgttggaaccacaccactggtggatgttgttgcccaggtccaggatgaagcagtcgccattgttgaagctctcccaggacacaggtacctcggtggcacggaccacacgccgccctttgacctggaagagtctctg

SEQ ID NO: 694136 - DNA, 953 bp, Homo sapiens
  misc_feature (10)..(10): n is a, c, g, or t
  misc_feature (101)..(101): n is a, c, g, or t
  misc_feature (127)..(128): n is a, c, g, or t
  misc_feature (167)..(167): n is a, c, g, or t
  misc_feature (178)..(178): n is a, c, g, or t
  misc_feature (191)..(191): n is a, c, g, or t
  misc_feature (195)..(195): n is a, c, g, or t
  misc_feature (223)..(223): n is a, c, g, or t
  misc_feature (227)..(227): n is a, c, g, or t
  misc_feature (234)..(235): n is a, c, g, or t
  misc_feature (281)..(283): n is a, c, g, or t
  misc_feature (301)..(301): n is a, c, g, or t
  misc_feature (307)..(307): n is a, c, g, or t
  misc_feature (309)..(309): n is a, c, g, or t
  misc_feature (323)..(323): n is a, c, g, or t
  misc_feature (326)..(327): n is a, c, g, or t
  misc_feature (333)..(333): n is a, c, g, or t
  misc_feature (337)..(337): n is a, c, g, or t
  misc_feature (350)..(350): n is a, c, g, or t
  misc_feature (353)..(354): n is a, c, g, or t
  misc_feature (360)..(360): n is a, c, g, or t
  misc_feature (368)..(368): n is a, c, g, or t
  misc_feature (372)..(372): n is a, c, g, or t
  misc_feature (375)..(375): n is a, c, g, or t
  misc_feature (381)..(382): n is a, c, g, or t
  misc_feature (393)..(393): n is a, c, g, or t
  misc_feature (398)..(398): n is a, c, g, or t
  misc_feature (402)..(402): n is a, c, g, or t
  misc_feature (417)..(417): n is a, c, g, or t
  misc_feature (479)..(479): n is a, c, g, or t
  misc_feature (488)..(488): n is a, c, g, or t
  misc_feature (494)..(494): n is a, c, g, or t
  misc_feature (498)..(498): n is a, c, g, or t
  misc_feature (534)..(535): n is a, c, g, or t
  misc_feature (641)..(641): n is a, c, g, or t
  misc_feature (652)..(653): n is a, c, g, or t
  misc_feature (716)..(716): n is a, c, g, or t
  misc_feature (719)..(719): n is a, c, g, or t
gaatgggaangtaccttaaagtaaacaaaactggtgctaatccatggcgttgaaggaaagttttgagagaaagctgtccagtgatggtcacatagattttnaacatgttccactttaggtaggcganncctttgagcagaaaatagtggatcttttctccaaaaggngtttaattttntggagatgttganaggnacatgccaaatctgagtatacgtgtganaatnatatggnngaggagcaaatactaaaccttgtatatcaagtttacatggggaaannnacattagataaataaatncatttncntgcctctttaaganatnncccttngggncacggggtatgcngtnngggggnggggagtnattnctngggggnntgctataattngtttnggtnttgcgcttggcagtnccactttcacatagttcaaaatcaggatatgtggatcttgattgggccttaggatgtcagtnttgaggggntcagtnagcngcgtgatactaagatgggccctttgaatctttaggnnagttcatccatttttagtcaataaaattggtgtactgtcaagtataagatttcttgaagtaagccacttgaaccattgtgaagctacacataacttgatgtctgantgaggttaaanntgggtgtataagtctttaatacagtgaaccatgctattaacccaacatctgttttataaagangcnagtttaacctgctttgcgttcttaatttctgttaatgtgcaaactttaccatgctaagacattagtaaatttataaattttcttgttgaacagcagcttcaatgcaaacacaatgcttccagcattggtattttggctaaggtaaatctacaaatcactcactgttgatgtttatggaatgaagcttttcacagcattggtttttaaagtcagtcaaaatagttacacaatgaa

SEQ ID NO: 694137 - DNA, 109 bp, Homo sapiens
ccaccatccgctcatctgcctaccctcaccccacgagacagcccctatcaggatttccactggaccttgcccaaatatgcaccttaggccactgcccctaaagactgag

SEQ ID NO: 694138 - DNA, 337 bp, Homo sapiens
ctgttcgctcgtgctggatacttcggtgaaagtccaactagtttaccgaggagttaatcttcggcctaatgaccagtagttagcaaatgccaagttctcaaacagctacagaacctctttattgggaccccagataaccttggattttagccttctgctaccctttcctgtctgcctcccgtgcattgtaagtaatatctgaaatggaactgtagtctgaaggcagtacaatggttgcttctccagtgtgctaacatctcagtgcttttttttcctggaattggagaggtgtaggatttgaagattagcacgtcttatgtctgtatgtacggttata

SEQ ID NO: 694139 - DNA, 225 bp, Homo sapiens
cccttttggggccagctgtaaaatatttggatataggaaatgttgtgtttttcttgcacccctgatattcagggtggattgtaaaatataaatttttgtgagatttccaagatttagatttttttgatacccttatttcccgatttaaaaaatgtggttatccccagtctcgagggggaaacttctgcataaaataactaacttggaataaattttttgcctcca

SEQ ID NO: 694140 - DNA, 370 bp, Homo sapiens
ggtaaagtttttcaagttcagcttgtgcccgaacataatcattaaaatcacgaagtacaaaatattcatcattataaacggtgagcgaatcaaaaatttcgcgaccttcacttttaatatttggcaccgttccgtcaattaaggcattcaaaattcgattaactactggattttgctcataaatatcacgcgcattataattaccattgcgataatattcataaacttcatccttagtcagcccaaaaacaaaattatttccatcccctgccgcttcaaaaatttcaatatttgcgccatcaagtgttccaatggttaaagcaccatttagcataaacttcatatttgaagttccagatgcttctttaga

SEQ ID NO: 694141 - DNA, 1032 bp, Homo sapiens
ggtcatctggaggagatttgctttctgttttctccaaaaggggaggaaatctgaaactgagctggcccactgatgggaacgaggggaaagcccatggggtacaggatggcctctggctgtgaaggcgagaggctaacatggggttcggagcgaccttggccgttggcctgagccatcttttgtgcttgtctggtcagtcactactcatcatcttgcttcacctgctcctgctgctgcctttacaacgactgtgccgccgaccacgtccggtttgtcaccacacagcacgatccagccactgatggtgcattgccccgttatcctcagcgctccaagtgtgcctgaccaagctaccctggaccaaagctaccaggtgctaccagcaccaatgccgccgtcagcgcagggattgccatgcatgcacctaagccaatgcagatacccaacacagcgttacgccagctccaggcccatgggcccaaccggccatacgcacgaagaacctgggtggatggacgcacgccgcagcccctacccccgagcagccatgacatccttacaaacccggcactacactggattgccccgaaagggcgggccctcttgacgcaatttcccttgggactcctctgggcttgccaacgttgggaaactgtaggcggtggtgtggccgtgaggctggtaggtgcaacaggcagcagagacacattgacggacccgattgtagcttgctggtgtcgtgtcccagggacaactggtttccattctacgtccccaattgttgattgctgttgatgatggtcctggccatgagacctattgggggggcattccccgtcgtgtgactgcgttggcaacaccggttggctgagaacgcccacgtccctttgtccaagaaagcttgagcgcttgtgtgacccacttaaccgttatggcgtcagtacttacccatcaagggcatggggagaattctactgggctcacaataaaacactttgtataaaccactaagaatctcccatggagactttg

SEQ ID NO: 694142 - DNA, 330 bp, Homo sapiens
ttgtatcagcaggaagccattgccattttgacccttgaagggcaaggagggaaacagtgttaccaaagcccagtaaaaactgctgtcatgaaggaggggcccccttgtaaaagacatcattactaccagaactggggggccaaattgctggggtttttttttggagaaaccaaccaaaaacatttgttggagagcccaggtgggcccaaaaaagggtggaaaaagaatttgggaaaagaaatggagaataagcagcccagtgttattcatttttgtaaattcctatgtaaaaggctcagtgttagaaataaagttattttactagttgca

SEQ ID NO: 694143 - DNA, 879 bp, Homo sapiens
  misc_feature (202)..(202): n is a, c, g, or t
ggggagaccagagaatctagcgactgaagcagcatggccagctgtgtggggtgcgcctgagcggggaagcccgcaaacgaggtggaggtctgcagacagaatcttttccaggaggtcttcagtttcctcatttgcagagtcttgggaccctagttgtatgtccaaaggccacttccagattccatttgtcagacagtctcanttgagacatattctggtgattccccttccacttgctaatgttaactgcacgaggcttgacggaacttcgctctcacagagttcgttggccactagaaatatcagtataccttgatatacagctctgggcatagagtgactcccttgcaatgtggcgtgtacttgacgttccactccgggcccacactgagaacatccccaatcccagaatcctcactacctaaggatgatgagatggaatacagataaggcaggagaaggaaagaagtccctaagtgtggatttctccctgggaatgagaaagtcctgtccctgcgttgctctggttaagccagaagtctggactctcaaagagaaatgcattcggggtgattacatggatccaatacctgatccccaagattgagcgatggacaatgatttgtggggtagcaatccaggagaaaggtgccttggaggagggtgaatgccgtcaagaaccaatagtggacagctttccagacaaccaattttccaaagtacttctcagaacggggggatgcttgtggcaaggctccaggagactctgtaatgggttaccggcctgtggcatgaccgagattaggagctagggggagtcacgcatgtgtgactgagggctttatggaggttacaatcatccggcgcactgggaaatgg

SEQ ID NO: 694144 - DNA, 170 bp, Homo sapiens
  misc_feature (157)..(157): n is a, c, g, or t
gttgccgccggtctgtctagacggatcccgttcatttctacacataatagttgatcatcagaatgattcctttagagcagaaacaattattaaggattgtttatatcttatacatattgggctaagccatgaggttcacggaagatttttctgtgcngggttgttgcaga

SEQ ID NO: 694145 - DNA, 273 bp, Homo sapiens
atacatggggatcaaaataggagctagaataggcaggatccaagtcgatggcaacagccagtcagtgaaatcagtatagtaggcagctgcacgggactacgggacaggaacactgggacagccgaacgcctcaacaggatagttcttgatacagctcttatacagctctccgagcttctccccagatgatgtgccgagcgggatcatccggcgccttgcagtcaagatcgtacttcccattgcgatagaactcagatgctgccacatccatgc

SEQ ID NO: 694146 - DNA, 613 bp, Homo sapiens
agcggggaacagtcacttcgggagtagcacaggtagacacatctcaaggctaaatctggctcaggtcgccacggctctcataaggacacacatgcagtaagaagactttggtaagggaattggagtacacccaagtgaaatggtgacaggaggttggtatggttaacatctgatatcagaaggttaaaagtgccttcggtcttaaatctcaaaccaaatatttggtgtgtggacctggggcagaagaagtgtccttccctcttttcttcaccgtcaggtagaaaacctgcactctgcagaagggtcctgtgtgatcacttaatcctctggtggagaagcagcagtaatgttatggcttccaaccggattaatcatttaatgtggaaaatagtcaaggagaccagtatctctggagtgcttaatatgccttctctttgaagggaggggacgggctctgctcggtacactcaaatgtgtagagtcagcaacaattccgtagcttccaactgactcagaatggatgcaacgtaggtcttctggcccgaggcaggtatcaagtccaaatcataatgaacttttcaccagtttcaaccagtttcttaaaagagagcta

SEQ ID NO: 694147 - DNA, 1050 bp, Homo sapiens
tattataaaaaaaaaaaaatcttctctccccccacacaaaaaaaaaaagaaaaaaaaaaacaaaaaaacacacagagaaaaaacaaaaaaaaaaaaaaaaaaaacaccccccaaaaaaaaaagaaaaaaaaggggggggagaaaaaaaacggacgggggataaaaaaaaaaaaaaagagggaggaggagcgagaggggcgcagaagagacaacaagaggggaggaaaaagaagagagacgagagaggggagaggggcgagagggggcgggggggcgacaccaaaaaggacggggacgaggcgacaacacgcagacaggagagagagagagagagagaggagagaagaacacaataatataacaaaacaaaaaaaggattaaagataaaaaaaaaattaaaagaagaaggcgggagggagagggtgggtgacggcgacggtaaaagaagaggaggagagggaaaagaaaccatgagccagaaaggagggaggaagggcggaacaacagaagagagaagaaaggagaacaaaaaaaccaaagcagagagagaacaaggaacaaaataagacaacgataaacaaagagaggggggagagacaggagagcgaagagaaacaaaaaaaaaaaaaaagaaaaaaaaaaaagaagacacgagcaggagagcgagaaaaagcacaacaaaacaaaataagaaaggcggaagacaagcagaggagcgaaatcaaaaacacaaaagcgagacgaacacaaacaaacaaagaaacaaagaaacaacactacacacaaataaaaacaccataaaccaacacagagagtcagctgtaatccaacgaacaaaataaaaggagcagaaagaaaaaaatagaaaaacaaaccaaaaaaaacgacggggcacacacaacaaaacaacaccaaaaaaacaaaaaaacgagaggggagcatacacacatacgaagccaacacaagctagagcacaataaaacaaacagcagacatacaaacaaacagaacaacgctggtgacacaaaccaaaacaatggtcaacaagac

SEQ ID NO: 694148 - DNA, 816 bp, Homo sapiens
cattctactctctaccttgtgaggtcaacttttagctcccaatatgagtgagagcatgcaacattgactttcggtctgagttagtcacttaatatatgtccttcagttcatcatgtgctgcaaaggcagatttcatccttttgtggctgaatatatccatcggtatatatacgtgtcttatccagtcatcactgatagacacttaggtgacggacttctattaaatgtatatgactactgtacctctgtcctccattgcctatatctcttcagttccatatctctgctgtccgtgctgcattgaatagctgttattactgccagcaactctttctttaggttggtaaccggtttataactcacaataaactgtaattttattagtgtacttttaatctccataagtgtatttagttcttgtcacatctgcctagccgttttaatttattttgttaattcgtaattggatatgctgtttttatttttaaaagcatgttaaagtgatggatacatgaacttacataagtaataaaaacaccacaacaagtatgagtgaaactggggatatctgaacaagatgatggatgggatcatgtccagtatcctgcgtgtgatactgtattatagttttcaacgatatcatcattgaaggaaccaggtaaatgttacagatactctgtataattcttacatgggatctaacgttattcaaaaaaaagcgaaaaaactttggggggctgccgaaatttaaaccttgtggggggggccaagatgaaaggggcacggccaagaaccgggagagggggggtcccaaga

SEQ ID NO: 694149 - DNA, 176 bp, Homo sapiens
ctggttccatgagtaagctattgcttatctagaaggagaaggcaagcaggtctccgtgaaaagcctctctccgatctggccgtctctcctacctggcatattggacagagcgtcatcttggagtatctctaccaccaccatgatgaggcacatcagcatcaaggcaattagcagag

SEQ ID NO: 694150 - DNA, 352 bp, Homo sapiens
  misc_feature (46)..(46): n is a, c, g, or t
ccgtccctaacattagaacgagtgggcgcagattggaaggggcctnggaggagcggaggaggggggggagaatgttagattccttacatacttcccccatattcctaaaaccaggcgacctgcgactccttgacgttgacaatcgagtagtactcccgattgaagcccccatttgtataataattacatcacaagacgtcttgcactcatgagctgtccccccattaggcttaaaaacagatgcaattcccggaggtttaaaccaaacccctttccccgctacacggccgggggtatactacggtcaatgctttgaaatttgtggagcaaaccccagtttcctgcccctcca

SEQ ID NO: 694151 - DNA, 617 bp, Homo sapiens
  misc_feature (2)..(2): n is a, c, g, or t
  misc_feature (8)..(8): n is a, c, g, or t
  misc_feature (11)..(11): n is a, c, g, or t
  misc_feature (69)..(69): n is a, c, g, or t
cntccgtnatngccaccgcctccatccgctcccgcagactccccacgctctgccgtgccctgcctcttnaccccccctcccccttcagccgggctctgtgggctcagggtgggagcacccgtccacgtgggtggtttggggcagggctggcaccggctgaccaacactctccccatcacagtcaccggactttgctgaggagttgaggtccctggaaccatctcccagccctggcccgcaggaggaggatggagaagtggctctggtgcttctgggcaggccctcacccggcgctgtgggccctgaagatgtggcactgtgcagcagccgccgccccgtaaggcctgggcgccgtggcctgggccctgtgccctcctagaggagcaggcacctcccccagacttggggtgggggccctgccagctccagcaccacccttgccccaagtcttttaacctgggtgttagcattttaaagagaccccacaggagttctggcctgtgactaactaactgccccaccccagccgagacctcggcgagactgtaactagtgatgtttgtacaaccaaagactctattttgtggtttaaggagaataaagttgactacatttta

SEQ ID NO: 694152 - DNA, 268 bp, Homo sapiens
  misc_feature (108)..(109): n is a, c, g, or t
aaatttttttgccgggccccccccccgccctttagggggttgggcagtcccccccttccccagggttcccagttttttaaccaaacgggggggtggaacattaaactnnagggtgggggggggtttttacccccccccccccgggcttggggtgccttttgtcccttaaattttttgggcccggggatggaaaaaaaattttttcccttttttttaaagggggggggtaaacaaggaaacccccctttaattttttttttttttccca

SEQ ID NO: 694153 - DNA, 687 bp, Homo sapiens
cggctgatctgtctgctccatctctcctgcaaagctccagccagcacactgccatggagagagcagctgcccagcccaggcccccgcatcctgtgggaacggggacgagcccctccgtgctgaccgagtgtctggggcatcccctgggactatagtcaggttggggaacgtgaagagctgctgtggcttttaggcaagccccagggtccccagtccctcctggtcgggggccacagaccctgcccatcctcacccagccactggcatactcctccaggtaccgtctggagcagctggagggaagatggctgaatctccctgctcccctagtggccagcaggtgagtgtcccaagttaacgggtgtgccccatggtgggtggagggcagggcagatggccgctgtgcacagggcccctcctccagggatggggggtcaggggccatcgtggggtgctgttgactccggttttccctctgctaccatggggcctcctgtgtgaggaaggccagggacgcttacctggccagagctgcctggcgactggggtgggggagcgcctgaagatgtgcttgaaccctggaagggggctcaaagctcctgagaacaccagacaggtgtcatcaggaccacaacacctcccaaggggcccacacttatccctgacctggccttatagtacaggaag

SEQ ID NO: 694154 - DNA, 3103 bp, Homo sapiens
  misc_feature (23)..(23): n is a, c, g, or t
  misc_feature (27)..(27): n is a, c, g, or t
gtacgcgctaggcggaccgcgangggnagaggccagcactgaggaggaggacaaggagggggccgtggtttctgcgccctctgtcaagggagtgtcgtttgaccaggccaataacctgctgatagagcctgctcgcattgaggaggaagagctgaccctcaccatcctgcggcagactgggggcctgggcatcagcattgcgggcggcaagggctccacaccctataagggggacgacgagggcatattcatctctcgggtgtccgaggaaggccctgcggcccgggctggagtccgtgtgggtgacaagctcctggaggtgaatggtgtggctctgcagggcgccgagcaccacgaggccgtggaggcgctccggggggccggcactgccgtgcagatgcgagtgtggcgggagcgcatggtggagcctgagaacgcggtcaccatcacgccgctgcggcccgaggatgattacagcccccgagagcggcggggaggggggctgcgcctgcccctgctcccgcctgagagccccgggcccctccgtcagcgccacgtggcctgcctggcacgcagcgagagggggctgggcttcagcattgctggtgggaaaggctccacaccctacagggctggtgatgcgggcatcttcgtctcccgcattgccgagggcggtgctgctcaccgcgcgggcacactgcaggttggcgaccgcgtcctctctattaatggagtggacgtgactgaggccaggcatgaccacgccgtctccctgctgaccgctgcctcccccaccatcgccctgctgttggagcgggaggctgggggccctcttcctcccagccctctgccacattcctcaccccccaccgctgctgttgccaccaccagcataaccactgccacccccggggtgcctgggttgccgagcctggcccccagcctgctggctgccgcgttggaagggccatacccagtggaggagatccgtctgccaagagctgggggccctctggggcttagtattgtcggaggctccgaccattccagccacccgtttggtgtccaggagcctggtgtgttcatctccaaggtgctcccgcggggcctggccgctcgcagcggcctgcgggttggggaccgcatcctggcagtgaacgggcaagacgtgcgggatgccacgcaccaagaagcagtcagtgccctgctccggccctgcctggagctgtcgctgctggtgcggagggacccggcacccccgggcctacgggaactgtgcatccagaaggcacctggggagaggctgggcatcagcatccgcgggggtgccaggggccacgctggcaacccccgcgacccacagacgagggcatcttcatctccaaggtgagccccacgggggcagccgggcgcgacggtcggctgcgtgtgggtttgcggctgttggaggtgaaccagcagagcctgctgggcctgacgcacggcgaggcggtgcagctgctccgcagtgtgggcgacaccctcaccgtgctggtctgtgacggcttcgaggccagcaccgacgcagccctggaggtgtccccaggtgtcattgccaacccctttgcggcaggcatcggccaccggaacagcctggagagcatctcttccatcgaccgggagctgagccctgagggcccaggcaaggagaaggagctgcctggacagaccctgcactgggggcccgaggccacagaagccgcaggtcggggtctgcagcccctgaagctggactaccgcgccctggccgccgtgcccagcgctggcagcgtgcagagggtaccgtctggagcagctggagggaagatggctgaatctccctgctcccctagtggccagcagccgccctccccgccttctccggatgagctgcccgccaatgtgaagcaggcctacagggccttcgcggccgtgcccacttctcacccgcctgaggatgcccctgcccagccccccacgcctgggcctgcagcctccccggagcagctgtccttccgggagcggcagaagtactttgagctggaggtgcgcgtgccccaggccgagggcccccctaagcgcgtgtccctggtgggtgctgacgacctgcggaagatgcaggaggaggaagccagaaaactacagcagaagagagcgcagatgctgcgggaggcggcagaggctggggccgaagcgaggctcgccctggacggggagacgctgggcgaggaggaacaggaggatgagcagccaccctgggccagcccgagccccacctcaaggcagagcccggcgtcccccccgcccctgggaggtggcgccccggtgcggacggccaaagctgaacggcgccaccaggagcggctgcgcgtgcagagtccggagccaccggcacccgagcgtgccctgtcccctgccgagctccgggccctggaggccgagaagcgtgcgctgtggagggcagccaggatgaagtcattggaacaggacgctctccgagcacagatggtcctcagcaggtcccaggaaggccggggcacgcgggggcccctggagcgactggccgaggccccttcccctgcgcccaccccgtcgcccacccctgtggaagacctcggcccccagaccagcacctccccgggacgcctgtcaccggactttgctgaggagttgaggtccctggaaccatctcccagccctggcccgcaggaggaggatggagaagtggctctggtgcttctgggcaggccctcacccggcgctgtgggccctgaagatgtggcactgtgcagcagccgccgccccgtaaggcctgggcgccgtggcctgggccctgtgccctcctagaggagcaggcacctcccccagacttggggtgggggccctgccagctccagcaccacccttgccccaagtcttttaacctgggtgttagcattttaaagagaccccacaggagttctggcctgtgactaactaactgccccaccccagccgagacctcggcgagactgtaactagtgatgtttgtacaaccaaagactctattttgtggtttaaggagaataaagttgactacatttta

SEQ ID NO: 694155 - DNA, 3082 bp, Homo sapiens
  misc_feature (23)..(23): n is a, c, g, or t
  misc_feature (27)..(27): n is a, c, g, or t
gtacgcgctaggcggaccgcgangggnagaggccagcactgaggaggaggacaaggagggggccgtggtttctgcgccctctgtcaagggagtgtcgtttgaccaggccaataacctgctgatagagcctgctcgcattgaggaggaagagctgaccctcaccatcctgcggcagactgggggcctgggcatcagcattgcgggcggcaagggctccacaccctataagggggacgacgagggcatattcatctctcgggtgtccgaggaaggccctgcggcccgggctggagtccgtgtgggtgacaagctcctggaggtgaatggtgtggctctgcagggcgccgagcaccacgaggccgtggaggcgctccggggggccggcactgccgtgcagatgcgagtgtggcgggagcgcatggtggagcctgagaacgcggtcaccatcacgccgctgcggcccgaggatgattacagcccccgagagcggcggggaggggggctgcgcctgcccctgctcccgcctgagagccccgggcccctccgtcagcgccacgtggcctgcctggcacgcagcgagagggggctgggcttcagcattgctggtgggaaaggctccacaccctacagggctggtgatgcgggcatcttcgtctcccgcattgccgagggcggtgctgctcaccgcgcgggcacactgcagattaatggagtggacgtgactgaggccaggcatgaccacgccgtctccctgctgaccgctgcctcccccaccatcgccctgctgttggagcgggaggctgggggccctcttcctcccagccctctgccacattcctcaccccccaccgctgctgttgccaccaccagcataaccactgccacccccggggtgcctgggttgccgagcctggcccccagcctgctggctgccgcgttggaagggccatacccagtggaggagatccgtctgccaagagctgggggccctctggggcttagtattgtcggaggctccgaccattccagccacccgtttggtgtccaggagcctggtgtgttcatctccaaggtgctcccgcggggcctggccgctcgcagcggcctgcgggttggggaccgcatcctggcagtgaacgggcaagacgtgcgggatgccacgcaccaagaagcagtcagtgccctgctccggccctgcctggagctgtcgctgctggtgcggagggacccggcacccccgggcctacgggaactgtgcatccagaaggcacctggggagaggctgggcatcagcatccgcgggggtgccaggggccacgctggcaacccccgcgacccacagacgagggcatcttcatctccaaggtgagccccacgggggcagccgggcgcgacggtcggctgcgtgtgggtttgcggctgttggaggtgaaccagcagagcctgctgggcctgacgcacggcgaggcggtgcagctgctccgcagtgtgggcgacaccctcaccgtgctggtctgtgacggcttcgaggccagcaccgacgcagccctggaggtgtccccaggtgtcattgccaacccctttgcggcaggcatcggccaccggaacagcctggagagcatctcttccatcgaccgggagctgagccctgagggcccaggcaaggagaaggagctgcctggacagaccctgcactgggggcccgaggccacagaagccgcaggtcggggtctgcagcccctgaagctggactaccgcgccctggccgccgtgcccagcgctggcagcgtgcagagggtaccgtctggagcagctggagggaagatggctgaatctccctgctcccctagtggccagcagccgccctccccgccttctccggatgagctgcccgccaatgtgaagcaggcctacagggccttcgcggccgtgcccacttctcacccgcctgaggatgcccctgcccagccccccacgcctgggcctgcagcctccccggagcagctgtccttccgggagcggcagaagtactttgagctggaggtgcgcgtgccccaggccgagggcccccctaagcgcgtgtccctggtgggtgctgacgacctgcggaagatgcaggaggaggaagccagaaaactacagcagaagagagcgcagatgctgcgggaggcggcagaggctggggccgaagcgaggctcgccctggacggggagacgctgggcgaggaggaacaggaggatgagcagccaccctgggccagcccgagccccacctcaaggcagagcccggcgtcccccccgcccctgggaggtggcgccccggtgcggacggccaaagctgaacggcgccaccaggagcggctgcgcgtgcagagtccggagccaccggcacccgagcgtgccctgtcccctgccgagctccgggccctggaggccgagaagcgtgcgctgtggagggcagccaggatgaagtcattggaacaggacgctctccgagcacagatggtcctcagcaggtcccaggaaggccggggcacgcgggggcccctggagcgactggccgaggccccttcccctgcgcccaccccgtcgcccacccctgtggaagacctcggcccccagaccagcacctccccgggacgcctgtcaccggactttgctgaggagttgaggtccctggaaccatctcccagccctggcccgcaggaggaggatggagaagtggctctggtgcttctgggcaggccctcacccggcgctgtgggccctgaagatgtggcactgtgcagcagccgccgccccgtaaggcctgggcgccgtggcctgggccctgtgccctcctagaggagcaggcacctcccccagacttggggtgggggccctgccagctccagcaccacccttgccccaagtcttttaacctgggtgttagcattttaaagagaccccacaggagttctggcctgtgactaactaactgccccaccccagccgagacctcggcgagactgtaactagtgatgtttgtacaaccaaagactctattttgtggtttaaggagaataaagttgactacatttta

SEQ ID NO: 694156 - DNA, 296 bp, Homo sapiens
gaataccaggatttgccagatatgagcacccacggtggccaatgagagaccatgtgatacaccatgcaacaccaactgagaccaaatattgccagaggttaacctgctgctctcccattgatgtccagtggttgacacatcagcgcaccttgggggaccaatctgttcccaaggtattgccaatcacagaccatgcattcacacaaggaagcacctgattgacatccaaggaactacaccacatagcaccaagtgaaggacacactgaggcccccagtgatgtggcctggcaaatt

SEQ ID NO: 694157 - DNA, 2832 bp, Homo sapiens
  misc_feature (23)..(23): n is a, c, g, or t
  misc_feature (27)..(27): n is a, c, g, or t
gtacgcgctaggcggaccgcgangggnagaggccagcactgaggaggaggacaaggagggggccgtggtttctgcgccctctgtcaagggagtgtcgtttgaccaggccaataacctgctgatagagcctgctcgcattgaggaggaagagctgaccctcaccatcctgcggcagactgggggcctgggcatcagcattgcgggcggcaagggctccacaccctataagggggacgacgagggcatattcatctctcgggtgtccgaggaaggccctgcggcccgggctggagtccgtgtgggtgacaagctcctggaggtgaatggtgtggctctgcagggcgccgagcaccacgaggccgtggaggcgctccggggggccggcactgccgtgcagatgcgagtgtggcgggagcgcatggtggagcctgagaacgcggtcaccatcacgccgctgcggcccgaggatgattacagcccccgagagcggcggggaggggggctgcgcctgcccctgctcccgcctgagagccccgggcccctccgtcagcgccacgtggcctgcctggcacgcagcgagagggggctgggcttcagcattgctggtgggaaaggctccacaccctacagggctggtgatgcgggcatcttcgtctcccgcattgccgagggcggtgctgctcaccgcgcgggcacactgcaggttggcgaccgcgtcctctctattaatggagtggacgtgactgaggccaggcatgaccacgccgtctccctgctgaccgctgcctcccccaccatcgccctgctgttggagcgggaggctgggggccctcttcctcccagccctctgccacattcctcaccccccaccgcatcctggcagtgaacgggcaagacgtgcgggatgccacgcaccaagaagcagtcagtgccctgctccggccctgcctggagctgtcgctgctggtgcggagggacccggcacccccgggcctacgggaactgtgcatccagaaggcacctggggagaggctgggcatcagcatccgcgggggtgccaggggccacgctggcaacccccgcgacccacagacgagggcatcttcatctccaaggtgagccccacgggggcagccgggcgcgacggtcggctgcgtgtgggtttgcggctgttggaggtgaaccagcagagcctgctgggcctgacgcacggcgaggcggtgcagctgctccgcagtgtgggcgacaccctcaccgtgctggtctgtgacggcttcgaggccagcaccgacgcagccctggaggtgtccccaggtgtcattgccaacccctttgcggcaggcatcggccaccggaacagcctggagagcatctcttccatcgaccgggagctgagccctgagggcccaggcaaggagaaggagctgcctggacagaccctgcactgggggcccgaggccacagaagccgcaggtcggggtctgcagcccctgaagctggactaccgcgccctggccgccgtgcccagcgctggcagcgtgcagagggtaccgtctggagcagctggagggaagatggctgaatctccctgctcccctagtggccagcagccgccctccccgccttctccggatgagctgcccgccaatgtgaagcaggcctacagggccttcgcggccgtgcccacttctcacccgcctgaggatgcccctgcccagccccccacgcctgggcctgcagcctccccggagcagctgtccttccgggagcggcagaagtactttgagctggaggtgcgcgtgccccaggccgagggcccccctaagcgcgtgtccctggtgggtgctgacgacctgcggaagatgcaggaggaggaagccagaaaactacagcagaagagagcgcagatgctgcgggaggcggcagaggctggggccgaagcgaggctcgccctggacggggagacgctgggcgaggaggaacaggaggatgagcagccaccctgggccagcccgagccccacctcaaggcagagcccggcgtcccccccgcccctgggaggtggcgccccggtgcggacggccaaagctgaacggcgccaccaggagcggctgcgcgtgcagagtccggagccaccggcacccgagcgtgccctgtcccctgccgagctccgggccctggaggccgagaagcgtgcgctgtggagggcagccaggatgaagtcattggaacaggacgctctccgagcacagatggtcctcagcaggtcccaggaaggccggggcacgcgggggcccctggagcgactggccgaggccccttcccctgcgcccaccccgtcgcccacccctgtggaagacctcggcccccagaccagcacctccccgggacgcctgtcaccggactttgctgaggagttgaggtccctggaaccatctcccagccctggcccgcaggaggaggatggagaagtggctctggtgcttctgggcaggccctcacccggcgctgtgggccctgaagatgtggcactgtgcagcagccgccgccccgtaaggcctgggcgccgtggcctgggccctgtgccctcctagaggagcaggcacctcccccagacttggggtgggggccctgccagctccagcaccacccttgccccaagtcttttaacctgggtgttagcattttaaagagaccccacaggagttctggcctgtgactaactaactgccccaccccagccgagacctcggcgagactgtaactagtgatgtttgtacaaccaaagactctattttgtggtttaaggagaataaagttgactacatttta

SEQ ID NO: 694158 - DNA, 3178 bp, Homo sapiens
  misc_feature (23)..(23): n is a, c, g, or t
  misc_feature (27)..(27): n is a, c, g, or t
gtacgcgctaggcggaccgcgangggnagaggccagcactgaggaggaggacaaggagggggccgtggtttctgcgccctctgtcaagggagtgtcgtttgaccaggccaataacctgctgatagagcctgctcgcattgaggaggaagagctgaccctcaccatcctgcggcagactgggggcctgggcatcagcattgcgggcggcaagggctccacaccctataagggggacgacgagggcatattcatctctcgggtgtccgaggaaggccctgcggcccgggctggagtccgtgtgggtgacaagctcctggaggtgaatggtgtggctctgcagggcgccgagcaccacgaggccgtggaggcgctccggggggccggcactgccgtgcagatgcgagtgtggcgggagcgcatggtggagcctgagaacgcggtcaccatcacgccgctgcggcccgaggatgattacagcccccgagagcggcggggaggggggctgcgcctgcccctgctcccgcctgagagccccgggcccctccgtcagcgccacgtggcctgcctggcacgcagcgagagggggctgggcttcagcattgctggtgggaaaggctccacaccctacagggctggtgatgcgggcatcttcgtctcccgcattgccgagggcggtgctgctcaccgcgcgggcacactgcaggttggcgaccgcgtcctctctattaatggagtggacgtgactgaggccaggcatgaccacgccgtctccctgctgaccgctgcctcccccaccatcgccctgctgttggagcgggaggctgggggccctcttcctcccagccctctgccacattcctcaccccccaccgctgctgttgccaccaccagcataaccactgccacccccggggtgcctgggttgccgagcctggcccccagcctgctggctgccgcgttggaagggccatacccagtggaggagatccgtctgccaagagctgggggccctctggggcttagtattgtcggaggctccgaccattccagccacccgtttggtgtccaggagcctggtgtgttcatctccaaggtgctcccgcggggcctggccgctcgcagcggcctgcgggttggggaccgcatcctggcagtgaacgggcaagacgtgcgggatgccacgcaccaagaagcagtcagtgccctgctccggccctgcctggagctgtcgctgctggtgcggagggacccggcacccccgggcctacgggaactgtgcatccagaaggcacctggggagaggctgggcatcagcatccgcgggggtgccaggggccacgctggcaacccccgcgacccacagacgagggcatcttcatctccaaggtgagccccacgggggcagccgggcgcgacggtcggctgcgtgtgggtttgcggctgttggaggtgaaccagcagagcctgctgggcctgacgcacggcgaggcggtgcagctgctccgcagtgtgggcgacaccctcaccgtgctggtctgtgacggcttcgaggccagcaccgacgcagccctggaggtgtccccaggtgtcattgccaacccctttgcggcaggcatcggccaccggaacagcctggagagcatctcttccatcgaccgggagctgagccctgagggcccaggcaaggagaaggagctgcctggacagaccctgcactgggggcccgaggccacagaagccgcaggtcggggtctgcagcccctgaagctggactaccgcgccctggccgccgtgcccagcgctggcagcgtgcagagggtaccgtctggagcagctggagggaagatggctgaatctccctgctcccctagtggccagcagccgccctccccgccttctccggatgagctgcccgccaatgtgaagcaggcctacagggccttcgcggccgtgcccacttctcacccgcctgaggatgcccctgcccagccccccacgcctgggcctgcagcctccccggagcagctgtccttccgggagcggcagaagtactttgagctggaggtgcgcgtgccccaggccgagggcccccctaagcgcgtgtccctggtgggtgctgacgacctgcggaagatgcaggaggaggaagccagaaaactacagcagaagagagcgcagatgctgcgggaggcggcagaggctggggccgaagcgaggctcgccctggacggggagacgctgggcgaggaggaacaggaggatgagcagccaccctgggccagcccgagccccacctcaaggcagagcccggcgtcccccccgcccctgggaggtggcgccccggtgcggacggccaaagctgaacggcgccaccaggagcggctgcgcgtgcagagtccggagccaccggcacccgagcgtgccctgtcccctgccgagctccgggccctggaggccgagaagcgtgcgctgtggagggcagccaggatgaagtcattggaacaggacgctctccgagcacagatggtcctcagcaggtcccaggaaggccggggcacgcgggggcccctggagcgactggccgaggccccttcccctgcgcccaccccgtcgcccacccctgtggaagacctcggcccccagaccagcacctccccgggacgcctgcccttgtctggaaagaagtttgactacagggcctttgcggccctgccttcttccagacctgtttatgacatccagtcaccggactttgctgaggagttgaggtccctggaaccatctcccagccctggcccgcaggaggaggatggagaagtggctctggtgcttctgggcaggccctcacccggcgctgtgggccctgaagatgtggcactgtgcagcagccgccgccccgtaaggcctgggcgccgtggcctgggccctgtgccctcctagaggagcaggcacctcccccagacttggggtgggggccctgccagctccagcaccacccttgccccaagtcttttaacctgggtgttagcattttaaagagaccccacaggagttctggcctgtgactaactaactgccccaccccagccgagacctcggcgagactgtaactagtgatgtttgtacaaccaaagactctattttgtggtttaaggagaataaagttgactacatttta

SEQ ID NO: 694159 - DNA, 234 bp, Homo sapiens
tgaaggctgaggctgcagtgagctgagattgcactactgcactccagcctgggcaacagagtgagatactatctaaaaaaaaaaaaaaaaaaaaaggaaaaaaaaaaaaaaaaaaaacccctttcctcacccttttaaggcccgtgttatctgccccttggtggctcatcgtcacattggcaaccaaaaacaacaattgccaaagccaattatccttgtgggacaattgccttt

SEQ ID NO: 694160 - DNA, 875 bp, Homo sapiens
actactccctagtgacagaggccgggaggtatcgggcctgactaagccgagtggcagcggagtgagcggagccttcagccccgcggctgggccgagcccgaaggtggctgtcggtgtcgtgggagcccggcggtgcacctggccgtcctccctggtgcctgcatctgctggtgtgttggttggaccaggggctctgtgtgcttcacacaatggctggtgcttctgctgtggctgagaaccatgcctgcgcatatgttgccttgaatgatgctctatgcctggtgcccatgcttgtggacctggcctgggttgcgttgccctgggagctgcccgggctgcgatgcgttgtgctgtggctggctgttgtgtctgcgggttgctgcatcccccattcaaaatgcactgggctgttgtggttgtgcctggactttggggatgtgctgcttgtggcacaggtggtgcttggttgggtgatggctgccccttgctttgtggttgggtgcctgtgcccttgctgtggttgttggccccattggaggccatggtttgtgccccctgtggctttgggttggatgcctggaacctcctggccctgtctggtggctggccctgccccttgctgtgtggccctggctggacatacggtcgtgtttggggctggtggaggccttggctttggttttccggactggatcccccttggggcctatggttggcacccctgggtgttgcccaacaacttgggccttaatgccaaccctggcttgttttgcctgggtgctgccttctttgtctccccacccgggggtggcttgtttccatgccggggggctttgggccttgttgtgaagtggccgggcctgctggcgccgttg

SEQ ID NO: 694161 - DNA, 2400 bp, Homo sapiens
gctccaagctgccccagcccgaggccgttgtggctctgctgcagggcatgcagcctgatggggagggccctgtggctcccgggggctggcacaatggcccccacgcaccctgggctcctcgggcccagaaggaggaggaggaggaggaagagggtagtcctcaggaggaggaggaagaggaggaggaggaaaacagggctgaagaggaagaggcctgggttgccgagcctggcccccagcctgctggctgccgcgttggaagggccatacccagtggaggagatccgtctgccaagagctgggggccctctggggcttagtattgtcggaggctccgaccattccagccacccgtttggtgtccaggagcctggtgtgttcatctccaaggtgctcccgcggggcctggccgctcgcagcggcctgcgggttggggaccgcatcctggcagtgaacgggcaagacgtgcgggatgccacgcaccaagaagcagtcagtgccctgctccggccctgcctggagctgtcgctgctggtgcggagggacccggcacccccgggcctacgggaactgtgcatccagaaggcacctggggagaggctgggcatcagcatccgcgggggtgccaggggccacgctggcaacccccgcgacccacagacgagggcatcttcatctccaaggtgagccccacgggggcagccgggcgcgacggtcggctgcgtgtgggtttgcggctgttggaggtgaaccagcagagcctgctgggcctgacgcacggcgaggcggtgcagctgctccgcagtgtgggcgacaccctcaccgtgctggtctgtgacggcttcgaggccagcaccgacgcagccctggaggtgtccccaggtgtcattgccaacccctttgcggcaggcatcggccaccggaacagcctggagagcatctcttccatcgaccgggagctgagccctgagggcccaggcaaggagaaggagctgcctggacagaccctgcactgggggcccgaggccacagaagccgcaggtcggggtctgcagcccctgaagctggactaccgcgccctggccgccgtgcccagcgctggcagcgtgcagagggtaccgtctggagcagctggagggaagatggctgaatctccctgctcccctagtggccagcagccgccctccccgccttctccggatgagctgcccgccaatgtgaagcaggcctacagggccttcgcggccgtgcccacttctcacccgcctgaggatgcccctgcccagccccccacgcctgggcctgcagcctccccggagcagctgtccttccgggagcggcagaagtactttgagctggaggtgcgcgtgccccaggccgagggcccccctaagcgcgtgtccctggtgggtgctgacgacctgcggaagatgcaggaggaggaagccagaaaactacagcagaagagagcgcagatgctgcgggaggcggcagaggctggggccgaagcgaggctcgccctggacggggagacgctgggcgaggaggaacaggaggatgagcagccaccctgggccagcccgagccccacctcaaggcagagcccggcgtcccccccgcccctgggaggtggcgccccggtgcggacggccaaagctgaacggcgccaccaggagcggctgcgcgtgcagagtccggagccaccggcacccgagcgtgccctgtcccctgccgagctccgggccctggaggccgagaagcgtgcgctgtggagggcagccaggatgaagtcattggaacaggacgctctccgagcacagatggtcctcagcaggtcccaggaaggccggggcacgcgggggcccctggagcgactggccgaggccccttcccctgcgcccaccccgtcgcccacccctgtggaagacctcggcccccagaccagcacctccccgggacgcctgtcaccggactttgctgaggagttgaggtccctggaaccatctcccagccctggcccgcaggaggaggatggagaagtggctctggtgcttctgggcaggccctcacccggcgctgtgggccctgaagatgtggcactgtgcagcagccgccgccccgtaaggcctgggcgccgtggcctgggccctgtgccctcctagaggagcaggcacctcccccagacttggggtgggggccctgccagctccagcaccacccttgccccaagtcttttaacctgggtgttagcattttaaagagaccccacaggagttctggcctgtgactaactaactgccccaccccagccgagacctcggcgagactgtaactagtgatgtttgtacaaccaaagactctattttgtggtttaaggagaataaagttgactacatttta

SEQ ID NO: 694162 - DNA, 285 bp, Homo sapiens
tgacttagtgtaacctaggagattttatagtttttttttaatgaaaccctgattgacgcccaccagtggggagaacagcgtttttttcctgtccccaaaaccaggaaaccccgtttgtaagggtgtgttgtggtgctttattgtacaccccccaggggggttttttttactttaatgtttttttggtttccccccccaaaaaaatcatgaatttgccccaaccctaatttttggttccttttttttttattgatggattttaaaatgaaaaattttataaggcca

SEQ ID NO: 694163 - DNA, 2326 bp, Homo sapiens
  misc_feature (23)..(23): n is a, c, g, or t
  misc_feature (27)..(27): n is a, c, g, or t
gtacgcgctaggcggaccgcgangggnagaggccagcactgaggaggaggacaaggagggggccgtggtttctgcgccctctgtcaagggagtgtcgtttgaccaggccaataacctgctgatagagcctgctcgcattgaggaggaagagctgaccctcaccagcctgctggctgccgcgttggaagggccatacccagtggaggagatccgtctgccaagagctgggggccctctggggcttagtattgtcggaggctccgaccattccagccacccgtttggtgtccaggagcctggtgtgttcatctccaaggtgctcccgcggggcctggccgctcgcagcggcctgcgggttggggaccgcatcctggcagtgaacgggcaagacgtgcgggatgccacgcaccaagaagcagtcagtgccctgctccggccctgcctggagctgtcgctgctggtgcggagggacccggcacccccgggcctacgggaactgtgcatccagaaggcacctggggagaggctgggcatcagcatccgcgggggtgccaggggccacgctggcaacccccgcgacccacagacgagggcatcttcatctccaaggtgagccccacgggggcagccgggcgcgacggtcggctgcgtgtgggtttgcggctgttggaggtgaaccagcagagcctgctgggcctgacgcacggcgaggcggtgcagctgctccgcagtgtgggcgacaccctcaccgtgctggtctgtgacggcttcgaggccagcaccgacgcagccctggaggtgtccccaggtgtcattgccaacccctttgcggcaggcatcggccaccggaacagcctggagagcatctcttccatcgaccgggagctgagccctgagggcccaggcaaggagaaggagctgcctggacagaccctgcactgggggcccgaggccacagaagccgcaggtcggggtctgcagcccctgaagctggactaccgcgccctggccgccgtgcccagcgctggcagcgtgcagagggtaccgtctggagcagctggagggaagatggctgaatctccctgctcccctagtggccagcagccgccctccccgccttctccggatgagctgcccgccaatgtgaagcaggcctacagggccttcgcggccgtgcccacttctcacccgcctgaggatgcccctgcccagccccccacgcctgggcctgcagcctccccggagcagctgtccttccgggagcggcagaagtactttgagctggaggtgcgcgtgccccaggccgagggcccccctaagcgcgtgtccctggtgggtgctgacgacctgcggaagatgcaggaggaggaagccagaaaactacagcagaagagagcgcagatgctgcgggaggcggcagaggctggggccgaagcgaggctcgccctggacggggagacgctgggcgaggaggaacaggaggatgagcagccaccctgggccagcccgagccccacctcaaggcagagcccggcgtcccccccgcccctgggaggtggcgccccggtgcggacggccaaagctgaacggcgccaccaggagcggctgcgcgtgcagagtccggagccaccggcacccgagcgtgccctgtcccctgccgagctccgggccctggaggccgagaagcgtgcgctgtggagggcagccaggatgaagtcattggaacaggacgctctccgagcacagatggtcctcagcaggtcccaggaaggccggggcacgcgggggcccctggagcgactggccgaggccccttcccctgcgcccaccccgtcgcccacccctgtggaagacctcggcccccagaccagcacctccccgggacgcctgtcaccggactttgctgaggagttgaggtccctggaaccatctcccagccctggcccgcaggaggaggatggagaagtggctctggtgcttctgggcaggccctcacccggcgctgtgggccctgaagatgtggcactgtgcagcagccgccgccccgtaaggcctgggcgccgtggcctgggccctgtgccctcctagaggagcaggcacctcccccagacttggggtgggggccctgccagctccagcaccacccttgccccaagtcttttaacctgggtgttagcattttaaagagaccccacaggagttctggcctgtgactaactaactgccccaccccagccgagacctcggcgagactgtaactagtgatgtttgtacaaccaaagactctattttgtggtttaaggagaataaagttgactacatttta

SEQ ID NO: 694164 - DNA, 382 bp, Homo sapiens
  misc_feature (55)..(55): n is a, c, g, or t
  misc_feature (82)..(82): n is a, c, g, or t
aggctgggtgcggtggctcacacctgtaatcctagcactttggaaggccggggtnggagggtctcttgagcccaggagtttnagaccagcctgggcaacatagtgaaatcccatactacaaaaaattagctggttgtagtggtgcacacctgtagtcccagctactcgggaggctgaagcaagaggaccgcttcagccggggaagtcaaggctgcagtgagccaagatcatgccactgcacttcagcctgagcaacaagagtgagaccctgtgccaaaaaaacccctcaaaaaaccatgttggggagggctgatcagattaggggagggaaggtctttgttgcagggaaaaaaaggcagtttttaaggcctcactggttttc

SEQ ID NO: 694165 - DNA, 879 bp, Homo sapiens
  misc_feature (871)..(871): n is a, c, g, or t
ttgtgctctatcccccgtcgtgccccgtattgacgttccatctcgaacactttgcaattaaaggtagattctcgtgtaccgttatttccgaggggtgtccgatgatcgcgtcgcgccagcattttagccgggcgttaacctgcagacatgtggagaagttgcaatagatgatacgttgtatatccaaatatatcagagcacgaatgatagctagactatatcttgccatggcagatgcgtacctcagcccacactgtctcgtagtcatcgtttatcacatagtgtgattgactggtgtgactggattcattggtttggacatcatagctagcatagtgcaattatgataatggggactgacccttatcacctctgtgcacttgggcatatatccggtactctggagatattccgagatgctgggagcttgtaaatagaccatggtggctgcatgctctgtgggacctaggtgcaagtacaaatgaggctttgtacatagctcttacagtgcagcagcaacccacagacatctgtatcatcaagctttccctacaccaaagtcggaatctactgaacaatcagaaaagaaaaaaatgtaagtgcaaatttgagaggaatagcaggtgcatgaccaattgtcaattaaatattcagttttatgtctccatgcaaacattcaaagtgcttcacatcagaagcggagtaaaatacgtgaaacacctgtgaagatctgcaaactggattagggtcttttacttcagtgtttaaataagcagaagtatgtatgcatggttatactattttgttaacatgtacaatttccgtgagtgtttcttcagaaatgcgttgttataaagtattgtctatttangtaccccg

SEQ ID NO: 694166 - DNA, 422 bp, Homo sapiens
  misc_feature (40)..(40): n is a, c, g, or t
  misc_feature (124)..(124): n is a, c, g, or t
  misc_feature (169)..(169): n is a, c, g, or t
tcccaccctttttttaaactatgccctccggttttttggnaccgtgtttggtgaaggggcccttttaaacacctggtacctcaagaatgccttttccgattggtgcctagtcccttccagattngttcccctttttaaatttgaaattagcccagatgtggtggcttanacctgtaatcccagcattttgggaggctgaggtaggcagatcgcttgaactgaggagttaagagaccagcttgggcaacatggtgaaacctcgtctctacaaaaaatacagaaattagccaagtgtcgtggtccacccctgtagtcccagctgctcaggaggctgaggcgggaggatcgcttgcacctgggaggtcaggactgcagtgagccatgtcctcaccactgtaatccagcctgagttacagagtgag

SEQ ID NO: 694167 - DNA, 3575 bp, Homo sapiens
  misc_feature (23)..(23): n is a, c, g, or t
  misc_feature (27)..(27): n is a, c, g, or t
gtacgcgctaggcggaccgcgangggnagaggccagcactgaggaggaggacaaggagggggccgtggtttctgcgccctctgtcaagggagtgtcgtttgaccaggccaataacctgctgatagagcctgctcgcattgaggaggaagagctgaccctcaccatcctgcggcagactgggggcctgggcatcagcattgcgggcggcaagggctccacaccctataagggggacgacgagggcatattcatctctcgggtgtccgaggaaggccctgcggcccgggctggagtccgtgtgggtgacaagctcctggaggtgaatggtgtggctctgcagggcgccgagcaccacgaggccgtggaggcgctccggggggccggcactgccgtgcagatgcgagtgtggcgggagcgcatggtggagcctgagaacgcggtcaccatcacgccgctgcggcccgaggatgattacagcccccgagagcggcggggaggggggctgcgcctgcccctgctcccgcctgagagccccgggcccctccgtcagcgccacgtggcctgcctggcacgcagcgagagggggctgggcttcagcattgctggtgggaaaggctccacaccctacagggctggtgatgcgggcatcttcgtctcccgcattgccgagggcggtgctgctcaccgcgcgggcacactgcaggttggcgaccgcgtcctctctattaatggagtggacgtgactgaggccaggcatgaccacgccgtctccctgctgaccgctgcctcccccaccatcgccctgctgttggagcgggaggctgggggccctcttcctcccagccctctgccacattcctcaccccccaccgctgctgttgccaccaccagcataaccactgccacccccggggtgcctgggttgccgagcctggcccccagcctgctggctgccgcgttggaagggccatacccagtggaggagatccgtctgccaagagctgggggccctctggggcttagtattgtcggaggctccgaccattccagccacccgtttggtgtccaggagcctggtgtgttcatctccaaggtgctcccgcggggcctggccgctcgcagcggcctgcgggttggggaccgcatcctggcagtgaacgggcaagacgtgcgggatgccacgcaccaagaagcagtcagtgccctgctccggccctgcctggagctgtcgctgctggtgcggagggacccggcacccccgggcctacgggaactgtgcatccagaaggcacctggggagaggctgggcatcagcatccgcgggggtgccaggggccacgctggcaacccccgcgacccacagacgagggcatcttcatctccaaggtgagccccacgggggcagccgggcgcgacggtcggctgcgtgtgggtttgcggctgttggaggtgaaccagcagagcctgctgggcctgacgcacggcgaggcggtgcagctgctccgcagtgtgggcgacaccctcaccgtgctggtctgtgacggcttcgaggccagcaccgacgcagccctggaggtgtccccaggtgtcattgccaacccctttgcggcaggcatcggccaccggaacagcctggagagcatctcttccatcgaccgggagctgagccctgagggcccaggcaaggagaaggagctgcctggacagaccctgcactgggggcccgaggccacagaagccgcaggtcggggtctgcagcccctgaagctggactaccgcgccctggccgccgtgcccagcgctggcagcgtgcagagggtaccgtctggagcagctggagggaagatggctgaatctccctgctcccctagtggccagcagccgccctccccgccttctccggatgagctgcccgccaatgtgaagcaggcctacagggccttcgcggccgtgcccacttctcacccgcctgaggatgcccctgcccagccccccacgcctgggcctgcagcctccccggagcagctgtccttccgggagcggcagaagtactttgagctggaggtgcgcgtgccccaggccgagggcccccctaagcgcgtgtccctggtgggtgctgacgacctgcggaagatgcaggaggaggaagccagaaaactacagcagaagagagcgcagatgctgcgggaggcggcagaggctggggccgaagcgaggctcgccctggacggggagacgctgggcgaggaggaacaggaggatgagcagccaccctgggccagcccgagccccacctcaaggcagagcccggcgtcccccccgcccctgggaggtggcgccccggtgcggacggccaaagctgaacggcgccaccaggagcggctgcgcgtgcagagtccggagccaccggcacccgagcgtgccctgtcccctgccgagctccgggccctggaggccgagaagcgtgcgctgtggagggcagccaggatgaagtcattggaacaggacgctctccgagcacagatggtcctcagcaggtcccaggaaggccggggcacgcgggggcccctggagcgactggccgaggccccttcccctgcgcccaccccgtcgcccacccctgtggaagacctcggcccccagaccagcacctccccgggacgcctgtcaccggactttgctgaggagttgaggtccctggaaccatctcccagccctggcccgcaggaggaggatggagaagtggctctggtgcttctgggcaggccctcacccggcgctgtgggccctgaagatgtggcactgtgcagcagccgccgccccgtaaggcctgggcgccgtggcctgggccctgtgccctcctagaggagcaggcacctcccccagacttggggtgggggccctgccagctccagcaccacccttgccccaagtcttttaacctgggtgttagcattttaaagagaccccacaggagttctggcctgtgactaactaactgccccaccccagccgagacctcggcgagactgtaactagtgatgtttgtacaaccaaagactctattttgtggtttaaggagaataaagttgactacattttacctcccgtctgcctgtccatcccccacccactagcacagacccttcctgccttccacaccgctcagcctcggcctccttgtgcctctgggcctcctgggcccggcgctgctgctcagcctccatgttctggagcatggcctccgtgaggctcaggtcccacgagcgcagcacgctcaccactgtgtccagtgaggccacctagtgacagacgacatttgtcgggccctcagtgcgtgttccgagtctcctcagcctggagaggaactgttgctctcccatctgggagaaagggtgccattatgcagaaagggcctcagtgctcacagctggtgcgtggtgggccccaaagcatgagcccctgtggggctgctgtccccaaagcccaggccacccaggccgctgggaattctcctgggctccctgaccaagtccaagcaggaacctgctcctgtggctgggcctccaagggct

SEQ ID NO: 694168 - DNA, 499 bp, Homo sapiens
  misc_feature (420)..(420): n is a, c, g, or t
acagtggaggtgggtgtgttttagctggcctcctgtagagtcagcctttaaactgctgtgaactttgtcatgacttgaagatagacaaaaactctctaaagacatgtgtttgtgctcacttcggcagcacctatactaaaattggaaggatacagagaagattagccatgccccctgctcaaggatgacacgcaaattcgtgaagtgttcgtatttttttttaaaaaagacatatgtttgttttccccattacagaatgtgtgagcttagtttatcttcttttgtatttagtcataaactctgaagctggcagctacgaccttaggatcaggaaggtgcatttcacctggtagaattaagtgttgctgattatgggaagcagaaggtaagtaatggaaaaacgttttgcctggggtgggnttctattttagaaaaaagaagatgatcattcttgaaccattagttttatttttgctattttcttttaactatcctgatg

SEQ ID NO: 694169 - DNA, 3364 bp, Homo sapiens
  misc_feature (23)..(23): n is a, c, g, or t
  misc_feature (27)..(27): n is a, c, g, or t
gtacgcgctaggcggaccgcgangggnagaggccagcactgaggaggaggacaaggagggggccgtggtttctgcgccctctgtcaagggagtgtcgtttgaccaggccaataacctgctgatagagcctgctcgcattgaggaggaagagctgaccctcaccatcctgcggcagactgggggcctgggcatcagcattgcgggcggcaagggctccacaccctataagggggacgacgagggcatattcatctctcgggtgtccgaggaaggccctgcggcccgggctggagtccgtgtgggtgacaagctcctggaggtgaatggtgtggctctgcagggcgccgagcaccacgaggccgtggaggcgctccggggggccggcactgccgtgcagatgcgagtgtggcgggagcgcatggtggagcctgagaacgcggtcaccatcacgccgctgcggcccgaggatgattacagcccccgagagcggcggggaggggggctgcgcctgcccctgctcccgcctgagagccccgggcccctccgtcagcgccacgtggcctgcctggcacgcagcgagagggggctgggcttcagcattgctggtgggaaaggctccacaccctacagggctggtgatgcgggcatcttcgtctcccgcattgccgagggcggtgctgctcaccgcgcgggcacactgcaggttggcgaccgcgtcctctctattaatggagtggacgtgactgaggccaggcatgaccacgccgtctccctgctgaccgctgcctcccccaccatcgccctgctgttggagcgggaggctgggggccctcttcctcccagccctctgccacattcctcaccccccaccgctgctgttgccaccaccagcataaccactgccacccccggggtgcctgggttgccgagcctggcccccagcctgctggctgccgcgttggaagggccatacccagtggaggagatccgtctgccaagagctgggggccctctggggcttagtattgtcggaggctccgaccattccagccacccgtttggtgtccaggagcctggtgtgttcatctccaaggtgctcccgcggggcctggccgctcgcagcggcctgcgggttggggaccgcatcctggcagtgaacgggcaagacgtgcgggatgccacgcaccaagaagcagtcagtgccctgctccggccctgcctggagctgtcgctgctggtgcggagggacccggcacccccgggcctacgggaactgtgcatccagaaggcacctggggagaggctgggcatcagcatccgcgggggtgccaggggccacgctggcaacccccgcgacccacagacgagggcatcttcatctccaaggtgagccccacgggggcagccgggcgcgacggtcggctgcgtgtgggtttgcggctgttggaggtgaaccagcagagcctgctgggcctgacgcacggcgaggcggtgcagctgctccgcagtgtgggcgacaccctcaccgtgctggtctgtgacggcttcgaggccagcaccgacgcagccctggaggtgtccccaggtgtcattgccaacccctttgcggcaggcatcggccaccggaacagcctggagagcatctcttccatcgaccgggagctgagccctgagggcccaggcaaggagaaggagctgcctggacagaccctgcactgggggcccgaggccacagaagccgcaggtcggggtctgcagcccctgaagctggactaccgcgccctggccgccgtgcccagcgctggcagcgtgcagagggtaccgtctggagcagctggagggaagatggctgaatctccctgctcccctagtggccagcagccgccctccccgccttctccggatgagctgcccgccaatgtgaagcaggcctacagggccttcgcggccgtgcccacttctcacccgcctgaggatgcccctgcccaggtccagctccaccccagaaccccacacgcccatgggcactgacagactccaccgggagcagcatgtcacttcacgaggcagcggcagaaagtacatatatgacgatggaggtgctgcagtgccaccagggacaggcaggagaaccacgacataagacgcgtagtaccctggatggcgtgcatgaccgaaccaatgccggagcgcactgccaggaacggacggcacagccacgacaagccctaacagacacgaaaagaagacgcgcaggacatgcctgccggagcaggcgcaggcaacaagagcctgcgggcccgcacaccgccgagggcatccagcaccatggcacccggggacagcaaagacaggaggcagacgggacggcaacacacagcgacggactcgaagcaagacacaagaacagagggaaccacgagccgcggacgacggccaaaacaatgacagagacaaccaagcgacagcaggacggaaaaaacaacaaccggagacaccagcgagcagaagcaacatgagacggccccacacgagcagaaccgcgaaacgagaaacgacacacacacccggacacgcgacagaacaccacacgaccgacacacgaacccatgaaacaaacgacacgaagaaaccaagcacccggaaacaacacggagacaagagccggcgcagccacagaggcaacagacgcccaacaacgagccgaggaaagagacagagagagaaaaaaagcaagagagcaacgagcacacaagcggaagacaggaacgaaagaccacacaagacagagacaaaagagcaagaggagagagcagaaggccaaggaaaggagacgacagaaacagcaaaaacagagaacacacagagaaacaggaagaaaacaagaaagcaaaaggacaccacacgagagagaggaaccgggacagcaacgagaaggaggaaccacagaaaggggaacagggcgaccagaacgaccaatacggcgaagacagccagacacaagaaaagagacagagaacaagcagcgacaaaggacaacgaaagaccaacagagacagcaacaaagcaacgcaggaccaagagagaaaaccaggaaacagacaacagcagagagagacagcagccggagagacagagagagcgcgaaaagaaagagcgaaggagcagggacagagagaggacagaggaacaagcgagccgggacaaagcgaacagagaacagagagaaagaggcagaaagagaaaagaaaggacagaagagacggccgagagacagcaaaacaacaacgagagaaaaaaccaggagaaaagcacaggaggaacaagacagcaagaggcaagaagacaaaacacaacaaaagag

SEQ ID NO: 694170 - DNA, 395 bp, Homo sapiens
gccatgtacctgggatagaataaagtgctcgattaatattagatgcaccgtaattatgatcctgtttattactctctacgattaactcctgagttctagctcttcctctcatcttgctataggatcttaagaatgttgcttctcgtcttccctgctccctgttctcagaccatcaaatgagaggtttgatgagatgatctctaaagtctcctttagctctacggtattagcagtcactgatctttttttctttctttttttttgaggtggggtctcactctctcacccaggctggagtgcagtggtgcaatcttggctcactgcaatctcttcctccctggctcaaatgatcttccccagtagctgggaagatcatttgaggtaatccgtgaggg

SEQ ID NO: 694171 - DNA, 120 bp, Homo sapiens
atttttgggggggccccccccattaaaaaaccccccctcttggggggttttttaaaaaaccccaaccccccaaaaagtttgccaagaaaagatttttttaattgttaacctttaagggga

SEQ ID NO: 694172 - DNA, 227 bp, Homo sapiens
  misc_feature (195)..(195): n is a, c, g, or t
gagaccgtgacgtagcacaggaaatagaaagacatataaaaaagcatccgatgaactatgtagacttatataaccccaaacggcaccgccaatgtattggtttagataaatgctaagtaatgataccaaatcgatagggttacttggaatagaggtaataggagactcggaggtatcccttctcagagtgtgtgnggtttatgtagccgactgaagttcatgagagt

SEQ ID NO: 694173 - DNA, 144 bp, Homo sapiens
ccttcgacttggcgggcacttagaggtggggagcagagaattctctatccaacatcaacatcttggtccagatatgaactcttcaatctctgcactcaaagctgttaagatagttaagcgtgcataagttgcccgccaatcgaa

SEQ ID NO: 694174 - DNA, 536 bp, Homo sapiens
tgcttatagccagcaaaaatggtctttgatagcagccttctagacatatttgcctttaagagtcctgttcctggcaggcctccacaggctccaagatagtggaacaagagaggaaacaaatctttaattatagcttctatttcttcactgtaaccactacttatttctgtactcctcagtcattcaaaattagaactcaggattaagaaactcacttgaaactgcacaactatttgggaatggaacaacttgctcctgaatgactactgcgtaaataatgaaatgaaggcagaaataaggatgttatttgaaactagtgaggacaaagacacaatgtaccagaatctgtgggaaacatataacatggtgtgtagagggaaatttatagcactaaatgcccacaagggaaagcaggaaagatctaaaatcgacaccctaacatcagaattaaaagaactagagaagcaagaacaaattcaaaagctagcagaaggcaagaaataactaagatccaagcagaattgaaagagatccag

SEQ ID NO: 694175 - DNA, 115 bp, Homo sapiens
ggctcccccgagttatcagacgggtgcacgatatcgaggtttctacgacagatgtcgtagatggcctcattgtctatcatgaacagcacaaatcagagtgctcccacggctggtg

SEQ ID NO: 694176 - DNA, 413 bp, Homo sapiens
  misc_feature (2)..(2): n is a, c, g, or t
  misc_feature (404)..(404): n is a, c, g, or t
  misc_feature (408)..(410): n is a, c, g, or t
anggacctttccctccatataaatttcctttttttaataatccatcccttacccaaaaatacatccttttatagccctcaacttttttccaccatatcctctttcccccctactaaagtaattccctgatgcccctcaaaagtgaaaaaggcccaagtaatgtgattcaaaacagaacagagccttagattttgagaggggtctgtctgcttacacttcttggggttttatgaggaaaacagagtttctcccaaaacagggtctgtggagccttctctctttttcccaaggagtccccagctgtcagaaagtaccttatgtcctctcatgtgggcattcagagtggcaggaagacagactggggaaataattcagttgactgagaagaaagacaaacaaaaaantaannntcg

SEQ ID NO: 694177 - DNA, 432 bp, Homo sapiens
  misc_feature (70)..(70): n is a, c, g, or t
  misc_feature (73)..(73): n is a, c, g, or t
  misc_feature (98)..(99): n is a, c, g, or t
  misc_feature (102)..(102): n is a, c, g, or t
  misc_feature (108)..(108): n is a, c, g, or t
  misc_feature (127)..(127): n is a, c, g, or t
  misc_feature (130)..(130): n is a, c, g, or t
  misc_feature (138)..(138): n is a, c, g, or t
  misc_feature (143)..(143): n is a, c, g, or t
  misc_feature (330)..(330): n is a, c, g, or t
cctcttcccaagcttaccgacccgcggctgctctacatctgctttttgggctactgccgcggcctgattnatnactgatcgccggaggccgatcgcgnnggntggttngcatcgccagcttctatanatnacggcctnttttnttgctggatattatcttgtaaaacgtgaagactacctgtatgctgtgagggaccgtgaaatgtttggatatatgaaattacatccagaggattttcctgaagaagataagaaaacatatggtgaaatttttgaaaaattccatccaatacgttgaagtcttcaaaatgcttgctccagtttcactgntacctgctgtttctgaatttgatggaacatgtttcttatgacacttgaagcttacgctaatctgtatgttgacaccttgtaattaaaatacgtaccatgaga

SEQ ID NO: 694178 - DNA, 123 bp, Homo sapiens
tgaagactgcggagatctcggggtgagccttcgtacagcagatccagtattttttggcgcccaatgagccagtagctcgggggtgatcttgagctcccaggagttctcaggtactcctcagct

SEQ ID NO: 694179 - DNA, 202 bp, Homo sapiens
gatcacatacgaggggagatcacatcacggataaaatggagatcttccgcctcacacacagagtcggtggctggcatctggctctttggtcattggtgctgggaatgtgcagagaccattacagattaactttttggaaaaagggtctcattctgtcacccaggctgaagtgcagtagtgcaattacaggtcactgcagcct

SEQ ID NO: 694180 - DNA, 275 bp, Homo sapiens
agaggatctccgtgactggcattaggcttataacaaacttcctttaaaaataggtcttggtcaggcgctgtggtcacacttgtatcccagcactctgggaggcctaggcgggtgggtcacgaggtcaagaaatcgagaccatcctggctaacgtggtgaaacctcgtctctactgaaaatacaaaaaaaaaattagccagggggtgttggcaggcgcctgtagtcccagctgctcgggaggctgaggcaagaagaatagcttgaaccgtgggagg

SEQ ID NO: 694181 - DNA, 129 bp, Homo sapiens
tcagctcggtaccagctcgccatgaagtttactcatctctgccgagcaggacaacgtgctgtggagaggctagaagtagaaaaggcccatgtttaccatctagtggaaattgttttgaggaggaaatga

SEQ ID NO: 694182 - DNA, 210 bp, Homo sapiens
ctgctacccgtagtctccactttctcactgcttaggagacagatcactcctggaggctggggatggtaggatggctggggattttttttttttaaacagggtctcactctgtggcccaggctagagtgcaagggtgcaatcacagctcacggcagcctcaacctctggggttcaagcaatcctcctacctcagcctccggggtagctagc

SEQ ID NO: 694183 - DNA, 837 bp, Homo sapiens
gagcctgcttgtggacagagcaggggttggcagtggtgacgactgtttgggaaaggaaatgtaagggcatttcggctgctgtgctggggctgacgaggagcacacaggagagatgcccctcccatctcccagagtgggttggctggagttcattgcggagcatgaggacgtgtgggggacaatattatcttattcttgagaggtgtaaagagctcggccttaaagaatctcaacttttgacccgagtgacctccaggatacatccaacagagtaacagtcaagtattagttaccatttactggctgggaaaagcagcaaacagctgcacatcctacagcggaacgacactaaacctgaaggagtttgaaggattgtggctcagatgcgaaaggacactgatgacattgaaagtcctaaacgcagtatccgagacagtggctacatcgactgctgggattccgagcgcagcgactccctctctcctcctcgccacggcagagatgattccttcgacagcctggattcctttggctctcgctctcggcagacgccttcaccagatgtagtcctcaggggaagcagcgatgggagaggaagcgactctgaatccgacttgcctcatcggaagctgccagatgtgaagaaggatgacatgtctgcacggcggacttcccatggtgagccgaaatcagcagtgccttttaaccagtacctcccgaacaaaagcaatcagacggcctacgtccccgcgcctctgagaaagaagaaagcagagaagagaggataccgcaagagctggagtacgcacctccccggtgggtggggagaggccttca

SEQ ID NO: 694184 - DNA, 515 bp, Homo sapiens
gcaagttcatgacttgttgaaaaactacgggaaccagacagcgtggcagcatcaagacggacatacacatcaaggaaacaggacggccaacatggtgaaaccctgtctctactaaatataaaaaattaggcaggcatgaattttttgacaggtgctgaggtgattcaacatcgaggaggatcatcttttcacctaatagttctgaacaactggacagccacgtctaaaagaacgaagcccaaacactttctcatactacatacaaatattaactcaggatggattatagacctaaatgtgaggactaaaactatgaaactttttagaagaaagcactggaaattttttttttttggtcttttggtgagacaggatctcccactgttgcccaggttgtagtacaggggtgtgatctcagctcactgcagcctcaaccttccaggctcaagcaatcctcccatttcagcctcccaagtagctgggattacaggcatgcaccaccacacctggaaatt

SEQ ID NO: 694185 - DNA, 684 bp, Homo sapiens
tttttttttaacttttgcctcagaaagacagctccctttcagagcaggaatttcccttcaaggtagcaggagatgaacgcgtgctgctccaggattttacagaactgattctgcagcaaagacaaatgttgcctgtatttgccagatagtataaacaggagcaaaagttgcacagctaaaccaggggctcattcccaggacagacatgcagttatggattccgaaagacaagtcaaaaggacactgatgacattgaaagtcctaaacgcagtatccgagacagtggctacatcgactgctgggattccgagcgcagcgactccctctctcctcctcgccacggcagagatgattccttcgacagcctggattcctttggctctcgctctcggcagacgccttcaccagatgtagtcctcaggggaagcagcgatgggagaggaagcgactctgaatccgacttgcctcatcggaagctgccagatgtgaagaaggatgacatgtctgcacggcggacttcccatggtgagccgaaatcagcagtgccttttaaccagtacctcccgaacaaaagcaatcagacggcctacgtccccgcgcctctgagaaagaagaaagcagagaagagaggataccgcaagagctggagtacgcacctccccggtgggtggggagaggccttca

SEQ ID NO: 694186 - DNA, 278 bp, Homo sapiens
gcctggcgcaagtccagaaatatttaacaggtttatttatttttattataaagtggaaccgctgaaacttgtgggctgaaacatcctaacttgcattaatcctttacgtctccgcatttatattaaaaattcacacacaaatgaaaatggaaaaactgccaatacctgatttctgtcccctatttttccactcgcaatcatatacttaggtaccttttgaccccatggaaaaaaaatattctaacgttcagaactaccaataacagtatgaagagaaa

SEQ ID NO: 694187 - DNA, 611 bp, Homo sapiens
tttttttttaacttttgcctcagaaagacagctccctttcagagcaggaatttcccttcaaggtagcaggagatgaacgcgtgctgctccaggattttacagaactgattctgcagcaaagacaaatgttgcctgtatttgccagatagtataaacaggagcaaaggacactgatgacattgaaagtcctaaacgcagtatccgagacagtggctacatcgactgctgggattccgagcgcagcgactccctctctcctcctcgccacggcagagatgattccttcgacagcctggattcctttggctctcgctctcggcagacgccttcaccagatgtagtcctcaggggaagcagcgatgggagaggaagcgactctgaatccgacttgcctcatcggaagctgccagatgtgaagaaggatgacatgtctgcacggcggacttcccatggtgagccgaaatcagcagtgccttttaaccagtacctcccgaacaaaagcaatcagacggcctacgtccccgcgcctctgagaaagaagaaagcagagaagagaggataccgcaagagctggagtacgcacctccccggtgggtggggagaggccttca

SEQ ID NO: 694188 - DNA, 488 bp, Homo sapiens
acccggggagggcatagacagtggatgtagaaggcgctgggggccagagaagaagagagacggaccgcgaggagaggcagatgtaccccacattttaccagtgaactggtccccgcgtgctcaaaaggtggcccttccaggccgttggtaataatagtacttgagctcaccgttatttttcgagggacatatttctttttgcttttacacataagcaaacagatgttcagagacgctaagtaacgtagcaaggtcacatgcgttaataactgttttgcaagagccaaattttacaaccacatcctaagcatggaccatcacgccacgtttccttccacacgttttacccgccgatgatactgacttatgatcactactgatgagaactattcattcagttaccaaatttttgctgagtgtggtacacattctggacatgggactaggcattggggtaccatggtgagcttaaacatggagaatagact

SEQ ID NO: 694189 - DNA, 427 bp, Homo sapiens
tttttttttaacttttgcctcagaaagacagctccctttcagagcaggaatttcccttcaaggtagcaggagatgaacgcgtgctgctccaggattttacagaactgattctgcagcaaagacaaatgttgcctgtatttgccagatagtataaacaggagcaaaagttgcacagctaaaccaggggctcattcccaggacagacatgcagttatggattccgaaagacaagtcaaggttaaggttttggtttttcgtttttgttttgaactatcattgtactgttgtgaatccaaactttgtgatcctttcttctaattctttctctactcttttttttttaaacctagggaatatgagttatttggggattttttttaaaaaaaacgttgtgcatgattttctgattgggaaagttgcagcaaag

SEQ ID NO: 694190 - DNA, 1089 bp, Homo sapiens
  misc_feature (1)..(1): n is a, c, g, or t
  misc_feature (159)..(159): n is a, c, g, or t
ncttgacggcgtgcgcggggcgaggcggctggacgtggctggagcttgtcgttgtgctcgctgtgttcggttccctgggtgtgggcgcggggtgttgttctgtgtcgcggcgcgttcttgtcggggtgttgcgctccgccggggggggtcgtggggcgnagtcccgcggttgcggctcgcgtcgaggctggagcggtttgtcggagcgggggcccgttgcggggtgttcccggggggagcgccgggggggctgtggggctcacagggttgtgccagggcgtgtccattcttgttgccgagttgtttttcacccctggaggcaggccagattgcgggcatttccgtgtggtttctgggcgagagcagtcgccaggttgagccctgtgcggctgcggcgtgtacgtggccgataccggacactccccccgtacgggctggccagcacaccccagggggcccctggtccgagggaatgtgtacatccacccgcctcccaggtggccccctcggctgtgctggcccccacgtttccatcgggaagggggtgaccctgggtgagggtgttcggctccgggagagcatctgtcctccctggagcccctttgcaggggcacacgtgtgttctgcatagcatcgtgggctgggggagccccgtgggaccctgggcccgcgtggagggtaccccccgtgagcccttaccccctcgatccccgagcccgcactggaccgtgagagcctttttcaggacgggaagctgctgcctgctatccccctcctgggctgccgagtccggatccctgccgaggtgctcatcctgaaactcgattgttctgccacacccaggaggctgagccgaagcttcaccaacccgatcactcctttgagtagggctgccacgaaggcccccagctcctacccacctccccttgaggctgctgcctgcttggccagcctctgtccagaaaggaaccagagaaagccacggctggatcgtcacaatgccggggagccaatgtggatggcctggggaactcctgggttttttccctcccgactccctaattaaccccgtgaaccttggagcccaga

SEQ ID NO: 694191 - DNA, 1015 bp, Homo sapiens
  misc_feature (154)..(154): n is a, c, g, or t
  misc_feature (160)..(160): n is a, c, g, or t
  misc_feature (164)..(164): n is a, c, g, or t
  misc_feature (167)..(167): n is a, c, g, or t
  misc_feature (175)..(181): n is a, c, g, or t
  misc_feature (183)..(183): n is a, c, g, or t
agagaataaatgcgaaggccaatctccacgaaataataatgtaattccattcaagacaagaggtgaagaacagatattgcctctgcattttaactcctcccagtgccataaaatgacaacttggtaaatgttgatgtgagtgtgaatcttttanggactncaanacngaaggagnnnnnnnangcaagtaactggcagaagtttggtgataaagattttcggacaggtttagaaaatggaatcctcctctgcgagttgctgaatgctataaagccaggacttgttaaaaagatcaatagattgcctacccccattgcaggactggacaatattatcttattcttgagaggtgtaaagagctcggccttaaagaatctcaacttttgacccgagtgacctccaggatacatccaacagagtaacagtcaagagccttgattatagtaggaagctgaaaaatgtattagttaccatttactggctgggaaaagcagcaaacagctgcacatcctacagcggaacgacactaaacctgaaggagtttgaaggattgtggctcagatgcgaaaggacactgatgacattgaaagtcctaaacgcagtatccgagacagtggctacatcgactgctgggattccgagcgcagcgactccctctctcctcctcgccacggcagagatgattccttcgacagcctggattcctttggctctcgctctcggcagacgccttcaccagatgtagtcctcaggggaagcagcgatgggagaggaagcgactctgaatccgacttgcctcatcggaagctgccagatgtgaagaaggatgacatgtctgcacggcggacttcccatggtgagccgaaatcagcagtgccttttaaccagtacctcccgaacaaaagcaatcagacggcctacgtccccgcgcctctgagaaagaagaaagcagagaagagaggataccgcaagagctggagtacgcacctccccggtgggtggggagaggccttca

SEQ ID NO: 694192 - DNA, 273 bp, Homo sapiens
acacacacacacacacacacacacacacacacaaatatacatatatatcaaatatatatgtatatttgatagagatgatagcaattatgtgtgtgtgtgtgtgtgtgtgtgtgtgtgtgtgtgttagccaagtgtggtttctcatgcctgtagtcccagctactttggaggctgaagtgtaagagttgcttgagcccatgagttagaggctgctgtgagctatgatcatgcccctgcactccagcctgggcaacagagcaaaaccccatctct

SEQ ID NO: 694193 - DNA, 103 bp, Homo sapiens
ttcactgatctagaggacccttctacagcacttcaggtagggtctcaggtgcaagggatctgcagagggagtgagggcaggctcattgcaacacggtctctca

SEQ ID NO: 694194 - DNA, 656 bp, Homo sapiens
  misc_feature (52)..(52): n is a, c, g, or t
  misc_feature (239)..(239): n is a, c, g, or t
  misc_feature (307)..(307): n is a, c, g, or t
gctaaaacactagatttaacatcaggatatagtgcaatccatacagcctgtnatgtgtggatttacgtacaaatttctacttaagacttaatatttattatcacttctacatttaaggatgcggagggtatacgagctacggacgtgaacatataaatacgtttatactggatattactacacttaaaacataatatacttttactaagtacgtattcataacatgtaaaccttccatncctgtgacagatcagcttactggaataggtgttatgtgttagaacctaaatgaacctatgatcgtttnctgtaggctttccatgatttccacatgtgtcacagcctttaacctgtgaagtagacattctgaatatactaaaaaccatcaaactgtttactttaaatgagtgcattgacgagtatgtgaattatgtctcaatagcactgttaaaaaatatagacatcagggctgggtgcgggtggtcagcctgtggtctctgtctttgggaggccaaggcaggtggatcactctgttgcccaggatgaagggcagtgcaatgtctcggtcaccgaacctctgcctcccgagtaagctgggaatacaggcgtgcaccatcagcccagctaatcctgtggattagagaaacacggttcac

SEQ ID NO: 694195 - DNA, 973 bp, Homo sapiens
  misc_feature (154)..(154): n is a, c, g, or t
  misc_feature (160)..(160): n is a, c, g, or t
  misc_feature (164)..(164): n is a, c, g, or t
  misc_feature (167)..(167): n is a, c, g, or t
  misc_feature (175)..(181): n is a, c, g, or t
  misc_feature (183)..(183): n is a, c, g, or t
agagaataaatgcgaaggccaatctccacgaaataataatgtaattccattcaagacaagaggtgaagaacagatattgcctctgcattttaactcctcccagtgccataaaatgacaacttggtaaatgttgatgtgagtgtgaatcttttanggactncaanacngaaggagnnnnnnnangcaagtaactggcagaagtttggtgataaagattttcggacaggtttagaaaatggaatcctcctctgcgagttgctgaatgctataaagccaggacttgttaaaaagatcaatagattgcctacccccattgcaggactggacaatattatcttattcttgagaggtgtaaagagctcggccttaaagaatctcaacttttgacccgagtgacctccaggatacatccaacagagtaacagtcaagagccttgattatagtaggaagctgaaaaatgtattagttaccatttactggctgggaaaagcagcaaacagctgcacatcctacagcggaacgacactaaacctgaaggagtttgaaggattgtggctcagatgcgaaaggacactgatgacattgaaagtcctaaacgcagtatccgagacagtggctacatcgactgctgggattccgagcgcagcgactccctctctcctcctcgccacggcagagatgattccttcgacagcctggattcctttggctctcgctctcggcagacgccttcaccagatgtagtcctcaggggaagcagcgatggtaggttggagacttaataaactatccatcttgaaattaaacatttgcaggggctgcattgcgcctggcagagggatgggcactgggaaagcaggctccatatccaccttgccggaacttagtaattctataaactggcagaaaaaagaagtctttgaatgttgtttttcatggtccttagaattttggttggctttgccagtagtt

SEQ ID NO: 694196 - DNA, 268 bp, Homo sapiens
ggcccccaaaaggcccgggtttttttttatttttatgcccccacccggtctgaattttcccctttggccaaaaagggggtccccgtgtcacggggtggtggaaaggattccaactggctaatgggggaaagggggaacccaaagggccaggggcccatttccccctttaaactgccccattaaggaggggggctatgggaagggggccccccctgcctttggttttttataccatttccttttaataaagccgggttaggtttttcca

SEQ ID NO: 694197 - DNA, 148 bp, Homo sapiens
caagtttggtttttttgtttgtttgtttttggcacagaaatcaatcatttttcattttagcttcaagtaattacatgagagctgttcaaacttgagcatgcatcagaatccccaaagggctggataaaactgagattgttgagctcca

SEQ ID NO: 694198 - DNA, 109 bp, Homo sapiens
ggtccctgcttgagcagtattgtgctattgcatactagtctttgctgctgcgagacatggtgggcctagccctactagtctcaatctccaacacatattgcctagtggt

SEQ ID NO: 694199 - DNA, 240 bp, Homo sapiens
tctcgtcgttctgagatcccgaaacctaattacgcatgagcaagtgtataagatgtttagagaggtatgccacagagggactcaacatgctgggaacagcacttatttcctacaacctgatactgccttgaggatgtggttagattccccaaggggcagaagagaaagttccttccattgatttatttcccccacattgctcctagttctgaatagaatcctctttaggcatagaagtcc

SEQ ID NO: 694200 - DNA, 265 bp, Homo sapiens
ctgagatagatctcaggtctgtactgcatcttacaataactgcaagaatgaaaaaagacatgttgatgcctgggatctatctcataggttccaactgaagtgttctagggtggggtctcagcaccagctgggtttatcaacagcttcccacgattatttaaagtatgcagccactgctgatgagccacaggccttattgctaatagtagcacttactccacactctcctggaggatccatctagagatcgaccatgcaggctatg

SEQ ID NO: 694201 - DNA, 697 bp, Homo sapiens
gtcttcgggtaaagatggtggagcgcgggtactgctttgcgctgactacattcagcccgtctgttaatcttgtccagatcgaatatgcttcggctgctgtagctggaggagccccgtccgtgggaattaaagcatgactaatggtgtgcgtattagcaatctgaggaataagacagtaatctccatggctgtagtgatgagctgaaggatgtacacataagctagagaccaaatataccaagcatataggtattggtgtacagttggcattggtgccccgatgtacatgatgtgtcgttgtggcaacagcaagctcgataaacatagactcaatcaaataactaatacttgtgctaccatggaaaccccattccatacaggctacagctgtgatacatgaggagctaggtcattctgtggtatgcattagaattattatcgtcaagtcccgtgttggctaggtttctggtcgctattttgagaagtatatcctatatgagctgtatatgtgttggggtatggggaactgcagggtagtgactcggatatttcaatgttcaagtcagaatccatcatggtagcgtataactttgtcctgggaaaatgctaacagacaatgggagaagaagctatgatgacatggggaagaagtttccgttggagaaaaaagatagtacatgaatgaatctgggaaact

SEQ ID NO: 694202 - DNA, 466 bp, Homo sapiens
atgagatcatgtacttcaatatctctgttctccctgtaccgttgttcgcagatatgctatgcatactttaagctgatacaaggaaatgcctttgacttctttattcttggtcctcttggttcccaaggtccgtcttcattacatacagatctattatatacactccccatttaccatctttcccattcatccctctatacaatggcttccacacaaaacactgcaccatactttctttaagacataataataaaagaacaactggtaaagctataaactttatagtcatacctaaaattcgaaatcttactgaaaactcactgtatccttaagtagcatgaaattcaaccagtatctttatcaaatacttcccagactcattctctatatgcatcacgtagaaagcattaaaaaccgcagactccctctttgccttctacggcttcgatcggtcaggataacgagc

SEQ ID NO: 694203 - DNA, 387 bp, Homo sapiens
  misc_feature (7)..(7): n is a, c, g, or t
cagcttntatgtgattgctgacatggtggccgacggcctgggctgggccatcctgccggtcaacattgccgagttcggcgatctgcgcccgcatctgcggcaacgcgcctgcgaggggctggcgctgccgccgctgaccgtgcgcatgctctggctggaagggctggcgcccggggccgaagcgctgtggatgcgccagcgcctggccgagctgctggccttgatggccacggcctgagcggtctgggctggcgcgggcgttgcggccgtgttcaggtgcaggcagcggctgcgtcttcggcaggcgggctctctttcgctcgtgcctggcgtgcggccagcacgcccagggcccacatggcgacaccggccagcagcgccaccacg

SEQ ID NO: 694204 - DNA, 904 bp, Homo sapiens
ggtttctggtgaggcctttcttcccagcttgcagaagacacctgctttgatgttctcacatagcttttccttgtgtatctgcattcctggtgtctcttcctttcctttttttttttttggttttttttgggtttttttttggttttggagacagagtctcactctgtggcccaggcttggagtgcagttgacatgtctcagctcactggcagcctcaacctccagacactcagtgatcctcccaggtaagcctcctgagtagctggagactacggtgtgtggaccaccatgcccagttgatttccatattctcttttaagagaaggggagttccgccatggttggcccaggctgggtcttgaactcctgagctcaaggtgatctggcctggcctcagcctcccaaaaggtggggattcacgggtgtgagccatgcacccgggcctcttcctcttcttataaaggaacaccagtcctatcagattagggcctcactatctataattcatttaatcccaagtgctccttaaaggggcctggcctccaaatacagtcactttggggctaagggctccaccatatgggattgagggggccccagtccagttcatagccattttttaacaaatttcacatttatgcgttccccattctcctggtgtgctccctcatgtttgatgcttgtcctgcctggtgtggacacttgtattgtgggccgggcatgaggggaattttcatcagcccctccaaaactggtcgctttggggtgcactttgcctggttcaaacgtccaacgactcaaaatcttgggagatcccatatatggaaggtgattagaacactcagtgtttcggggctcgtgagatagttcccgtttatacttttggaatccctctgagtagtat

SEQ ID NO: 694205 - DNA, 161 bp, Homo sapiens
tcttgtactcttttcccggactcttgttccacagcagagacattgagtataccattggcatcaactgtcaaaagtgacttaccctctgagagaacacctacggggtgcagcgtctagtgctctagcttgcgtacgggggaatcctactaagagctcgaccc

SEQ ID NO: 694206 - DNA, 122 bp, Homo sapiens
cacctccagtagcactcaacagttccagaatgagctcgcttcagtcgtcctagcatgtccccaacacctcttgcatcgctgcagatctacctgtgaatgcttgtaaccccttgggcagctcc

SEQ ID NO: 694207 - DNA, 150 bp, Homo sapiens
catattatgcaaatcagtttggtactagtgatgagacatctggctattactctcacagtcagtgtcagataactatctgtctagaaatcttaagtctgggccatgtgcaatctgcaggttgtaattgggttcagggtatgtggttgcgcc

SEQ ID NO: 694208 - DNA, 261 bp, Homo sapiens
gagatggagtcttgctctatcgcccaggctggagtgcagctgcgcgatctaggctcactgcaagctccgcctcctgggttcatgccattctcctgcctcagcctcccaagtagctgggactacaggcgcccatcaccacacccagataatttttttagtacagacagggtttcacatgttagtcaggatggtctcgatctctgactcgtgatcgcgcttggtctccaatggctggatacagctggacacacgctgctggat

SEQ ID NO: 694209 - DNA, 389 bp, Homo sapiens
tgggaaggcttttagctttttataaaataatgaagtatgcatgaaaagaaagcaaattttagttggttgcagtcagagaatatggaaagggttattattataattaggattttattattcacattggaaatcactgctatgtgttaaggaattgaaggtggcctctggctagcagccattaagaaaatgagcccctgagttcaacgaccctcaaatgaagtgaagtctaccaataaccactgaataagcttggaattagattccttcccagctgaatcttgacttcagccttgtgagacaccctgaagtagaggatgcagctaaattttgtccagactacacacccacagaaactgtatgataattaatatatgttgtttaaagttgta

SEQ ID NO: 694210 - DNA, 131 bp, Homo sapiens
gtatatctccagcccggcgctgaccccggagttcctgaggcactacttgcatctttggaacacgtcagtaatatgattgataacaggtggctatgtagggaccctgtgagttggtcatgtacagttactat

SEQ ID NO: 694211 - DNA, 90 bp, Homo sapiens
  misc_feature (11)..(11): n is a, c, g, or t
  misc_feature (19)..(19): n is a, c, g, or t
  misc_feature (42)..(42): n is a, c, g, or t
  misc_feature (58)..(58): n is a, c, g, or t
caaaaccatcntatttacntaaatatattctgtgaagctatnccaaattgttattttnaaaacatttatttttattaaaatgaatcccca

SEQ ID NO: 694212 - DNA, 871 bp, Homo sapiens
  misc_feature (335)..(335): n is a, c, g, or t
  misc_feature (609)..(609): n is a, c, g, or t
  misc_feature (763)..(763): n is a, c, g, or t
gcggtacgccgattcctcctccttggtcgccgcgtccttggctggcgtcagaaggaatggctacaaagctgtcctgagcacatgaggaagatcgtggttcgacaagcttcagaatatgacgacgcgagaccagcgagatttctacgacgcagatgaaacgtggccctgtgggcagagtgcctcccggcccacgggaagaacgggcgcgcagtgtgaatccctccgggtgacgatggcggaagagctcagcagaggaagcatacccatgaaggatcgcccgtgtgctgtgaaacggctcaagcgccgccgagaggacgcggtccgaggcgggacancgcgagtcgtgagaacccatcggctggaggcttgcgatcggtcccggcgattgaccaggtgctgggaaggatgcgacgacacgccacgaggtgctgcgggatggaacgatgggtaactaggcgagtctcgtccacgtcgaaggaccagttcacctatagacctgggaatggaccctgaggattggagaccgtcgctgtaggaaggacatgaggcgtcggctcttgggacccaccagagtgcacacctgggcgcgccaagcatagtatccacaanaggcagcagttaggtcccgtcgcacatcgacggccaagagtgggaaaggccaccgcgccaagacgcaaaagagatggcccaaggtcgatacaacccgaaggcgagaatgagactggcaaccgaaggtgaatcgaatcggcaacatttgggaagnctgggtatagggcagagtcgaccgaagtggacggacggcaggcgacaagaagtggagggctgggcaacagagccgtgcagggggagggaaggcggggctaacggggaa

SEQ ID NO: 694213 - DNA, 100 bp, Homo sapiens
gctctaaaatacactgtactgatctctgcattctgctcttcaagccagtaacgttatgttccccaggtctttgaaaggccgtttctctgggaatatggga

SEQ ID NO: 694214 - DNA, 335 bp, Homo sapiens
tgaatatatgtccaagagaaatgaatacacatccacataaaaacttatacatgggccgggcatggtagctcaggcctgtaatcccagcactttgggaggccgaggtgggcggatcacttgagtccaggagttcgagatcagcctgggcaatgtagcaacactgcacctctacaaaaaataaaagaattaactgggcgtggtggcgcatgcctgtagtcccagctactctggaggctgaggtgggaggatcccttgagcccaggagatggaggttgcagtgagctgagatggcaccactgcactccagtctgggtgacagagcaagacccagactc

SEQ ID NO: 694215 - DNA, 331 bp, Homo sapiens
cagagaatctgtagtcgtatatcaagaatacttaactaacactgaacggttgccatgtctatgagcactagatattactgaagtgacaatgctactgaccatctttggctgcagaacagaaactggcagaatccgaacccatcgacccaaaaatgtccccaacgcctgatgaccaatacccatctgtgacaaggaacaggggtccgcgatgttggccactgatttgggtgatgtgctcaatggcttggggtctagggtgaaacccctgggctctgggagggtcttaggctcctgaaacatggaattctaagtgccattcttggaacagcta

SEQ ID NO: 694216 - DNA, 1100 bp, Homo sapiens
  misc_feature (241)..(241): n is a, c, g, or t
  misc_feature (244)..(244): n is a, c, g, or t
  misc_feature (357)..(357): n is a, c, g, or t
  misc_feature (522)..(522): n is a, c, g, or t
ggtcctgagctcacagatggtcggccaacctcgagccccgacaatagagggagagatggcagacgagcaactcggatagtccttgtagcctcctaggctcggttgaatgactacagcagtcgcctgtccgatgtccgttggaggccaacaattaatattccgcggaactcatgagtaacacctacaaatgccgctgggaatagtctggtgacgatcattgcttagggcgtgggacattggnggngtactcctggtgtccaaacaccaaatgagaaaactggcccttacacatttgggtggggtgtacctagggggccgtgcacaccacaagcggtagagaattcaagtgtaccatgngcaccactggtctacccgcgcaggaacgttgtccatggtgtctgcgcacattcagttgtcgggtatgaggacatattaccatggttgtagatggcgccatatggaagttggtttcgtcccactgaagaggattcaaaaatgatgggtgctccttcaggcaagacncgatccaaaaggttgcgacctcttcaagggcatgccacgaagaaaccgggtctattgcactcggagaccgagtgtgtgactaggcgaggtattattgggacctacaagaaacacattaggcaaaaaaggaaagaaaaccgctcagggaccgaaacagcgagttaaaccccgtaagttgtgcttctccttagcgttaggagagtggcggccgatgggcgcctcaggttcggcgacctcgctaggaaaggcaatggcctacccaacgcgtaatagatttgtagggcacaactcgaatttgggcgaccattgggagctcgttgccgaaggcgtgaagctggtggaaaccgataatttccccttgagttgaccgtgtcactgtgagccataccctagtggtgcttaaaagattcgagaagttcttgaacatcagaaagccgccgagcgtcatattacctgttgccgctggggtggagtgttcaaacagcagaagggtttaaaaaggctacctggagcgacgcgggtcgttgcctggccaagctggtttgtcgctcgaacacatgagatctcacagttaatcc

SEQ ID NO: 694217 - DNA, 818 bp, Homo sapiens
  misc_feature (1)..(1): n is a, c, g, or t
  misc_feature (313)..(313): n is a, c, g, or t
ncctcaggcgtgacagtagaccctcactgaccaccaaggcacagaagtaaaaattaccagtccagaagaaaatgataacaaccaacagagcaggggctatgctgccgtggcttaaaagatttttaaaaagagagtatatggatcgcaagaaaaatgaagggttatcatacttgaaagataagcacatagttattgctgaatataatgtgacactatggtcgaatactactcattcatttatagcgggggggaagcctagtcggaaagaccacgataacatttaaatcggctacctaaaggataattacttacnttttattggcatagtggttttaaaaggtcatatatgaaatacttaaactaagacgggacagtaggagaattctgcacttggaagacaatttgccacttggatgttgtagaaggagtgaaaaataaggatcactctttattggaccgctttattaataaggttgagaaggcgagcttattctaaataattgttcttttaggaaggcggaagaattttaaagaactggtaattaggaaaggcatgtactagttttgttaaagcactaacctcttgaatgaaaaaacaaaaaaaattggcctctttggccttaaccggtggggccctgccggcgcttcccttgaatgaggggtaagtgatgaaactgggtcagtgattgcttggactcggtcgctgccttaagcgaagcgtagtctttccttaaggggggatacgggtgtccccgaatcaggggatccgcaagaagaacatgggacccaaaggccgtcaagcggcattagacttaaag

SEQ ID NO: 694218 - DNA, 245 bp, Homo sapiens
ggggggtttgtttaaaaaccccccccccctgggccccccctattttgggggggtggggcccggggggaaggcccctggggggaaaaaaatttggggcccgtttcccttgccccccccccccccccttttgggtttcccccccgggggccccaaatttcccaggccgaaacgggccttccccgccccccccccccccatttttttccccggttgggggaaataaaaaaaaataaccggttttggga

SEQ ID NO: 694219 - DNA, 807 bp, Homo sapiens
  misc_feature (121)..(121): n is a, c, g, or t
agcgggggttcgcgacgccgtggtgacggggccggtggcggatgtgcggactgtgcgccggtatctggtactccggcgggtatgagcgatgtgtgatgcggacagtggctggactactagncgtgtccccagtcggacgaacaggtagcccggcgtacgagctgcgcatgtggtgtggtacgcagtgtggtgagtacctggatggcccgtcagtggcgagtccggcatacaaggtcgagcagcgtcagggcggcttggggactgatccgcctcggtccccgctaactgcggacactttccagtatgcgtgagaagggacacatgacgaagtcgaaggggaggaggtgctattagcacattttaaagcaacacagatctcagtgagaactcagcgtcaccattaccgtgagaagatgatgcttaaagccattcagtgaaggagtctatcccgcatgattcaagtcaccgtcatctacctatgccccgaacttccaacaccggggggattacatattcaacagtgagactttgtgattggggacacagatacgaagtcgtgtccaagcgtgcatcgtaaggttacccgcaaaggctgtgaatttcagtatctttgtagtggcgtctatagtattccataagtgtggaatgtaccacagttgacgttgtagtcgaattccaggcatatggttgggcagcctatgttggtatctagtgtctttgctattgtgaatagtgctgcgagtgaaacatacaggatacgtgtgtctatatggggtagaaccaactacatagttctttggggtatac

SEQ ID NO: 694220 - DNA, 312 bp, Homo sapiens
  misc_feature (265)..(265): n is a, c, g, or t
tcttgtacttctactagacattagttcttctactcgggtgatcgcttggtccccttgggtgtgaggacgctcagtgatatttctgggatgtttaggtagcgggtgttgagcttgaacgctttctttattagtggctgcttctaggcctactatgggtgttccattttttactctctctacaaggttaaaacctagtgtccaaagagctgttcctctttggactaacagttaaatttactaggggatttagagagtcctgtgggcnaatttaaggttgaacaaaggttctatcttggtacaaccagctatcat

SEQ ID NO: 694221 - DNA, 268 bp, Homo sapiens
gtcgacgtcaatacccatcctaaacacatgccgggtaaacaatggctaggtgtgacattaaaagatgaaggaggaagaaagatcaactctttttgattcctacggtttccccccccagattttcacatttccccacatctactaaaccgtttttgaccaaaattggatcaaagatctactacagcatcaaacaagtacaagataacctttccactacatgtggtcaacactgtgtattctacctatgtcaaagagccagtggtcgacg

SEQ ID NO: 694222 - DNA, 788 bp, Homo sapiens
ggcaggtcctggtgcttgatggtctatgccatctcctggggccgcctggacggacatcgtggcttaacaggtactgctgggccgcaaggtggtggtcgtatgctagtgaaggcatcagcattgtctggcaatttctacagaaacgagttgaactatgctggccttttcgctcgcgaaacgcgggatatgatccatctcagatccacttcgccgagatgacgccttatgcaacgattctctggtgcgccgcgcagacccgtcatacttcgtgcgcggactctggtgcgacggtaatggatggcccacaaagaggacagaggcgagggccagggcctgcctcatggatccagtcgttcaagggtggattcggaaacgagacgagtcctcgaactccggggcgccttagcttagccaagggaaacacgagaagaccggatagaggttgtgttttcccatgtcatgacgcgcttaccaaacgggggtttcggattggaccggttcattggtaagggccccttaacccaaaaaggaaaaacaatgtttttagacccctttattttccttgcgtggggtcggcgctttgcggacttcaaccggaaaggctctcgtgtcgttggggacaccgtagcacaggcgcatgttgaacgaaggccatcccatggatgcgaagacacgacgtgacaatggacgaataagccggattattctcagcatatctcgcgacatgaaagaaatcatgctacatgaccgctaacggacaagaggccgagaagatacgtggagaatac

SEQ ID NO: 694223 - DNA, 531 bp, Homo sapiens
tcactgcagtcaatctgaacaacctgagctcatgggccggggtgtaagagtggtataaacctaaggccctgatcaaagcagacatgtagagctggtactccaggctgacagtctctccaggtgtacagctgctgtccctgccctgtcctgtccattgcacagtctcctatgtctgagcccagatgccttctgttcagggccctcctttggtgggaaagcagagccctgacccttgaatggttgtccttgactctgtgcatgctgccatctgcagagaggcacctaagctgtttaaagagcacagtgattatgactgctccacctagaggtggaaggggacaagaggcatccttgatcagtgtccatacattctgggcagagacatgattttattgttccaacaagtgacattctccgggctatcatagtatctttgtaatatgttgaagataatttgaattgactgattttgatagaactgtgtgtataagctatagacaattaaaaaagctttcttctaaaaaaaaaaaa

SEQ ID NO: 694224 - DNA, 254 bp, Homo sapiens
cggcacgagggtgattggtgtggtcagagcaggcatccagtggatctgtggcacagtcacgctgttggatgatgctgctatcatccatgaggtcaggggggccctgcaaggttatctccaggtgatgggattcacgtcagtcctcatgccaccagaggccatgtaccacgtcccagagcgacaggcagggaggttgcgtacttagcttcggggggatatctccgtgagacctgagccccaagacgtacggaccg

SEQ ID NO: 694225 - DNA, 409 bp, Homo sapiens
gcgcgaatatttccccgataccttttcgactgcggttcgacaaaaatcccgctggatcatcggcattgttttccaaggctttcccataaatggacctccagcctgacgctgaactactttctctggcgcgaccgcaaaggggcaatcagtaactttgtcagcttcctcgcgatgctggtgatgatccagcttttgctgttgctggcgtatgaaagtttgtggcccgatgcctggcatttcctttctattttcagcggcagcgcatggttaatgaccctgctgtggctctttggtttgatggttaaccgcatcgtgcagcgggtgattttcgttactggctactacggcctgacgcaggggctgctttccgtcctgcgtcttttctggggcaacctgattcttcatggcc

SEQ ID NO: 694226 - DNA, 341 bp, Homo sapiens
  misc_feature (123)..(123): n is a, c, g, or t
  misc_feature (125)..(125): n is a, c, g, or t
  misc_feature (141)..(142): n is a, c, g, or t
agatcagcggattcagagacacacataagagatcatatggtgactaatgcaagatgaaactctcagcttggaaagtatcaaggaataggatgaaagaaagatccctcgttccgagtgttatgnanggatgccccctcagannaatatgcaaaggggtaactggcttggaaatgggtatttatgcatagtaaatcccactcacgagttttgcctatttgaagcttctctcactgacagtgcatctgtgaatgttcgctggtgttgaaaatgatgcttttgaacggtgccctgccttccctgcgtgaaatgtcttttgctggtcgagatactagggtgttgct

SEQ ID NO: 694227 - DNA, 421 bp, Homo sapiens
  misc_feature (5)..(5): n is a, c, g, or t
  misc_feature (22)..(22): n is a, c, g, or t
  misc_feature (39)..(39): n is a, c, g, or t
  misc_feature (48)..(48): n is a, c, g, or t
  misc_feature (68)..(68): n is a, c, g, or t
  misc_feature (73)..(73): n is a, c, g, or t
  misc_feature (102)..(102): n is a, c, g, or t
  misc_feature (113)..(113): n is a, c, g, or t
  misc_feature (129)..(129): n is a, c, g, or t
gaagntaaaaaaggtgggcttnccccaaggcccttgggnaaggctctnggcccttgtgggaatttggncaaangtacaagcccccttttgtggcctgaattncaacaaggctnggtaatgaagtgtctngtggcttttcccaagatgcaacaaattcaaagctgtttggtggatctaccattctggggtcttaaaggatgatggccctcttctcactactgcactaagcagtgcctcagtgggggccctgtgtaggggctcccacccaacatttcccatctgcagtgccctagcagaggttctccatgagggctccacccctaaagttgacttttgcctggacatccaggtatttccatacatcctctgaaatctaggtgaaggcaggcctaacaccacatggaagccgccaactctctgt

SEQ ID NO: 694228 - DNA, 875 bp, Homo sapiens
aacgagggtgttcgatggtacagccgagtcgaagcgatgccatagacctcaacaggaacttgttgactgttcacggctcttctgggcagtgatttcttggagccgttgaggtcgactaaccaatcgttaaagacggagccatctgtctcttgtcgtctccgagaaaagacctgtagaggagaaacaagacccgactggtttacacgttcgatgagcccctgtaccttcttctcacactcgagcccgtcacgcggccagagactccatcccccttgctctcaggactggttcaacccccgacgtggtacgtaaccgtgtaccggagacttttagcaaggggcccaaggggctacttgctacttaggaagaactatatgagattggacctcctgcaccggctgacaactgaagcgccatgcgacgacaactgctatttgctttgacttctcagtaaacaactgggaggccaggctgattggaaccccgaatatcttgaccccttgctgcatgtgcgcgtactgcatcatacctgttaaaaagttcgaggcccatattatatgtaaatagcctggtacctggtcctatgctcagatctcgtcacgccgcgccttgtgaaccatgggccgttctgttgctcctcatggttgttcctgccgagctactaggtcttgttcggagttggccaggcatcttggtcccgacgggtcctcctctttctgcagagtgttgccttcttgccacaccttttgacgcgacgccttactgtcccgcttccgtccggcttactttgacttgcccagcgcctagtgtccggccacgctcacctcgccccactgtggcggctgccccctggcgaggctcttgcccctctgggg

SEQ ID NO: 694229 - DNA, 237 bp, Homo sapiens
ggctaaagcatggtggctcacgcttgtaatcccagcactttgggagccaggcaagaggattacttgagggcccaaggggggaaggtttttaaaaaaggaaaggaaaagccaggcccgggcaacacagcaagacctgtctctacaaaaaaattaaaaattagttagcgcactagtagtgcagccagctactgagaggctgaggaggaggatcacttgactccaggagtttggaggttt

SEQ ID NO: 694230 - DNA, 204 bp, Homo sapiens
ctgtgactctacaggagcttactcatttcagttctgtggctgtgaagtgtgaaattaaggagtttgtagggagattagtatagagaggtagagttttttcgtgatagtggttcagtggataagtggcgttggcttgcccatgattgtgaggggtaggagtcaggtagtaagtattcaggaggggggtttgttacggggggtccg

SEQ ID NO: 694231 - DNA, 197 bp, Homo sapiens
  misc_feature (141)..(141): n is a, c, g, or t
  misc_feature (174)..(174): n is a, c, g, or t
agtagagacggggtttcaccatgttagtcaggctggtctcgaactcctcacctcatgatctgcctgcctcggcctcccaaagtgctgggattacaggcatgagccaccgggcccggccgaaatgtctcacttttactaaangtctgctcttctgtattatttcaccttccttanaaaagcatgtattactttgtcat

SEQ ID NO: 694232 - DNA, 329 bp, Homo sapiens
gaaaaacggtgtttcaaaaaatatggtacacctgtcatagattctagtctcatccattgtttttgagttttttgtctgcaatttagactgaccttgcttctttctgtgaaccaaacagtcatctcttgactgcttctcgtcagaaacaagagggatggataacataaaaatctggatcagtatctaattctgagcatgtattggaatcgtctagcaactccgtatcagctcatctagcaattcctgtgactgagaatgcctaacctcctggggaatgcagcccagtaggtctcagcctcattttacccgataagtcacaggcattcttg

SEQ ID NO: 694233 - DNA, 909 bp, Homo sapiens
tgtggtggctcacgcctataatcccagcagcttgggaggctgaggtaggtggactgcccgagtccaggagtttgagaccagcctgcgcaacatggtgaaaccccatctccgctaaaataacaaagggaaaaaaaaaaaacaaactagcaggcatggtggtgcatgcctatagtcccagttacccgggaggctgaagtgggagaatcacccgagcccggaaggtcaaggctgcagagggccaagattgtaccaccgcactccaattgagtcaaccacagtgagaccctgttctcaaaaagagaaagctaccagttatcaagaacagctgttagaactcatgttcaatattaggcaacaccagattaccggggaccaaacagtctgctagagaagcagaccctataaacatacgctataacctgatttcacacaagggttaaaacggcacatccagctgttcgaacaagggatcggacaaagcatacgggtcctaaaaccaactgggatatccatattgccagaaaacaaattccatccatagctcctcacaatggtacaacaatacgcctagacctacattgtgaaccctaaaccttatgaaaccttgaatagccaggtgccggagtggtcatgcctgtaatcccagcactttgacgagtgacgagggcaggtggatcaccctgaggtcagaaatctgagaccagctgggccaacatggtaaaaccccatctcatataaagttccacaatttacccaggcgatgtggggtggaccctggtaaagtgtgccgatttcaacaaatgggggcacaatttcacagctctccaaaaatcgtaaccactgattggccataacgccaagaaaatcaacccgaaaacacttggaaccgcaacacaaaccactggttca

SEQ ID NO: 694234 - DNA, 886 bp, Homo sapiens
acagagagatgtatcacaggggaggccgcaccgtcgtttgtgtgctcgcgggtttgcgcgtgtcctgacgaagttgcgtctccagtggttttcgggcagggtcgagacgtcgaaggttcgtggccctgggaacgaatcccccggtgacgggtccctggtcaggggtggtggcctccgcctatgtcgccggctgcctgtatgggctccacccgtcgcacctgagcgacttttgttccgtcagaaagggttctcgccttcgtttaaaccgggagcgcgcccctatttgctagagcttgctgtaagcccccccgtctgatgtgcgtgctccgcccacccccgcggttggagagcttctcaagtcaggcgaccccagcggcacatttcggttctgcgacaattcagacccgagagtcccggggggcctgtttacaagaccacgaggtctaccaaggtctctggggcatcggtgaagagtcaccactagtatggtcccggatctctcatgagcgcgtcaaggagattattctatcccctgtagtgtgcgcgccccccgcctcttgcgaatccagtggtgtgagcaagaccgcttgcaaaacttgtatggatgtcccaatgcgccacctcaagacagtcaatgcggtctacaaacgtggttcaatggatgaccacaaggcgatggtcaccgctttccatagatacagatgaaccattagtggggcaccctggcgcgttttctatctgtgtgccgaggccgactatagttgatatgagtgttagaaacacccgcgacaggttttgtgactgggaagggagtagtgcccaccagatcttcgctgtcgaagacagtcggcgaaccccttcgaaaagtaacgggccacatgacaaa

SEQ ID NO: 694235 - DNA, 899 bp, Homo sapiens
acagtgctaatagatggatgtagtgtggggcacgcacttaggagcatggtgaataaacagacggaaggatggtgagatcaaatggagtagaagcccagttggaattaggctagtaaagaatgtgaaatgggctgtcacttggtggttttgccaaacactgacaaggtaggattctagagtggttccacgtagatactgtacttgtttggccagtgaatggagattaggcatactccattagtgttgtcgtatgtgagaccctgacttcaagatcgctggacgtggtctaagaagaatagggatattagtgggaaaggaactgtcgtgtagtgacctggctgtgcattgtttggtgcctagtatcaatagattgtgcgtggtcaggtcaaagcatgaaatcactttcggtaaccagtcaagtcacctggtaacacagattctaccagttcgttcattcatgtcccatgctgaaggtgagtgagtcgatccagagtcaaattcgtccctattgtatatattctaggttctacatagatgaagggtgctttggatagctaggaagcctcatgtggtttcgagaggtactgtaaatggtagatataatggcaatcatgttgggccaagcttattacgaaataatagatggtcgttgtgcatgtgtcttttgacatttttgccaatggcaagtttaacgacatgtttcctaagcaagtccggatattgggaaggcctgcctaaggattttcgtgcacgttgatataattgttaggcatccagggtggcgtgtacacaacttgggcttgttggggacctttgtgggactcgggttgacatcaggacaaagaggagttgtaaatgttgggggctaagagcgcgaaataggggggcatacacacggg

SEQ ID NO: 694236 - DNA, 351 bp, Homo sapiens
  misc_feature (1)..(1): n is a, c, g, or t
  misc_feature (84)..(84): n is a, c, g, or t
  misc_feature (328)..(328): n is a, c, g, or t
naattcggcacgagatgagttttaaacaaaccctgtcccgccgggcgcaagtcgtacgcctgtaatccccagcactttgggagnccgtgggcaggtggatgacctgagctcaggaatttgagaccagccctggccaaccctggcgaaaccccgtccctactaaaaatacaaaaattagccgggtgtggtggcacatgcctgtagtcccagctatttgggaggctgaggcaggagaattgcttgaacccgggagggagaggttgcagtgagccgaaatcacgccattgcactccagcctggacgacagagtgagctctgtctctaaacnacaataaaaacccaaactctgaa

SEQ ID NO: 694237 - DNA, 89 bp, Homo sapiens
tacagaaggcagagaggaaggtttaatgagccctgtccagggcccttcagtggggagcctccttcttcttgcccttctgtcgtcttctc

SEQ ID NO: 694238 - DNA, 179 bp, Homo sapiens
tgttgtaaaatagacatgatctcaggccagtgttattgcttctgagatactttttacctcctgttagtagtcagcggtcacatattaaatatgcagctatcacactgaaggatcagatcattagaactttgactgactaaatataactcttgctaagaatccttgagcttgtctcatgt

SEQ ID NO: 694239 - DNA, 198 bp, Homo sapiens
  misc_feature (138)..(138): n is a, c, g, or t
tacatttctttatacccatattgcatttcctaaatgggccagcaaaaaccagtggatccctgccaaagtaatgttaaagatgtgctgacagctttacaaaaaaattttctccaactaatttgcaaagatataaaatanaatgtagttcgtagttttcaagcattaatggaaagtgttcctattaaaaaattccccata

SEQ ID NO: 694240 - DNA, 506 bp, Homo sapiens
ggagcttatcctggagacgacgaactgacctatgcgtgttacacaagaaagtctcgtgctctaactacacacctacccacatcttgcacactttggctgccaacaggactgtttggtttatccctgtaatacatgccaaacagaatgtattagagactatgtcatataaatccaccattctaagacaaactgaccttgataaagtacttactgtaattcacatagcataccgtttcttaaactcagattctaagacagtgcctctaaccataaaggtgaatgcaagtgtacctttggaaaatctgggagtggcccaaagtagcccaacacacaaaactaggctgtatttttcaaactggccatattctattgtgtgcatgagtgtgaaagcaatagatagatggaaccactgaataaaagcaaagactcctcctggagcgttatgaacatattcccaaagtaaaacaacacttccttcatccatttattcaacaaacttttattga

SEQ ID NO: 694241 - DNA, 271 bp, Homo sapiens
  misc_feature (2)..(2): n is a, c, g, or t
gnggatcgagctcgtacccattgtttgaaggcgtgggatgtagagaaactcaaaggaaaacagggtgtgtttctgacaggtaaatggataaagctgggatataaagatgggctgaggtccccctctttaatttgttctaaagcagaagcatcgggcagactagaaaaccctgacttctttttttttttttttttttggagagggagttctcgctctgtcgcccaggcgggagtgcaggggcgcgatctcggctcacggccttcaaacatgg

SEQ ID NO: 694242 - DNA, 544 bp, Homo sapiens
  misc_feature (219)..(221): n is a, c, g, or t
  misc_feature (249)..(249): n is a, c, g, or t
  misc_feature (356)..(356): n is a, c, g, or t
  misc_feature (495)..(496): n is a, c, g, or t
  misc_feature (498)..(498): n is a, c, g, or t
cacaaggccgggcagggcacttggtgctttcttcgcaagggaaaagcttttttattggggttccccactttaaaacccccctaaacctgggggggagaaacacccccccccccccccagggggggccccccgccccccaaaggggggccccccctatattcccggggggggggggcccccccccctaggaaaaaccccccctttttttttttttgtggnnncccccccctttttttaaaccacccccanttttcccccaaatttttttttttttttgtcccttttcccccccccccccgcctttttgttctctaaaaaaaaaaggggggggggggggggtggcccccccccccccnggggggcgcgggccgcacaaaaaaaaattatttctcccttcctcctctctcaaagagaggagagaggggttgttttttttttttttcttcaaaaaaaagggggtggtggaagaaaagaaaaaaagaaaccccgcgcccnntnttttttttttttcccttccccctccttcgctcgtgcaggcgagaag

SEQ ID NO: 694243 - DNA, 406 bp, Homo sapiens
ccctagcaccttcctgtacagagtggtgtttgtgtttgtgtatctgtgtagtttatagtgtgtgttgttgatgggaacagctgttgggaaaagctggttacacaaggactggataaagaaatatatccttatcagaaatggaggtccaatgttgactcagaaatatatcatggtcaatacacaaagtctatgtgtcattaccgtctggtgtgtataaaaagccttacatgctttgattaaccctccatctagtccatatctcaatggagggttgagttcaattatgggtatcatattttaagagagacattaataagttgattgtgtccatagggaggtgaccagggttgtaaagggtctgatgatgcaagaacaagggagtagcttccctgaaggtacaggaagg

SEQ ID NO: 694244 - DNA, 143 bp, Homo sapiens
  misc_feature (17)..(17): n is a, c, g, or t
ttatgtggagagagaanctcctgctgggagagcatagaggaggacaagtagtataaatgatagtagatactataatataccactatagtacatgtaggtatatagacactagctagactagcctatgtacctagtctatacag

SEQ ID NO: 694245 - DNA, 240 bp, Homo sapiens
gattcggaacgaggagcctgggcaacacggtgaaacccaactctactaaaggtacaaaggttggccgggtgtggtggcacgtgcctgtagtcccagctacttgggtgggaggctgaggtgggaggattgcttgactccagaggtggaagttgcggtgagttgagatcacgccactgcactccagcctggcaatctgacaaaccgggtgacagagtgagattttgtctacaacaacaacaa

SEQ ID NO: 694246 - DNA, 444 bp, Homo sapiens
aaagtgagggagtaatatgcaaaaaaagcaacaaaaaactggtttttcagtgcggtcagtcgttgccacaggaattggggcagccgtattctttgtgctaatgaaatttattgctattccaacgggcgtaccaaataccaccattaacgtggcggaaggctggttggccttaatagcgagtttatttgggccggttgttggcctactggttggtattattgggcacaccttaaatgatgcggtcacttatggtgcgccgtggtggtcttgggtaattgctgatggtgtttttggtttcctattaggattgagtaaaagtcgcttgccttggaatatggcacattaacgactaaaaaaatcattcaatttaacatttggcaagcagtggccaatatcattgcttgggtgattatcgcccacttggtgacattttaatctacaaag

SEQ ID NO: 694247 - DNA, 793 bp, Homo sapiens
  misc_feature (680)..(680): n is a, c, g, or t
  misc_feature (712)..(712): n is a, c, g, or t
  misc_feature (724)..(724): n is a, c, g, or t
  misc_feature (728)..(728): n is a, c, g, or t
  misc_feature (730)..(730): n is a, c, g, or t
cccctttccttgtgtcctggtccatccgtcttccgcctcctgggcgtgtcccctgggtttcccttgtgccagcatttccttccctccttcttttttcccgttttgccctttctcccgtttttctaggccttcctcctctgcccggccttcagtgatgtcccttgacctctatgcgggattcccagcgtcctgggttcccttctgagctgcccatcgcttgttatctgcctatagaaccctctgaattctccggctttgtccttgaggtccttgttgtgctcttggtggcctagggcgttctctgcgctgtctccatctttcagtgccttttccctgtgtgcggctagttccgcacgccttgcttccatcttctgcatcggtttctctgccgtcatcggcttccgagtagtcagggtccgtgtgcctggcgtccgcgcttcccgtggcgtccgcgcttcccgtggcgtccgcgctttccttcgcgtccgcgctttccctggcgtccgcgcttgccctggcgtccgcgcttcccctggcgtccgcgctttccttggcgtccgcgcttcccttgccgtccgcgctttccctggcgtccgccctttccgtggcgtccgcgctttccctggcgtccgcgcctcccctggcgtccgcgccgaggcccgcgcgcgtcctcgtgccgncttcctgccgcccgcccgctccgctgtctctnccccaaccgccncgcntntacgatggtctcatgggggggggtcctgcaccgccggcccgccgtgccggccctcctctcggt

SEQ ID NO: 694248 - DNA, 228 bp, Homo sapiens
  misc_feature (13)..(13): n is a, c, g, or t
  misc_feature (59)..(59): n is a, c, g, or t
  misc_feature (62)..(62): n is a, c, g, or t
  misc_feature (92)..(92): n is a, c, g, or t
  misc_feature (99)..(99): n is a, c, g, or t
  misc_feature (110)..(110): n is a, c, g, or t
  misc_feature (113)..(113): n is a, c, g, or t
  misc_feature (132)..(133): n is a, c, g, or t
  misc_feature (150)..(150): n is a, c, g, or t
  misc_feature (158)..(158): n is a, c, g, or t
  misc_feature (161)..(161): n is a, c, g, or t
  misc_feature (182)..(182): n is a, c, g, or t
  misc_feature (191)..(191): n is a, c, g, or t
  misc_feature (202)..(202): n is a, c, g, or t
  misc_feature (207)..(207): n is a, c, g, or t
cggcacgagaganagagagagagagagagagagagagagagagagagagattatacccnagncaaccccttaaacacccctccccacatcangcccgantgatatttccnatncgcctacacaattctccgnnccggccctaacaaactngggggcgnccntgccctattactatccatccncatcctagnaataatccccntcccnccatatatccaaacaacaaag

SEQ ID NO: 694249 - DNA, 267 bp, Homo sapiens
ttcccaaaagggcctggatgcaaggttaccattttgatgttggagcggccccctccctgcaaccagggtggccctaggacaggaggagcttcgggcccagcttccccctgcggtgggggtgaggggtggccatttcctgccctggggcccctggcttcccattttgggctgactcataggggagtagggggggagtccccaaaaccagtgctgggacaaaaatggggaaggggtgtgaactttttaaaataaacccaaaaacccaga

SEQ ID NO: 694250 - DNA, 258 bp, Homo sapiens
  misc_feature (118)..(118): n is a, c, g, or t
aggtgagcgattccgcaatggctgcagtgcgttacattgtgctttgcgaaacacttcgcaatgttatcaaacacctgtcttgaacgcgccgggcgtgacattgcatgcgtgtagcccntttcagtggaggaacacgactgagcaactctgattgtggcgtgctggcctgggcgcgtcttgcacctgtgtgaaacagctgcttgctgcagggtggcggcggctgctgtcctgacgcagagcttgttggccatttatctt

SEQ ID NO: 694251 - DNA, 161 bp, Homo sapiens
tactgatacaatcgagctcgtgtaccctcgataagggccaaattaatgggtggaatgtggagatatgttatggttatggagacatatcatattaggtaatgctagtgctgagtggtagcgaagttcctgcataagaggtgtatgtgtataagcttatcgag

SEQ ID NO: 694252 - DNA, 109 bp, Homo sapiens
aggtatgtctttgtgaatggggtttccgatgaccaggacttacaggcaattctttctctgggtgtgttctcacattgggcatcatgcacgtgagtgctcccctgaagat

SEQ ID NO: 694253 - DNA, 582 bp, Homo sapiens
tggaattcggcttacgggaacaatcacttccaatatgatctagcacctttctagcagccagtaaatcggggctagtcttccatgccaaatagcaaatgtctaggagaggatactagtactatagggcttctatcagctagcttcaacagagtggcagcaaccaagctggagtccaagccccctgataaaaggcaggcaatcctatcagtactgtcatcaaacgtttctttacagcattattaaaaaggatcctgaggttgttcttcacagtatctatctcaaaatctggaaagagtaactccacatagtcatagagggcgtgcaggggttcatcctgacagtgatgatatttaaccatttccacggatgcaaatttgccataatggctttaaatccaaaacttcatagttgtccaggaagaaaaggcttccaattttaaaaagggagtcgcggagtgcttcaatgtaacaagaccttaaagctatctgaacatacagtcaacaatccatcttctgtccattgcttaaaacaaaggtctagactccatatagtatctctaaccaggaacatttctaattggca

SEQ ID NO: 694254 - DNA, 415 bp, Homo sapiens
  misc_feature (42)..(42): n is a, c, g, or t
actgtgacgttcctgagtcctgtagagaaatgtgctctctgnctgattgatagcagcgcgagctggaggtgttgggtcgggagaccagcctgttcgagcccgccgcatgtaggagctggtttccatcctggcaccagtggacacacctccagcctcgagcccggtgctgctgcccggggttctccttcaggctctttgacgccgttccagggggcacctatccaggcatcctctgggcctctagcgagaggattggctcccggcttcagcactcggtgctgcagtacgacgtgcccttaatcgctctgagccttgccaccatcctgtgaaccaccggaaaacctgttccagcgcgcacagcttgcccttgggactggacggatccaaaaaggctcaagctcggcccccccacaga

SEQ ID NO: 694255 - DNA, 116 bp, Homo sapiens
catgacgttgtagttcggaatgacacgctgcgaaccgttatagtgtcagcgtcagcatggatccgccatttgtcatcagttccgcagcgcggcttggcgatttccgtgaacgagaa

SEQ ID NO: 694256 - DNA, 528 bp, Homo sapiens
  misc_feature (26)..(26): n is a, c, g, or t
  misc_feature (78)..(78): n is a, c, g, or t
  misc_feature (100)..(100): n is a, c, g, or t
  misc_feature (130)..(130): n is a, c, g, or t
  misc_feature (173)..(173): n is a, c, g, or t
gacacgtggcgacaagaggagggaantggtgccactgtcgaacgtgtctagtctctagtccctgctgggaagatgganccgccggaatgtgtctagtccntagttcctgccgggaagatggaaccgcctntgaacgtgtctagtccctagttcctgccgggaagatggagccncctcttgaacgtgtctagtcccctagttcctgcccggaagatggagccgccatcttgaacgtgtctagtcgttagttcctcccgggaagatggagccgcctcttgaacgtgtctagtccctaggtcctcccgacttcacccgtacaagctcccagctggcttgtgtatgtctgcagctcgacttgacaggctgttcattgttagaaaatgacttggggctgcttttcgttaaggagaaaagctgccgggcgcagtggctcacacctgtcatcccagcacttttggaggctgaggcgggtggatcattaggtcaggggttcgagacgagcctgaccagtgaaaccgcgtctctact

SEQ ID NO: 694257 - DNA, 913 bp, Homo sapiens
  misc_feature (913)..(913): n is a, c, g, or t
ggcggggcataggagcccggtctgtgatcgccgaggggagtgagatcgtccagtcctaagagaaggcctctctcatcagtctttgattatacttcagatcaccagtccctcaacaccaaagttgcgactatggtgagatgacttcaaaataaggcagcccctttcaagttcggaccaagcaaaaaatcatttctcaggggagaccggatgcaacacactttgagggcaaaagaaggatgtcctcggtgtccgggcggccaagagagggaacagaggcatcgtttggctcgaataattcccaattaggtcaaggatggaaaatttataaaccaattctccctttaagcggcaacaggaagcaaggcaattagaggaggcttcgaggctttcacaccctcagaagtgtatcctccccgtgtgttacattcgtggtgttcactccacccaaggcagaaagtgcaggccatggtgtgacattaccttgatccagtttacaaataccagagttgtctgtgacattcccagaaacgcggacatttgtggtgcaggtcggagaatttgactgggcttgtggtgggcacattttcttttaagtttaaaacaaaagattgacggttataaaggtccctacattccttataaaggaaatgggagattaacttctacgccagttccatagaaagaacggttgacttaaaaaatttttgtcggacaacgcggttggccatgcgtgggtaccccagcacttttggaggtggaggggggaccctcactgtgggcttgggtttgcagacaaggctacacaaggaaccccggcttctacaagacagacaatactgtgtggggtggcgtcggttatccccgcggtggcgaggaccacatcaccagcaggggggcgcgcacaacacccgcn

SEQ ID NO: 694258 - DNA, 1129 bp, Homo sapiens
gtgacacgatctcgactcactgacaatttccacctctcaggttcaagtggttctcctgcctcagtcctctcaagtagctgggattacaggtgcacagcatctccccacgaactaatttcgatatttatacgtagagacgggatttcgccttgttggccaggctggtctcaagctcctggacctcaagtgatctcgtgccaccttggccttcccgagaacgtgctggggattgcatgacgtcgagtctacatgacagcgcacagccacattcctatgtctcttaagctctcagaatctcccctagctccctccgaggttgtcgtgcgagttggttggtcgccatcgaataggctgtcgtcaatctaccacttccttcgcgacggacccatttgtggtaattctccttccaagacgtacgcgctagagaccacaagacctcaggcatcgtagtctaagagtcaccgtcatatcatgacgggcggtgtaggacacatgcactgacgaccacgatacagaagatactgaaagacgtgaagtgagcagccgttcccctcgctgttgtggaactgtgcgggattacacacagcattcaactctaagcctctataatcatagtagactactacaccctaaccgagagaggatgagccagaccaatgaccagacgatgaaaacgagcgaaagaaatgccaaacgaaagagagcacaaaggcatggaggccatgaggagcaagagagaaacgaacgaagaggagcggaagagaataaaggataacagacgttgatcaccaacacatgggcgcatgcataacgaaatagggacatcagataataaacaatagccaaaaaagacagaccagagcaccccagaggacgagagacacgagagatacaacagccgaatgcaacagaagaccgaacaaacaaaagagaacgaacaacgaaagaaacgagagccaagataacacaacaaagggatgaacagcaagaagaaaaaaaaagtacagacaacgcggacaaccagagaaagcacaagacggaaggagcgagacgcccaacgacggaacaaagcgacacaatcaaaaaaacgcagaaaagatgaaaagcacagagaacagcggaacacaat

SEQ ID NO: 694259 - DNA, 107 bp, Homo sapiens
gtagaagcatcgaaagcgttggagaggtgttaccgcaacgcggcgacaagggtcgttcccgaactaagagtggggcatacataatcttgctgctatacttcgaagct

SEQ ID NO: 694260 - DNA, 898 bp, Homo sapiens
aattctcatgcgtgtaacacttgtggtgggactctgctcattgtatcggatgtttaccctggttcaccctttgccctcgtcccgcgtgcttgggttcctgcacggacctatgtgcgtcacaggtgaccttggtgccctgtgaattccgggcacacaaggaatctcggcgagggaccaagggacctgctcgttcccgcccccgtggtcccgcggccttaaattccccgactgttctctggtgtcccacctgtgtttgttcccccccccccgggcctcatctctttagctgggctgtggctccccccgtggtgtgctaggcccccgcgaattttggttacacctgtgtgcgttgcctcccggggccctgtccccgcctgttaggccaacatcatggggatgctttctttcacttggggtaatcctcccaggcgccccacagttggtgccccgcagaacaattctccggagtggtaggagtgattatgcgggcttctctccattctctccggccagggagattcccctgcgctgccatcgtgttgtatacgcgcgcccctttgggggcctcacactttttgagggtttcacgcggacaggaccttttgccgtctgtcgaggaagcgttctaaccaccaagcctttgtgaaagaacacccccatcggcctcccccctcggctgcggcgtgaagcccccgctgtgcagcccccccgtgggttaaccgccccctcgtggccacaatttttcccctgccatacatgcgtgtccttctcccgctgtctatcccggggcctggggcgccccctctccccaaagcgggcgggaaatcttttccccttcttttgggagccccacggggccatgcccccaaccccccgggcagtcaacaccccacataac

SEQ ID NO: 694261 - DNA, 428 bp, Homo sapiens
  misc_feature (373)..(373): n is a, c, g, or t
  misc_feature (399)..(399): n is a, c, g, or t
catgacggatcaatgggatgccgggcgactggacagtgacctcgagggtgtcggtttcgacaccctggcggtgcgcgccggtcaaaaccgtacaccggaaggcgaacacagcgaagcgctgttcctgacctccagctatgtgttccgcacagcggctgatgctgctgcgcgctttgccggcgaaacgccgggcaacgtctactcgcgctacaccaacccctcagtgcgtgccttcgaggagcgcctggctgcaatggaaggcgcggagcaggccgtgggtacgtccaccggtatggcggcaatcctggcagtggtcatgtcgctgtgcagcgccggtgaccatgtactggtgtcgcaaagcgtgtttggctcnaccatcaagcttgttcgagaagtacnttaagcccttttggcgtacaagtggacta

SEQ ID NO: 694262 - DNA, 275 bp, Homo sapiens
  misc_feature (30)..(30): n is a, c, g, or t
  misc_feature (55)..(56): n is a, c, g, or t
  misc_feature (220)..(220): n is a, c, g, or t
  misc_feature (226)..(226): n is a, c, g, or t
  misc_feature (242)..(242): n is a, c, g, or t
  misc_feature (258)..(258): n is a, c, g, or t
cataataggttcaccgctagcagaatatgngaaacaaagattagagtggaaatanntaagaaaaggaaaagaagagaatagataaattaaaagtttttttacaggtcagcaaaattgacaaatttttagctagattgactaaaaaaaaaaaaaaaatactcaattttccaaattcagaattgaaaattgagggctttaagctgggcccagttggctcacncctgtnatcccagcactttggnaggccaaggctggcgnatcacgaggggaattct

SEQ ID NO: 694263 - DNA, 443 bp, Homo sapiens
taccaaacttttttttttttattcgttggagttttttgggctgactgggcccggaccaattcaaatgggggctgggttcacacaggttacagggggaggcaaaaggggaaaaccccccacagcctccaaagcgcctccattggaaataaccccccatgcgctccttcgggccgaacccctgttaactgggggatcctggggatgctttgcacctggaagggcggggcatgaaagccccactcccggaaatgtttgtagtccccggaatggggatcgcattccagcacatactgaaatcctcggtagcccggaaactgggagcaaacccagttggaaaagaaaaaaggcaaacagttccttttcagagaccccagcttggggatcaacacaggggcaaagggatttatgcccacccccacaattccagccatcctggccttttt

SEQ ID NO: 694264 - DNA, 250 bp, Homo sapiens
ctgcattggacgtgaagccacagcaggtggctggactgctggcctgttcctaatgagctacgctgggctttgaggtagaggttggggtttatgaaccacatctctggctgaaagaccttgctgaggctctgtaatgttctgtggccttgggattaacctatttctcattaccgatctaattttctattctgtggatcagttatgccattagacactattgtttaccattgggccttatgaacgttgccta

SEQ ID NO: 694265 - DNA, 746 bp, Homo sapiens
tcgagttgatttgttcagttgttttaaactctcatttgagttactgaccaaaagacagggtaaatagagctctctcaagattctcagctttatgtttatggttccctctcaatacctttatgcaaagtgaaactgaacaccaccataagaaaatcctggcttagggggaaaagaggcaaaaagacctctaaatatatgtcaaggtataacccttagttctctcaattctccttacatcgtggtgacaaatggaggggcaggaatctcgtaccctaaatatgactgttggaggtatcgagtgcgtaaagaagtcattctccgtggttcactatcgttgtgggaaaggcaatgaaacagcttagcagaaggagctatcaccaggaacctcaagtgatggacaaggatagtctcttgcgacaaaacttagatgacaactttggaccggagaggcaagatccacacaatacctggacatggcgcgcatgtatcgaggaacacacgaattaatctatcaggatgtcttggcttaacaaaccctggggacaatcgctcgaaacaccaaagatagagcccctcgcgcgccgtgcgtcatgatttaaaagctatttcctaccccccactctttcagggaataccctttttacctctttgccacttatatttcctggacaaccctccaagtagtcggcaaaccagggccaggactgcttggaaaatgcccagtctactccccattatgtataaag

SEQ ID NO: 694266 - DNA, 962 bp, Homo sapiens
gccactccaccttactaccagacgaccttagccaataccatgtacccaagtaatgtataggcgatagaaattcgaaacctggtcgcaagtagatagtaggtaccgcaaggagaaagatgaaaaatgatagccaagcataatatagcgaaggactaaccccgtataccgttctgcgatagagtgaagttaactgagagagatacactgttgcaaggagagccagagctaggacccccgaaaccaggacgagctacctaagaacagctaaaagagcacacccgtcgtatgtagcacagaatagtgggacagatttataggtagaggcgacgaacctaccgagcctggtgatgatgctggttgtccaagatagaatctgtagttcgagcttgagagtacgcccacagaggcctctaaatccccttgtaaatctaactggtagtccaaagaggaacagctcttaggacactaggagaagaacctctgttgagagagtaaagaattcaagacccatatgtaggcccctgacgggctactacaacccttcgctgacgccataaaactcttcaacaaggagcccctacaacccgtcacatctagcatcaccctctacatcaccgcccgaccttagctctcaccatcgctcttctactatgaacccccctcttcttaagaacatacccatggacaacctcctactcctcaattgtacacattctaatcgcaatggcattcctaaatgttaccgaacgagaaatactaggctatatacaacctcacgcaaaggccaacggttcgtaggcccctaagggagctactaaaacccttacgcaaccaagcaaataaggaagacgtcaagctcaaccacaagttacctaaaatcccgaagttacctggatcctcaaccaagtgggccattcatagcgattgacaacaccgctctacgcaactgaaactctcccaag

SEQ ID NO: 694267 - DNA, 440 bp, Homo sapiens
cagaacaaagttcggatgtctgggctggggtgtccacattcatgtgtgtaaggccccttgactgtgaaaaaatggaaatggagatggagggaagaaggggcatgggcatgggtttaaagacagggaccaaccccccccccattccccacaggggccgggccgcgggttgcgtcacggcttgtaatcccagtactttgggaggccgaggcaggaggatcacctgaggttgggcgttcgagaccagactgaccaacatggagaaaccccatctctactaaaaatacaaaaaattagctgggtgtagtgacgcacgcctgtaatcccacctactcgggaggctgaggcaggagaatcgcttgaacccgggaggcagaggttgtggtgagccgagattgggccactgtactccagcccaggcaacaagagcgaaactccatctc

SEQ ID NO: 694268 - DNA, 590 bp, Homo sapiens
  misc_feature (45)..(45): n is a, c, g, or t
  misc_feature (68)..(68): n is a, c, g, or t
  misc_feature (171)..(172): n is a, c, g, or t
  misc_feature (180)..(180): n is a, c, g, or t
  misc_feature (188)..(188): n is a, c, g, or t
  misc_feature (191)..(191): n is a, c, g, or t
  misc_feature (214)..(215): n is a, c, g, or t
  misc_feature (217)..(217): n is a, c, g, or t
  misc_feature (220)..(220): n is a, c, g, or t
  misc_feature (238)..(238): n is a, c, g, or t
  misc_feature (240)..(240): n is a, c, g, or t
  misc_feature (256)..(256): n is a, c, g, or t
  misc_feature (295)..(295): n is a, c, g, or t
  misc_feature (297)..(297): n is a, c, g, or t
  misc_feature (302)..(302): n is a, c, g, or t
  misc_feature (338)..(338): n is a, c, g, or t
ggccgagccggggctatttctggcgctggcgcggtccaagaaggncatcccagccatcactcttccanctgctccttagagaagggaagatgagtgagtcgagctcgaagtccagccagcccttggcctccaagcaggaaaaggacggcactgagaagcggggccggggcnnggccggcnaagcgtcnganggagcccagcgaagtgccaacanncntangagacctcgggccgaccnanagggaagcaaaaacangggtgctgccaagacccggaaaacaccacaactccaggnanggaanccaaggggcagacccaaaaaactggagaaggaggangaggagggcatctcgcaggagtccatcgcgagcgaggagcagtgacccattgcgtgcacgccctgcatcctcaagctgggaggaggcaggcattcccatttctggggaactggaaccagggcattggcttcccgatatccaacaaagaggacacgacagaagagagcagacaaaccaaggaaaacaccacaaaaaaacaaccaaacagcaaacaagagacagacacaagaccaaaaacagaaagcgagtaag

SEQ ID NO: 694269 - DNA, 636 bp, Homo sapiens
  misc_feature (45)..(45): n is a, c, g, or t
  misc_feature (68)..(68): n is a, c, g, or t
  misc_feature (171)..(172): n is a, c, g, or t
  misc_feature (180)..(180): n is a, c, g, or t
  misc_feature (234)..(234): n is a, c, g, or t
  misc_feature (237)..(237): n is a, c, g, or t
  misc_feature (260)..(261): n is a, c, g, or t
  misc_feature (263)..(263): n is a, c, g, or t
  misc_feature (266)..(266): n is a, c, g, or t
  misc_feature (284)..(284): n is a, c, g, or t
  misc_feature (286)..(286): n is a, c, g, or t
  misc_feature (302)..(302): n is a, c, g, or t
  misc_feature (341)..(341): n is a, c, g, or t
  misc_feature (343)..(343): n is a, c, g, or t
  misc_feature (348)..(348): n is a, c, g, or t
  misc_feature (384)..(384): n is a, c, g, or t
ggccgagccggggctatttctggcgctggcgcggtccaagaaggncatcccagccatcactcttccanctgctccttagagaagggaagatgagtgagtcgagctcgaagtccagccagcccttggcctccaagcaggaaaaggacggcactgagaagcggggccggggcnnggccggcnaagccggcttcggcggtgagtcccggagcaacacgcgcgtgtgtaggggagtcnganggagcccagcgaagtgccaacanncntangagacctcgggccgaccnanagggaagcaaaaacangggtgctgccaagacccggaaaacaccacaactccaggnanggaanccaaggggcagacccaaaaaactggagaaggaggangaggagggcatctcgcaggagtccatcgcgagcgaggagcagtgacccattgcgtgcacgccctgcatcctcaagctgggaggaggcaggcattcccatttctggggaactggaaccagggcattggcttcccgatatccaacaaagaggacacgacagaagagagcagacaaaccaaggaaaacaccacaaaaaaacaaccaaacagcaaacaagagacagacacaagaccaaaaacagaaagcgagtaag

SEQ ID NO: 694270 - DNA, 1210 bp, Homo sapiens
gccttatgcacgcctgctgctctagtcagtttatgatgccccctcaatggcattaggacccgctgtagtacgtgtggaggctccgactacacattgggcccgtccgtagccctcagtgtcgcactactgccaaaggcttgcaggcttggccactgctacagtaggctgttggcactccttatgatgctgcgctggctgatcttcttctgaaccctgtatgctctcgagcagctgtctcatcgtgagaccactgttcgcctgcaggctaggcacattgctcggcgccttggcatttcttattgtcacgccaccgtatgactatgcccttgcccggtacttgacatctgtccctgcgtcatgaggccgcaggtcctgcggtcagccttgcgggcgttatccctccatctcatgggccaagcggggcacttgtcccgcaagactgctgacattgctagcggatctcgatttattccccacaggtgtccctttggaacccttggcacaccgagacgtagacacacttttggcggcttgtagccagctctatcgtaatttacacagcgagattcaatgtgcaactacggcttcgattgcagcacgtttccaccttgtagtccataggcgcttcgcttgactggcacaggcataacgtacctgaggcttgcggtacttaaaccactttcattaacacgagtacaacttggctatgaataacacgcttctattcttggtacaccgctcctgaaattctcaaaacagtcgggacgtgtgcaattcccatcattctgggcactttccgctcccttttgtgcgtggtcccccgagagagctcaaattctacacccaaggcgtggacccaaacggcttggggtgatagtataaccctgttgcccattcaatcgatgctgcgctagagcattttcgcgcgctgtacaatacggttttgtttacgcacccactttttgtgcgtctccgtctctcgcatctcattggtccgaactgtggctcagcccggaacggtcgttttcgcgcctttggggccctaaccgggccttgggacgtgtagccgctctccccttataggtcacccttacaggcgaccttttggttgcccccccgccttctgcatcgccccttttcgtttaagccgcataggcccccgtcgcattcccgttactccgtgaaccagatcgctttgccacggccattg

SEQ ID NO: 694271 - DNA, 456 bp, Homo sapiens
  misc_feature (430)..(430): n is a, c, g, or t
cgggttcttcgaccgggaacttctacccacctttcaaaactcagtggagggccgggcgcagtggctcacacctataatcccagcaccttgggagccgaggcaggcagatcacctgaggtcaggagtgggagaccagcctggccaacatggtgaaaccccatctctactaaaaatacaaaaattaactgggcatggtggcacatgcctgaagtcccagctactggggaggccaaggtgggagaatcatttgaacccgggaggcagaggttgcagtgagccgagatggtaccactgcactccagccggggtgacagagcaattggctcttgaaacaaacaaaatcgtgctgtcggtactctttggcagcttaactttttaaattaaatcggatctttggaaagagtttccttatcggcatcaagagaagggnttcaagaggggagagtcaggaagaga

SEQ ID NO: 694272 - DNA, 1041 bp, Homo sapiens
  misc_feature (341)..(341): n is a, c, g, or t
  misc_feature (382)..(382): n is a, c, g, or t
gccgaaacgcgaagaaggaagctcctgcccctcctatagctgaagcccatacgacgaagcgctttacaggtccaccgatagggctgtgtttatcggtgtccacagtccacaaaaagaagaagatccgtatcgtcaggcagcttccggcggccagaaagacactgcggactccggatacacgcccaattatcctcggaacgagcgctcccaggagaaacaaggcttgactcacgtatgctatcatccctgttttccgggttgaaccaagtgtgagtctgccagtagaagacatatagaacgataacaatcacaccttgctattcacttggtgtgatgttaanagccaagcaaagacaccaggattaaatcatggctagtgaangacagctgtatgacaattgactgtgggccatacggtcaagcaccactgattcgggcgctgatggagagaacgacaggcaatatcgttcggactaggctcctagattactgatcgcttagcgattgtttgccaaccaatacattgggcactcatctattgctcgatgtcctagtctgcctatattcttgaactactagtatagtatacttgtatcgttttcactcgaagtaatcagatagaatgcgacatccggatgacgagaagatcaccccgaggagcgtgttgcacccattcgtagcggaggggggataattgacgccttctcaccacaataggccgagtcccttgcggtctggaagcgtggcctggccacgggaagctgtactttgtacctacacctcaggtgaaggaattccgtcggcacgaaccagccgagataggcaaggctttcaaaacaaaccaacgtgaccagcatgcgcgggagaatcacgctgcgttttaacatttaacagggggaagaaagacctcgtgcttacggttcggtcccttgcgactttcagacgccaagagacatggaccactggttgcttccaggctcctcccctggtgatgaacgcagctacggaaccctgcctgaacggccatcggtccatcaccca

SEQ ID NO: 694273 - DNA, 205 bp, Homo sapiens
ggagaagatctgcagctgaggagagcgcaggaagagatgaattctcagcaggggagaggaatggaacagatgctcgctcgtccctgggccagtcagcgtcagagaacttagggggacacagtgtccgtatctaaaaaggagaaaaaccggaagcgtagggaccgcaagaggaagaaaaagccccagcgggtgccgaggggtgtcc

SEQ ID NO: 694274 - DNA, 491 bp, Homo sapiens
  misc_feature (4)..(4): n is a, c, g, or t
  misc_feature (7)..(7): n is a, c, g, or t
  misc_feature (130)..(130): n is a, c, g, or t
  misc_feature (174)..(174): n is a, c, g, or t
  misc_feature (176)..(176): n is a, c, g, or t
  misc_feature (195)..(195): n is a, c, g, or t
  misc_feature (197)..(197): n is a, c, g, or t
cccnccntccagtcatacgctgagtccggtggagaagtaccgattgcttgttggtgtcgctgttgatcacgtaggttgctagatcttacccgaccgttaagacccatcccaaggaactctagtcctcaantgtatggcttgtctgcaggtctcaaaaactctgctaagagtccntnattccccgctagtctttcnangtggtctcatctacgagctgggtggcccaaattcccgatttcctcaattcatcaatagacactctgctttttgacattccgaatctggttgaggccatggaggttcaaactggcatggtggggtgcgcaggccacggcgattccagtgcgcaggccccagcagccatagagcggggccaattctgctggccgcagggcccaggtgagcaatgttttcaatattcctaggctatgtagttcatctgttttccaaactgtaggaaatctccaaaatttttccaatttattttttgg

SEQ ID NO: 694275 - DNA, 348 bp, Homo sapiens
aaacccctgcccttttttccagtcccttccaagggtccccaggtgaaaacagcctgccctgcatcccagggtttggtttcagggtccagggccctgcgctgccccctccctcgtgcttcaaccaaaaaaatgggggtgcaaatagggtgttttgggtcccaaaaacccaggccccccggcgcgatttttctgggcaagagggcagggctcccccaccttccttaaccggggtgggggtccaggtcccccccttgcccttgtgggaaaatccctgtttcaacaaaatgggccaaggtcccccaggtttcccccgcccgtgtttatttggttaataaaactttgggtcca

SEQ ID NO: 694276 - DNA, 212 bp, Homo sapiens
agctgcacaggaaggtttgtcagcagcatttgggtggatgcctccctgtgctctgaggccctgggggcacttctaaacaggcaccatgtccctggggaaaacccaacaatccaaaccgccttccgctttgtgaaacaagagaaccaaagctcaggacacataaaagctaaagttggcacggcagggccttttttaaggccccgaaggtaact

SEQ ID NO: 694277 - DNA, 445 bp, Homo sapiens
  misc_feature (8)..(8): n is a, c, g, or t
  misc_feature (35)..(35): n is a, c, g, or t
  misc_feature (90)..(90): n is a, c, g, or t
  misc_feature (116)..(116): n is a, c, g, or t
cggcgggnccgcgggagggtgggggtgtcacgtgnccgtgccctggcgaacttggcctgcgagcccgacggtgcggtcagggccacgcgnggcagccccttctcggagccaccgcngcggccagccaacagccggcttctttcggtttgtcaggagaggccatgggtcagcgtctttataatgtaaatccgcccttggctttcgttaaagccgcagaactcaaagatgagggccgatcttactttaaaaaaagaaaacaactcagagagttaaaaatcccaactacctaccaggttaaatacataacaaagttaatattcccaactcggcacaggctttcggttcctctcggctccgtgtgttataaaatatttaagggcagattttagtaggaagctggtaactttgtaagttaccgaataaaatgaaaatcggttttaccttt

SEQ ID NO: 694278 - DNA, 752 bp, Homo sapiens
  misc_feature (529)..(529): n is a, c, g, or t
  misc_feature (534)..(534): n is a, c, g, or t
  misc_feature (545)..(545): n is a, c, g, or t
tggtacaggcccggaatcgttaaggatatcgtggcacgccgtctcgaggcgccgaaatgcagagagaggagaagcagcttgaggcatcatgagatgcactgctgagtcaagtggctgatctgaaaaactctctggggagtgtcattggcgatgtgggagaacgagtatggctcggctgacctgggcatctgtcctggacagtgtgttgcctctgtctttctgagacagcatggaagctagcgtctgaatcgagaggtccttggatagcactgaagagagagatcatccgcgtgatatccgatacagccgagggtcactcattaccatcgtggctgttgatctccgagagccgatgatgaagatctcatgcggcagactgaaggacgggtgcctgttttcagccatgaggtagtccctgaccatctgagaaccaagcctgaccctgaagtggaagaacaggagaagcaactgacgacagatgctgcccgcattggtgcagatgcagcccagaagcagatccagagcttgnataanatgtgttcaanccttctggagaaaatcagcaaagaggagcgagaatcagagagtggaggtctccggccgaacaagcagacctttaaccctacagacactaatgccttggtggcagctgttgcctttgggaaaggactatctaattggagaccttcaggcagcagtggtcctggccaggcaggccagccaggagctgggacgatccttgcaggaacctc

SEQ ID NO: 694279 - DNA, 200 bp, Homo sapiens
  misc_feature (84)..(84): n is a, c, g, or t
  misc_feature (88)..(88): n is a, c, g, or t
tcattttggggaaactttccagagatcccaattaagtttgaccttaccggtgtggtgggggggtacttctgttaccgaagatgnaganctaccggcaaggaaactcggtactttcggttcaatcgtgtgctggcgcgtgaaaacctgaaggaatacctagatcagatctgcccccacgaagtcgctcattacattgcacg

SEQ ID NO: 694280 - DNA, 115 bp, Homo sapiens
ccatcgcttccatgccggctcattctgccttttctatcatccttcatctccttttcattcccctaactcttccatctctccccctacatgaaacccaaggtgccgatgcatagcg

SEQ ID NO: 694281 - DNA, 250 bp, Homo sapiens
atctcgagctctgacattcggcggacgacgcgtatcgattggcagtgaggggcgcaatgatctaggctataatatcggagatacgtagcggtactgtaacacctgactctagaatatagtagcatggcaaattaaaggcgtgatatcgatcgcgcgcagatctgtcatgatgatcattgcaatttggatccatatataggggccggggtaataattacctcaggtcgacttcccatgaccattcgaattc

SEQ ID NO: 694282 - DNA, 111 bp, Homo sapiens
tttgtgcgcgtgggttgtgggcgcctgggttgtgggcgcgtgggttgtgggcgcatgggttgtgggcgcgttaccgcactggacgcctcgcggcgcccatctccgccacaa

SEQ ID NO: 694283 - DNA, 369 bp, Homo sapiens
ctctcatctccacacggttatgtgagtgttgtttaatcagagatgatacatgatagccaatcagcatttcttaccagtgtgagcgcacacgttacgatgcaattctagccaaaaaaagaaatttttttgtttttggcttttccctagtctttgggaaagcaaatatacaaggatttccggtgggcttcgggaagtaggaacgggggttggaacgagccccacgtgccaccttttagtggagtggccgcttttgaaacagaatcccgggcctcggtcaccggagacccaacccctagcggggccaactccagtgaattcacccatttttctccttcaaagggcctttccaggggggagagagggagagag

SEQ ID NO: 694284 - DNA, 343 bp, Homo sapiens
  misc_feature (17)..(17): n is a, c, g, or t
  misc_feature (145)..(145): n is a, c, g, or t
  misc_feature (147)..(147): n is a, c, g, or t
  misc_feature (195)..(195): n is a, c, g, or t
  misc_feature (218)..(218): n is a, c, g, or t
  misc_feature (294)..(294): n is a, c, g, or t
  misc_feature (316)..(316): n is a, c, g, or t
tagagtatgtatgtttnggtttgtgtatgtggagtgtatgtgtggattgtgtgcctgtgtgtatggggtgtgtgtggcgtgtgtgtagagtgtatgttgggatgtgtgtgtggagcgtgtgtgtgcacgtgtgtgtatgtttgtntntgtgtagtatgtgtgtagtttgtgtgtgtgtatttttggatgtgtgtntatgggtatgtgtgtaatgtgtntgcatggagcgtatgggtgtgtgtgtatatttatatttgggagtctgtgtctgtggagtgcatgtgtgtagagtangtggaacccaccatggtacttntctcctgccgacaagaccaacgtcaaa

SEQ ID NO: 694285 - DNA, 327 bp, Homo sapiens
  misc_feature (13)..(14): n is a, c, g, or t
  misc_feature (79)..(79): n is a, c, g, or t
tgagatggagtcnnactctgtcacccaggctggagtgcagtggtgcaaactcagcacactgcaacctctgcctcccggnttcaagcaattctcctgcctcagcctcccgagtagctgggattacaagcgtgcaccaccacgccaggccaatttttgtattttcagtagagacggggtttcaccacattggccaggctggtcgcaagctcctgaccttgtgattcgcccgccccggcctcccaaagtgctgggattacaggcgtgacacttgcgcccagccgcaggccttcattttgcacaggagaaaagaagtcattcattttaaga

SEQ ID NO: 694286 - DNA, 886 bp, Homo sapiens
  misc_feature (809)..(809): n is a, c, g, or t
  misc_feature (816)..(816): n is a, c, g, or t
  misc_feature (823)..(823): n is a, c, g, or t
  misc_feature (825)..(825): n is a, c, g, or t
  misc_feature (827)..(827): n is a, c, g, or t
  misc_feature (829)..(831): n is a, c, g, or t
  misc_feature (834)..(835): n is a, c, g, or t
  misc_feature (839)..(839): n is a, c, g, or t
  misc_feature (842)..(842): n is a, c, g, or t
agacagagtttttttctgttgcccaggctgcagtgcaatggtgtgatctcagctcacttaacctctgcctcccagattcaagtgattctcctgcctcagcctcccaagtagctggcactacaggcacccgcctccatgcccggctaatttttgtattttttagtagagactaaatgtagtagagaagtctctttagtagagacttcaccatgttggtcaggctggtattgaacccctgacctcaagtgatctgccctcctcggcctcccaaagtgcttggattataggtgtgagccaccgggcccgccctagcccaggaatttgaggcagcagggagctatgatcatgccactgcactccatcctaggagacagagtgagccctaactctaattaaaaaaaaaaaaaagggaaactcagaaaggcccattgccaaaaatagattcttaaaacctcagaatcagatgtctcttagaacatcctctgagtttgtagatcctgagtcattaatgtggcaatcatcaagatattccccaagcccctgctctgtgctaagtactgtaccgggctggaaatcaaggggaatgaagtgctgagcaaatacaagcccttcctcatctggtcccttccgagcttactatgagccacatgcctcaggtacaccacagtcatcacaagtctctaagcactcagtgctatttcttacctcttacctctgcacacactgttgcctcttggaattctttccttctatctgcctaatgaacttgtacttaatcttaagactcaagctaagcatcactttctttngtcaccntcactcntnancnnnctnnaganccncaaagttggtcacactcccttcatagctaaggacagtgttttat

SEQ ID NO: 694287 - DNA, 477 bp, Homo sapiens
tcttgtgtctctgaatactgtggacagcatagagagtatgtgaggctgaccataaacagtggccatggggatactgtgtagcagggctatacagtctctgaaatggccagagaaaaccctcattgacctctatgcacaggttgtcctggaatggatagagctccgtgaattgggtgctgccaggtcacttttgagacagactgatcccatgatcatgttcaaccaaacacagccagagcgatatattcatctggagaaccttttggccaggtcttactttgatcctcgtgaggcatacccagatgtacgtcaccacgaaccgagcagagcagcaatagcccaggccttagctggcgaagtcagtgtggtgcctccatctcgtctcatggcattgctgggacaggcactgacgttgcagcagcatcagggctggcttcctcctggtatgaccatagcattgttccgaggccaggcacg

SEQ ID NO: 694288 - DNA, 434 bp, Homo sapiens
gtttccctttttcccctttttccccccccttaggggttttttcccttgggttaaaatttttggtttttcccccctttccccctttgtttggggtcccatttttccaggccccggggggggaatttgggatttggagttttccccgggggggattaaaagggtttggtttccctttccaaaatttttttaaattttttggaaattttggggttggtttgggttggttttttttttggccccccccccattttcccttcgccttccctttccgttgggttttgtttgccctttttggggttgggcttttttttgctttttcccaattttccccaaaaacccgggttttttccccctttttttaaggggttttttttttttttttaaggggtttttttttttttcttttttttttttttttaagggcttaaatttga

SEQ ID NO: 694289 - DNA, 139 bp, Homo sapiens
aaaaggttaaattttccggtatttgggaaaaggtttgtttaaaggagggcaaaacccgtttaaggggttttcttttaaaaaattaagggttttgggccctaaaaatttggtttttttaaaaaaaaggtttggattttga

SEQ ID NO: 694290 - DNA, 310 bp, Homo sapiens
  misc_feature (5)..(5): n is a, c, g, or t
  misc_feature (17)..(17): n is a, c, g, or t
  misc_feature (62)..(62): n is a, c, g, or t
  misc_feature (308)..(308): n is a, c, g, or t
aatanttaaaaattgtnagaatttaaaaattcaacagcaggccagatgtagtggctcactcntgctgggaggccaaggtgggtggatccgttgaagccaggagtttgagatcagcctggccaacacagtgaaaccccatctctactaaaaatacaaaaattatccaggcacggtggcatgtatctgtaatcccagctactgggaaggctgaggcacgaaaaccactcaaacctgggaggtgcaagttgcagtggagctgcagtggcaccagtgcattccaagcctgggcaacagagcaagacactgtntc

SEQ ID NO: 694291 - DNA, 354 bp, Homo sapiens
ggcggaggtgcatggctgcagtgagctgtaaccacaccgttgccctccagactgggcacagagtgagactgtgtctcttagaaagaaaaatgctgactgggcgtggtggctgacacctgtaatcccagcactttgggaagcagaggcaggaggactcttgagcccgggagtttgacaccagcctgggtaacatagcaagaccctgtctctacaaaaagtaaaaagtaaaaaagttagctgggcatggtggtgtgcacctatagttccagctacttgggaggctgaggtgggagaatcacttgagctgggaggtagaggctgcagggagccatggttgtaccaactgcactccgg

SEQ ID NO: 694292 - DNA, 256 bp, Homo sapiens
  misc_feature (11)..(11): n is a, c, g, or t
  misc_feature (15)..(15): n is a, c, g, or t
  misc_feature (25)..(25): n is a, c, g, or t
  misc_feature (33)..(33): n is a, c, g, or t
  misc_feature (37)..(37): n is a, c, g, or t
  misc_feature (64)..(64): n is a, c, g, or t
  misc_feature (97)..(97): n is a, c, g, or t
  misc_feature (115)..(115): n is a, c, g, or t
  misc_feature (120)..(120): n is a, c, g, or t
  misc_feature (123)..(123): n is a, c, g, or t
  misc_feature (127)..(127): n is a, c, g, or t
  misc_feature (135)..(135): n is a, c, g, or t
  misc_feature (137)..(137): n is a, c, g, or t
  misc_feature (142)..(142): n is a, c, g, or t
  misc_feature (158)..(158): n is a, c, g, or t
  misc_feature (170)..(170): n is a, c, g, or t
  misc_feature (175)..(175): n is a, c, g, or t
  misc_feature (181)..(181): n is a, c, g, or t
  misc_feature (201)..(201): n is a, c, g, or t
  misc_feature (204)..(204): n is a, c, g, or t
  misc_feature (208)..(208): n is a, c, g, or t
  misc_feature (210)..(210): n is a, c, g, or t
  misc_feature (226)..(227): n is a, c, g, or t
  misc_feature (250)..(250): n is a, c, g, or t
tcttgctgtgntggnggagcccccnccgatgancctncctggtgctggcctgagttcccagganctgtctggtggccctggtgatggcccctgaggntggagcccccatggccancccanccnggcnctgttctntntcctntcaccccatccccacncccctggtggcntgacncccacnccctggtggccccatccccnagntccncncgatatggtttttacnnctgtggatttaataaaaacttcnccagtt

SEQ ID NO: 694293 - DNA, 184 bp, Homo sapiens
caagcagtaagctctttggcccgtaaaaatactcattcaagttgataattgccagaggaaagaagaaatatttgagctagacagtgtagttaccctttagagtcattatgttaactccagcaaattgcaaagctagggcgggctcggtggctgacaccgtgtatccccgcacgttgagaagctt

SEQ ID NO: 694294 - DNA, 237 bp, Homo sapiens
aatggaatggaactgaagacacagctgccgtggagcagggtttatcctagatgatgtaagtatgaatcttcacccttagcgtgaaaaatccaccaacggcccataaaaccaaatgtgtaaaagactcagaaactcaactgggaaaaaagaacctgacaaaagccgttagtttagtgacgagatgagtagtctccatccaaagctgccaggagaccatgaatttaaaacttgcggccg

SEQ ID NO: 694295 - DNA, 503 bp, Homo sapiens
acagggtttctccatgttgcacaggctggtctcgaacttctcacttcaggtgatccgcccacttcggcctcccaaagtgctgggattacaggcatgagccaccgcgcccggccgccttggcctctcaaagtgctgggattacaggcgtgagccaccatgcccagcctaaaccatatattttttttttttttggagacagagtctcgctctattgcccaggctggagtgtagtggcacgatctcggctcacggcaagctctgcctcccgggttcatgctattctcctgcctcagcctcccgagtagctgggactacaggcgcccgccaccatgcccagctaattttttgtgtttttagtagagacggggtttcaccatgttagccaggatggtctcgatcttctgaccttgtgatccgcccgcctcggcctcccaaagtgctgggattacaggcgtgagccaccgtgcccggcctaaaccatattttttaagtgaaaatttgga

SEQ ID NO: 694296 - DNA, 138 bp, Homo sapiens
agaaggtgctgtgcacaatcgaggcgacacctactggatgcatgcgcaagctgctgaataggcattcaggaccacctaccccttatgccccacctgggattcaaatgaaagtgaaacatgttagatagaactctgtga

SEQ ID NO: 694297 - DNA, 147 bp, Homo sapiens
cgcttacccacggacacaccacgctctacccacggacacacccgctatacccacggacaaccacgctatacccgggacaacccgctactacccaggacaccacgctttacccacggacaccagctattacccacggaaaccagctat

SEQ ID NO: 694298 - DNA, 968 bp, Homo sapiens
ggagaagcagaagatagcagaaggaaatgtttaagagaactatgaacagaataatagtcctactctggtagcgaagcgttaacggaagtctgaggacaatcatccgggagatgctgatggctcgaagggcccagtagggagacctcgtctgggaagctacttcctcctgccaccttcccattcctggtgggggcagaggagtgtctgcagggaaacaagtttctcctctggccccgatggatgctttattcggatggcctggcaacaatcacgatttaaactcgcatcaccggctggagaccctcattgtgcgttcccaggcgcctggcaggttatttaccgcggtctcttgcccgtgactcacgcatacgtgtcccagggacacttcttctcctctcggagatgtgtgatgaactcccaggagaggggcagatgggagccagggcaagactacggcaagctctgcctgagcctttccactaaggcacgccaggccagaccaactagccacagcgtctgtcccacatctgctaagccctggctccccttgagccacacggcgactggaacagaccggctgacgaagagcgcagctgccccgctcctccaaactccagcgttctgctcgcctctgacatcagaggcccttccatctcatgaacgcgactgcggcctacgcacatcttctcctcacccccttccctgaaacccttgcaacataacggctccaacctctcccacaccccttaccatgcccaataacaccagaacgagccaaccaaaacaaccccaatgtctccaccacacctcaccacctcccaaccacaaccgcaaaatcaatccgcatccccattgcgcatgacccagatctgccttcaaaaaaattaccttttccccctgccctcctccccaataaaattccccacacagcgacagctcccacacaacacacaccacctctcacacaa

SEQ ID NO: 694299 - DNA, 968 bp, Homo sapiens
  misc_feature (408)..(408): n is a, c, g, or t
ctcataatccccccctccccccacaccaaaaaaccaccctaacccaaactgcacctggttcctgtctacattcagatttagatgaaagccacaccatcggaggcagcccagaggcccatgcggagatgttctggattcttcagacgcatagcttccatcgtgatgcaaactctttgactaactgcgcaacagcgacaccgggtacgcacactcatcacctatcaaatcccccctcccgcttcccatctgacccctccgccactcctactctacttccaaccctccacccacacttgaacgcccgaacttccgcccccgcccccgctgacacccatcgcctcatcttaccacacgcatcccgccccacccgcacacccttatttagtgctctcctactttaggccacanctaattcccaatcctatctccccccacttcccctacctccccgccgcctacactccctaccacgatactagctctctcgtccaccgaaccccacgctgcacacgactactgacccgcccaccgcgccctcgatgacccctctctcttcttgatctacctaactgctgtcccatccaccctcgccctcgcacgcttgcacacgctacatccgtccgcgcatccaccgccatcccacgcaccgacaccgcgcatcctacaacccaacgtccgccctctctgcgatttcctcctatgactcttgatactgctcacctcaacacatcccataccagacatatccacccgcactccccgctcgacacgcgatttatcgccgttcgcgcgcgctaactgctcgcgacgaatcgagattcatatcacgccccgctcccgctctttgaaccgcacacctttccctccttcccgccctactccatcccgcaccaacacatacactcttattatcgccacaccccgacatcgccacttttcaccattccacgctccacatccctcctccg

SEQ ID NO: 694300 - DNA, 144 bp, Homo sapiens
tgttaacattcgtcccaatatgtccagctgtcaaagccatcatatatcagtatatggaagagatttatcatagaattcccgactcagacccatcttctagcaaaacaatgcagatcatctccaccatccggacacgaatgttca

SEQ ID NO: 694301 - DNA, 263 bp, Homo sapiens
gacgggcgcgtgtccactgattatgaggggccttgtaggccatggcatgctgttaggacttatactaagctcggcgcgagccatatgaggtgttttaacagatgattgatgggactgacttccagctgagtggcatccaggaggtctacgtatcactgctcatggacagcagggaggtacgagaggaccttcgtctccctgagggagaccttgacatggagattgagcagacgtacgactgcggagacgagatcctgatcacg

SEQ ID NO: 694302 - DNA, 621 bp, Homo sapiens
gacctcccaaaaaggaagtttacaaataagcccagataatacagactacaataaatacctatctcttcaatgctcagacaccaaagaacatctactagcaccaacaccatcttggaaaacatgacctcaaccaacaaattaaataaggcaccagagaccaatcctggagaaacagatatgtgacccttcagagagagaattcaagatagttgtgttgaaggaactcaaataaatttatgatatcatagagaagaagtccagaattctatcagataaattgaggaagaatattaaaataataaaaagaattaagcagaaattctaaagctggaaagatgcaactggcatactgaagaatgtgtgattcctttaatagcagaatttatcaagcagaagaactagtgagcttgaagacagtctatttgaaaatacacagtcagaggagacaaaacaaataaaacaataaagcatgcccacacaatctagaaaatattttcaaaagagtaaatctaagagttactggaatttaagaagatgtagagaaagtgctatgggtagaatgttttttagagggataataatagagaacttccaaaacctagagaaagatgtcaatatcca

SEQ ID NO: 694303 - DNA, 159 bp, Homo sapiens
gaccagctttgagctccatcaagggtattttaagtaatgtcatttgagcaggactggattttaggccgaggcaaatatctacgtgtttttccccctcctctgctgttttatcatggtttcaaaacaaaaattttttttgggcattcccccctctggggt

SEQ ID NO: 694304 - DNA, 331 bp, Homo sapiens
gaatattgtaaacactgccggattttctgaggggaataaactatgtttcatgcagggggccaaacccataaactattttgctatcaattaaatcaacaatattaattaaaaacaataaaaaggtctgcagggttagctttgttaagcttccagaagtattcgttgtgacgatgttcctctgaaacagtgtcagtgttctcaggtctttctacacttaccaaatcacctgcatgtaccatgctttaaagaagtaacgctcagataacatgccacacggggaatccaaacgttagtacggggaaaggtcagtttagaattacagctaaggtca

SEQ ID NO: 694305 - DNA, 640 bp, Homo sapiens
cacctggctttctcgttgtagcgcacgtccccacggtgcctacccaaatagggccctgaattcccaccataacgggggctccatcccgcggaggtgcccgcagtttgccagccgacaccccctaggcccaacacttactgcgcggacatccctcttccatttaccaaaattctcccggcgcggtaatatgtaacgctgtcgtggccacccaacgacacttttctcggcggtcatcccggcatctgccccccgacagtggtaattgcgggttacccgccggttccgcgtacgcgccccctgggaccatcctcattcactcgttagggcctccacattacactttctctgaacacgcccgcgataatgattcaaaaatttccactgaattttagaaaaccccttcgtctttcgacgccgcaaatattccttaaatatatagaaatcccctcccccactaaccctcgggtgagagactatatttgagagcccccccgccctcatccaccaccacatgtcgcgacaaaccccctaattgacacttaatatccttcgacccacaataaaggagaagaatatctgaaccccccccaacgggttttaacccaccccctgggccccctaattttccccacaaaaagaa

SEQ ID NO: 694306 - DNA, 209 bp, Homo sapiens
gtactagggagacatgtcaaagaggagccagtcgaaactacgacagggtcaattgaagtagaaccatgactttctgccggtagaaaagactatggggaagaagttacctgcaaggtacagcaactccagagtcatcaaaaacagaaagtggacagcaggacaaagagcaaggattactgcaaagtaatatttccatatgagacacgcga

SEQ ID NO: 694307 - DNA, 1175 bp, Homo sapiens
gtctccctccccgttgtgttatgatcggggttaacaaatgttgaataccactgtacccctgttagttgtgtattcaaggacacccagtctccggaagtttttatgggggggaccaccgctttagttgagagtatctttttgaaaggggtattgccccaccacagagatttgtggttcaccccaagattagacgaccgaaagggccttttgtgttttgaaaccgtgttccggagtcccacatgttgaaacgttgattgatatccggggttctccttgataaaggggttattaccgggagcgcccttttggggggtggcccccgatatttttctcgggccatccagattggtgcccgggcgccctaatggggctattaatgaggcccctatgtgcgccactcgggggggttctttggtcatgggcgggccccccccccgggggggctttgggaagtgcatggtccctctcgtggctcaagataaagctctgtcgcgcgcttttgctgcgccgtggtaaaagaaaaagagttgcttgggagctcaccctggatgtgttgaatttggaaaccttgtttactcgagaaacttggggcgacaacaagaggctggggcgtgggcgcgcggcgcggcgattatgtggtacaccccgcgacagggtgtttctcaaggaatctcttgtgtggagcacctgcggtggaagacttgtaaccgtggccctccgcgtctgcccgttttctcccagaatgcttctcaagatctctcaaagtggttgcccgggccagaagagcgttgagtcggagctggagcctcccaggacccctgccggcccggtggtcttcttgccccacagtctgagctgttgtctctcgtagaaccccgagaggagataaacacaaagagccagacccttgtctcctctggggggagccaattggccccttgtgctggtaacaccagccagctcccgaagagatctccacccagaagagattcccacagcccagctcccagcgctactccagagcttgcccaagagggggcgggccttgtggaagaactccttacacactggggccaccacactagagatggggcagaaacttgtttgcatctttgtcccccagcaaaggctacaagttacctccttccaattgataattaaccctttttgaaatg

SEQ ID NO: 694308 - DNA, 265 bp, Homo sapiens
  misc_feature (91)..(91): n is a, c, g, or t
  misc_feature (177)..(177): n is a, c, g, or t
  misc_feature (224)..(224): n is a, c, g, or t
  misc_feature (245)..(245): n is a, c, g, or t
cttactcccaacactttggaatgcttcggcaggattgcttgagcccaggagtttgagaccagcctgggcaacaaagcgagacccccatctntacaaaaaaaaaagtttttaagttagctgagcatggtgacttactgggcccctgtagtgctagctgctgggaagctgaagcaggangatcatgtgagcccaggagtttgaaactgcagtgagctgtgattgtnccactgcattctagctttggngacaaaacaaaaccctatct

SEQ ID NO: 694309 - DNA, 725 bp, Homo sapiens
  misc_feature (275)..(275): n is a, c, g, or t
agggagatgaaaggtgactgcagtgaggatttgccctgtgtactcgcctctgcaagatccacatctcagctgcacaactggctggcttgtgtgtgagcctcagttttatcatcagtaaaatgggggaataatcatatccagctcagaggtttaacttcagcctagtgcacggaagacatggtaaatggtcatcgcttctcccttgaatggaccgagggcccccgactcccatagcactaccccataaagtctaggctcccgacttcggcattcangccttcagtgataaatccaggcccaccatccgtccccacaccacctttcacacaccccctgcccccaccctcgcaggcctcttattttagctgcacatgctctccctgcctccgaaatgcttgcggcctttcctttccatttattgacgcccttgtgttctctctgagcagcccttccctgtgtccctagctggagttcctcactccctcctcagtgtcctgaagcttcttgttagagctgctgcagccacttggttgtgtctggaagcaagtctgcagcctctggcttccttgcgggactgcaggtgacttgaaagcacagctggtttccaggaagctggctttcgtgccaatgggcccaggggttaaagcaggcacagttccagcaactggtgagtctccaaattcataatgtcaagacctcagagaatttaaccatgacccactggg

SEQ ID NO: 694310 - DNA, 246 bp, Homo sapiens
tcctgatcgcatttagaccacatgcatttaaaatttttttaaaagtataaaaacagattcaaaccaaaatcatacaggctaccttccctgatcaaataccatatgataaagatattaactataaggatgaagccaaaagagtattatttgaaaagattaataaaacagttaaacccttcacaaggctgatcaaggaaaaaagagaaaaaacaccaaacacaaattaccaatgtctaaatgcaatca

SEQ ID NO: 694311 - DNA, 229 bp, Homo sapiens
acatctcctggaggagcatggagcatagcactgcggcaggagctgattgacaatcagacacgcatcactcaggaggccggcagtgtatctcctgcgtattcaagccaggtggcagcaactcatatcattctcctgctggacactgggtcagaagcgtaccaggcatgtctggcagcaagcagttgccagcaagtttcatggttgtacccgtgcaagcgccatgcaactc

SEQ ID NO: 694312 - DNA, 301 bp, Homo sapiens
ccccccccccccgggggtttaaacgggcttccccttttttggggttttttttcccccgtttaccccaaaggggaaacccccccccgggtttccggggtcccggccaacccccccggggggggcttgggttaaaaaagggggttttgggggttgccgggggaccccccccccttttttcccccccccccccccaaaggggggtttttttttttttttttgggaaaacccagggggttaaaaatttttttttctggtggggggcccaaaccggaaaaaaaaccgggggggggggtttttttta

SEQ ID NO: 694313 - DNA, 82 bp, Homo sapiens
  misc_feature (75)..(75): n is a, c, g, or t
  misc_feature (77)..(77): n is a, c, g, or t
tggaagccaacccaggcaagttcaagctcccagccggggaccatgcaggagagaaaggtgttcgtggagcggatnangaggc

SEQ ID NO: 694314 - DNA, 254 bp, Homo sapiens
aaggactcccgtgaatgtgcagccacgccatgatgctggacggcgccaacaagtcgatcaaccgcatcaccatcgacggtgatacctcacaccaaacgactgctgacatgctgcatcgccaccggaccaggccaattctgccgagcaatcacttccaccgacaggtccattgttcgcgagcgttgaaacatggcagtgtttgacaatgtgcatggcacgtggcccaggccatcgtgcgtgacggcgagggcgcg

SEQ ID NO: 694315 - DNA, 662 bp, Homo sapiens
cgtggtttgtgtggtgggaagggttttttttgtagtggggggtgttgtggttgttgggtggttggttttgtggttttgttgttggcggggtggggttgttgtgttttggtggggttgtttgggtggtggttttgttgttaggggggggtacttgtgttagtgttctgggtgtttttgggggagttgtttttgtcgaggtttttgtgtttggtgttttttctcgggggtgtttttgggtgtgttgttttttttttttttgtgtgaagggggttgtttttgttttgcttggtttttgcgtttgttggggggggttgtttgtttgggtgtcttgcggctctgttgggggggtgggttattttggtgcgggggggggttgtgttggtttttttttgggggtgtgggggggggccccgtggttgtagacgaggggtttgttgtggtgttgtgtgttttttgtgggggggtggtttatttggtctgggtggggtttgggggtgttggggtttgatggggagttgttgaggaggagtggggtgtagaggaagaggggtaaggtatagtaattaaagggatggggaggaggagttaatgagagtataaatattgaggaaaaatttataaaaaaaaattaacatgtcgaacgcctcggcccagtcgactct

SEQ ID NO: 694316 - DNA, 88 bp, Homo sapiens
cctcggtttctcggctgctgggtcggtcccgaccacagctggggcggcctatgtcgagtggcgcccatgggaagagggctcagctcgc

SEQ ID NO: 694317 - DNA, 144 bp, Homo sapiens
tctgccccagcctcccgagagctggccgagtgcaccaccacgcccggtctactcaagggttcttgagttaggcattctaagaaagagaatttagtacttcaggacagtcagcaagagaactcgatattgcgtggccagaaggca

SEQ ID NO: 694318 - DNA, 238 bp, Homo sapiens
gcatattagagatctgtagagaacatcaggaaattgcagccactttatccagatctgattacatcttgcagtagactcacttggtgatatttctgaaatgtggtgggttcatgattgattttggattctgtggtgtttcctgctttgtctctcaatttgatggttatgtcccctcttcttacattcttgtaccatgttataatatccacaaagtaatgatacatgcagaatgggctct

SEQ ID NO: 694319 - DNA, 693 bp, Homo sapiens
taacataagaggctggggctggcatatctgaccaaagtgaagaagcagagaaggaggtggatgtgaggcgacccacgcaaggactttgggaccagaacacagcatgactctgacccatggcttttcatggagacacacagggacaagagacatggcaagagtatattattgttaaagggcagtattaagagtgaatcatacacaggatgtattgaacgtttactatatgatcagagctgcaccagtatcagctcatctaaacctcgcaaccctatgagaggcactgttactatgcccattttatagacaaggaaactgaggacagagaggttgagtaatttgctcaaagttacacagcagaaaagtggcaaaccaatcttgcctggggctgctgacccgggagcccctacttttgactgctggccatgctacattgccgcagctccctgtgagcaaggagatcccatgtaccgtcctagtttgggccactggagagaaaagagtaatgaagatttagatttattcagtaaaggaagacaaaggggaagaagataatttgcatttatgtgtcacatactgggtatgaatggttcttcatttaatgtttacatcatcttcgttttatcaatgctgaaactgaaaatagaggaagttagaggacttgttactctacgctgcttccaagtggtctga

SEQ ID NO: 694320 - DNA, 202 bp, Homo sapiens
aaagtttcaacattctccccagacgatctagaagggtcttcctcctcatccaggtgtctttgaaaatttaacctgagagacagtttcacggccatgagtgggaagtggaggtcggacattacttgttatacctctctgacattaacattaacataaactttaagtccgatgagaaacgttttactaccacggtgctataacg

SEQ ID NO: 694321 - DNA, 411 bp, Homo sapiens
tgtcctttgggcatcccctgtgcactccagagctcctgtcccttctgggccggcccacatctgtgtacaagccttgttttgtcccagtgccattttctacacttagagttcctctgctgcctctcatatttccatttaaggccctctcgagaggttctgttctcctgcccagcagccattcccttcctagtttaactagaactccatttctcatcctgccaggaatccagccgtggagtgagcttcagcaagcctctctgcagtctcttgtctgctccaaaactgtggcctctggttgtgagaaatgggcatcctgagtcagtgagagcagtagttagcttgcagcagcttccccctctcccccctgagttgagccttttcttctgagctacaatcaatcgctctccctgt

SEQ ID NO: 694322 - DNA, 281 bp, Homo sapiens
ttttgatggataactaccgatttgcacatacgacatgttgagtctctggtgaacgagtatgatgatcatggagaggttatcatcttatttcgtccttacacatctcactaaccacgttagaggaccagactgtggcatatacagagccaaacaatgaccagtggcaaaattaaaaagtttctccaggaaaacattaatggtatctgccctcacatgaccagaagacaataaagcttcgatacagggcaaggacttatttatagcttactatacatgtggac

SEQ ID NO: 694323 - DNA, 756 bp, Homo sapiens
  misc_feature (167)..(167): n is a, c, g, or t
  misc_feature (171)..(171): n is a, c, g, or t
  misc_feature (175)..(175): n is a, c, g, or t
  misc_feature (179)..(180): n is a, c, g, or t
cttagtctgtaggagcagcgagctggcttgaggacccggggagaccctcaagaatcgacccatcaggacgccagagctgcttcagcggtgaccaccttctccctctaacacattcttcccttcttcacaaacggcccatgtcagacgaaggctcaagggggagccgnctgncccngtgnngctgcccccgtgcctcccagtggttgctcttcagtggggctggctgtgctggctggctcctctggctgggtggctcggtgcaattccctggcccccacgcaacctccaatggtcttgctgcagatggccatcacctgcttgtggctctgaagagccagaccctcctccagaacctgatgagtgaggatgatgtgcgtcagtgtgctgcatggaggccatgtcggctgccttcctgaggccagcggtgaggcaggttggagcagatgaatgatgctgcctccgagtgctgtcacagcccatgccccccactgctggggaggcctgatgcaggctggccgaccatgcaatgagcgatgagggggccctgtgtgctgctggccgacctgtgtgagaacatggacaattgcccgcagacttctgccagctgtctggcatgcacctgctggtgggccggtacctggcggcggggggctgcgggactgcgggtggctgggcggccagcctcatcggcacgtgcagtcagaacgtgcagccatccaggagcaggtgctgggcctgggtgcctgcgtaacctgc

SEQ ID NO: 694324 - DNA, 882 bp, Homo sapiens
attaatcccctggcccaacccgtcatctactctaccatctttgcaggcacactcatcacagcgctaagctcggactgattttttacctgagtaggcctagaaataaacatgctagccgttttagttccagttctaaaccaaaaaagatagggacgcctcgtcccgacagaagctgccatcaagtatttacctcacgcgagcaaacggcgatccataatccttctaatagcatatcctcttcgaagcaatatactctccggacaatgaagcataaccaatattaccaatcaatactcatcattaaataatcagtaaagtggctatagcaattaagaatctaggaatagcccccgtttttcacttctgaggtcccagaggttacccaaggcacccctctgtacactccggcctgctttgcttcatcacatgagaaaaaagctagacccccatctcaagtcatataccaaatctctgcccctcagtaaacgtaagccttctcctcacgtctctcaagtcttatccatgcatagcaggcagtttgaggtggattaaaccagaaccagtacgcaaaatcttaaggatacgcctcaattagccacataggatgaataataagcaggctctacgtaataaacctaaaataaccattcttaatttgaccctatttatatgaatcctaaactacaacggattctagtaatcaatttcactccgcgaccagaccttataatatctcggccctgaacagtaaaatgagtaaaccttattccatcacctcttttctagagagggcggcccgtaaccgcgtttggcccaggcgcttagagaacaaaaaaggttttcccaataggaaaccctgaaattataggaatccgcaaaaca

SEQ ID NO: 694325 - DNA, 805 bp, Homo sapiens
  misc_feature (167)..(167): n is a, c, g, or t
  misc_feature (171)..(171): n is a, c, g, or t
  misc_feature (175)..(175): n is a, c, g, or t
  misc_feature (179)..(180): n is a, c, g, or t
  misc_feature (205)..(205): n is a, c, g, or t
  misc_feature (274)..(274): n is a, c, g, or t
cttagtctgtaggagcagcgagctggcttgaggacccggggagaccctcaagaatcgacccatcaggacgccagagctgcttcagcggtgaccaccttctccctctaacacattcttcccttcttcacaaacggcccatgtcagacgaaggctcaagggggagccgnctgncccngtgnngctgcccccgtgcctcacctagggngttgtcatcgtatctagggaggcggcaggactggactggacggacgcgcggcgtccagtcgcgtcgtgnggggcatcgtgcgcagatttccgcggcccaccacacgtcgaaccgtccgaaggtgttgcatgcaagtatgggcatcgaccggcagggcctctgagaggagcgcagacacgctgcctccaggaacgcgatgagttgtaggagcaggcggtctaggtgggcatgcatggaggccatgtcggctgccttcctgaggccagcggtgaggcaggttggagcagatgaatgatgctgcctccgagtgctgtcacagcccatgccccccactgctggggaggcctgatgcaggctggccgaccatgcaatgagcgatgagggggccctgtgtgctgctggccgacctgtgtgagaacatggacaattgcccgcagacttctgccagctgtctggcatgcacctgctggtgggccggtacctggcggcggggggctgcgggactgcgggtggctgggcggccagcctcatcggcacgtgcagtcagaacgtgcagccatccaggagcaggtgctgggcctgggtgcctgcgtaacctgc

SEQ ID NO: 694326 - DNA, 1491 bp, Homo sapiens
  misc_feature (1463)..(1463): n is a, c, g, or t
ggctagaaatatttcccctacttgcagttggttctgtaatagcctataatacattgtggacacatagtttatgcttattatagataataggttagctttctttgccaaaaataagtagtaaactagtgtttcaacacttgatatatcttaaccttataaactatatatactttttaacttaccagaaaatgtcataattatacaaacagcaaagtctaaagagcaatacttactagagctcagcagccttcaataataataggggttgatacagacactgtggggtactaatattcttcatacgttccacatgtgaattattaggcacaggcaaccccaaagacaaagtccgtgatgagccatccgtggaagtgtgccagagttgaccaaagtgaacctgggaacaagaaggccccaatagcgatggggcttatttaagcattttagatgggaccaacaacaaaagatgtttaggactaaatcttatcctgcattagaaccctccctttggccctgggacttactaaaaatctacaataataaactgggggtcactgagcagatgggtttatggaaggttaaattacgattccttatcacaacgggttttaacagactcttaccttgagggcacaagattatacacccacttatttatcagcacgaaacatgttctggctacgcaggttagagaggaaaatcaccagaagaaaatccagacatacaagggggttaaaacaatatatgaggagaaagaaccagggtggggctcatataaatacccccagtaatccaacgacgtcctgagggccatatattaagtgggttacgcagttttagttcttccagccaagagaattaatgttgtcgggaccgcccgttaaaactcaaagcaacacatataacgtgcgcggtaacactacacaaacaaagttctgatgccacccaatttttggtaaccaatcttggactatgcggcaacacacgactttctgtgcacactgcattaaatgctcaaccacacagacgcaggggaaataggggcacgatagaggacaacaaatcaaaagcacaacggcggacaaccttggacacacacgccacataagcaaacagaacgatgataaataagggggaagcgaaagacaccacaagcaagacaaattgtggtgatccattcccataagaccactggagccccctctctgacacatacctcaacagactaaattacatgtgataagatagtaaaaagaattgtgtagacagacaggtcggactaccaaacatctatttatacctttgagtaagtgagatcaaaggtatcgtacactttgataaatacacgcaatacagagaatgatagatcatctatctgtatacacaaaaacgtgtggacatgtagtagacgcacaagaagctgatcagaacacaatctatcatatgagtgcgccacatagatncaacatacgtcatttttaacatacaaca

SEQ ID NO: 694327 - DNA, 345 bp, Homo sapiens
caaacccactccaccttactaccagacaaccttaagctaaaccatttacccaaataaaggttaggcgattagaaatttgaaacctggcgcaaatagatataggtacccgcaagggaaaagattgaaaattttataacccaagcataattatagcacggactaacccctatacctcctgcataatgatttaactagagatacctttgcaaggagagccaaagctaagaccccagagaccagacgagctacctaagaacagctaaaagagcacacccgtctatatagcaaaatagtgggagatttatagatagaggcgacacacctaccgcgcctcgtgatagctgg

SEQ ID NO: 694328 - DNA, 920 bp, Homo sapiens
agcggagtcacacagctacctggtaggtgactggaggtgttgatcagtgcttgtgtgggattttgctgatgtggccccaagcccgccgtccctccccagccctgccgatggcagaagaaacctcgacaaagtgaaattgggaggagtcaagagaaagttaaaagaaatattggtcatgatgaatagcagcccatggtgtttccgaagcccgtgagcctgtgatggaaacaggaaatacaaatggcccagcatctcatgagacctgaccacattctggtgcgttgcgcacatcaccttggagatttagcaacaggtaattcgacaggggagacgccctgcatcatctgcatacctcgtgaaggatctggatagcccgtgccaagaactaacagtcagtcccagactcggaggttcctgttacaagagttcagtggcaactggaatgcaacaccgatcaagtactttggtaatagcaatggaatgaaacgagtggaacatttagcatgtggtacgatagttaacatcgatttacttagtctatgttcgcgacatgtagtgcttcggttcgtggtggacagttcagtatgtgtgaggacccgagtctcgtgtcacccattcccaggcttgggggtaaagaggatcacccctcggaggaagtccaccgcatcacacgacagggagcgctgaataagccggtcctagggagtgggtccgatccgaggacatgagacgaggcgccactgcggggacacgttctgatcggtaacacatgtctgactcggcggggagaaacgtgcgatacctcgactgaagaagagaacgagacaaagaacaagcaaccgcaggaggaaagatcaaggaccaggactgaaaagaaccacggagaacaacagataacgatagaaaaagaacgaccacaa

SEQ ID NO: 694329 - DNA, 225 bp, Homo sapiens
  misc_feature (65)..(67): n is a, c, g, or t
ggttatacacagatagatgttattaaaggcatatggattaatgagattactatatattattactnnntgataaggagcaatttttgagcaccttctatgttccaaggacattttctaaggccttacatgtatcagatatttaattttcccaacaaggctacgaagagggtacagattattacccttatttttttcagaggatgagactgagacacacagaggcta

SEQ ID NO: 694330 - DNA, 915 bp, Homo sapiens
  misc_feature (44)..(44): n is a, c, g, or t
tcacaatccgtattacactcaaagacataagtcagtgtcacacnacccaaatgccttggtaaatttgttgtgcataacatatattgaagataccatagccacagcctgacatacgactacgtcccataatcacaactggaaggaaagtcatgacctaattggacaaaacaattcttaaagcttatatcagctgaaaacaaacttctgtcatgtcgctgcctttatccatcattaaaagatcgttaggattcaaaggtgctactctaataaaatacttcatgagcgcaattctgctttggtgatgaatctttcaaggcaatctcaacttacttctttaataaacatttaatatcaatggatctgagattaaaaggtctggggctgttttgcctcaagaagtgtgaactaatggcctttttccttatctggaggcaaaatcgttatccccaccacggaaaataacaccactaaccttgatggttgagtggaaagtcacattcacctgaaaggatgaatcccgattctcacacaattttggagaaaataccgcataagatcatgtgaccaaacgcccattaattggcaacagacctcaagagacccctgtattattaagcttccctcgatagtgatcccatccattgctgaaaacataaaaatgactaccacttatggaaagcggtggcataccctcccagattttacaactcacatgttacgctccaaaacccttattcacttttctctaatatcccaccgctacactgaccttcacctttatttattggaacaattggatctttatataacaatcgttccttttcctgtagactttacaccctcaatctgtatatgattaaaccccatgccaaaaagacaaacgtgcttaagttgtctgtgagcctctgtgtcaat

SEQ ID NO: 694331 - DNA, 463 bp, Homo sapiens
aggtagggtgtcactatgtcacccaggcgggagcgcagtggtgtgatcacagctcactgcagcctcgactccctgggctcaaatgatcctcccacctcagcctctcgagtggctgggacctgaggcatgagccgtcaggcccagctaattttttttttattatttgtagagataaggtctcgctatgttgcccaggctggtctcaaactcccaggctcaagtgatcctcctgccttggcctcccaaagggctgggattacaggtgtgagccactgcactggcccagcattcaactttttgtgtgtgtgtgacagggtctcattctgtcacccaggctggagtataatggcatgatcttggctcacttccacctgggcaacagagtgagactccttctcaagtaaactgggcttgaaaaaaaatttaaaactctgctctctggaagacagtggttagaaagtaa

SEQ ID NO: 694332 - DNA, 1136 bp, Homo sapiens
  misc_feature (229)..(229): n is a, c, g, or t
tggtttgtttgttttgttttccctcttcatcttgctatagagttcctctactagtaaattatttgcaattagccaggccttcgttgaacgtggggggtctgtcccattttgcaggggttcttcacgttcactttcagatagggggcaaattcggtgtgtagccaccttcggttataaacctcgccacagcgccaacttccaaatagcttagcggcaggggcaaagggcntgtggataggggtctcggctgtgtgtgttacaccctgtgccaattaaccggttccactgtgttaagcggcttgtcaggggcttgcagcaaggcggtgtggcttggcggttgtgacagtatagccaggtcttgtgtgcattattcttgttagggcttgacattattccacccataataagaggtctcagcaccctataaaatatccgttcgcgtggttaaaccaacaccgtggattaggcggaggattggctgtgttgtgggggttcaccggcttcggaccttgccacccatttttcttgttccggcccctctctgtgcccctttcaaatgtggggcctcttctgtgaaagcggtttgccgtgggtatgcgcatgccaaataagggggctacaggggagaacgccccggggaatgtgcatcttaaaggggacattgtttaccgttgttttagattaccccccccttcattcccgtgaaataggggggccaatgattgccattaagtgtggccattagggggaccacattcgtgttgtggaaaagacatggggaaatggcgtgaattattaaacctcccgggacccattaatacaggcctccaaaactttacgggggggctataaatttcccaaacccatttgtgcctttttctgtgtggtggacccattgtttctatattaggggccaattataccaccggtgtcttggtatgcattgtttttccccctctgagttttaacagggggcccctatttcaccaggtagcccgggggtaaatttcataccccggggagacccatggtgttgatgtactaagagagtttatttgtttgtgaaaattattgaaaaccgcagaaacccattttgagagcccggtatatgacaggaagagtttttgtataccgag

SEQ ID NO: 694333 - DNA, 241 bp, Homo sapiens
gagagaatcgggagtagaagtagagtgacctataattcttcttcaggccggatggtgaaccgcatctttcgggtggtgagaactaaagggaattggttgtggaggttagggaggggaatgaggattcttgcccgtttggcagggcgatccttaagccactttggaagaagctggctaccacatttaatccagtgaaccaacttttggaggtcggtgtggccatcaggggatccagtttaag

SEQ ID NO: 694334 - DNA, 969 bp, Homo sapiens
cgctaacggaagataccttgcgaattgctaggataaaaatcgccccttcctacactaacatacgtagcgagataacagaagtccaaactatgtagtatgcgagtccttatagaatcagataataaccacctactaaaacaaaaacaattaacattacaatattaaaaacaaaaacatataaaaatataaaaatatatcattaatcactactattatattataaataatttatataaaataaatacaacacaatatatcaatcactctacattataatatcccccatcactcatctaacatatctatcaccataccacatatacaaaacataaatacaccaacataacaacataaaacaacataaaaacacaacaacaaaaacactaatacacaacaaaaagatacgaacacaaatacgacaaaacagcacaatcatcaattgagatatcaatagtaagaaacatcccgacaaaaccacgcaaaaattaaacagaaaattcagatataccagaaaaatgagaagacacaagactacagaaccactattctcgcactatttaacaacaaatctcatcctcaaccatataacaaactatcacgcaatctcagcacacatacacattcatcaccaacaccatatttatatcatctacatataaaacaaaaacaaaacacacaacacacccaaccccactaacctctatacccctccacccctaccccctccttctcccattctcctccctcccattcaacttcaccctccgtactcaacaaaccactcatcacactagaaacacatatcatcccttcaccctcttcctttcaattaatatactctactacatctcacctctcatctagctccatatcaatacaatacacacacaaccatctcattcccccttctattcaccactaccaatactgtacataacaccacactcacacttcaaaacaccaccacac

SEQ ID NO: 694335 - DNA, 152 bp, Homo sapiens
gtactggtgtctgatgcaggcttctaagggactgcataggagttctctggcagatggttggggaaacttgtcaggctgaggaaatatctcaatgcatgacatgtcagaggtatgaaatgacacagtggcagacggtgccgcgggcgatggca

SEQ ID NO: 694336 - DNA, 942 bp, Homo sapiens
  misc_feature (3)..(3): n is a, c, g, or t
  misc_feature (188)..(189): n is a, c, g, or t
  misc_feature (205)..(205): n is a, c, g, or t
  misc_feature (209)..(209): n is a, c, g, or t
  misc_feature (232)..(232): n is a, c, g, or t
  misc_feature (236)..(236): n is a, c, g, or t
  misc_feature (250)..(250): n is a, c, g, or t
  misc_feature (298)..(298): n is a, c, g, or t
  misc_feature (301)..(301): n is a, c, g, or t
  misc_feature (311)..(311): n is a, c, g, or t
  misc_feature (322)..(322): n is a, c, g, or t
  misc_feature (326)..(326): n is a, c, g, or t
  misc_feature (339)..(339): n is a, c, g, or t
  misc_feature (350)..(350): n is a, c, g, or t
  misc_feature (355)..(355): n is a, c, g, or t
  misc_feature (364)..(364): n is a, c, g, or t
  misc_feature (366)..(366): n is a, c, g, or t
  misc_feature (379)..(379): n is a, c, g, or t
  misc_feature (393)..(393): n is a, c, g, or t
  misc_feature (400)..(400): n is a, c, g, or t
  misc_feature (402)..(403): n is a, c, g, or t
  misc_feature (410)..(410): n is a, c, g, or t
  misc_feature (414)..(414): n is a, c, g, or t
  misc_feature (416)..(416): n is a, c, g, or t
  misc_feature (419)..(419): n is a, c, g, or t
  misc_feature (430)..(430): n is a, c, g, or t
  misc_feature (437)..(437): n is a, c, g, or t
  misc_feature (439)..(439): n is a, c, g, or t
  misc_feature (442)..(442): n is a, c, g, or t
  misc_feature (450)..(450): n is a, c, g, or t
  misc_feature (462)..(462): n is a, c, g, or t
  misc_feature (479)..(479): n is a, c, g, or t
  misc_feature (492)..(492): n is a, c, g, or t
  misc_feature (500)..(500): n is a, c, g, or t
  misc_feature (503)..(503): n is a, c, g, or t
  misc_feature (511)..(511): n is a, c, g, or t
  misc_feature (514)..(514): n is a, c, g, or t
  misc_feature (517)..(517): n is a, c, g, or t
  misc_feature (523)..(523): n is a, c, g, or t
  misc_feature (536)..(536): n is a, c, g, or t
  misc_feature (538)..(538): n is a, c, g, or t
  misc_feature (540)..(540): n is a, c, g, or t
  misc_feature (567)..(567): n is a, c, g, or t
  misc_feature (850)..(850): n is a, c, g, or t
  misc_feature (912)..(912): n is a, c, g, or t
ggnatttaatattacatgctataatgatatttatctcacagtttatatttcattcatttatattatttttttaaaaggtttctttatcagctactaaacatctcagcaatttggtgtgcatagctctagattaagcaacaaagaattgtactgataacaaaccacaggggaaatggtggttagtaagnntcagccttataaaacncccntccacactgtttcacagcaagantgcnctctccaaaacgtngccatcaaaagcagcaaacaaaccctatattacatccatttgacatanttncagccaaacntatattttgcngggnatgattaaatggngggtgtgtganatccntcttttttnanattcttttttttnaaaaagggtgattntgatttngnngtctctntatntnggnggggggggggnggcactncngcncttttgcnggtataacttantcttggcagtgtctcantactgggcatgcnttgttgtngtnctgttgtngtngcngttgtnttgtgtgtgtgtntntngtctcatcagtatgctactgtcatggnaagtttttgtttaagtaggaatctaaaaatctatttagttctcatgcataaatgcataaatcacatcacttttagtgcaatgcctgttatgtaattccacattgtctaatcatgaaatcataaagacagataacagccatgaggaaccaaagacggcacattttgagagattcagagcctgacactcaaaggaccgtggcagtaactctgtggaatgtcacagttttacaagaacaatactgtggatgaaagaatcaacagcacattgagcattcctaaattngttgttattcagcaaatgccaccgaggagagaaatcaaaaatgaaactcaagacatcaaggngttagagccaccaatgaccctatgtacaac

SEQ ID NO: 694337 - DNA, 137 bp, Homo sapiens
  misc_feature (133)..(133): n is a, c, g, or t
  misc_feature (136)..(137): n is a, c, g, or t
atctggcatggccttcgtgtcccactgccaacgtgtcagtggtggactgactgccgtctagaaaaactgccaaatatgatgacatcaagaaggtggtgaagcaggcgtctggagggccccctcaatgtggtgncann

SEQ ID NO: 694338 - DNA, 949 bp, Homo sapiens
gggggggcctctttttccggctggaaccatggaggtgtgctataagagatgacaccatggaggtctcctgctggtgtgccggaaacccttaatatcaaacgctagggaactttcgcacacctgaatactcagggcgccttgagaaatactgtttgcccatgaatgcattgtcttctgacgaggcgcagtcaggcaagctgtatctattgggaaaaagcaagaagcactgatcgctgagggaatatagggcagaatggttccgtacctgctatgttcgtaatgtgctggaggattggacatggaaaacgtctggccatagcttcgtagtgtatcctgccaatagaccctcatactcttggtgttagtcatgcagaactcagagggtactcatgtggacgttgagcccagatggttcaaaaggtgtagcacgtcttctttcgccttctgtctaaatcttcacatggaaccgtttgtgtagtgctcgaaccaagggtctgtcgattgactcgatagctgagcgatttgtagaaggccttattatttgccattggaggtgtaccccgaatcgtgaagctctgctcacattgaggctattctacaagcgtggtttatggccataatcagataagaatgcgaaattgtgttgtaccgatgaggcctttgattgcgtccatcctcttgtgtcaatacggggtcatctgcagtggaaggaatttggattctatgaagaatcgtattctgttgggagaaaacgctctcagccagatgggtcgacataaactttcccgtgtgtggccctgtttcgaacttggtcgtttgcccagtgagggtgggaactgaagcacaatgggaccacacaatttgggtagaacaggtggagaattgcttggcaccggcggaaggcccacaattcagcaggggtagttcgaggaatgaccaagggggttac

SEQ ID NO: 694339 - DNA, 570 bp, Homo sapiens
  misc_feature (20)..(20): n is a, c, g, or t
  misc_feature (119)..(119): n is a, c, g, or t
ccaagaaagggctccaaganagccgtgacaagacgccggcaaaggaggaaagaaacgcaagaggcccaggaaggagagctacgccatctacgtctacaaagtgctgaagcaggtccacnccgacactggaatctcctccaaggcgatgggcatcatgaactcgttcgtcaacgacatcttcgagcgcatcgccggtgaggcgtctcgtcttgctcactacaacaagcgctccaccatctcatctagggagatccagaccgccgtgcgtctgttgctgcctggagagctggccaaacacgccgtgtccgagggcacaaaggccgtcaccaagtacaccagctccaagtaaagcgttgaatttcattcagctaccccaaaggctcttttaagagccacccatactatctgttaaagaacatgctgcgtcttgatatatatattttttaagtaaccttgttaatgacgtttatctgaaaggtgaagtagctatgtttaattaaagcaggattgttttgtggctattctacagtgcaacaataaaaaaataattaaaagcagacttaacttata

SEQ ID NO: 694340 - DNA, 923 bp, Homo sapiens
  misc_feature (79)..(79): n is a, c, g, or t
  misc_feature (85)..(85): n is a, c, g, or t
  misc_feature (89)..(89): n is a, c, g, or t
  misc_feature (92)..(95): n is a, c, g, or t
  misc_feature (104)..(104): n is a, c, g, or t
  misc_feature (107)..(107): n is a, c, g, or t
  misc_feature (126)..(129): n is a, c, g, or t
  misc_feature (138)..(139): n is a, c, g, or t
  misc_feature (141)..(141): n is a, c, g, or t
  misc_feature (143)..(143): n is a, c, g, or t
  misc_feature (148)..(148): n is a, c, g, or t
  misc_feature (180)..(180): n is a, c, g, or t
  misc_feature (188)..(188): n is a, c, g, or t
  misc_feature (193)..(193): n is a, c, g, or t
  misc_feature (197)..(197): n is a, c, g, or t
  misc_feature (201)..(201): n is a, c, g, or t
  misc_feature (211)..(211): n is a, c, g, or t
  misc_feature (234)..(234): n is a, c, g, or t
  misc_feature (237)..(237): n is a, c, g, or t
  misc_feature (687)..(687): n is a, c, g, or t
  misc_feature (741)..(741): n is a, c, g, or t
  misc_feature (746)..(746): n is a, c, g, or t
tcagacagtctcactctgtcacccaggctggagtgcaatggcatggtctccactcactgcaacctccacctcccgggtncaagcnattntcnnnnctcagcctnccnagtagctgggactacaggnnnntgccaccanncncngctanttttgtatttttagtagagatggggtttcacnatgttggncaggntggnctcnaactcctganctcatgatccacctgcctcggcntcncaaagtgctgggattacaggcgtgagccaccgcacctggctagatatgattttattaacatttgtaatgtgcagtattctgggtgtatgcctgcatcccaccaggcatttaggaggcattatgagaagggcaggcagttgaagaatagtcctgactccttcctggctggggaatgtcatgtgagagctggcattgctctgtggctgttggtttctttagcccaggttaaagcccgtctctaaagagggagacacaatcttagacctgccaagtggctagactggtgtgatccaatccctgtgccttattgtgactcttgtaccataatgacagccctgtgcttgggctgctgagtgtgtgctgtgggtgagatggttaagcaccaacagaatgggctctgaggcctatagccatcctggctttccccagcagactttgaggagagcatcnggttacatctgtataatttcgaacttgcttctaggacagagggcttcctaccanctaancatgctccctctccccaccaataaaacaagcgaataaaaaaaattttgtgggaacatcttccctggttcttgggacctgcgccaagctgtaaagggcttgtgacctcgttcctgtggtccagtgggtccttggctgggaatgtgctggctccttgccttgggtggatgggaatcaaa

SEQ ID NO: 694341 - DNA, 351 bp, Homo sapiens
  misc_feature (251)..(251): n is a, c, g, or t
gcttacctttagtaatcacgatatctgaggggtacatgggaatgcaggaccagcaggtggtggctagtctatctgtaggacttacggaccggactgctgatattaactgaactctctgacttcttctacagctgctcatagacaatccaccagatcactgcatgtctcacgacgtcacgagggacgaagcttacagcatgttctagtagttgacagccacttctggttgagctactcataagactgccagnctgtattcttgcatattcagcagtcctgcacgatgtgggcccctctctgcatattctacccgtgctttcccacagtgtcctcttgcatcagctggccatc

SEQ ID NO: 694342 - DNA, 120 bp, Homo sapiens
  misc_feature (12)..(12): n is a, c, g, or t
gagctcggtacngttcttttccatagcaacaggatatctgaaagcctggtgcagtgatgtggttctggtcccatattacagtcctgagcttagtgttgatctgcacgtgctattgaaact

SEQ ID NO: 694343 - DNA, 271 bp, Homo sapiens
tccagcttgtacagcaacagccatgaccgcagcaattgcgaaaaccagaggcttgattgccatcgagggtttcatggtgattctccgtactctattaggttaagtgtcgttcttaactgaagggtcaatccgcgacccggatgctcaaggtgttggccatgcggtttcccaccccggcactctggttcaactggatcacgccacggctaccggtgaaggcctgatcactggtggtgacctggcgatagccggctggaatgtcagttgctcc

SEQ ID NO: 694344 - DNA, 247 bp, Homo sapiens
caagtaaatcgagctcggtccgcgaagagttagcgttgatgaatagagagtcctttcccctatgcttatattatgtcaggcttggtgaagatcagatgcctgtaggtgtgcggcttaatatctaggttctcatgttctattccataggtctattagtctagtttgaataccacaagcatgctgtcttggatactgtagccttatagtatagtttgaagtcaggtaatgtgattcctcaggcttagtt

SEQ ID NO: 694345 - DNA, 893 bp, Homo sapiens
  misc_feature (1)..(1): n is a, c, g, or t
nctcgtggctttccgagtgtcgcaagtgtcctccaggaagcggtgtcttgtgtgtttctgcccaaatgggttcttccctcggtgtagaggaacgatgattgtccaggcccccttcatccacgcggggcgccccccccccgacagtcttgacaggcccagagtcccccctgtgactgggggaacccacaagaacaggggtaacggggaccctggcaaaatcctctccggacctggttctattcctttttgtccaacccctcctttttcgcttaatcgggctgtatactcccttcagggcaacaggggatgcttgaaatcataggtcccctgatccagaaccaatggtctccccccagtgaagtggacaaagctgtcaatgaaagcctctggattccagaagaatcccgcccgagtccccctggccgtcattatacgtcccgccagacaccttagggcggcttaccccagaaaacgtgctgcagcgtaaacctgctggaggggagatcgcactgtaagcgcccgacccccgcgctgggccgtccccgaaaaaagggggtccacccaaagcgcttctccaggctgacagggttttacagaaaccacagcttggcggatatcaagtccccctgggcgcatccccccgtgacgggggacacatttcgccataccccccagctgcctttttcaagttggctcaataagcacgtgcgcctggcccctcccatatacatctcctccccggtgtaggcccagatgggaattgtgaccatatcccaaggaagttggaagatgaactgttgaacgaagtaggacacacctgtgacgctcccttggtgacttggcggcaaaaacagaaggaaaaaccgaaattgtaacttaaaaaccccataaag

SEQ ID NO: 694346 - DNA, 302 bp, Homo sapiens
gggtctcgtctggggatctccgatctctcctctgctaaggtcagaggtactggtgcgtaggcgttccctgagccggccagtctgagaatggaaaggtcctggagctgagcatttaggttaaaaccggtaaacagctgaaagtacagattctctctccccgctctagctcatgcactattccaaaaattcaaaacgctgatatcggtagcatctctgtgccctcctagtgtatgtctgcaccggatgcttacccttaaaacagtctcggcatacacttagtgattccctactccaaacatgta

SEQ ID NO: 694347 - DNA, 271 bp, Homo sapiens
gtcaattctagaggatcccggcgtctggaaaaggggagatgttgagcactgttcagcagctgtggcttcgctggcgtcccacatttgtctccagtcttgtatcagctagcacttcactctagaaccatcataatagtgaggagcagtaaacacctgattggacaaccagccaaatccatgtcacactaaatagcagctccccattatgacctgggttagtcacacgtgcaagatcaaggtccgactcacctaggatttcaattggtgcccc

SEQ ID NO: 694348 - DNA, 146 bp, Homo sapiens
ggcgttctagaggatccctcgtaatatgtcgaggtcaacttataatcccagacagctttggaagtgcgaggcaggtggatcacgaggtcaggagttcgagacccgcctgaccaacataggtgaacacctgtctctactaaaaatac

SEQ ID NO: 694349 - DNA, 121 bp, Homo sapiens
cactggattcggtattgatgcactggatctgaacaaaatgcctccatgagcacattcttcgaaaaatcattctcattaatttttttattagaaaaacaatgtaaccattatactgaacaag

SEQ ID NO: 694350 - DNA, 304 bp, Homo sapiens
  misc_feature (42)..(42): n is a, c, g, or t
  misc_feature (53)..(53): n is a, c, g, or t
  misc_feature (86)..(86): n is a, c, g, or t
  misc_feature (111)..(111): n is a, c, g, or t
  misc_feature (136)..(136): n is a, c, g, or t
  misc_feature (181)..(181): n is a, c, g, or t
  misc_feature (192)..(192): n is a, c, g, or t
  misc_feature (269)..(269): n is a, c, g, or t
ggaagtttgagactagtctgggcaacaaagtgagaccctgtntctaaaaaaanaatttaagaactaggccaggcacagtgactcantgcctgtaatcccagcactttgggnggctgaggtgagtagattgcttgantccaggagttcgagaccagcctggaaaacatggtgggaacctgtntctacaaaaantataaaatttagctgtgcgtggtggcacacacttgtagtctcagctacccaggaggctgaggcgggcggttcaaatnagcccatgagattgcggctgcagtttagccattga

SEQ ID NO: 694351 - DNA, 1551 bp, Homo sapiens
gaaaacccacgaggggacgcggccgaggagggtcgctggtccaccctgggggcgtggggagtgaggtaccagagttcagcctccttttggccccagacgcctctgtgctcggaatccgtggtgctgcggattgaggtcccggtatcctaagcggactgcaaggatggatggaagtgctgggaatccttaggagggctcgtgattgagcgatggtccatctaacttggtctttgtcagggtgcctggggcattgcaacatgtgaggtgaccttcgatctacagggcgttccgtgcattttcctgatagccctttccctccgatataccttcggactagtgcagagcaaactcttccccttctacttccacggtctccatgggctgtgccgttcatcaacctctgcatcttggccttcacaagcatgctttgggcgtcagctcacattctgtgcagggccagccagctttacctggctgtccttgagccttacgctgtgccacttgtcaacgcacgcttggctgggaaacacctggacctaagttgccatgtgggcctgcaaccgttggagaaaggacgaggctggagtggggaggaccagggagcaccagggtgccggaacctacggcagtgcaagaaaaggatcccaggtacgcagcttccgcagaattcttccgcgagcatggctgggccaccttggacctgtggtggtccgagacaggctgtctaaggcgtgcccggaaatagagcctataattgcgcggcacaaaacagtctcgcggagaacacaaaaaaattgcgtcgccgaataaacaatggcgccactaggtatggtcatcgtaggggtatcacacgtcttgtgtttagccagccgtgcccctgtcgtagcagcagaaggcgaggcagcggaggacgaaacagagggaacgaacgggcaagaggcagcaggcaggcagcgcggagagacgcgcaacgagcaagaagacgagacagacagagaggaagaagagaagaggaggacgagaaagagtgcagagaggacgcgacaggagagaagagtgacgcaaagacaggggagcgaagcaaaacggcgagaagcgaagcagcagacagaagagaagagaaggaagagacaggcgagcagggagacggggaaagacgagagagaaggaagaaccgagcagaccgagaaaaaaaacaagaaagaagagagcacgagacaagacaagagacagagcacaacagaaacagcaagggcagagaacgaccaaagaagaagaacacaaaaactagcaagcaaacaagacagacacagaaaagagaacaacagcacgcacggaaagacacagagaagacacgcgaacagggaagacagagaagaacggcagcagagcagaagccatcacagaaaacgaacggaaggaaaaagagacaaaagcagacagagacagcacagaagaaaagagcgaagcaggacaacagacagccaaacagaacaaaacaaacaagacacgaacgaaggaaagaagagcagaacgagcccgaacaagaaa

SEQ ID NO: 694352 - DNA, 892 bp, Homo sapiens
gtggcggaactgctgctccggctgggctggagtgctgtctgatggcggcctggacagctgcctgagttggctggctgagctgggcatggagcaccaggcggtgtgtgggcgccgtgaagagccttcaggctgctgggcgaggtcatcgaggctgaacttcggtccaccaagcactggtgagcttacttgctgtgagtgtgctgaaggaggattgccctgggatgggcatgccatgatggccctgtgtgtttctgaagcattcccccatgatgtggcctggcccagagctgagcttatgcgactgcccagtggcaaatgtgggcttcagcaatggccatgtccaacaagtggattcgggtggacaagagtgctggctgacgggccccgggtgttcctgagtggtggacagcatggaggatgagtgtgcagcggctggctccagctggtcctgtgttgggtgacatgggctgagaagcttgggggagaccggagaggagcgagctgaggaagaggaacgctgttggctgaagtgaactctgaagacctactggtgtgagcaaaggcaagtgcctttagtaccagcatctgcaagcaagagacagagctgagcccagagatgatctccagtggctcttggcgggacctggccctttcaatggccctacacactttcttggcccacggtgtctcccgatagggccacttcagccgtgctcaaggtccgctccccagttccgacagatcttcctggcgctgggggttccaccgagatgccgctgttacttcattgggagtctttctgacttgacgcctcttcccgccagagccccacgccgtgacaggacgacactttttctggattccgcggaggctgggtccagggtttgccggg

SEQ ID NO: 694353 - DNA, 109 bp, Homo sapiens
atgcagctgtagctattcagctagcagctgctgttcgctgctgctgtatctgttgctcgattttgatgatgccatttacttagatgctagctgctagctgctgctgcag

SEQ ID NO: 694354 - DNA, 410 bp, Homo sapiens
tatatataactgcattttattacacattgaagctctgtggcaactgtgtcaaggaggtctattgtcaccattttttttaacaccttgtgctcaattcctgtttctatcacattttggtaattctcggtgaatcttaatgatactattggaattggtttgggacaccatgaaccatgctcatataatatagcaaacttaattggtaaatattggggtctgactacttcaccaactggctggttttttatctctttctctctaaatgaggtttcctgtgtccctgagacacaacaatattgaaattaagccacgtaataacctaattaattggcttgagtcaattaagcctctatactaatgaggaagggctctaactatttaagagggaagagattcacatctctcctttt

SEQ ID NO: 694355 - DNA, 1628 bp, Homo sapiens
agcaaatacagcgagtctagagtggagccttttaaaaatgtgactgtaaaccgcccacctgtgtcctcccattggcgatggatttctttggtgtcatgacatcagagaagaaatcgagcatgggagcgtgtgatagaggtccaggactgggcgtgtcggggaagcgaccctggatgtctccgacctcatcaaattactgcggtgtcttttctttagaaagcgcaggctaccactcaagagcactctatagatcatcgcaaattttccgagagagggttagtatccagaaactggtaaggcgtcgacataactagactagcagtgtcatacttggacgtcagcatagggagggcgtgcagcttcgtgcgggtggttagtgcagaagtagccacaagatgctatcgggccgtgcacatagtcaaaaccaccatctgttagcatagttaagaagagcaatggagcatcagttggagttaatggttcaagagtatatattacatccatacacatcgtatcgtgttgacgtagggcagggagcaggtcatacagcgtgcataaccgcatttacaggggcttgattcccaagacaccaacagcattccagggccggatatggggggcaacaagaacagtatgccaaccatattacgtggacgaggccggtaaggccaaggatcaacattgcaaactaaggggcacagccaaggcacgcgggaagagagatacagccacagacgaagagggggagacattttcccacggggcacgaaacgtacattaccacatacaattcccaaattcggacaccagatcaccttggcacagaaagaccgtacccaaagcaggagcacaatcgaggagaccgttgggcacaaaggagcaccatggtaatggggacaaacacagtggctatctcactccgacggattgggtactagtacccctgtgagaaaggaccatctggtatgccaatggagagacgaccaagacaacaggaggcacacagatccaggacagagagtaccaaaagcgggaacacactcttgggcattgggggaaagacaccgccagacacagtgggacaggacccaccagtattaccacacgcgggaagcgaagtttagtacacaccaggacaccagacaagagttcaacgagaatagatcgactaacccgaattacacaagagggcgacatgactgtgacaaggggagtattccacagaatcgcagtgggagaacagcagaagatagtaagagagcaacaagccgagataacattcgaaacgaacagcggactaagaggaggggaaacgcaacattccacacatgtggactatggagagatccgcacgacaaggaccatggggacaacccaccgatggtgtgcccaccacagcagtatgggtttaggagtgaaaaacgaagcaaagagcacaccagcagtgaaacaggcagacaccccacggcgaggaccaacaaacaggggcaaactgcataagccacgttgaaacacaaacgccacgcagggtaacggaagcacacagagaacgaggagagccaaggagatgaacaacccggtgaacagtgcagaagcagataaagagacgacgacaaaagaagaaacgg

SEQ ID NO: 694356 - DNA, 548 bp, Homo sapiens
cgtctgccctgacattatttctttataccactaggacatgggattatgcagaatgttggttgagtggctttttatttggtagagacagggtctgtctctgttacccagcctagtctctaacttctggtctcaagtggtctttccagctcggtcttcctagtgttgggattgcaggcgtgaggcagcgcacgggccagatggcgattgtaaagaataatgtgaggaaaataattagatttgtgcaagtgacgatagttgagatgttagctaaaatgatgacctagaggcagctcgttttggtaaatatctatagtcagtttaggctgctataaacaaagtaccgatagatatgggagtttatgacacgacagaaagcttacttctcacaattcttaaagtctgggacatccaagaataacatgcctttagacgcgaggttgcatgtaccagcttgggcgatagtggcgagtagcctcctattccatgttgtcctagcaagcatggttccctttactattattttggtctctatatatgttcatgtgtca

SEQ ID NO: 694357 - DNA, 213 bp, Homo sapiens
tcatcgagctcggccctatttaccgaccaccgctttggcctcccaaagtttaggattatagacgtgaggcactgcgctcagccttgtctttgttttcagatgtttgactattatgtgtcgatgtaggtttcatcgggtttatgctgtttggggtttgttcagctttttgaatctgtaggtttatgtcttttgccaaacttggggtggtatcag

SEQ ID NO: 694358 - DNA, 813 bp, Homo sapiens
  misc_feature (594)..(594): n is a, c, g, or t
agcggagaagggttgctgtggtagcgctcgggcgccatgttaggacgaaggggaaggaggagaagcgcttaaagcggcgggagcaggctgctgggagaggggttgagcctcgagggcgtagaggcaggccctccccgtctcgtcgcagcctcgaggtggcatccatgccccagggcggcaagatggcgagcgggtgctcgggaggcgcaagtgactgcggcggcgccaggcagctggggacacgatgcctgctttgcgagtgactaccactaggggatcacagaaacaaaagcaataaccgagcaagcgtagaggcacttagtgggccctctacttgtcatcatcgagacattgagactgggcgcccgaaggagagacatgtgacgtgccgctacgtgtgacatccgaggacaagttcaattttgcatttacgagtcaggaagaggcccttaggaggctgcttatccgaagaggaagggtaaaagaagggagaccttgggaaggagcggtcagggagttgccacaagtattggggagggggaaataacgttcagatgtaacaccctgtgggatcaaaagatggatgtgggcatnaccgggagcgaaaaatgcaagttggatagagagtgacggaattgtatttctcagcgaaattgctggttagagttgaagcacactggtacgcgtcgtggaagagaactgttgtgaaacacttttgagatggtataccagagtatactgacgctgtcatgacataagaggggggtgtggagtatgggatggcgattggtgctgttggtacccaaggtactt

SEQ ID NO: 694359 - DNA, 133 bp, Homo sapiens
  misc_feature (3)..(3): n is a, c, g, or t
  misc_feature (6)..(6): n is a, c, g, or t
  misc_feature (45)..(45): n is a, c, g, or t
  misc_feature (73)..(73): n is a, c, g, or t
cangancagcaacaggatcatgatcaggcatctgcctttggccantttcatgtcatgggataccatgtactcngtgggggggtaacttatcacattggagcggcagcgtcacgatagggtcagtcagctgtac

SEQ ID NO: 694360 - DNA, 817 bp, Homo sapiens
gtgagccgcagggccgtagtgcagccatggcagcccagcctggaatggcatggtcttgaagccccacttccacaatggacttggcatgcggcgctgtggccacagtggttcaaccatgcctggccctgtaagatccgcagactgtaatgtgccctggcaatgccaatggctgcagcctgcgatctgccaccggctgccccagcagtcagaggtccacatcctgtgcaccactctgtagcagctgcacccaacggattctgtgtaaccacacagaatgtgtgctgctgccttgtgccagcgtgcattcatgccatgtgagtgatgctcaagtggtttggcctggcaacttcacaacgacaggtgtaggcccgagaaccatctgtgccatttcttggtggatcacgacggacgtgctggaacacatgtccaactggaggtccacttgcaatgtgccaactggttgcatgcggtgctagaacggcagtaccagcctccaaaacatcatcgctcttccccagtgaacgcacctcggcacccacaagaaagggaggaccagttcatgcgtgacagacactgaaacctggcacacccaagcgtgacctggaccgtgtcatgccctgtccgtgaacgtctataacgacaggagaccacgctcgaggtcactcactgaggacagagacagaatctcacagccttcgctaggtctccgtatggcccgtgcaacgctcggatctacggcatccgggcaaaaagacgccaacgcaaggccgcgcacacgcgctgttgcaacgccacactcacgccctcctggcacctt

SEQ ID NO: 694361 - DNA, 179 bp, Homo sapiens
  misc_feature (66)..(66): n is a, c, g, or t
  misc_feature (80)..(80): n is a, c, g, or t
  misc_feature (149)..(149): n is a, c, g, or t
  misc_feature (163)..(163): n is a, c, g, or t
  misc_feature (175)..(175): n is a, c, g, or t
agaggatcccctgtgagattctggcccatcttctctgcccgctctcggaggaagctctctcagggngtgccttgggtttngtccacaggcatctctccatacttgttacagatgctgacaagggacacattctggaaggggaccacccngaactcgaacccangtgtggggtacncgag

SEQ ID NO: 694362 - DNA, 105 bp, Homo sapiens
ctcggctctaccttgttcggctctaccttgtctcggctctaccttgtctcggctctaccttgtctcggctctaccttgtctcggctctaccttgtctcaagattt

SEQ ID NO: 694363 - DNA, 298 bp, Homo sapiens
cctttatttaaagttccaaaaaaaatgttctcctctaaaaggaacccccatcccattaagcagatactctccattccttccttcctccagcccccagcaaccaccaatctgctttctgtctctatggatttatctattcttgctattttatataaatcgaattgtatgagaccttttgtgtctggcttctttcacttagtacaagtttttgagatttatttacatagtagcatgtatcaacacttcatttttatggccaaataaaattgtattatgtgtttatagcacaaaaaaaaaa

SEQ ID NO: 694364 - DNA, 190 bp, Homo sapiens
agggtcgtaagacactgcttttccacatcacaggcgacttaggttatcagaattaggcggagtctgacgcttggtactgtaatttttatagcttgtttaacacatttacccattccactaggtccgctgatcataggcttgtaggaagtacttcctcattcctgcattcataacaaaacagaacaccgcg

SEQ ID NO: 694365 - DNA, 515 bp, Homo sapiens
ttcataagggcgatcgtagtattcttggggtagaaaatgtagccatttcttgcagctcatgagttacaccttgatctaacgtctttacgtgtggacttgcgcttactttgtaggccttcatcaggggtttgctgaagatggcggtatataggctaagccagaggtggtgaggttgatcggggtttatcgattacagaacaggctccctctagagggatatgaagcaccgccaggtcctttgagttttaagctgtgggtcgtagtgttctggcgagcagttttgtttgatttaactgttgaggtaagggctaaggcataagtgggtatctaatcccagtttgggtctaagctattgtgtgttcagatatgttaaagccactttcgtagtctatataggtgtcaactggagttttttacaactcaggtgagttaaagctaaataggggagggggggtgtctaaaacactctttacggccggttctatagacttgggtaatcgggtgaccggggtggg

SEQ ID NO: 694366 - DNA, 185 bp, Homo sapiens
tcggtccaggttactagggttatggaacgtgaagggtgtggataggtaggggagcattcagccgtgaggggggagcattcagtcgggaggagcattcagccgtagaggagcattcagccgggaggagcattcagccgggtaggagggagcattcagtcgtggaggagatgcattcagccgggatg

SEQ ID NO: 694367 - DNA, 129 bp, Homo sapiens
ctttatcagtagaggtatggcgggcaggaggtgggatgcggtggtgatgtgctggggctgggaagcctggctttgtacaatggtggcacacactgatgtactgcattccatgctcttgtgaagcttggc

SEQ ID NO: 694368 - DNA, 102 bp, Homo sapiens
  misc_feature (48)..(48): n is a, c, g, or t
gagacagtctcgctcagttgcccaggctggagtgcagtgagccgagancctaccactgtactccagcctatgcggcagagcgagactctgtccccccccccc

SEQ ID NO: 694369 - DNA, 343 bp, Homo sapiens
  misc_feature (9)..(9): n is a, c, g, or t
  misc_feature (11)..(11): n is a, c, g, or t
  misc_feature (149)..(149): n is a, c, g, or t
agtggctgnancctcccgatttcgattacgccttcaacctggcctacggcaaaaaacacacagatgcccaacccttgttcgaagcgttgcgagcactgatcgatcaagcgacagagcaaaggctccacgccgcagagtgacgggtgtgntcacaccgccctggccgcaatcgcctccacctccaccaacgcccccggcaacggcaacgccactacttgcaacgcggtgcgcgccggtttgtttggctgttcgggcgtgccaaagaactgggtatagccgcgctgcaacccggcaaaatccagcttgccatcggtctcttcggcgccgaccagaaacacccgta

SEQ ID NO: 694370 - DNA, 340 bp, Homo sapiens
tgaggacagtgttacacagctcatttcacccttggggcaggtgcacctgggaagcctggatgggccagcagacccaatgggaccagcaggacccacgggacccacacttccatcactgccacggtgcaccagactgggccagtgggcaccaacgatgtcctctcgtcaccagtgaagcccacggtgctccgtgttttgaccatggatgttcctattttcaccaaggtggcaccatggttcaccacttcacaccatggagcacctggtgctgtcccattcacatcacatccatgacctattgttgtccccataagtgcctcttgaatgccatggaatgtcc

SEQ ID NO: 694371 - DNA, 145 bp, Homo sapiens
gaagtcgtcaagtacctgttagggggctggccgggctgggagctacagttatttgtaccagcacctggtcactggtgcaacagaaccggatgcagttgagcggtgcaaggggccaacgagtcgacgagtacaaaaccgagcttcc

SEQ ID NO: 694372 - DNA, 261 bp, Homo sapiens
  misc_feature (94)..(94): n is a, c, g, or t
  misc_feature (154)..(154): n is a, c, g, or t
  misc_feature (158)..(159): n is a, c, g, or t
gctaggaagcagcatctgggctcgctgttcgacatccactcctgagaaggctgcagcccctgccagagcatacccccctggcatgatgggattngtgatccctccagccacgatgccctcaggatgataaagagagagtctccccaaagaggcncccnntagcagctccatagacaaagtgggcatgagtacccggcaggcatggggtggtggtggcagatcagcatccagacttcataccaggagaggcagggtcccaag

SEQ ID NO: 694373 - DNA, 492 bp, Homo sapiens
tcttgttatccagtggcatgccaaaggagaactgaattagcttctgaggcttctgctgtaaatcagaagtgtatgttagtcaagagtaaacaagatgcacccagtatggtgggagggttttgctgtcagtagctcaaagtatggtgtagaaatggcctcctccctccatcctgggaagtcccagtcccatcttggtgtgagaatcaaccagggctttcctggctccacctgagaataaccaactccctctccgtaatcaggaggcccaaattgtcaccttcccaaagaaatttatattttcacggtagcctgaaggtgcaaacacatagatcgactcatttttaaataaggcacatatcacaattttttaaccaccagaaatgtcttacaaagaattaatagctcttaacaaaaatacacaccaattttatataccttcaaaaaatatttgcaacctctaaataaatataattttcttaaaataaaaaaaca

SEQ ID NO: 694374 - DNA, 171 bp, Homo sapiens
  misc_feature (33)..(33): n is a, c, g, or t
ctacccacgagtgaaaactgtcttccacagaanctgttccttgtgcacaaaggttggtgacactgctgtagagagatcacagaagcaagaatgaggcgagccttgagtttggtgagtggggagacccttgttgaactggtagggcgttagccccgggttgcatttgagctg

SEQ ID NO: 694375 - DNA, 425 bp, Homo sapiens
ccattatgggcgggggttcagaggcctactgtttttgcgtgcgaaagcctgaaccaccatccagcggggcgttttgcatcatagatacaacagctggcaaacactgtaatatgctacaatctcatctgatcccggactgagagcaaatatttgcactctaaccaaatggccaaacgctcagttgtcttacatgagaggataattagagtacttctctaatggaatcctttcctgcttttaattactggtagagacagggtcttactatgctgcccaggatggcattgaacctctggccttaatagatcctcctactgcacctgtaagtgctggaattcaggcatatccaatgtccctgtctctaattggatgttcgtaggattatagagttaatcgctggggatttgaagaccttgaggcccttc

SEQ ID NO: 694376 - DNA, 588 bp, Homo sapiens
tcccggcgggaatgcggctgtacacatgagcacaggaaggtccttgacacagtcgcgaacaaacacaaggacttgaagacacacggtttcacactggagtcctgccgaagcatgatcgcactcatggatacagatgtctctggtacggttaaccggcaggagatcgagcacctttgggacaagattaatggctggcagaatatctgcagacgctatgagacaggccagtgcggctccatcgacagctacgagatgcgaaatgcagtgaacgacgctgtattccacctcaacaaccagctctatgacatcattaccatgcggcacgcagacaaacacatgaacatcgactttgacagtttgatctgctgcttggttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggacccagcagctacacccctacag

SEQ ID NO: 694377 - DNA, 248 bp, Homo sapiens
aagtcaaggtctgcggtacatctgagtacacaatggtctttcacagaagagggagcaaagtatgacggaaagttcatagggcttcaggagtctgagagaaaggggtcaaatcctgaatacgttccttatctgtgtgatcttcagactcatcattctaatattctgaggtcagtctcctcctctataaaacaagaatcagacggggcacagcggcgtcacgccagtgcctctccgccaccggcgcccgg

SEQ ID NO: 694378 - DNA, 605 bp, Homo sapiens
agtccaacatccggtaggtcaagcatcagtactaccttttttaaaaacttccggtaatctttagggtccactcaaatatatttatacacggtccgggggtttcttttatatggtaatttaaggttacaggggcttttattttggggcagggctctggttcctctaactacatggtaagccactcaaaggccaaaatacggtgttacatatttttaacattctcccagggttggcagttggtagggactcagtaaatattggtagaataagggatgggatagcagtagatatggaagaaaaaaataagggggcatgatccttaaggtccagcagtttacaaccaatcggtggtagaaaatacaggtggaaaaaaacttggatttatgtgactggctttttttttaaatttaaagggcctcgggggatctgaaaatcataatatggagatcagtattgtagacaagaaacacagatttctcccaatagatggttaaccgattagaacagggcggcgggatagaactttcggtgattatgaaatggtcccgagccaggcgcgggggctcaggcttgtaatcccagcactgtgggaggccagatggggg

SEQ ID NO: 694379 - DNA, 160 bp, Homo sapiens
ctgatatagaggatccttatctgaactgctgatttctctctttaatgaaaaagacatgaggccggatgcggtggttcaccgctgtaatcccaacactttgggaggcgaggcaggtggattgcttaagttcaggagttcaagaccagtctgaccgcggcct

SEQ ID NO: 694380 - DNA, 731 bp, Homo sapiens
ctgtggctgggtgcgaaccccgcacggctagtggcgggggctgctcccagcttctggcggtcacggacctgccgcctcctcctactccgcatgcgtcgagcctgcccgggtccgggcgcttgtctatgggcaccagcggggatccagccaaggtcgtcgaaaccgtaattcctgggcacacatggcagctcagaaatgttgccgtgacctactttgaggagatgatttgagcgaaacaccgcattctagcctggatgacatgaacatctccgtatggctttgtgcttagactcaagaacctggagcttaagcttgctgtgagaggatcaagatgtcctgtgtgaagatgctggcggccctatcaatccatctgacataaatatgatccaaggaaactacggactccttcctgaatctgcctgctgttggacgggaacgaacggtgttgcacacggtggctacgcggtgggcagcacctgtgaccgggctgaacgccatggcagacctggcgtgattccagcaaatgctggtttaggaacctggcggaccggaggctgtgttcacgctgaggcaagctctgatcctaagttccgatgtgcacatccctcttcagagcgctgcttcctgggtgtccatccctgttactgccctaccggctgttgcatggactttcgagcaacctgcatgccagggcactctgtcttcagaatgcatccaacagcggcagtgcg

SEQ ID NO: 694381 - DNA, 1035 bp, Homo sapiens
aggtccgctccgtggtcccttctccttcgtataccttggctcgcgcttcttctcgcgcaggtgtcgctgtgtggttccctgttgtctgtgtaccccctttggagcgtgttgtgcatttcttgttgtccgcagtcgcgtcgtcccgattctgcttttgtcgtaggcgtggtctcgttgtttccgtttttgacaacccacttcccctagcccttggactgctctgtgtctacgactaatgctattcccgctaacaacttaatgaatacaggaatgccaatggtagtctaggggggctcaggcccactgcgatgtagcctggtcctgtagccatgccgcaatctcggtctctttacgctttcctagcctctagtcctgtgttactcgtaccaacggcccttttgaccgtctctcctccaactctgtccgctggcttccctcgttctctgattggcacgcatcacaattcttggcttccactgcatgactcatgcgccgagtccaatcaggcattgttggacgagactcaagctggataggctgctcctggaactgtaagcactgcaaatattggccccttcaccggttgaattgctgcaggatactcatgaacatacagttgtacccattcattgtgtctgcaccagggttaacgagtaaattacagaaaggcttccctctcccgacgccggccagagtccagctctacaacgtagtgcttcagcgctcaccagaacttcctgctgttcggtgcagacgttgtctataaatgaaggcaccaggggtgaccgggggccatgtccgagcgcaccttgttcgctagatgggctgtggggcaccggcatgcctcttccccagggatatcctctccagatcgtaaccaagagccccttgcaaacttcttcgactcagattcagaaatgatctaaacacgaggaaacatctattcattggaaaagtgccatcggtgtgtattttaagggattatgagcttctctaaagggctaaggctgcagagatatttcctccagtacgccc

SEQ ID NO: 694382 - DNA, 425 bp, Homo sapiens
ccaggacccaggtctttctctcaattatgttttactagtcatagtgttggacagtattatgcatcactgagactgcatcagagtttgcattttgtatgtttcctggccaagaagttatggttgtggctgtagtatagtcagctttctgtagcataagatttgttttcccatacttacttcacttgttatacatcactgattatttgggttaaactggactcatttcaagcagtttgcttttgttcaaatcgtgatgagaaacctaatactgtaatttgatttgagccataaaacacattttaatattagcttgtattatagttattaagcttgtttttgtggaaaaaaacttactaaaacctaggtaactctagattaggccagttcaggtgtattttgtatcttagtaatggatcatatcgtaa

SEQ ID NO: 694383 - DNA, 138 bp, Homo sapiens
cccgttcgctactgtgttcatgctctgcatattaaggttcctatacaggcaaatccgtacgcagcatctcgtaaagtggagtgcacacgttgtccggggctgggaagacgccaggcagtactttgtgcatttgcctgt

SEQ ID NO: 694384 - DNA, 322 bp, Homo sapiens
aacaggatcttctcatgctgtatcccagcactttgggagactgaggcggtggatcacctgaggttgagagttcaagaccagtctgaccaacatggggaaaccccatctctactaaaaatacaaaattagctgggcatgatggtgcatgcctgtagtcccagctactcgggaggctgaggcaggagaatcgcttgaacccgggaggcggaggtttcagtgagccgagatcgcaccattgcactccagcctgggcaacaagagtgaaactctgactcaaaaaagaaaagatgctattgaaggattgctaggtatgattggcaaa

SEQ ID NO: 694385 - DNA, 166 bp, Homo sapiens
ccggtccacctcacagtcttcctgggatacaggctggcataactcacatcgtgcgggaagtcgacaggccgggatccaaggcgaacaagaacgaggtggtagaggctgtgaccattgtagagacaccacccaatgtggttatgggcattgtgggctacgtggaaac

SEQ ID NO: 694386 - DNA, 785 bp, Homo sapiens
  misc_feature (20)..(20): n is a, c, g, or t
  misc_feature (65)..(65): n is a, c, g, or t
  misc_feature (69)..(69): n is a, c, g, or t
  misc_feature (72)..(72): n is a, c, g, or t
  misc_feature (119)..(119): n is a, c, g, or t
  misc_feature (132)..(132): n is a, c, g, or t
  misc_feature (177)..(177): n is a, c, g, or t
  misc_feature (183)..(183): n is a, c, g, or t
  misc_feature (185)..(186): n is a, c, g, or t
  misc_feature (189)..(189): n is a, c, g, or t
  misc_feature (193)..(193): n is a, c, g, or t
  misc_feature (206)..(206): n is a, c, g, or t
  misc_feature (219)..(219): n is a, c, g, or t
  misc_feature (236)..(236): n is a, c, g, or t
  misc_feature (240)..(240): n is a, c, g, or t
  misc_feature (254)..(254): n is a, c, g, or t
  misc_feature (258)..(259): n is a, c, g, or t
  misc_feature (267)..(267): n is a, c, g, or t
  misc_feature (441)..(441): n is a, c, g, or t
  misc_feature (680)..(680): n is a, c, g, or t
  misc_feature (742)..(742): n is a, c, g, or t
cttttttctcattatattcncttccccgttgtgccatccccgggccacgtcttcattggtctgcnaccnggntaacctggtctgttttttcagtggcgtgtctttttttagggtacttntttctttttggcnctctgtgttggtggaagggccagggttttctttgttttgggtgcnttgttntnngtnttgngtgtggttctttnctgcctgctgggnttttttaagatgtggtntttnggtctgtgcttttngtgnntggtgtcntgcacattttgaaatttaccaactagaatgttctcctaatggaaaaagaaaaaagaaaagttatgacagtttttgtttaagacagatgtttaaatagcactcttctttttgaccatttaaaaataatttggcagctgtaaccacctatggtcataacacataatcacttacaanagacaagcaacagatacagaattaacgatatacttttaatatttttacaaccctctttaagttggtgcctaatggcatttaacaagatttttatattcagtgaaaaagatttagaacataaactgacatgaagtaaggaatataatttctctgtgccatgcaaaagagaagtcaactttttacacatcaatcactcctaaacagttctaattaaaatccaaactgttcccatttttgcntcattgtcattctttggcaaaagatctaaatagccatgggttagggaacaactgttcactcntggtcttcattttttttttttttgcacaatacatgtgttttgt

SEQ ID NO: 694387 - DNA, 1599 bp, Homo sapiens
  misc_feature (713)..(713): n is a, c, g, or t
  misc_feature (928)..(928): n is a, c, g, or t
  misc_feature (1154)..(1154): n is a, c, g, or t
  misc_feature (1163)..(1163): n is a, c, g, or t
  misc_feature (1336)..(1336): n is a, c, g, or t
tgccgtgtctcttgctgctgtgacgttgtcgctgtggtgtctctcgtgctactctttgtggtggggtggtcgcctcttcttgtagtcggcgttcgtgatcgcctgctggtgagtttggttgttgtggctggctgtttagaggtcccatgatggcttctgctgtcatggtgcaggtgtcttatgtacgcatgggtcgtgtcacagatggtgtcttctcgcgcgccgggttgtggtgcccttctcttgtgtgttcgcgattgggtgcgtttttttccagagccaagggtcttttttcgtctgccccagtgtggtcggggccgccagttaccgctctttgtgtgtgtgctcgcggcgtttggggcgacactgtttcctgccttagggcacccctttcctcccttggtctctcacccatcctcatacccccaaccccgttgggtggctcctgtttcgcacccgacagagggggtgtttcccacgcgcccccattgtgcctcgttgtccgaagcccgcttgtgtgtgtttgtgtttgttggccctcttggtggccccgttccatcgacacctcgtggtgggggttggtgtcgccccaccgctccccttttgggggggaccacagcagtgttgtggtggtcacgcaacgtgatgagtcctcacacggatgggttgggtccgctcccacgcgtgggggggtgaacaccctttccacgagnggggcactatactttgtggggaatttctccaggaagcttatagcccccggcgttctttttcccctctgggggccctcgggggaagaagtttcttggaccgtcttttaaattcctttgttcattgtgtgaagacaaatttcgcccggccccaaggtctcgcgcctggagtgatgtgtttgaaatctctcacggttcttgtcccatttgggcccccncgggggccacagaggggttttaaaacactgctttttccgggccccctcgacactttgcgctgaccactgtctctgtgggtcctggtaaccagccgcttttcttataagccacgccgcttgttcccacggagagaggcccaccccgctcgtgtggttctcttctggggtaaaaaatgttgtgtgaccacggggtccacttccctcgttctcccctcggtaccctccnctcggtganaagtgtggggaccccctcgctcgtttctcggtgtcccccctcgtgaggcctcgttgagattgagttgccctcttgggtcccacgctaaatggcgctttccgcgagtccaccacccacggcacccgatgtgggcctctggaacgcctcttggtcacagctgttcttcacgtagnccctcggagtttgtagaatgtgactccactcccctcgctcgtgaggcactccccgggagccctctgaggagaggtttatccatagactatgagaactggccaacagtccacccccaggattaccggtccagccttattccccttccacctccccagtggaccgctcaagaagtttccagaccagccgagagctctatttttagaagaaatatgttaccctccgaaatgatgaaaccccatcttatatttaaaggccaagatga

SEQ ID NO: 694388 - DNA, 959 bp, Homo sapiens
atcattctgtctaaaaatagaatcgaatagctacactctgtacgtttattctaaagtgactaatacgattctcaggcttcgttggctcgtctcgattgagtgccgctgttgtaaccgtgggtatattacccctcagcagctgtgatttcacgtgtcctgtgataacaacgggatttgttaatgtttgttaccaactttggggatatacatcgtccagtgtctggtaacgaatctggttcctaaagcgaaacagtgtcgtttttcaacgggaacgctctgcttcttttttaaggagcccccccttttctattcccaccacactatttttatgtgggatacccccgtaattttgcccaaaaaaaaatgggtggttatatgcgaccttaacctataattatgacttccctcacaggaaaactgttcaagagactcctcgtctctgaacaaatatttccattggtcaatgggcaccaaaaatgcctccatacatgtattcgaggcaaagactccctttctgggaggatctattgtcaactaataaacaagattttaggttggtattatacaaaccgtttttccccacgccaccacggggaaccctatctaacaagagcggctttgtacgccgggagctatgacatgaggcgagggagtaacgggtagctgggatcgcagctcaatgtttacacaccaccgtcggcggaatccgccgggcgagaaggattactcgcctcgacacatgggcaatgaatatcttgtggaaaaaatacgggagaacatagactctttagggagtatgttagtaggtgattcctctagatatgaatcccactacataccactgggcgacataaatgttttctatctttatggttgcgcggagttactattcttattttttttttcccatcccaaaaacgtttgaccccagggggcccaacaaattcttcaacataaca

SEQ ID NO: 694389 - DNA, 312 bp, Homo sapiens
caggagtctatgaatacaccgcgcaaacccgaggctattcctgcgcgtagcagtagccgaactctgcgaatttgtccttccgcctcggaggaggcccgggtcagaaagctacaggaagtgacctcgtagaacacacccaaagccaggtcattcctttctgggcctaggtcattcctttctgggcctctccgcccggcctccagaggacacctgggctgtgatgccaagagcccaagaaggcgctggtgtggaatgtgcccagatgttttttttccttcggaaaacattgtgtcctgtccgcgggttattccg

SEQ ID NO: 694390 - DNA, 885 bp, Homo sapiens
atgagccaccaatcacatgcctatcatatagtaaaatccagcccagttgacccctaacaggggccctctcagtcctcctaatgacctccggcctaagccatgtgatttcacgttccactccataatcgctccgtcatactaggcctacgtaaccaacaacacgtaaccagtatagccaagtgattggcgcgatgtaagcatcgaagaaagcactattagccaagggccgaccatcacacgcacacttgctctcaatagaaggccttcggatgacgggataaattccgtactgttagtttatccctgcaggataggtattgtctctttacctgtgcgacaaggactatatttgtcttgaggccttgtttgtagacccaaacctttcgccaagcccgtaggtacacccgcattaacaccacaccaaatatcagagtacgagggtcaaaacttggggcacacgcgcgacaccgagggcgaattcaaacgcgcgacgtaaaacttcggcacccctgaggaatagggttccccccaagcgtcccgtcaaatgaacgacacaccgtcccgcacaaatcgcactgccgcgactgaaggccagctcactccgacgagcccacccggggagtccttctcacccaaactgagatcttcaacctcacgaaagatcacccatacccggccatacgccacacatcagcactccacgccagccacgggcgcacaaagtactagcacgcacaacctaccccggggcgccctccgtacatccaccaaaccccgacgcgttaccaaagcccgtccaagggagctcacgcgaccagaaggtcgtccgcggaccacccattccaccggaccggccactctaaccaggctcccacaagacccgcg

SEQ ID NO: 694391 - DNA, 228 bp, Homo sapiens
tgctgccgtcctcgtacttgtcttatcccttaagtaccctctcaactaccaggtggctactgaggtgcctgtccacccccacccccagctcaatggactggaactgggaatgggacacacaatgaatgaacgggcaccctatgttctacctacagtgcagctcaatgcatgcagtgatggaatatgcatgcatgtggggtacctgatgctacgacattctgtaataca

SEQ ID NO: 694392 - DNA, 808 bp, Homo sapiens
ggacttcggtggtggccactgtgcagaccagacttcgctcgtactcgtgcgcttcgttagttatcctaccgcaaccatgttgacaaacccgatatggctgagatcgagaactgtcgataagatcgagaacctgaagaaggacagacacgcaggagacaaatccacctgtccttcctaaagaaagacgtatggaacatggtagcacgctaactcgaggcgatatcgctaatgaggcgctgtcggccgccaaaggatggctctgtacattctcacatgcattgcctatcttatgttacttctagataggctgtctaacttggtaagatgcaaagaggtgggatcaaggttcaagatgactgtgctgccgccttttctacatcgaaagaactactgtactaactgaatggccgggcctgtgctttcccatctgtcttatctatcgtgggctggcagggaaggaaagaacttgcatgtgggtgaaggaagaagtggcggtggaagaagtggggtgggacgacagtgaaatctagagtaaaaccaagctggcccaaggtgtcctgcaggctgtaatgcagtttaatcagagctgccattttggttcctggttgcaactgatttctagcttatgcggcactggcacagatttttgttcaatggtgccgattagaccagcgtttcacacaagctccacacgtgataaaaacacaaaaacaatactagacgagtggctcccggccctggacgcccggaacacggtggattacacaacacctccctggagctcgcgcgacccccaggagtacgtgcc

SEQ ID NO: 694393 - DNA, 153 bp, Homo sapiens
cgggaagtagaccggcttgtgaggatagaccgaagctagtagggttgaccgtggctagtagggttgaccgttgtctagtgggtagaccgtggctagtagggtagagcgtagataagtgggttagaccgtagctaagagggtagaccgttgcta

SEQ ID NO: 694394 - DNA, 1284 bp, Homo sapiens
  misc_feature (1284)..(1284): n is a, c, g, or t
gagtgggcctgatcgggggcgcgtgggcggggtcggctgacgcgtcgctccgggcctcggatcccggagcgcggggaggcagacgcgactgtgagctgctatgtccccgatccctgcggccggtcgcgtggggacacaagagcccatcgggggtgcccggggattgggattggagcgcaggacactgcacgtatcgcatcgcgtctgcgcaccatggcccagtgggcacctccacaaggcaccgtgagagccacaagcgcgggaagaaccagagccgcgatgcgtcttcggactcagagcgatggagcggcatggcggtagccagtggctggcgggtccgccatgcgactgtggcgcctgggacgtgccgctggggtgccacatcctggggcatcacatgggcgcggacaagtgcccttgtcatgcattgaggacgtcgcgtcgtggcgactggcacgtgtgcatgacctacagtcgggtccaacggtcggcagcagaagccagctaagacctaacaatggggtaagcggaggaaagtggaggactccagtgggccctctcgaggagccagggctgtacaaccgtcgcggggtggacaagctgtggcagaagtggggaccaggagcgactccttcgagattccggaccgggtatctccacagggcctcaaggggcaagaagatacactataacacctggatgcgggccaatagggggcagcacgttggtgaccccttggggaagattctcgaggacacttgggacgttgccagcagggctagccaaagttgagcgacaggagtacggcaggatgagccacgggggggcacaaggaaccaaggcctttggaaccccgagggaggcaattccttttgtcatttgggccggaggagggaaactggcaggcactttggtgaggagagggagcggctcgagacccctagagaaaacgggcacctccaagtggtggaccccggagggatgggttcagggacttggggagccccgtggcctggggaggcagtagcgcctggcgaatcgcaagggggaaaaatgcccaccgacgaaggatcaacccctcaaccgaccagccacacaccggggcagagtcgccgctatgtgggagagaaaacaggaaaccacgaaaggatatagcgctacaccagcgacagccgttgcaggaagggggaagagggcccccgcgatgagcaagggggccataggaaggcgcataggaagagatgtcaacgatgcagtccgcatctgcgcactggaacagagtgn

SEQ ID NO: 694395 - DNA, 985 bp, Homo sapiens
tttgtcgaagctagaggaccggcaggcgggcagcagcaactacgtgacggacggtggcagaacccagcagtgatgtggaggtggagacccacagtgagccccgagacttcacctgagctacctcagtggtcaccaagagtggcaagataaatgaaaacccatgaggtttgtgtgctgtggaccatgtgatgcctgacctggtgacaatgctatgccaagctggtacctgttgaggcatgctgtgtggatgtgcccatgtgatgcgtggttggcatgcatggattgatgtgacatgtggtggtgcatgtggtgtatgtggcaagatgcgcgtgaggccatgcttcacgatgccatcttgtagcagaactttactatgacgagaaatgtgtgacaaagcagatggccaacgcctgctatggccgacatatactggccaactcgagaacaatggacgacgagggtgataccagacacttttggcgtgagtgagcctcgggcaaccgaggtttcaactctcatacattgcacactgcactttacctcgaaaaccaagggaagtcgtccgcccgacccacacgttgcactgttttaccaataccaaagttgtcttcccaactcggaacgcgactggcagtgattgtgcatataccagcaccgcaccatggatgaatgcctacccaccacaaacgtcattgattgccaagacacagcttagccacgacctgggccccctatggcgcaacaccgagcacgggcatgaccccgtaacgccaaacgtgacaacagggacggccatgatccccctaatcatggccggcgttacattcatcccaggcgctgaaccgccaccgccaagcgcaccaacgactcacaaaacccgaccgccgtgcaatcgggaactagaccaaagaaagaacgccagacgcaaagagacccagcgggaggcacacagcaacccgaccccacccgacaaacaaaaccaaga

SEQ ID NO: 694396 - DNA, 370 bp, Homo sapiens
tcacgtgatttgcatagtggcaggtactggcaatctgtgctcgtatgtactgcgctgctgcagtctggatccaggacacttctggtacttcttggggtggcacctgtgggctctgactttgccctggcacgggtagtccttttcactggccaggccgctgtcgttagaggacagttatgaacgcgtcccagacgaagccaacgtggacgacatccccacagcggacacaatcaaacagttcctgcacggagacgtccacaaaatcccagaaactgatgcgccacagggtctctatgttgactgccgctgacatggaccagcagcagttgcagtctttctggtccttgatgggtgagatggagccggacaa

SEQ ID NO: 694397 - DNA, 435 bp, Homo sapiens
  misc_feature (273)..(273): n is a, c, g, or t
  misc_feature (337)..(337): n is a, c, g, or t
  misc_feature (399)..(399): n is a, c, g, or t
  misc_feature (402)..(402): n is a, c, g, or t
ccgatggccttctgccacttagttaatgtgcacctggcagcttaggtggccgcggagaaagcaactttggctgcaccaaggtccggcacaagtctggagaagcttcagccagttccagctttggtatcaggatgacgctggcctcataaaatgagttagggaggattccatctctttctattgattggaataagtttcagaaggaatgggtaccaagctactccttgtacctctggtagaattcggctgcagtctgctggcctggactttttngggtgatggctggagtcagctggcaatacagaagcaggaaacattcactgaactcagaaatatntcccaaatgaagcatagaaataaagtcttcttgcctctttctcagaattgattatgttcagntcnggtgagacaccacatgctgtctagattcatctt

SEQ ID NO: 694398 - DNA, 793 bp, Homo sapiens
gacagagacgctcagagctgtgttctcaggatgaccgagtggcgagacagcaggcaccagcggggcgcacgagaccccagacatcaagctctttgggaagtggagcaccgatggatgtgcaagatcaaatgacatttccctgcatggattacattgcatgtgaaggagaagtatgccaagtacctgccctcacagtgcagggcgggtatgccgccaaatgcttccgtaaagctcagtgtcccattgttggagcgcctcacctaactccatgatgatgcacgggccgtaacaagcggcaagaagctcatgactgtgcgcatcgtctagcgtgccttcgagatcatacacctgctcacgggcgaggaaccctctgcaggtcctggtgaacgccatcatctaccggtggtccccgtggaggatctcctgcggcgcattgggcgcgccgggactgtgagacgagcgggctgtgggtgtgtcccccctgcggccgtgtgtagcctggccatcgggtctggtgtggcacaggcgctcgtggaagtctgccttccgggagacttttggaccattgctgaagttgcctggcagatgagctctctcgagtgctggccatgggctcctcgtactcctatgccaatttggaagaatgacgagctgggagcgtgtggccgaggtctaaccgctgatttcccagggtggtggccaattgactgtctggccttgggggggtccggcctaacaaagggaaatcggggcgctcttggggggccagggtttccggggggtccgttttcgc

SEQ ID NO: 694399 - DNA, 246 bp, Homo sapiens
  misc_feature (78)..(78): n is a, c, g, or t
  misc_feature (148)..(148): n is a, c, g, or t
  misc_feature (210)..(210): n is a, c, g, or t
  misc_feature (221)..(221): n is a, c, g, or t
  misc_feature (230)..(230): n is a, c, g, or t
atgtgagtccgctctgttgccaggcccattccactatttttgtaatgttattggccttttctttttgtctctcttcantttccctaatcccacttgggggaatgaggcgggggaagaattgttatttttatttctatactgattatgntactatactgtcttcaaggaaaaaattctctaggacttcctacgttttgggttttttacatngtttctgaganaaatactanaaacatacttagctga

SEQ ID NO: 694400 - DNA, 546 bp, Homo sapiens
ggcagggcctttgctatctccatgggcctggcagaacatcgcggaatccacaaaggggaatgaccctactcttgccttgactgtggcaagagctaccgctccttctccaacctttggaagcacggcaagacccatcagcagcagcatcaggcagctgtgcggcagcagttggcagaggcggaggctgccgttggcctggccgtcatggagactgctgtggaggcgctacccctggtggaagccattgagatttaccctttggccgaggttgagggggtccagatcagtggttgactttgcccgacttcctttttggcacctccattccctgttgttgaaggccctccagcatccccttaagcatttgtacaaaatgtgtcccttccttttcccatccccaccaccttgtaagttttaaattggatttattttttcgtgaggggggtgttttggggtccttgacacacataaaggtgccccccccccttcccctttttagcattggtgaccccaaaaatgaaaccatcaataaagattgagttgcca

SEQ ID NO: 694401 - DNA, 723 bp, Homo sapiens
ggcgagctgtgacgaatgcccacaagatgaaattcagtgatctcttctccctgtgcgtgaggactatgaggactcttccaccaatgccacccaatgagccggctgaaaatgcatgctctgtccaagccctcgacagtcgaaacgacatgccacacatgccccccaactgccgaacgactgagtcgtggctccagcaagtgcttcatgaatgaggaatgacatctgacaaccgaatgcctaccaaatacggaaacgacaaaccgggtcctctcgcacgcttggagctcgtgacacgatgaactcgatgtgcccctgcacttccaccattccacacaccaccggactagcgacctgacctactaccctcactattgcggtgatttccaacaggcttcaattcacgcagcgctgcagcgaaggatcgccaccggcgcaacaccacccctctgactgccatccccacaaagcctccacacgacctgctagccaccgcagcgcagctctcccatcccctctcgagctcgacagcttcttgccgcacacgcctccaccacataccacaacacccctccacccccacctctcacctacccctccctctcgccaactaccaaacacccctctcccacccatgcaccttcccccccaccgcagcaatcacagccaccatacaaaaccccgccccacacccaccacctcccataacaacacacacctaacacc

SEQ ID NO: 694402 - DNA, 110 bp, Homo sapiens
tacttttcccagggaatcatttattgtcaatagagattatctgtgtgcgtcaaatagggaattcaacaaaataaagaacgaggacaaccagttgaaatgcactggtatct

SEQ ID NO: 694403 - DNA, 520 bp, Homo sapiens
gcgtcgaccttgagctcaggagttcaagaccagcctgggcaacatagtgagaccctgtccccacaaaaaattgaaaaattaacttggcatggtgtcacgcgtgtgtagtcccagctacttgggaggctgaagtgggaggatggtgtgagcatgggagggcaaggctgcagtgagccatgatcacgccactgcactccagcctgggcaacagagtgagaccctgtctcaaaaaataaataaataaaataaaacaaagcgttgccacttagtttgctaaatacagattcctttcttcactattcatgttgaagggggaaatatttcagttataaatgtgaagagaatcccaagttgtttttgttttgtttgtctgattggtttgttttgtttgttttggtttgagaagtctcgctgatgtcacccgggcggacaagtctcgactcctgatctccagagtgcgggattaaaggcgtgcacctgtgctccgccgaggatccaagttttttgaaagtttatcttg

SEQ ID NO: 694404 - DNA, 129 bp, Homo sapiens
aaggcgcagtgcacagatttcgagctctgaattcgcggcgcattacgcgtatcgatgcgcagtgaggggcgcaatcatccaggccatatatccgagtatagtagccgtaacgtacaacggtactctaaa

SEQ ID NO: 694405 - DNA, 346 bp, Homo sapiens
aaggacctatgacctggttagcacctgcaccaaggcctggtggcgatgccgaacaacgacacgcccagcacatgggcatgcgtgcggcgtgcagccagcgcattggcgacgttatggttacccagcaggttcagctgtacgtgctcgtcaccttgcggggtatgcagggtgaaggacgggcaaccacgggcgtcggccttgatattcgaggcatggaaatcggcagcggcgtttgtgcaaccgcgaagctcaagaccttgcgaccggcggcacgtacacgccaggtttcgaaggccttgtcgtcgaggttcagcacggcagtgccggatgcgtcgaggccttcgat

SEQ ID NO: 694406 - DNA, 956 bp, Homo sapiens
  misc_feature (42)..(42): n is a, c, g, or t
  misc_feature (134)..(134): n is a, c, g, or t
  misc_feature (141)..(141): n is a, c, g, or t
  misc_feature (224)..(224): n is a, c, g, or t
  misc_feature (313)..(313): n is a, c, g, or t
  misc_feature (327)..(327): n is a, c, g, or t
  misc_feature (379)..(379): n is a, c, g, or t
  misc_feature (502)..(502): n is a, c, g, or t
  misc_feature (516)..(516): n is a, c, g, or t
  misc_feature (546)..(546): n is a, c, g, or t
  misc_feature (596)..(596): n is a, c, g, or t
  misc_feature (620)..(620): n is a, c, g, or t
  misc_feature (649)..(649): n is a, c, g, or t
  misc_feature (663)..(663): n is a, c, g, or t
  misc_feature (700)..(700): n is a, c, g, or t
  misc_feature (731)..(731): n is a, c, g, or t
  misc_feature (756)..(756): n is a, c, g, or t
  misc_feature (791)..(791): n is a, c, g, or t
  misc_feature (810)..(810): n is a, c, g, or t
  misc_feature (870)..(870): n is a, c, g, or t
  misc_feature (874)..(874): n is a, c, g, or t
  misc_feature (882)..(882): n is a, c, g, or t
  misc_feature (923)..(923): n is a, c, g, or t
cctgtctctctgggacagagcctaaaagatgatgttcatgtnttgtgtgaatgaaactcaaacactcttcagtttttagagtaattttctggtatcgagcgaccacaccgaggagcacaccctgcttccaaggntgcggcnttctgcacacagtgggggatccccacccaccctggctcccctcaagggctgcgtgcacagtgcccgctttccagtaacctganccaccctgagttcctattccattttgctcggggaagaaaaaagaaatgccctgtggctcagctctgccactactcagaacaccagcttnagcttccctatgtnccccagattcagcagcccagcagggattgggggaaatgctcccacatcaggngggtggtggcctggtccctgcagattggactggcttttcagccatctccaggaagcaacaactagcagaaaactgttccttaaccccaagggtgatgcacacttctcccctggtctttctgcnccccgatgcccctncatttacacagcagttcgcagacccttgcngcaacctgcttgtgttgctgagcctgctgtgggagcgcctaaactgagtncgcgtgtccgctccaaaggcagcnggcttgaattctgtgggaacgtgcccttnaccctttgccagcngttgctggggagttttttcggcccctttctcagactnaccacctaccttcaacctgcgcagaacaatnagcgttctgaccacttgctagaganggctttaggccgaccactccatcctcactgcaggncttcattccttctggcttncatcactgcatggccccctaagaggtccccctcctggcccttgttactgttccttaaganagcnactccgcnctaagcttttggaggccagggacaaagtttcgttcactgtnctttccgctgcatgagttcagtttctgggcagg

SEQ ID NO: 694407 - DNA, 103 bp, Homo sapiens
aggtacgaggagggcgtgggatactggtgattggagcttggggttcaaggagcagttgggcaacgaaacatgagagagagagcgagtcaagagttctcagaga

SEQ ID NO: 694408 - DNA, 322 bp, Homo sapiens
ggcgggggggggaaaaaagggggcctttcccccccccccccccccttggggttttgggggtccaggtcccccccccccccggggggccccccccccggggccccttttttttttttttttttttttgggggggggcccagggaaaaaccccccccgggggggggggttttggggggggggggggtttttttttttttttaaaattttgggaagggggggtcccccccccttttttccccttttggggctttttttcccccttttgggggaaatttttttgggggggggcctttttttttttctttttaccccggccccccca

SEQ ID NO: 694409 - DNA, 95 bp, Homo sapiens
  misc_feature (33)..(33): n is a, c, g, or t
  misc_feature (53)..(53): n is a, c, g, or t
caagtttaaaggaattctctgaaaaagttatanaattattctaggaaacatanccataatagtgttttaagggactttcacctggggattttata

SEQ ID NO: 694410 - DNA, 656 bp, Homo sapiens
tcgggagacgtgcgccttgagctatttcggtttcctgtggctacgagagcgggtccttggcgggcgtgaggcgcctagccggatgtgctcatgccagatggcatcgtctctgctggctaagcctcacttgccgctccgcccgggtgctctctagagcccggtttatcgagtggcagtctccagggactgccgacatacaagcaagcgtatgtggagaagcgtgctagccgcggtccctacaggacgaacgaaccgtccacggtgaatgtccagtgagacgacagtcaccgagggggctgccaaaatcgcctttcccagtgccaacgaggtcttttataacccggtgcaggaattcaagtcgggacctgacatgtgctgtgatcaccgagatttagctgcgcattcagcttggggccaaaggagtccagatcaaggttccaggagagaaggacacgcaagaaatgtggtcgtggacttgtcatgagcacgaggcggacgaggttgagctgaaagacagtgaaaacctggtcctcacgtgagaccaacctcgcgacagcggccgttgggggacatctgtgaggaaggcctgctgtgtgctggaagtgcctggagcttcaggcctacgttccattcgattagccctagacgtgctgggc

SEQ ID NO: 694411 - DNA, 102 bp, Homo sapiens
  misc_feature (72)..(72): n is a, c, g, or t
ggatttgctggtgcagtacaactaggcttaatagggacatgtctcaattctttgtatatgcattcttttcangatgtattaaacaaacaaaaacccttcaca

SEQ ID NO: 694412 - DNA, 606 bp, Homo sapiens
  misc_feature (293)..(293): n is a, c, g, or t
  misc_feature (295)..(296): n is a, c, g, or t
  misc_feature (559)..(559): n is a, c, g, or t
  misc_feature (603)..(603): n is a, c, g, or t
gaacatctggctttcaagggaacaaagaatcggcctggcaatgccttagagaaggaggtagagagtattggggctcatcttaatgcctacagcactcgagagcacactgcttacctcatcaaggcactgtccaaggacctgccaaaagttgtggagctcctggcagatatcgtgcagaacagtagtctggaagactcacagatcgagaaggaacgagatgtgatcctgcgggagatgcaggaaaatgacgcctccatgcagaacgtggtctttgattacctgcatgcgacacntnnccaagggcacacctctagcccaggctgtggaggggcccagtgagaacgtcaggaggctgtcgcgcacagacttgactgactacctcaacagacattacaaagccccccggatggtgctggctgcagctggaggtgtggaacaccaagcaagctgctggaccttgcccagaaacacttgagcagtgtctcccgagtgtatgaagaagatgcccgtgcctggtctcaattccatgtcgcttcactgggcagttgagattccggcnatcgggatgacgcccctgcctttgggccacgttggccattttgnaaa

SEQ ID NO: 694413 - DNA, 1112 bp, Homo sapiens
aggagggagatctacgcgaaggagccagtgcagtggtggcagtggaggccactgtgatccagagtcccctcaccccatttccttcccacagtgtccctgtgccaaatgatttattatctcttgacaaccaaggtgcctccgatctggatttccaaggacgaatttcctctgaagcaccgtgaacttgctactaccagcaccatgcccataccgaatatccgagccactgaaccctggagcagaagaaggagctgtctgcacatctgctcaccggcatcgtggcaccttggcaggggcatcctggctgcagatgagtccacatggtgagcattgccaagcggctgcagtccattggcaccgagaacaccagaggagaaccggcgcttctacctgccagctgctgctgacagctgacgacctgcgtgaaccccatgccatgggggtgtcatccatcttccatgagacactctaccagaaggcggatgatgggcgtcccttcccccacgtcatcgaatccacggagcggtgtacgtgggcatccaggtacgacaagggacgtggatccaccctggcagggcaccacatggagagactaccacccaacagggttggatgcgactgactgaagcgcatgtgacccaagtacaacgacggcacgcgacgcttgacttcagcccactggccgatcgtgcgcctgaccgattcgggcacacacacacccctcacgccatcgaccctcattgcacacatgccaatgtactggccccctactccacgttatgaccacgcccactgcgcctcgcgcccaccacgcgccacctgacaccccacccagatgcgcgaccacagaccgagacgggcacgcagacatgggcaaccgagaacagccagccggacggcgacagaacaccggcacgtgagtagcaccagaaaccgaacaagagaacccaccgtgcgtcaagccgagactgggaaccacggaccgaggagtgagacacaacgaaaaccacgaaacgaacagcacagaagcccagccagcaccacgcaccaaataccccccactgacgtcaacccgaccgacggccgaccaccaacacggcgcaacagccgag

SEQ ID NO: 694414 - DNA, 175 bp, Homo sapiens
tggtcgtagcatgcagggcgaggaggttgggccacgaagtagccggccggggacatgaacgcgtggccgcaacgtcctggtcgttggtagaagaggacatagtctgtcttggactccatctgattctcatatactggtaatacacttttatcatctaagtatttccacttgccgt

SEQ ID NO: 694415 - DNA, 350 bp, Homo sapiens
taaaaaaaggtatttattaattcttttttttttttttttttttggggaagggggaaggcacttttggtttttgggcatggtggggggggaaaaaataaaaactaagttggggagaggaagggccccttaccaaaaaaaaaaaaaaaaaaaaactggggttttccccctggggtttataaggggggggggaaatccttttggggggtttgggtttggttattgggacccgtttattcgccagccaataaaaggggggggggggggggacctttgaaattttgcccttggtagaaaatggttaaaaaaatactttttttgtttttttttggaaaaggaaaaataaaagaaat

SEQ ID NO: 694416 - DNA, 194 bp, Homo sapiens
ttattggaaatcagaggctcaaaaagtaaacgaaggctgatggcacgcctggggataggcctggaaacgaggtgaagtggctgaggtgctatgaggagtcccctagcgccggtcttcgttcagagaacatgcccctggcccctgcgcacggatggagtcctatggcggcgtcatatgggtgctccttggtcgtg

SEQ ID NO: 694417 - DNA, 102 bp, Homo sapiens
tgatgactgcgtaagccttagactaaagcctttgagcatggtaagagatgatttctctcctgggagcagttctcatcctgggagcaattctcatcctgggag

SEQ ID NO: 694418 - DNA, 153 bp, Homo sapiens
tacataagatgctctccctctgcgggcctcttattgctcctgctcctctgactccgccgccgactgagtcgctcttgctactcttcatcgccaatcgcctcgtgtcgcgcgatctctccgcccatgcagcttcaaggcgcagtgcttatgtct

SEQ ID NO: 694419 - DNA, 547 bp, Homo sapiens
cactcacgaggtagtataacagaggcaagacatgtcatggactacaaaccaacaggcttgttcatcaccagccatgggagcaaggaaagggaaaggctccaagaaccactcttgtcattgtggccattaggtaaatagagctccaccactcactcacaacaggaatgctagtggagagaaagccacacactcagttctggacatgtcgagctttagctgtctgggatacaggagggtggagatctagaggatgagatggagggctgggctgctgatgccaatttagagatgtctgccatggccatgagtggtctcaatcaggaaggacagaatgagatgcgaagaagatctccagctgagcctggaggaattctacccccagttgtgtaaggaggaataaactggctaagaaaacagaagaacagtcagaatggtaagaggaaaaccaaaggagaataacattttgtaccctagaaaaatgtatttcaagaaggatggagtgttcaacagtttagaagagagccagagataatgagactgagccgtg

SEQ ID NO: 694420 - DNA, 3267 bp, Homo sapiens
gccaaaggcacggagggagagacagcaagtgcctttccaagccttggtggacaccacacctgcagctctccccttggccacagcaagtcacgtggctgggctcagcattaaggggtgggggacaggcctgccactttattgtccgctctgcacagtcgggtggcagtaggctgagaatttggagggctaaacaactgggactctggagagtctgtgtcctaataatgcctgctttggagcactccttccccacccgcctgctccaggggaatagcgtccctggtcctagcatttcactagatacctcgtgcctttgaaccgctgtgtttgggagggaggaagaggatagacaggtccagggctcccctcacttgggaaggtcctagtagaaggcattccttctgagtctcctggccctacagcttctcacccctgctgctccccaagacctgacccggaccaatcagctgcatctctgcaccaagtgccacccccaccgtgcactgctcgcacctcacgctccccatgggctggcccggaccccagtgaggtctgcacctctcggaccagccaggacctcggaagccatgacctgggtgttcagggcttggcggaggagacgctgctccgcgggggatggagaagccccgcccctccacaactcccttaatctggatgcaattagaggaaaccagccaaaaaccccgcggcagctgttgccccgggattattcccagccagcgagaggcattagggcgataattcagtcattagacttctagccttcccaccgccagaacgtgcaaataggggataatcagccctgcacggccatcctcagcaatgctgcttatttaacccattttttaaaatgacacttaatgttattggctggcgtacgtgtgtgcgcatacttaaaagttgatgcgtggtgcagctctgctgctaatgtctgctgacagcgtcgcccgatgttgctcagggcctctgggaagaggggacacctttgatgtgggcgtgctggcacccaagaggcagcgtggtcaggctcgatgcttgccagccctggaaggtcccgccagggttggggggtcgggtgagcactcagagatctggggaggaagcgaggagcctggtgtcctcaccaggtgcagaggggaaatgcgtactgctccagaaggttctgactcaagtctcggccctgaggactcagaactcacaagtcatggatcaagtacagagggagggagggccccagcccacccctgcgggggaggaggagggtctgaaggtgggagggcagctccatgagcagccactgttcctgaccagccgaagtgccaggcagggggaggtttccatgtccaggagggagaggacctccaccctctgacctttcagttttccatagcagcccagtgtgaagctcggcgggggtgggcagggcatcaggacaagatgaagatgctggctctggaatgaggactccccttgggctaaggggtagtggctggcagaggttgcccagctcttttggaggccacagggaatagaggtggggtggcaacaggaaatagggtgtgggctgtagaccatagtgggtggggtggtgcttccgttcctgtgaggcccgcccccctgagccccctcgtctgcttcttgtttggcagaaatagatgtggggcacagcccctagatgatgggaatctgcccacgctgtgccctctggggaatgaaatcttgctcctcgtgcagcctcccctttcccttgcggggtgggggctgggggtgccaaggctccacccttggagggggttgctgggggtgccaaggctccaccctttgctcgctgggcagagggaaggaagcacctccctgtatgctctgcaggggcccctgcaggccactttgcctcagaggaaggaggagaggtcccctgggaaaatgcacacacacacacaacacacacacacacgcacacacgcacatgcacacacgcacgcatgcacacacacacacacaacatatgtgcaggggtgcagcctaagtcagtggagccaggactggctgcgcagctgggcctgccccattcttggagtccccagggaatgagcctcaggatccacttcgtcccttgtttctaagccaggctgcacggccgttcctgggtgtgaaagcattctgtcctgtctccagtcagagggaaccgcccccaaactagaaagctaatttcccccgaaggttcatgaagccagaggcatgcccttgggggttggtcgggagaagggtgagaggcagtgctgtggaaggggcctggcccctgctgcctgcgattctccccgggtatgtggccttctgcctccttcagcctcagtttcctcgcctgtaacatgagaacaatgatgcctgcctgcccaggccacctcctgggactgcagtggggactctaagtgtaaaactgtcatgaggatggtttatgaagtcccagggaccacacctgccactcagggaagagaccgctgacctcagccatcagccatgtgcatcgtgaggggcagcgagctcaggacggagagctctcccttggttcggagtcagcacacctgcactcccacacgcccacccagctgtgtgtcctccgccgagggtgagcctctctgtgactcttctgtaaaatgcaccccattctgcccactcctgccacgagacccatcctctgcgatcccgccaggcatgtgtgtgtgaatgcatgtgcaaagctctccatcagaagggtggtgtgggccctgcaggtcctacccctcggccttgaagctccctcgggctgcggactctgcctcctgggtctgagcattagaaccaggagaggggtgtccctgggcagagccaggggtgcaaacagcctgcagccatctggccttttaagtatagtgtgtcgcatttccgggtaggaaggtagcatttcaagttcaaagagaggtcaagtcatgcaaccatctttcctccagcacttttggggtaaggaggacagtttttgttatggtttaggggaaattttcatgaaattttcaccattaccaatagattactgatgtccatggcaagtgatctgttcttggtattttgttttgttttgttttggtttttaaatgtaatcacccattggtcaggcccaggactggtcaccatgagctctgctagccacggccccaacgatgcttccggctctcatggattccacagcaaataaaactgtgctgacaacag

SEQ ID NO: 694421 - DNA, 2454 bp, Homo sapiens
  misc_feature (2416)..(2416): n is a, c, g, or t
gccaaaggcacggagggagagacagcaagtgcctttccaagccttggtggacaccacacctgcagctctccccttggccacagcaagtcacgtggctgggctcagcattaaggggtgggggacaggcctgccactttattgtccgctctgcacagtcgggtggcagtaggctgagaatttggagggctaaacaactgggactctggagagtctgtgtcctaataatgcctgctttggagcactccttccccacccgcctgctccaggggaatagcgtccctggtcctagcatttcactagatacctcgtgcctttgaaccgctgtgtttgggagggaggaagaggatagacaggtccagggctcccctcacttgggaaggtcctagtagaaggcattccttctgagtctcctggccctacagcttctcacccctgctgctccccaagacctgacccggaccaatcagctgcatctctgcaccaagtgccacccccaccgtgcactgctcgcacctcacgctccccatgggctggcccggaccccagtgaggtctgcacctctcggaccagccaggacctcggaagccatgacctgggtgttcagggcttggcggaggagacgctgctccgcgggggatggagaagccccgcccctccacaactcccttaatctggatgcaattagaggaaaccagccaaaaaccccgcggcagctgttgccccgggattattcccagccagcgagaggcattagggcgataattcagtcattagacttctagccttcccaccgccagaacgtgcaaataggggataatcagccctgcacggccatcctcagcaatgctgcttatttaacccattttttaaaatgacacttaatgttattggctggcgtacgtgtgtgcgcatacttaaaagttgatgcgtggtgcagctctgctgctaatgtctgctgacagcgtcgcccgatgttgctcagggcctctgggaagaggggacacctttgatgtgggcgtgctggcacccaagaggcagcgtggtcaggctcgatgcttgccagccctggaaggtcccgccagggttggggggtcgggtgagcactcagagatctggggaggaagcgaggagcctggtgtcctcaccaggtgcagaggggaaatgcgtactgctccagaaggttctgactcaagtctcggccctgaggactcagaactcacaagtcatggatcaagtacagagggagggagggccccagcccacccctgcgggggaggaggagggtctgaaggtgggagggcagctccatgagcagccactgttcctgaccagccgaagtgccaggcagggggaggtttccatgtccaggagggagaggacctccaccctctgacctttcagttttccatagcagcccagtgtgaagctcggcgggggtgggcagggcatcaggacaagatgaagatgctggctctggaatgaggactccccttgggctaaggggtagtggctggcagaggttgcccagctcttttggaggccacagggaatagaggtggggtggcaacaggaaatagggtgtgggctgtagaccatagtgggtggggtggtgcttccgttcctgtgaggcccgcccccctgagccccctcgtctgcttcttgtttggcagaaatagatgtggggcacagcccctagatgatgggaatctgcccacgctgtgccctctggggaatgaaatcttgctcctcgtgcagcctcccctttcccttgcggggtgggggctgggggtgccaaggctccacccttggagggggttgctgggggtgccaaggctccaccctttgctcgctgggcagagggaaggaagcacctccctgtatgctctgcaggggcccctgcaggccactttgcctcagaggaaggaggagaggtcccctgggaaaatgcacacacacacacaacacacacacacacgcacacacgcacatgcacacacgcacgcatgcacacacacacacacaacatatgtgcaggggtgcagcctaagtcagtggagccaggactggctgcgcagctgggcctgccccattcttggagtccccagggaatgagcctcaggatccacttcgtcccttgtttctaagccaggctgcacggccgttcctgggtgtgaaagcattctgtcctgtctccagtcagagggaaccgcccccaaactaggcctcagaaggtgaggctccgaagccacctgccgcataggcctgacagtggaggaaatagcggggaggtggtgctgagaaaggttgcggaacgtttattattattatttcttggcacacagccttgtgctgcccatgttgctaggcctgggttggagaaaaggcaaatgcaagtacagcactttcgagaagggcntttatatgtgcacagaacatagagaatgtgcacccgaa

SEQ ID NO: 694422 - DNA, 170 bp, Homo sapiens
gcggttgttctctggagcagcgttctttatctcgtccgccttctctctacctaagtgcggttccgcacccgatgggaaggattcggatggacatggacatgaggcccccttagggccccaggaactatcttttcggggtgttgtaacttaagggcgacaaaggtattatc

SEQ ID NO: 694423 - DNA, 109 bp, Homo sapiens
aaggttgaaagggcccccggggttttaaggaaaaaagggggtttccccttttttttttttccaaacccccccccgggtggttttaaaaaaacggcccttggggccccca

SEQ ID NO: 694424 - DNA, 297 bp, Homo sapiens
atccttcctcttttacgttgcaggaattgtcttatttaattaatccatcagcctctcatagcaaatatttgagaaaacaaatgtttttcagattctattttcagtagggaagtaaaaagatgcagctcagtgcgcataaagttgagacacagatggggacatccacccccccctctttggaacaaaaaaaatgactgggggggaaacacaggtcaccatgggaacaggggggacacaggacacacagggggggggtgtctccacctcctcacattttgctaacaggagcgcagacac

SEQ ID NO: 694425 - DNA, 357 bp, Homo sapiens
gagctggaccccgcaactgcttgggatgtagtagttttcgtaattcgcagggatcaatgatgggcactgaccaggcttgattcttacacacatatgcatgggccgtgctttccaaccgtccgagggtactcacgaaaggcagctggcgggacaagaagctcctggggtccccctcatccacaatcatcaccttgttaggaatgttgacaaagtggacgccctgctccacggccttggtgtccttggcctgacggcctccacaaatcacaacctgcttgagggtgtgctgctgggctgatagggcgcggaccatcttgggcaacgccaccgggacaccacgcatgctctcgtaaaagg

SEQ ID NO: 694426 - DNA, 303 bp, Homo sapiens
  misc_feature (242)..(242): n is a, c, g, or t
gtgacaacggctgcatctgggacctcaagttctgccccagtggagcatgggaacttccaggcacccctcggaaggcttcctcttctgccccggttgggtctcttggctctggccttctcagacgggaaagtacttctattcagtctaccccatccggaggcccttcttgctcagcaacccccagatgcagttaagcctgccatatataaggtacaatgtgttgcaactcttcaggggggggnctatttcaagctacagagccctctgagtgttggtgagtgtctctgtctcggctctgatgtc

SEQ ID NO: 694427 - DNA, 104 bp, Homo sapiens
taatctatgaggatcccccggtgctgccttatgatgagtcgagcgggcttatcgcccgagctggtgagcaacctggcatcgctgctgatgcagcattaatctct

SEQ ID NO: 694428 - DNA, 142 bp, Homo sapiens
cttgataattgagctatgagcatcctgtaagaggctaggtctactagcggctatatgcacatttgtccgctatacaagaagtttactcattccccgtatccccgttttctcactagaaggttagctttttttgtaagttttt

SEQ ID NO: 694429 - DNA, 448 bp, Homo sapiens
gactccttaagtgttaaataatgtagaagtaaaaaaatttttttaaaaggcttaattggggaggggggacttatttctgtttacggtgtattaccttccttccctcctcttctccccccaaacccaacaaaatacagttgggaattcactgaaacagtaccagcaagtcatgagattttttagtaaagatgagaaagatggttgaagaaaattagtgcataatttctcagtgaataaagtggtagctctcatatactaaatagacaagtttacatgctggtaatttagaaaatggactaaaattattcaaaaaccggttgttggtggtttaactcctgggtctttaaggcttcattaccaatgtttcaaagagttctaatggtacacggtgggtttaaatttttcttttaaggggatagttggtaatagtaagaactgtcccatatgt

SEQ ID NO: 694430 - DNA, 106 bp, Homo sapiens
ggcagatggctgtgggttacgtgctgtggtgacgtgctgtgatcgtgatcctttatttgcactgtatgagaattttcacactaacaagagtcgagggactcaacac

SEQ ID NO: 694431 - DNA, 253 bp, Homo sapiens
agaaaaatacaggtctacttcactcagaattcttcagatttttacacaacctaccagggtggagtggggagactggggggcaggcagccgcaggagtagggctggtggagaggggctatgcttctgtctccacctgagactggctccctgccgtagtagctcttctgctcctaccttacatctactgtagtacagtgggatggtctcctgaggaagcctctgtcacttgagacttgcacataatgccaagggt

SEQ ID NO: 694432 - DNA, 769 bp, Homo sapiens
gacaacacagctaacacaaggccccgcaggcaaggactctgggacagacgcaggcagctgcccagagcccagaccaagcatggacgccgtgatgccaccatggagaaactccgggcacagtgcctgtcccgcgtgccctcgggcatccaggctctgccaggtttttccgccaactagacggggacgggagcagatccctgacgctgatgagttccggcaggtctgcccaaaactcgggctgtgctgaccaggcggaggcagaggggtgtgtgcaggaagtgggaccgcaatggcagcgggacgctgaactctggaggagtccttgcggccgctgggggcccccatgtcccaggccgggaggtgtcatcgcagctggatttgtgccagctgacccgcagtggggacggcgtcgtgcggggtggacgacctcgcggggtgtgtacaggtggctgtgcccaccccaggtttgccgcatgtgggatgtgacgcgcgaccgaaggttggtggcgccgtttccttgacaaccttcgacttccttctggaagaggacggggcacgggtcaccactggccggaatttccgaggcctacctacccgggcgtgagtgcctccatgaaccccggatgcggagtcgtgcccatgattgaccatgtgcctggcagctgtgagcagtccggtcaaccctgtgcctgtgctgtatccccaccctggggaagcctccttctggcccttttatctgtgggcaccccccagctggggcgtggggacg

SEQ ID NO: 694433 - DNA, 129 bp, Homo sapiens
  misc_feature (24)..(24): n is a, c, g, or t
  misc_feature (67)..(67): n is a, c, g, or t
  misc_feature (85)..(85): n is a, c, g, or t
  misc_feature (129)..(129): n is a, c, g, or t
cgaggatccggatgtgtgctccgnggaccggaacatctcggccagctaccccgcggcgcacagcctncagacgacttggggccancttctacccggagctgaagccctacagctcccgggaccccgaan

SEQ ID NO: 694434 - DNA, 208 bp, Homo sapiens
  misc_feature (64)..(64): n is a, c, g, or t
  misc_feature (115)..(115): n is a, c, g, or t
  misc_feature (125)..(125): n is a, c, g, or t
  misc_feature (144)..(144): n is a, c, g, or t
  misc_feature (151)..(151): n is a, c, g, or t
  misc_feature (153)..(153): n is a, c, g, or t
  misc_feature (165)..(165): n is a, c, g, or t
  misc_feature (168)..(168): n is a, c, g, or t
  misc_feature (177)..(177): n is a, c, g, or t
tacacttaggaaaattcaacttaacttgaccgctctgagctaaacctagccccaaacccacatncaccattactaccagacaaccgttagccaaaccaatttacccaaataaagntataggcgantagaaacttgaaaccttgngcaatanantatagtacccgnaangggaagatnaaaaatcataaccaagcatattatagcaagg

SEQ ID NO: 694435 - DNA, 800 bp, Homo sapiens
  misc_feature (244)..(244): n is a, c, g, or t
  misc_feature (608)..(608): n is a, c, g, or t
  misc_feature (625)..(625): n is a, c, g, or t
tcaagctttttgaccacgctatggtccggcggcccatcggtctggaacaggctgggctttgtacaactaacaagagtttgaaagaagcatatattccaaaaggaacagaagtattcattcctggacgaaaccccaagaactccctctggtttctcagaagtctaattccgagcaacacttcaaacaggggaggagaacacaacacgaaaatctcaaactaagaagctgcgtccggaatcttccntgtgatgtgtcaattcaaggtcgctgggctggaggcgccgtggcaagttccctcacaggaggtggtcattcggccaaacaggcctgggtggtaacgggcggccctctgtaacacggcaaacggtctaatgaaaccttcctataaaggaacctaagagagacaagggcactccacaagcggctgaatgagggacgggctgggaagaatgggcaaggccccgggaactggggcagaatctctcaaaggcagaacctaacaggcaaggttcgaacaccaaaactcaccagccaacgaatgaacgcaactaactccaagaaactaaccgggctggctctaactggcttcacggggagcctggagccantggtccgaagaaccttncctggggccttcgctggaagttggccggtcctggtggaagggcaagctgtggggcttctaagctgagccggggtgtgcgattcctgttgtaaccttccccaagaggcttcaccttgggcctgggaagttgtgcactccaattgggcaacaagactgggcccttttcgttggttcc

SEQ ID NO: 694436 - DNA, 1255 bp, Homo sapiens
tgatctgaagtggaattgaaccagcctaaatatgccattagagttaattaggtgacttgctgatcatattgtaccgtgtgtgactatggccctgggaaccaagttgaagaaataacgaaatctcctctgagatgatgtagtagcatttctgctcgggccatgctcttgtcatactttatataacgctcaggattagatacctgcacgtacttgtaaattaagttttagggttacataattcctgtaagagactgctccaagcaatcatactaccttcgttgtacaattttctactcacttgcgaatgacagagatgagacagacgaatgtggtgcctcatggttaatcgaaaaagtccaaggcgaagtacgtccttatccgacatgttcggcaactactgatatgtccaatcctgaaagcggtgtgtaattagggagaatgaaagaatacaaaatttagtgataatgcgtactatggacttactgtatatgcatggaaatgaacagtaacatttgtcagggtttatcacttacacaatacgtagtatccgtgggacctttggttgaaagtcattaataggacaggcaatccccctgatggtgttaagatgttctctgtacatgaggatgatcatgtgggtagggtcgcttgagatgttgtacttggccctaaaactggacgtccgatagccactagccacacttgacatgtactttgagttactctgggaaggaggtcaactaatatacgtgatatacttccttgatgtgaaaattcgaagatttacttgactaggcgccgcatgaaagggggttgtgatctaaacaagtggcgtgaacgaaaaggcccttgtaaaagaagatagtctttggtagttgacccaattctgcgcggtttgaaggggtaaacattgttaaagttcaatcgtacgccaaggaaggcggggaccacccatgtggacaaaaatgggggaaccaggttccccaacgtggagtaaacacagtgtctccaggggaaggagcaaacacacttatgaggcggaacctcttaggggcccggaaccttgtgacacttgacgttcatacagagcgttccttataggtgtccttgtgttgcaacgtgccttttcttgccaactggctacttagttccagagaacaggcaagacaacagttggcttggatgttggagacatattatcggccgtcgtagatcagatcaaagagtgtgtggtaatttacacagcaaatctccc

SEQ ID NO: 694437 - DNA, 225 bp, Homo sapiens
  misc_feature (119)..(119): n is a, c, g, or t
  misc_feature (143)..(143): n is a, c, g, or t
  misc_feature (146)..(146): n is a, c, g, or t
  misc_feature (184)..(184): n is a, c, g, or t
gtttttagagattcagtgaggccagttttcttttctcactgtaatcatagggattggttcattaggtaaataagaaatgaattaaaaattaaaacagaaaaggactccaaaaacaaaancaacaaaacaaaattcatttatcnctncttagatttcagcaataaaggtatatccagttgacctnccatctaaaatctgaaatctgaatgctccaaatccaaactt

SEQ ID NO: 694438 - DNA, 720 bp, Homo sapiens
agcgggttctccatcaccactgtgatggcatccgcttccgtgactgtcactgtgcaccctccgcctgtcctgggcccacgcaggacccccaagcggggctctgcacaggccaggagggctacccagggactgaccacgggttgttcatgggtcctcacctgcttttccaggtccaggtgagaggacgaatttgaaggtagaagtcacagagttgcaggatgtggagtgcgaggagtggccccggggaagcagctccaactgagggtgattaaaatctgaagcaggccgggcgcagtggctcacatctgtaatcccagcacttttggaggccgaggcaggtggatcacctgacgtcaggagttcgagaccagcctgggcaacatggtgaaaccccgtctctgctaaaaatacaaagttagccaggcatgatggcgagcgcctgtaatcccagctactagggaggctgaggcacgagaatcgcttgaacctgggagggggaggttgcagtcacctgagattggaccattgcactccagcctgggcaacaagagcgaaactccatccttcagaaaacagaccatcctatcaactccaccactgctctactctaccggaggcgtccaacatccggaaaccccttgccccttcaccgtttccagcaccggcctgggatatgaaccggctccgaataccggtcaacgttgccttggcccaggattc

SEQ ID NO: 694439 - DNA, 403 bp, Homo sapiens
atacagtaattagaactcgagcgtggtaccatcgtataaggcctaagagtacctgctaacagtgtcatccaagtgttttcatgaggtcggagccgccgctcatgtttcgctatctctgagctgtccctcgtgccctgtgtgagattgttctcgctaagagggggctcaagatggtgcggcctgagtgtgcggccggcgggatatgggatacacccgtagggtgggcggggtgtgtcccacggcctaattccatctttccagcgatgacacgagagtgcccttgtgaggctggcctccttgggcgcttgtccccagcggaccgcgcgtcgtgagccacgatgctccccataccccacccattcccgatacaccttacttactgtgtgttggcccttatcgaggg

SEQ ID NO: 694440 - DNA, 253 bp, Homo sapiens
  misc_feature (151)..(151): n is a, c, g, or t
  misc_feature (187)..(187): n is a, c, g, or t
  misc_feature (190)..(190): n is a, c, g, or t
tcataatatgtcaatggcgtatcaatgacgtgaaagaccgacttcacagctggttggtagtctgtggtctctaacattactctcatgcgaattcagaatttaagctttataagcaactcggaacataagacactaattccatcttgaaaanctgtaaaaagaagcgtaggctctgtccacgaccaanccnagcctatgcctaattccaggttgaatgagtctgctccttaaataaacctatcccagacagaac

SEQ ID NO: 694441 - DNA, 591 bp, Homo sapiens
  misc_feature (159)..(160): n is a, c, g, or t
  misc_feature (163)..(164): n is a, c, g, or t
  misc_feature (167)..(168): n is a, c, g, or t
  misc_feature (173)..(173): n is a, c, g, or t
  misc_feature (175)..(175): n is a, c, g, or t
  misc_feature (181)..(183): n is a, c, g, or t
actgaccggatcgtatttacaggcacgaaacgaggtgtgaccgtaagtacgcattcactggccgaaagatagaaagggaaggacggctgtaacgaagagtaagaaatagaagaaatgaatcatgagggagagaaggatgttaggaaggagagaaggaannatnnaannagggngngcaggnnnaagagaaggaagcaagggagggaaggaaggaaggaaggaaggaacgaaggaaggaacgaaggaaggaaggaaggaaggaaggaacgaaggaacgaaggaacgaaggaaggaaggaacactttggccccatgcagacatgggtcctcatcctggccccatcactacctggatggtcgttgggttaaactgtggaggtatctgagcctccgttttctcatctgtagaatgggtggatgggaattaacagcagaaaaggaggtgagaacaagaggagctctgagcttatggtgggctggctggtgcatattgggtccctcatagacattacagatgaaatgcagatggacccaggtatccagatgggtctccagatgcaggacatcctaaacagttgccggggtacccagc

SEQ ID NO: 694442 - DNA, 264 bp, Homo sapiens
ctgtgtatttatacatgaccagttttatattttggatgcatacaattaagatatgcttgcttgatacaggttcaggggctactgagtatctacaaatctaatcaattcatagatgtccttaggttcaagactatatcctgtatatgaatatttttgaatcaatttataaaaataaggtcagagacagaaaaatacacttgtgactgcattttttggtacaacagtgacatcttgtggtaaaaactcagtggataaggtcgacgc

SEQ ID NO: 694443 - DNA, 1707 bp, Homo sapiens
  misc_feature (646)..(646): n is a, c, g, or t
  misc_feature (842)..(842): n is a, c, g, or t
gtaggaactttaaattatcacaatgtccagaagaggtaaagtaacttgcccaattgccacacagcaagcaagttggcctgtccatggatgtgatcttaggttgtgtctgacgtgcaggagcccccacccttcacttttccagtgtgtgtgtgtgttgagggggttcaggaacagagggaggactattgtgtaagcggagccccaggcacgtgatagggctccgtggagaaaattaagggggcatgggtgtcgccagtggacgcctcacaacaggtggttgtttgctccctgtggccctgtggttcgccttgggagaagaatgtgacgccggatttgtatgtgtttgtgatgtgttctgcacatgtgtgccatgcttgtgcgcaacgccctttgtgagatcggggtgtgctcagtgtgtttgagagtgagcgctgtctataagaaagagaggtgtgtgtatatcatctccccaagtgatgactctagaggtcttatagaggagagagctatgtgtatgagttctctctcaacgcgtgtgcgccatacgcaagacaacatttccgcgctatgggcgcgcccaaggtagaaacattgttttgccccacacacagcgtggcacagaagattaccatgtgtgtggttctcnccacaaaggccacacagtgggtccacacaagtgcgtgtataagaaataccccatgttgtgtgcacacccgcgtgtgttaagttagtagaccgtggaacaaacaccagcgtggtttcaagatgaaggctcgttgcccacgtgtcggtgtggacaaccccaagggggggtcccacacaagctcgtctgagaagaagtnccccgttgtggtggtgactataaacccaaacacagtcttacaaacgacgtgttgtcactgttgtaagacaagttcttccattctctgttgtgagaaccaacacccttttcttccccgagggggacgaagttgtctcccctatatcagacggaggggaacattgtggtgggcggacccctttctaccaaatgctgtgttggaaacatcgtttggtttttgcaaggccactttgttggtaccccccccccaaatttcacaaatgtgttgtttgttttcccccccaacgattattctccaaaggggtgcccgagacccctgtaggggaaaatatcattttcacccccgtttccaaagaaaaggtccagctctgtgggagagaaatacccccgataatcaagtgtggacaaaaaggccaccaacggaattcatgtgtttgtagccctgtagagtagggggcccccttattgggaggagcatcccttcccaggagtgagccattgtgggcgcgtgcacaaggataacctcattgtgaggagagccgacaaaatacgctgtgtgtccttggtggaagaccaacgttggagcaaacgagtgatattcaaaggcccccaagaagagttatttattattcccccagcaattggttctcgtgagcaaaaccctggaaagaccttcgtgtgtactccctctgttgtgccctcagatgggtacggttggtctaccatcctgtgtgatgcgacgtgtgaacacatacatggtcgtagtgattctacatatgtgataattccgatagatgatgaggatagtacccgccgtcggtctgatcgtctacacgtgccataaatagagctcgattgctgggacc

SEQ ID NO: 694444 - DNA, 237 bp, Homo sapiens
ttctagaggatcccaatcagtaacacaagattcgacatgaaaaacaaacattattcatgctacaggtttttaattgtccttggacaacaccaaaaacacagtactcacaacggcatgtttctagttgtttttttttattttttttgtggcccctaaaacccgatattttaaatacttccacaaattccaaaaggaaaaccaaccttattccaggcaccggtttttaattttccttgg

SEQ ID NO: 694445 - DNA, 267 bp, Homo sapiens
tgccagtctctgcccacagtcttctgcctgatccagagtcttagccatgatccacagtcttctgcatgatccatagtcttagcctgctccacagtcttcgcatcagtgcgacgacttgtggggggaggtcaccctccctgcacctgatgtggtccaatgtatcttcattcaattgaatcagagtcttttttgaataaatctgtgttcatgcgctgtgggaggcataagcacaaaatagagttgcctttgtaagaaagaaggaaacca

SEQ ID NO: 694446 - DNA, 529 bp, Homo sapiens
  misc_feature (75)..(75): n is a, c, g, or t
  misc_feature (233)..(233): n is a, c, g, or t
  misc_feature (265)..(265): n is a, c, g, or t
  misc_feature (432)..(432): n is a, c, g, or t
aaacaggagttgaatgagcccccgaaacagtccacgtctttcttggttttgcaggaaatcctggagtctgaaganaaaggggatcccaacaagccctcaggattcagaagtggttaaagctcctgtcactaaagtggctgcgtcgattggaaatgctcagaagttgcctatgtgtgacaaatgtggcactgttctccagcaggcctctgctgcagctttttctctcagtgttntggccctctcctctcttgaaagttctctgccnactttggttttccctctgcttgtaaaacattgagtcccctccctgccttggttaattgactcacaccagctgtgcgatgcccgcttttacaattaaaggaaaactgttgtgttcagtgtccccttgtcagcaacactgtgtcccttcgcccccccgtttttttttgntgcatttggacatcagccaaatttgaacccaatcaaatataacgtgtttgaccctgattttgtttttactcaataaatgtatagcctccaaaacaaa

SEQ ID NO: 694447 - DNA, 98 bp, Homo sapiens
ccaccttcactgtgtccacccttcctagctttgtgcccggggtgctgagcccttccccggtcagccgggccgcgggaggagggagccgtcaccgagga

SEQ ID NO: 694448 - DNA, 843 bp, Homo sapiens
agcattcgggccggaatgtctcgctccggtggccttatgtgtgcctcgcgctattctctctttctggcctggtaggctatccagcgtactccaaagattcacggtttactcagcgtcatccagcatagaatggaaagtcgataatttcctgaattgctatgtgtctgggtatcatccatccggaggcatcgaagttgacttactgagaaatggactagagaattagaagaaagtggacggcctagttccagacttgtctttcagctaggactggtctttctatctcttcgtacctacactgaattcactcccctagctgaacaagagatgtagtatgccctgccgtgtgcataccatgatgcactttcgtcactagacccaatgatagttagagtgcggatctgcagacaatgtaagcagcactcactggacggtttgatagatgccagctatttggattcggatgaattccaatattctgcttgcttgctttttaattattgatatgcttatacacttacacttaatgcacaaaatgccatgggtctataatacctgttcacactggacagtgtatcttctctctaattctaccttctggagtgctgctctccatgtttgaatgtatctgaggcacgttgcgtccacacggattgctctaccgagggctggccgacttaaaagctgggggagcacaaaaagttctctttatcaatcatccaacatccctggcccaggattggaactctctcaatcttcttgcactccaaagcttgtttagatatgccaagcgagataattaactccattactacccgccccactggggggcattgactttat

SEQ ID NO: 694449 - DNA, 81 bp, Homo sapiens
gccgaggacacggccgtgtatttctgtgcgagagatggcggtgggggctactccaaatacttcccgcactggggccagggc

SEQ ID NO: 694450 - DNA, 316 bp, Homo sapiens
tctaggaatggggtctggggatacacgagagtgctgtgtcatgttatttcatcgtttggaaggctgtgttgtggttatgtaggagaaagtccttaactggagaacacacactcgagttcagaagtgatgggccaggaggttggcaccctcatgtcaaatggcttaggacaaaatactctttgtaccatacttggcaacttttgtctagatcttaaatatttccaaataaaaggttttgaaaatctgcttctttttaggaatagccacaggaatctccttaggcagagacaaataaagccccctgcccatccatgct

SEQ ID NO: 694451 - DNA, 290 bp, Homo sapiens
agcagtcatcgagactgaaattttcatttcagctagtaagctaatctctgacgattacctaaaaattctaataaacacaaagaatagtcatgttataaaagaaccttagactcctacttaaaatcttttgtactgtatttcttttatcatatacaaagtgattatactggccgtcaatatttcaaaaatgcattgttctgaggaaacggtagtatatatattttaggaaaatgtatccaggccaggtgcgaaagatcacgcctgcaatcccagcacttagggaggccgag

SEQ ID NO: 694452 - DNA, 154 bp, Homo sapiens
acgtgccgcgcggggcaacgccgtcttcttcagctatgagcgccccgacccctcgacgcgtaccctgcacggcggcgcgcccgtgctggccggcgaaaaatggatcgccaccaaatggctgcgcgaacgcgaattccactgaagagccagcgaa

SEQ ID NO: 694453 - DNA, 1247 bp, Homo sapiens
cactggtgtgctctgtatgcgctgtggttgttgatgctccgtgtgtggtttgtggtttgaggtggcgtgttgcccaggtatcatctgtctgcatcgcgcagtgggaggtaggtgtgttgtccgccaggcgcggatgctggtgtgctgtccctgatttgtctcgcattcgagtgtccaacggcgccaggtgtccatggctgtgcgcgttgccgaattggtgtatgctgttttcttgagcgcggtataaaattgcagggtaggaattgagcgcgcatatgtcgttgttgcggacaccacgtgtgtgcgtaggcttgatggtggaatcgtaaagcgactcatggttggtaactgttgttgtttttaatttaatttttttcataagtattgggggtaatctactggtaggaaaggtggcagaggggagagcccagagttttagtggcttcggtagtttgcgattaaaggttgttgtaagtgtcgtgaagaatgggttttttcggacgtgtgtttgtggaagtttcctgggcgcttaaagggccccgtgtggtgaaaaccaattgagtttgagattgggcttaagggtaccaaagggaaagtgccctggtgtgaggtgggataatgcattccgttcgggttgggctgggttgatgtcttaggtgtttctaccaggagatcattaagtttttgccctcctaaataggagaggggctagtgtcgttaggagtgcagtggtgcttcacactggagtaccagctctttcttgttgcttaggccgttagctgtggaatgcttgccctagtaactaaaggtagaggcaagcacacattgaaaggcttgctggatcagacggttcctgagaagtttgtcagtctgtgaatgtgcttgtgtagttaagacctgaatgttgtcttgttaaggctagagcaaaggagtcatgaagttgttccagtgagttagccagtgtaagctccgtgcaatgaatgtttatgtgattgaagcaaatgtgaatcgtattattgttaaaaagtggcagagtgacgtgtaagctgagtcagtgcagtgatccgctcatcccgtgaaattgagtttatgtagtcattgttacttattttattcattagctaactttgtgctatgtatatttctagatagttgactagtgtaatcgattataaaggatatttatcaaatccagggattgcgattgttgaaattgattaattatttaacatcgcggaagtattcta

SEQ ID NO: 694454 - DNA, 141 bp, Homo sapiens
ccttggggcccccccttcccccttttttgtcccccaacttaaaaggaatgaagggttttggtttccctgggagggggggggggcagccagggtttacctgtacactgacttgagaccagttgaataaaagggcccccctta

SEQ ID NO: 694455 - DNA, 201 bp, Homo sapiens
aagtcttgcataattttgtcaaatttatttctaagtatttcaaaattttaggctcttataaattacatttttaaaattacatggctgggcacggtggctcacgcctgtaatcacagcactttgggaggccaaggtgggcggatcacaaggtcaggggttcgagaccagcccgaccaacatggtgaaacgctgtttccccca

SEQ ID NO: 694456 - DNA, 350 bp, Homo sapiens
atactcagaatatggatagctcctttttattactatgcctttacgagtcgttcatctttcaagtcaacactcttcagctaatcacagatctaagcttacatgaaatctgaaaataaactttactgtgttttcagaggatttggccgttaacagtcaacggtggcatggcaagattgtagttgatttgacatgattgtagttaaacgaaaccaaaccacacatcaacaagggcacagcaggcaagcagaatgcaaagcaccatttccattcaccaagccaatccacgcaccagtttcattggtctcaggcaacatcaaacaacagcaagcaagcaagcaaagcaaaggcaa

SEQ ID NO: 694457 - DNA, 673 bp, Homo sapiens
  misc_feature (414)..(415): n is a, c, g, or t
  misc_feature (419)..(419): n is a, c, g, or t
  misc_feature (425)..(426): n is a, c, g, or t
  misc_feature (430)..(430): n is a, c, g, or t
  misc_feature (536)..(536): n is a, c, g, or t
gtggggactgggcatcttgctcagagtgggcaggaatccccaggaagtgggacaagagtgcctcgtcggaagtcgccccagccctctacgcgtctgcagccacaccccgacatggtgctcgggtcacaggccttgaggtgctcctgtgtcacccagtgcaggtgtctgcccccagcctctgcgcctgtgagaccttctctctggaaaattcttctctgatatccacatgcctttgcattgcctccctgtctcgccctgaaaggtgggcacgggccccctcctgctgcagcgtctctggggctgcccgcctgcagacacctccactcagttcctttccatctttgcacttgagggtcggcttccccagggcagcggcctcactggtagcccccaccaaccctggagcactaacanncctnttggannaggncctgagtgcaggaagacctgagtgctgattgtgttaagagaaatgcagccattcccaaaggctgcctgttgctggctctgtgtttgcagaattcccaagatacgcnccctctgagtcccactgccgtctcaggtgctgtgttggtttcttcggcgacacttccccttcctgcatttgattgcgtggtgacaccaggcgtgcacctgcccctcctgcatctgctgccgtttgttcttcgacgaa

SEQ ID NO: 694458 - DNA, 805 bp, Homo sapiens
  misc_feature (132)..(132): n is a, c, g, or t
  misc_feature (191)..(191): n is a, c, g, or t
  misc_feature (478)..(478): n is a, c, g, or t
tatttttacgtatagacggggctttgccttgcctggccaggctggtctcaaactcctgacctcaggttatccacctgcctctgcccctcaaagtgctggaatcacagtcacgatgccactgcgcccggcccngaggcctttgcagtgcttagcccccagctgctctaccccttcagatgggaggatttcanaaccacgttcagatcatcttttttctgcagaaaaatcatgctttaacgtgcaagctattaattcatagaagaaaatgtttcaatcctatcagttctttttttcgagacgcagtttcactcttgtcacccaggctggagtgcagtggcgcaatctcggcttcactgaactccatcttctggggttcacgcagttctccttgcccagcctcccgagtctctgggattgcaggcgtcaacaccagggctggctaattctggatttgggggagacagggtttaggccatgntgggccgggacggtcttgaacttctgaacgtcgggtgtactggccaatcggggccttcacagggcgggacataccgaagatggagccccctcggccgacaagataacgggaacagactctgcgagcccgtgaagcagaggttaaagggccccaaaagcacgcggagggacaacaacgacgagtggcaacgggcccatgcggccaaaaagatcaggagacaccgacgggggcagcagacacacaacacaccagcggcaagaatgcgccacagaggagagagagcgaacagcatctagcaaaacgggcgctccgcatattgctgcagta

SEQ ID NO: 694459 - DNA, 146 bp, Homo sapiens
ttcctatcgtgtcggggttgcacagagcactgggttggaggatagcggagcatggagtgggtgatgcacacagcacgtgtggataggaagcgcatgagcacggtgagtagatgcactatgagcacggcggggtctggtgcgtgttc

SEQ ID NO: 694460 - DNA, 219 bp, Homo sapiens
  misc_feature (6)..(6): n is a, c, g, or t
cagatnaaggatattgctgcatatcgtgccagggcaaagtgaagccggaaagaatttcctggaggccaacaggctcaaagaagaagaacgaaccagaagatgaggagcgaggaggagttagaagaagatgagagatgaggaggcaagacggatgaacgatgacagacataaatgggctatcctattaatgagtgcttggaatcagtgtgtagttcgctt

SEQ ID NO: 694461 - DNA, 1703 bp, Homo sapiens
ggtctcttcctgaccatcaggttctgtgttctgctctgatcccactccaactgcagtcaccttgtgtgctggcccgcctgtggtcctgggagcccgaggccagcccggctgccgcatcctgctcttcgcactccggctgcccaggctttgctgaggttctgcagaccttcagcacctgcaaggggatgctgggtgagatcctgtctgcattcgagttcatggatgctgtgtgcatgcagctggtcgggcgccatctccacctggccagcccggtgcaagagagtccgttttacgtcctcatcgagacttcaggctccaacgcaggccatgacgctgagaagctgggccacttcctggagcacgcgctgggctccggcctggtgaccgatgggaccatggccaccgaccagaggaaagtcaagatgctgtgggccctgagggaaaggatcacagaggcgctgagccgggatggctacgtgtacaagtacgacctctccctccctgtggagcggctctacgacatcgtgactgacctgcgcgcccgcctcggcccgcacgccaagcacgtggtgggctatggccaccttggagatggtaacctgcacctcaatgtgacggcggaggccttcagcccctcgctcctggctgccctggagccccacgtgtacgagtggacggccgggcagcagggcagcgtcagcgcggagcacggagtgggcttcaggaagagggacgtcctgggctacagcaagccaccgggggccctgcagctcatgcagcagctcaaggccctgctggaccccaagggcatcctcaacccctacaagacgctgcccagccaggcctgacggccactcctgctgctgccaaggcccactgggggtcggcgggtggctctcgggcgggggtgttgcggtggctctgagggatgagccggcagcgggcaggggaccaggcacctggttgaagggactgggagcccgcactggggaactgccggacgcaggccctcgggcaggagcatctggcagagtggggggcgtggcaggcaccctcctttgcagggcgaggtggggcctctgcagccatcctggacaggccggggtggcggcagctttgcccacgtggaagcggggtgggtctcacttgcgtggtggcccctggccccatcttgcctgctgcggcctggggagcaggcgctgggtggtggttctgcctgcttgctgctcgttccccgggcatgcgtgggcagcggggggcatgcgtgggcagcagggggcgtgggcagcgggggcatgggcaggaccacgtgggccgtgatcgtgggttgccgagaggacctgagcgctgcggctctgctgaatggagccgggtccctcaggccgtggacgccctcgggaggggggtgactgtggcttgtgtctggacaggaatgtgtcatttcccacatcttctagagggctgccagctgggaagacagttatcagggcaagctgtgctctgagtttcgggttctgctcctacaaagaacgtgcggtgctgcgggcgagggccccggcacggacaagggccactgcagagtgtgtttctgctcgtcagctgccctgggcagcggatgggctgggcgatgcagctggatgcacatctcattctgtcatgaatgtccagtaaaaatctgaattggttgcaaaaaaaagaaaaac

SEQ ID NO: 694462 - DNA, 2616 bp, Homo sapiens
ggtctcttcctgaccatcaggttctgtgttctgctctgatcccactccaactgcagtcaccttgtgtgctggcccgcctgtggtcctgggagcccgaggccagcccggctgccgcatcctgctcttcgcactccggctgcccaggctttgctgaggttctgcagaccttcagcacctgcaaggggatgctgggtgagatcctgtctgcattcgagttcatggatgctgtgtgcatgcagctggtcgggcgccatctccacctggccagcccggtgcaagagagtccgttttacgtcctcatcgagacttcaggctccaacgcaggccatgacgctgagaagctgggccacttcctggagcacgcgctgggctccggcctggtgaccgatgggaccatggccaccgaccagaggaaagtcaagggtctcgctctcacccaggctggagtgcagtgacacagttgcagctcactgcagcctcgacctcctgggctcaagcaatcctcccgcctcagcctcccgagtagctgagtctacagatctccacaatggaagttcgaagcaagcaaaagccacgcaaaccacaggccgatctgtctgagccctaggatttggcccggttctgcttcagccaccagcaccgtctgctcctcctcagaatccttcctcccccgtggcccgcccgccgtgtccctcctcctccacggcccgcccaccgtgtccttccctcccccgtggccacccaccatgtccttccctcccctgtggcccacccgccatgtccctgcctcccacccgacatgccccttgagctgcctgggccctgctgttgtccccactgcctgtgtgactctgcgcccccttccctaccctgccccaccctggttcagggagcgtccaggcccattctcatcctcagggccttccctggcccttgccactctgtgccgtgtcatgacctgaagctgcaggtgggcgcctcccccttccgtcatggctgtccccttctgtgaggtgcagccgctgattgcggagtcccaggtgctcggtgctgtcgtggagcctgggacattcactgtctgggattgattccatggattggagccacacctggtctggggcattcgctgtcctgggtcagagcccctcctggtctgggacattcgctgtctggggttggagccacacctggtctggggcatttgctgtccggggtcggagcctcacctggtgaagatacagaacatgctgctgccctaaccccgtgtggtgtgccccctgtccccgggtgtcgttcccatagccagcccttgtctcatctcgtctcatcttctagatgctgtgggccctgagggaaaggatcacagaggcgctgagccgggatggctacgtgtacaagtacgacctctccctccctgtggagcggctctacgacatcgtgactgacctgcgcgcccgcctcggcccgcacgccaagcacgtggtgggctatggccaccttggagatggtaacctgcacctcaatgtgacggcggaggccttcagcccctcgctcctggctgccctggagccccacgtgtacgagtggacggccgggcagcagggcagcgtcagcgcggagcacggagtgggcttcaggaagagggacgtcctgggctacagcaagccaccgggggccctgcagctcatgcagcagctcaaggccctgctggaccccaagggcatcctcaacccctacaagacgctgcccagccaggcctgacggccactcctgctgctgccaaggcccactgggggtcggcgggtggctctcgggcgggggtgttgcggtggctctgagggatgagccggcagcgggcaggggaccaggcacctggttgaagggactgggagcccgcactggggaactgccggacgcaggccctcgggcaggagcatctggcagagtggggggcgtggcaggcaccctcctttgcagggcgaggtggggcctctgcagccatcctggacaggccggggtggcggcagctttgcccacgtggaagcggggtgggtctcacttgcgtggtggcccctggccccatcttgcctgctgcggcctggggagcaggcgctgggtggtggttctgcctgcttgctgctcgttccccgggcatgcgtgggcagcggggggcatgcgtgggcagcagggggcgtgggcagcgggggcatgggcaggaccacgtgggccgtgatcgtgggttgccgagaggacctgagcgctgcggctctgctgaatggagccgggtccctcaggccgtggacgccctcgggaggggggtgactgtggcttgtgtctggacaggaatgtgtcatttcccacatcttctagagggctgccagctgggaagacagttatcagggcaagctgtgctctgagtttcgggttctgctcctacaaagaacgtgcggtgctgcgggcgagggccccggcacggacaagggccactgcagagtgtgtttctgctcgtcagctgccctgggcagcggatgggctgggcgatgcagctggatgcacatctcattctgtcatgaatgtccagtaaaaatctgaattggttgcaaaaaaaagaaaaac

SEQ ID NO: 694463 - DNA, 2374 bp, Homo sapiens
ggtctcttcctgaccatcaggttctgtgttctgctctgatcccactccaactgcagtcaccttgtgtgctggcccgcctgtggtcctgggagcccgaggccagcccggctgccgcatcctgctcttcgcactccggctgcccaggctttgctgaggttctgcagaccttcagcacctgcaaggggatgctgggtgagatcctgtctgcattcgagttcatggatgctgtgtgcatgcagctggtcgggcgccatctccacctggccagcccggtgcaagagagtccgttttacgtcctcatcgagacttcaggctccaacgcaggccatgacgctgagaagctgggccacttcctggagcacgcgctgggctccggcctggtgaccgatgggaccatggccaccgaccagaggaaagtcaagggtctcgctctcacccaggctggagtgcagtgacacagttgcagctcactgcagcctcgacctcctgggctcaagcaatcctcccgcctcagcctcccgagtagctgagtctacagatctccacaatggaagttcgaagcaagcaaaagccacgcaaaccacaggccgatctgtctgagccctaggatttggcccggttctgcttcagccaccagcaccgtctgctcctcctcagaatccttcctcccccgtggcccgcccgccgtgtccctcctcctccacggcccgcccaccgtgtccttccctcccccgtggccacccaccatgtccttccctcccctgtggcccacccgccatgtccctgcctcccacccgacatgccccttgagctgcctgggccctgctgttgtccccactgcctgtgtgactctgcgcccccttccctaccctgccccaccctggttcagggagcgtccaggcccattctcatcctcagggccttccctggcccttgccactctgtgccgtgtcatgacctgaagctgcaggtgggcgcctcccccttccgtcatggctgtccccttctgtgaggtgcagccgctgattgcggagtcccaggtgctcggtgctgtcgtggagcctgggacattcactgtctgggattgattccaatgctgtgggccctgagggaaaggatcacagaggcgctgagccgggatggctacgtgtacaagtacgacctctccctccctgtggagcggctctacgacatcgtgactgacctgcgcgcccgcctcggcccgcacgccaagcacgtggtgggctatggccaccttggagatggtaacctgcacctcaatgtgacggcggaggccttcagcccctcgctcctggctgccctggagccccacgtgtacgagtggacggccgggcagcagggcagcgtcagcgcggagcacggagtgggcttcaggaagagggacgtcctgggctacagcaagccaccgggggccctgcagctcatgcagcagctcaaggccctgctggaccccaagggcatcctcaacccctacaagacgctgcccagccaggcctgacggccactcctgctgctgccaaggcccactgggggtcggcgggtggctctcgggcgggggtgttgcggtggctctgagggatgagccggcagcgggcaggggaccaggcacctggttgaagggactgggagcccgcactggggaactgccggacgcaggccctcgggcaggagcatctggcagagtggggggcgtggcaggcaccctcctttgcagggcgaggtggggcctctgcagccatcctggacaggccggggtggcggcagctttgcccacgtggaagcggggtgggtctcacttgcgtggtggcccctggccccatcttgcctgctgcggcctggggagcaggcgctgggtggtggttctgcctgcttgctgctcgttccccgggcatgcgtgggcagcggggggcatgcgtgggcagcagggggcgtgggcagcgggggcatgggcaggaccacgtgggccgtgatcgtgggttgccgagaggacctgagcgctgcggctctgctgaatggagccgggtccctcaggccgtggacgccctcgggaggggggtgactgtggcttgtgtctggacaggaatgtgtcatttcccacatcttctagagggctgccagctgggaagacagttatcagggcaagctgtgctctgagtttcgggttctgctcctacaaagaacgtgcggtgctgcgggcgagggccccggcacggacaagggccactgcagagtgtgtttctgctcgtcagctgccctgggcagcggatgggctgggcgatgcagctggatgcacatctcattctgtcatgaatgtccagtaaaaatctgaattggttgcaaaaaaaagaaaaac

SEQ ID NO: 694464 - DNA, 2518 bp, Homo sapiens
ggtctcttcctgaccatcaggttctgtgttctgctctgatcccactccaactgcagtcaccttgtgtgctggcccgcctgtggtcctgggagcccgaggccagcccggctgccgcatcctgctcttcgcactccaggtctcagataggagtcactcgcctcttcgtgccacgcccacgtctaagccgggtggaacaggcccttgcaggtgtctgcccccagcctctgcgcctgtgagaccttctctctggaaaattcttctctgatatccacatgcctttgcattgcctccctgtctcgccctgaaaggctgcccaggctttgctgaggttctgcagaccttcagcacctgcaaggggatgctgggtgagatcctgtctgcattcgagttcatggatgctgtgtgcatgcagctggtcgggcgccatctccacctggccagcccggtgcaagagagtccgttttacgtagatctccacaatggaagttcgaagcaagcaaaagccacgcaaaccacaggccgatctgtctgagccctaggatttggcccggttctgcttcagccaccagcaccgtctgctcctcctcagaatccttcctcccccgtggcccgcccgccgtgtccctcctcctccacggcccgcccaccgtgtccttccctcccctgtggcccacccgccatgtccctgcctcccacccgacatgccccttgagctgcctgggccctgctgttgtccccactgcctgtgtgactctgcgcccccttccctaccctgccccaccctggttcagggagcgtccaggcccattctcatcctcagggccttccctggcccttgccactctgtgccgtgtcatgacctgaagctgcaggtgggcgcctcccccttccgtcatggctgtccccttctgtgaggtgcagccgctgattgcggagtcccaggtgctcggtgctgtcgtggagcctgggacattcactgtctgggattgattccatggattggagccacacctggtctggggcattcgctgtcctgggtcagagcccctcctggtctgggacattcgctgtctggggttggagccacacctggtctggggcatttgctgtccggggtcggagcctcacctggtgaagatacagaacatgctgctgccctaaccccgtgtggtgtgccccctgtccccgggtgtcgttcccatagccagcccttgtctcatctcgtctcatcttctagatgctgtgggccctgagggaaaggatcacagaggcgctgagccgggatggctacgtgtacaagtacgacctctccctccctgtggagcggctctacgacatcgtgactgacctgcgcgcccgcctcggcccgcacgccaagcacgtggtgggctatggccaccttggagatggtaacctgcacctcaatgtgacggcggaggccttcagcccctcgctcctggctgccctggagccccacgtgtacgagtggacggccgggcagcagggcagcgtcagcgcggagcacggagtgggcttcaggaagagggacgtcctgggctacagcaagccaccgggggccctgcagctcatgcagcagctcaaggccctgctggaccccaagggcatcctcaacccctacaagacgctgcccagccaggcctgacggccactcctgctgctgccaaggcccactgggggtcggcgggtggctctcgggcgggggtgttgcggtggctctgagggatgagccggcagcgggcaggggaccaggcacctggttgaagggactgggagcccgcactggggaactgccggacgcaggccctcgggcaggagcatctggcagagtggggggcgtggcaggcaccctcctttgcagggcgaggtggggcctctgcagccatcctggacaggccggggtggcggcagctttgcccacgtggaagcggggtgggtctcacttgcgtggtggcccctggccccatcttgcctgctgcggcctggggagcaggcgctgggtggtggttctgcctgcttgctgctcgttccccgggcatgcgtgggcagcggggggcatgcgtgggcagcagggggcgtgggcagcgggggcatgggcaggaccacgtgggccgtgatcgtgggttgccgagaggacctgagcgctgcggctctgctgaatggagccgggtccctcaggccgtggacgccctcgggaggggggtgactgtggcttgtgtctggacaggaatgtgtcatttcccacatcttctagagggctgccagctgggaagacagttatcagggcaagctgtgctctgagtttcgggttctgctcctacaaagaacgtgcggtgctgcgggcgagggccccggcacggacaagggccactgcagagtgtgtttctgctcgtcagctgccctgggcagcggatgggctgggcgatgcagctggatgcacatctcattctgtcatgaatgtccagtaaaaatctgaattggttgcaaaaaaaagaaaaac

SEQ ID NO: 694465 - DNA, 329 bp, Homo sapiens
  misc_feature (22)..(22): n is a, c, g, or t
  misc_feature (48)..(48): n is a, c, g, or t
  misc_feature (248)..(248): n is a, c, g, or t
  misc_feature (296)..(296): n is a, c, g, or t
tttgccttatatttctaatggncagtactgctgtagattctagatgtncttttcctttgtcgttgctaaattctcttattagttatagtagttattttgttggtttcttaggtttttctttgctttttttctattttttaaatttttattagaaacagggtctctctgtcacctaggttggagggcagtggtgtgatcataactcactgtaacttcaaactcctagcttcaggtgatcccccaacctntggcctcccaaagtgctgggattacaagcatgagccaccacaactgtnagtttcttaggtttttctgtgtactcaatcatg

SEQ ID NO: 694466 - DNA, 2293 bp, Homo sapiens
  misc_feature (1620)..(1620): n is a, c, g, or t
  misc_feature (1679)..(1679): n is a, c, g, or t
  misc_feature (1966)..(1966): n is a, c, g, or t
ggtctcttcctgaccatcaggttctgtgttctgctctgatcccactccaactgcagtcaccttgtgtgctggcccgcctgtggtcctgggagcccgaggccagcccggctgccgcatcctgctcttcgcactccggctgcccaggctttgctgaggttctgcagaccttcagcacctgcaaggggatgctgggtgagatcctgtctgcattcgagttcatggatgctgtgtgcatgcagctggtcgggcgccatctccacctggccagcccggtgcaagagagtccgttttacgtcctcatcgagacttcaggctccaacgcaggccatgacgctgagaagctgggccacttcctggagcacgcgctgggctccggcctggtgaccgatgggaccatggccaccgaccagaggaaagtcaagggtctcgctctcacccaggctggagtgcagtgacacagttgcagctcactgcagcctcgacctcctgggctcaagcaatcctcccgcctcagcctcccgagtagctgagtctacagatctccacaatggaagttcgaagcaagcaaaagccacgcaaaccacaggccgatctgtctgagccctaggatttggcccggttctgcttcagccaccagcaccgtctgctcctcctcagaatccttcctcccccgtggcccgcccgccgtgtccctcctcctccacggcccgcccaccgtgtccttccctcccccgtggccacccaccatgtccttccctcccctgtggcccacccgccatgtccctgcctcccacccgacatgccccttgagctgcctgggccctgctgttgtccccactgcctgtgtgactctgcgcccccttccctaccctgccccaccctggttcagggagcgtccaggcccattctcatcctcagggccttccctggcccttgccactctgtgccgtgtcatgacctgaagctgcaggtgggcgcctcccccttccgtcatggctgtccccttctgtgaggtgcagccgctgattgcggagtcccaggtgctcggtgctgtcgtggagcctgggacattcactgtctgggattgattccaatgctgtgggccctgagggaaaggatcacagaggcgctgagccgggatggctacgtgtacaagtacgacctctccctccctgtggagcggctctacgacatcgtgactgacctgcgcgcccgcctcggcccgcacgccaagcacgtggtgggctatggccaccttggtgagcggcgccccggggccgcggccctgtgtgtgctgggtggtgggccccacggtcaccgtcaccctgccaggcttcgaggcagggcagtttgaccatggtctctggcttagcatatctcccgtagacactggcaggaccacggtgtctgacagggaagggaaaatcctaatcgttgtcatgactcgttttgagtattttggaaaagactgccatcgtgcacttgtaatggcagagcgcatggctcagcttgtcagaacgttctgggatcttcagtggcatgcagggttggagggcatcagccttaaccccggagtccgggatgcgggtctcaggggctcctctcacagggcccggcccngaggcctttgcagtgcttagcccccagctgctctaccccttcagatgggaggatttcanaaccacgttcagatcatcttttttctgcagaaaaatcatgctttaacgtgcaagctattaattcatagaagaaaatgtttcaatcctatcagttctttttttcgagacgcagtttcactcttgtcacccaggctggagtgcagtggcgcaatctcggcttcactgaactccatcttctggggttcacgcagttctccttgcccagcctcccgagtctctgggattgcaggcgtcaacaccagggctggctaattctggatttgggggagacagggtttaggccatgntgggccgggacggtcttgaacttctgaacgtcgggtgtactggccaatcggggccttcacagggcgggacataccgaagatggagccccctcggccgacaagataacgggaacagactctgcgagcccgtgaagcagaggttaaagggccccaaaagcacgcggagggacaacaacgacgagtggcaacgggcccatgcggccaaaaagatcaggagacaccgacgggggcagcagacacacaacacaccagcggcaagaatgcgccacagaggagagagagcgaacagcatctagcaaaacgggcgctccgcatattgctgcagta

SEQ ID NO: 694467 - DNA, 1113 bp, Homo sapiens
ggtctcttcctgaccatcaggttctgtgttctgctctgatcccactccaactgcagtcaccttgtgtgctggcccgcctgtggtcctgggagcccgaggccagcccggctgccgcatcctgctcttcgcactccggctgcccaggctttgctgaggttctgcagaccttcagcacctgcaaggggatgctgggtgagatcctgtctgcattcgagttcatggatgctgtgtgcatgcagctggtcgggcgccatctccacctggccagcccggtgcaagagagtccgttttacgtcctcatcgagacttcaggctccaacgcaggccatgacgctgagaagctgggccacttcctggagcacgcgctgggctccggcctggtgaccgatgggaccatggccaccgaccagaggaaagtcaagggtctcgctctcacccaggctggagtgcagtgacacagttgcagctcactgcagcctcgacctcctgggctcaagcaatcctcccgcctcagcctcccgagtagctgagtctacagatctccacaatggaagttcgaagcaagcaaaagccacgcaaaccacaggccgatctgtctgagccctaggatttggcccggttctgcttcagccaccagcaccgtctgctcctcctcagaatccttcctcccccgtggcccgcccgccgtgtccctcctcctccacggcccgcccaccgtgtccttccctcccctgtggcccacccgccatgtccctgcctcccacccgacatgccccttgagctgcctgggccctgctgttgtccccactgcctgtgtgactgtggcttgtgtctggacaggaatgtgtcatttcccacatcttctagagggctgccagctgggaagacagttatcagggcaagctgtgctctgagtttcgggttctgctcctacaaagaacgtgcggtgctgcgggcgagggccccggcacggacaagggccactgcagagtgtgtttctgctcgtcagctgccctgggcagcggatgggctgggcgatgcagctggatgcacatctcattctgtcatgaatgtccagtaaaaatctgaattggttgcaaaaaaaagaaaaac

SEQ ID NO: 694468 - DNA, 656 bp, Homo sapiens
tgcaggcgggtgtgttaggcttccccactgggcggcaccctcgatggggtctaccctaccctcatggagcccgtcattgctgcccaaggaggccccccgggtcgcccggccagagcggacccgagcagacaccggccatgccttcctcgccaagcccccagacccgctccgggactggagcccgcctcctcccccagcaaggagctcggagccccggtccccatagttgccatccatgatctctggcacacgccaccatctgtccagcaacaccctgcagaaggaaccgtcgcaccatcaccacgccagcccggacccagccggtagcacacctagcctcgagcctacgagacccgcaccgggaataagactcaaagtaaacccttttccatccaggaactggaactccgttctctgggttaccacggcaagcagctacatgccccgaatggggtaggagcccgtcagacctgtgagctcacccagtctgacccacgacaaggggcatccccaagcacctggaagagctcgaccagagccaactggagggggagctgcggcccaagcagccaggccccgtgaaagcttggcggggaggccagcacacctccacacaacatgcaggcgctagcctgagagccagccctcgtccacac

SEQ ID NO: 694469 - DNA, 409 bp, Homo sapiens
tagctgtagctgcgtagatcgtcagtgagacgctattcataacagagctaaaaaaacacgcagagccagttaaaagctctaatatgtgtttaaagaacaaattaatgaaagaatgctgtagacaggccaggtgcggtggctcacgcctgtaatcccagcacttagggaggccgaggcgggtggatcatttgaggtcaggagttcaagaccagcctggccaacttggtgagaccccgtctctactaaaaattcaaaaattagcctggcatggtgggcgcctgtaatctgagctacttgggaggctgaggcgggagaatcgcttgaacctgggagacggaggctatagtgagctgagatcgtgccactgcactccagactgggtgacagagtgagactctgtctcaaaaaa

SEQ ID NO: 694470 - DNA, 226 bp, Homo sapiens
tctgtgtggaaagcggctgtgcagacatttaattgttattatcaaaaaaaaaaaaaaaaaaaaaaaaaaaaaaaaaaaaaaaaaaaaaaaaaaaaaacacacaacacaagaaaccaacaccacaaccacaccaacgacaccaaacaaccaaccacacaccacaacaagaaaggaacaaagagcacgcgactagcgcaacgcactttttgcccggcaccagccgcgc

SEQ ID NO: 694471 - DNA, 217 bp, Homo sapiens
tattatttatttattcttcgttaggtacttcaaattatcatccactgagggtggaaggggagtgagcacacacacttgggaggggtcttgagattatcatcccctaacggtggatctgagggtccaaggggagggaccatacactcctaggtgtcttgagattatcatccgctcacggaggaaggggtttgagctgactctccttacgaggcccttg

SEQ ID NO: 694472 - DNA, 293 bp, Homo sapiens
agagtttcccttcggcagatatgtcgctctgccataagcggtataagatccacaagaaggttcgagaagcatcatcggaaaattaatgaaatggaggctatcaagcagggtcacaagaatgcctatgaacagacccaggagttccaaacagtgctcccttttaggaggctcttcttagggaagctgagcttcggaaacagaggcttgaagaactataacagcagcggactgttgataggcagacagaactagaaaagaaaagaaaacttgaaactaatcctgatattaagcca

SEQ ID NO: 694473 - DNA, 806 bp, Homo sapiens
  misc_feature (806)..(806): n is a, c, g, or t
cctacggctaggtacgaggcctggtttgccgactgggaggcgccgggctgcccctccaagcggcgcaagtcgagtcgcccgacgtggaccaggccagcttctccagcgacagcccgcgggatgacacgctcaccgagcacctgcagagcgccatcgacagcatcctgaacctgcagcaggcccccggccggacgcccgcgccctcgtacccccacgctgcctcggccggcacccccgcatccccgccgcccctgcacaggcccgaggcctaaccacccttccagtcacaacggtggactcggcgccaggacgttgaccagataacaccgggccgcctccccattccccgatccccatcctccacgaagacgccgggaccagcccgtgttgtccgccctcagactcctggggacctcgagccgggaatcccccgtgacggtattacttgcctaagtaataagagtcacaaaggcctccttccctgccgcctgcttcagctgggttgctgaagaggtgggcgtggatttagaggcaggggggctgtgatgtagaacgtctccccttgccaaacggagggggcaaagtgctgtgtcagtccctgttcattcccagtatcctggcacacccatgccctcatcccggggggaaccgcgcatgtgtttgccagggatgaggccacggcgtagatgccaacgctcgggtgcatgtttgctgagtggtcctcagaggagagcagggaggagtgcaggtcggcagaagataactatccgcgccaaaggtgtaaaacggagggggacacccagggn

SEQ ID NO: 694474 - DNA, 290 bp, Homo sapiens
tgggaaggccggtgggtactgcagcctgggcagtgggtggttccagccccatcctcgttccactcacagtcagcccggtgttccacctgagtcagcttgatgggtttgcctgtgatcttgctaaatgtctggtgaatcaaacaatgattgcagcttcatctcctgcagtggacttggtgacttcgccttcataactcagcttcagctatggggacagtgaggacctgactgcacggatctacatgttctttttttctacgaatggtgtatccctgtgtggtacctgaact

SEQ ID NO: 694475 - DNA, 430 bp, Homo sapiens
gcgaattcactagtgattcagccatgttggccgggctggtctccagctcctaaccgcgagtgatccgccagcctcggcctcccgaggtgccgggattgcagacggagtctggttcacttagtgctcaatggtgcccaggctgtagtgcagtggcgtgatctccgctcgctacaagctccacctcccagctgcctgccttggcctcccgaagtgccaagagtgcagcctctgcccggtcgccaccccgtctgggaagtgaggagcgtctctgcctggctgcccattgtctgggacgtgagcagcccctctgcctggctgcccagtctggaaagtgaggagcgtctctgcccggccgccatcccatctaggaagtgaggagcgcctcttcccacccgtcatcccatctaggacgtgaggagcttctctgccc

SEQ ID NO: 694476 - DNA, 253 bp, Homo sapiens
  misc_feature (239)..(239): n is a, c, g, or t
  misc_feature (250)..(250): n is a, c, g, or t
gatgggatttggggataggtttggttatccaaggggcagtgctgagctccttgccaatgggaaacggaatgctggtgatttccaggaagtgacctcacaatgactcaagctactgcttactgttgattgtgatgaaatgccagctgaggcacatgccttgggagctaagtggttgctgcacttgaccgctatgaagactggtgtgggaatggtccttttggatgcacttcagcaggggntccccaacccnctg

SEQ ID NO: 694477 - DNA, 178 bp, Homo sapiens
gggggggaaaaagtggggggggccccccgtgaatttttgggtaaacccccgcgggccccgggggtcccccggggggtaatccggttttacccgggggccctttttttttgggtccaatgttttttattttgggggggccccctttttttttttggccaataaaaggttttaaacccca

SEQ ID NO: 694478 - DNA, 137 bp, Homo sapiens
catacagacggatccccgcccacatatcgttcgatagaggttgtggggaacgtaaatgcatggatagtatacatggtgctgagtgtagatgtgcctatctagatagtctggcatgaagggagaggaagcttagacat

SEQ ID NO: 694479 - DNA, 289 bp, Homo sapiens
  misc_feature (93)..(93): n is a, c, g, or t
  misc_feature (258)..(258): n is a, c, g, or t
tagagagcttataacatcaacatatggagagaataaagaagtagaagaagagaataaagttctaaatcatttcaaggaagtgatgacccatgntatatcatttatgtgaaggggaagttacttaaatcattttatttgtaccacatctgctccagtggtctgtttgacgaatatggatcttaaaagagcgattacattaagctctatgtgcgccgtgtattcatcacagacgacttccatgatatgatggctaaatanctcaattttggcaagggtgtggtggtatcag

SEQ ID NO: 694480 - DNA, 134 bp, Homo sapiens
gagcctattaatgaaagtggggatacggcgaatcggatcaccccacacatttgcggcttaagcacccgtggtgtctttttgcagattagaaaacacgcgagcggaagtgtaggatctcatacattccgttctgg

SEQ ID NO: 694481 - DNA, 849 bp, Homo sapiens
gctggaatctggtcaccttccatccatgcgacaacttgtgcagattcttgacaatgaaatgaagctcaatgtgcatatggatgcaatcccacaccatcgatcatagactaccaccgtatcatggcgacgtgaaaactcttttgcatgtaagggatcattgcaagaggcagcgtgaccttgacgttactgaaggcctgtactgaagacagcaacgctgtgttagttactacgaccagatgctttcttggcaggctcgtgtacctcgttgggaaaagctcaatgcaagaatagtgttgcagtgctggcatatttggtaattcgtgcacattcatgagacgtgcgaacgaatactgtatagctttccccagctcccacaaaatcacccagttcatgtgtgtgtgtgttgagtttaaaggtacaacagttattatttggtacctttttgacttggccctatatgaaaaagtgtataccttgcgttacaattttgctcttatttccgaagactgtctgtgaatctgtggtgctctatatatgcaggtataggtcctgatataggtactaaagattgtcccgttggggaatcagtagaagctcccaaagtactttattaagagtttattcagacatttctatttggccctgtcaggtttatacagtttacgaattctacgcgattgcaagattatgggggaacaccaatatgcagaggccctatacaatggggcgggtggttgtgcgggtggattacagaacaggttaggaaaccatgggtttaggcaatgggttaagggtacggcggcacacccatggatgggaaaatcgggggtcataagaagaaaaaaggtg

SEQ ID NO: 694482 - DNA, 269 bp, Homo sapiens
ccagaggcaccaaggaggcagacggcgctgagagctgagaccgggccactgcactcgagcctgggcgacagagggacactccatctcagcaccacagatcaaaacagcacagactcccatatcttaaatgcatggagctcaactcttgagtattttcagaaacgtttacacatagaagatctgcggattgagaaactgttgacgtataaacgagaacacctacaaggatgtcatcacacccaagattactctgagcgcgaatctataac

SEQ ID NO: 694483 - DNA, 149 bp, Homo sapiens
  misc_feature (78)..(78): n is a, c, g, or t
  misc_feature (119)..(119): n is a, c, g, or t
tctgagtaacgtcgaatcgattttcttaatcccacatcaattcacttccattaattctcaaacatccatgcccaacgntcgcttaccgtgaatgttgaggtcggcaagcgtaaagcgtnccttcccagtttgtttcatagtcctcgcgc

SEQ ID NO: 694484 - DNA, 109 bp, Homo sapiens
gcaggagtcaaggttgagtagtaggaagtgcggtaggtagtgaggataatataagatagttaaatgaagaagtggtgtatgttagggttgtacggtagaactgctatta

SEQ ID NO: 694485 - DNA, 300 bp, Homo sapiens
  misc_feature (261)..(261): n is a, c, g, or t
atgggtcacagcgaccaggatctcctcagaccccagtgggtgcccccaggccctgagcttggaggggctagagctggcccaggcctgccctggagagcctcacagactggcagccagacaggggctgggcatggagtgggagtcaaggaggcttcctaggggaggcagtggctccaggagccctggagggggaggctaatcacacaggatgcggggcctgtggccaggggaccagccaggaccagggcctggaggcagcanagggcgtgtgtttgctgggttacctgctgggctggcctg

SEQ ID NO: 694486 - DNA, 204 bp, Homo sapiens
  misc_feature (164)..(164): n is a, c, g, or t
  misc_feature (194)..(194): n is a, c, g, or t
tgtttagagatcctgtgctaggtgagtgaggtgtatcttggtcactgaactctgcttcctgggtcagcgattctctagctcagctcctgagtagctgggttacaggaccacaacatgccggtaatcttgtatttttagtagagacggggtttcaccatcttggncaggctggtgtgatcatggctcattgcaancttgaattcc

SEQ ID NO: 694487 - DNA, 466 bp, Homo sapiens
aattccgttctaaatatgccagtgaatggagtataatttttctcgggattcagttgaatttatcaatgaaatctaaatacgtgctttcccaagggtcctggcaactgaaagctcccagcttttgcccagacgctcctactcttaacccacaggaaaggaacactcgttggagggtccacgcctgtgtagtgtcgccggcttttcatctcccctgtagagatcgcggcccttgggcggagctgagggtgccggtagcgttttcctccgcgagatggagctgacgagtacgggagggggggtgccctcagactcagcgacaggataaaagactttataggaatttgcacagaaggtgcggggtgggggaggttgttgttgttgttgtttatttatttatttttagaaaaaagctctgcctccgttttattagcaaataaaaattatggagaaatgtaatagccaaaaa

SEQ ID NO: 694488 - DNA, 105 bp, Homo sapiens
gtattagcacctggagtgagaggtctatagaaaacaagtacagtggctgggcgcggtggctcacgcttgtaatcccagcactttgggaggccgaggtgggtggat

SEQ ID NO: 694489 - DNA, 130 bp, Homo sapiens
ccacgccgaggcccatacacttcttgagatcagtgtggacgaagttgttgccaacttcgtccactgggacctgattttaagaagtatactggaggctcggcgtgtgcagtatggttactcggcgtgtgca

SEQ ID NO: 694490 - DNA, 466 bp, Homo sapiens
ttcggagttgcttatgtcttccttttctgcacagatacaggtaaaatctgatactttgttttggcgacatggactatggcgatgtcatagatatggtgcggttgcagttgcaagatgctctgtgtgaattatatacattttagaaaactatgtacagatgaataatttaaaattaattgtaagtggtatttgtggtcttgatagagttggccacgatgtccaaatgtaatattaagcctatgggaaagtcagagccactttgtgtttgtatacttttggagtcagagtctggctctggtcgcccagactggagtggatggggatgatcctgggctcacagaaacggcacacctcttaggtccaaatggatcctggtgcctcagaagccagatgtagcgggattcacaggcctatgccaccactccaagataatttttcgggtatttaaagtaaaaatgcgggtacg

SEQ ID NO: 694491 - DNA, 95 bp, Homo sapiens
  misc_feature (53)..(53): n is a, c, g, or t
gttaaagtgcaaaaccgcacgctttaaataccagcgttcccctggagttcttngcgcctctgtccaacttccgttacggtacttgcgctttttct

SEQ ID NO: 694492 - DNA, 542 bp, Homo sapiens
  misc_feature (501)..(501): n is a, c, g, or t
  misc_feature (518)..(518): n is a, c, g, or t
gcccaggctgtggtgcagtggcatgatcatcgctcactgcagccttgaactcctgggcttaagcaatctcccacctcagcctcctgcacagctgggaccacaggcgtatgccaccacgcccagctaattttcttttttgtagagatggggtcttgctatgttgcccaggctggtctcaaactcttgggctcaagcaatcctcccacccagcctgccaaagtcctggggctacaggcatgagccaccatgccatcttctgctcagctcctttcgtagtctcccgtccccgggccctcctcccccatggctgctcatggactactgcagctgcctggtgcctgctgttcctccatcaggcctgtgtccccatgcccttctgctgagcctacgctcttcccaggtggctgcacagctcccttccttactgaaacacccgctcaccagagaggcctgccctggccaccctctaaggcagctgtatctgcctctcccattcatctnctcatactactgtgctnttcttcctaaatgatcctaccaac

SEQ ID NO: 694493 - DNA, 788 bp, Homo sapiens
gcctggtgtgattccgtcctgcgcggttgtatcacttggagcagcgttctctgaatctccgtaccgacttctctcctacctaagtgcgtgccgacacccgatggacagcattcgatgcccccatggcacatgcagcccccctgaggccccagaactcatcttttcggttagtgcaactcaaagggccgcacaaaagaatttcatccactttaaggtggatacatgcatgaacaatgcagcaccagttcatctttaagcaacggtcagttacaggggcatggtgcaaaggatgagttgcacatagttgcaagccagaggcaatgacattacgcaggcagtccacttcaaagtcaacactggccacttttgcaactgtcctgtcacagccaacaggttacccttgggggcttatgacaataacaaacaccaagtggtcttcaagggtacgacagtgtggttacagggccagctgccatcatcacgtggacagcaccttaagtcagcatcgtgggcggacagactgcagagtacagcaagactgacagcacacgaggaggcctgtgacaactcttccacgtatcatcctgggaaaaaccagcgaacatagaaccctgggcaggtgcgaagcacaagagatacccaccacgaacaaaacgtaacgaccatagactggatcgcagacaagatcgacgacgatgacatcaatcaaccgacggactgagaccacaccacgcgaaacacacaaaagaagaagactgaataaagaacaacacgacaaaaaaccgcca

SEQ ID NO: 694494 - DNA, 1159 bp, Homo sapiens
  misc_feature (34)..(34): n is a, c, g, or t
  misc_feature (183)..(183): n is a, c, g, or t
  misc_feature (335)..(335): n is a, c, g, or t
  misc_feature (404)..(404): n is a, c, g, or t
  misc_feature (427)..(427): n is a, c, g, or t
  misc_feature (457)..(457): n is a, c, g, or t
  misc_feature (469)..(469): n is a, c, g, or t
  misc_feature (475)..(475): n is a, c, g, or t
  misc_feature (504)..(504): n is a, c, g, or t
  misc_feature (510)..(510): n is a, c, g, or t
  misc_feature (512)..(512): n is a, c, g, or t
  misc_feature (534)..(534): n is a, c, g, or t
  misc_feature (540)..(540): n is a, c, g, or t
  misc_feature (545)..(545): n is a, c, g, or t
  misc_feature (552)..(552): n is a, c, g, or t
  misc_feature (580)..(580): n is a, c, g, or t
  misc_feature (625)..(625): n is a, c, g, or t
  misc_feature (669)..(669): n is a, c, g, or t
  misc_feature (677)..(677): n is a, c, g, or t
  misc_feature (701)..(701): n is a, c, g, or t
  misc_feature (707)..(707): n is a, c, g, or t
tcccagtgcgcaagtggctggcggtgtgtgtgtngggggcggcccgggactaggaggggctcggggccaggccggagccgtggtaggcgggtgcagcggctgcgcggcgcggcgcggcgcggggcgggcgtgctctccgcggagagttagaggagttgccgagctgagctccggtggagcganggcgcggagctgggtgcgcgccgagcctctgcctcccgccgctcctcgccctccattcctcgctcccgtcttctcccggccacaccgccactgctgccgcctccctgggaacagtagccgggggagggggactggcgcggtcagagcctgcnaggaggtgcggggcgccggggcgtaggggagcgcgccgggccctgcccgagatcagataacagccggcnggggagggggtgggccggccgtnctcacagcggaccgagggaccgacgccagncgcccggccaancgagcncccagcggcgggggcgccgtccaggcgcncccccnanccgtggctggacagggcgatcngctttncaganagacgcncccctcggatggagcgcccccgggagcngccctgaggcggtggcggcagcgcggcgatgcagcagcgcggcantgccggggccaggaacgccgcccggagctgggaggacgccgagngcgccgcncccgggccactgaccgaggatgtnctagtnactggatcctttccagttggtgcctgggaaatggcagccactactaattcagccttgaagacagtaccgtgcccactcagcaccattacatagaagaaagaactcaagaggagccgccctgcctggaactaagcttggggccgagccagttccccacccccggggatgaccgacgggcaagcgggccacccctaagcattggtcatcgcaagagacggctgacctgcaccatgtcgggccacgggtccggccggagggcgcgcgcgcgggccgcaccgttcgcgagaagccatggactgtggtgcacatgcgaagccacgacccgcgaagtacactgtgactccgcgaatggactccggcccgcccgcgcgcggcacggcaccggcagcctgccggcgcaccgaagcgcggcctcacaacacagcgagggcggccacaccgagagcgcgcgt

SEQ ID NO: 694495 - DNA, 657 bp, Homo sapiens
  misc_feature (52)..(52): n is a, c, g, or t
  misc_feature (404)..(404): n is a, c, g, or t
  misc_feature (474)..(474): n is a, c, g, or t
  misc_feature (554)..(554): n is a, c, g, or t
  misc_feature (610)..(611): n is a, c, g, or t
ccttttggacaagaggcggtcatctaaccatggtcatgccaggaaaagaccnagtctaattccaagctaaagttggtgcgtagcctggcagtgtgtgaggagtcctccaccccatttgctgatgggccattagaaacccaggatataattcaattgcacatcagttgcccttctgacaaggaggaagaaaagtccacaaaagatgtctctgaaaaggaagacaaggacaaaaacaaagaaaagatcccaaggaagatgctgtccagagactccagccaggaatatacggactccactggaatagacctacatgaatttcttgtaaatacactgaaaaagaacccaagggacagaatgatgctgctaaaattagaacaggagattctggaatttattaatgacancaagtaagttacttgcatgaaatatataattagaggtgggagggggcactggaaataaatttaggtacanttttaggagatgttccccttgaagtgtgatttttgaaaacatactgaagtttttaagttattatgtagatttgagttganaaataatttatatcttttcagcagcttgcacttgtcccagattttctgttctaaanntcttccttttctttgcaacatcatcaggtaggtatgatgaaggacg

SEQ ID NO: 694496 - DNA, 530 bp, Homo sapiens
  misc_feature (277)..(277): n is a, c, g, or t
  misc_feature (347)..(347): n is a, c, g, or t
  misc_feature (427)..(427): n is a, c, g, or t
  misc_feature (483)..(484): n is a, c, g, or t
cctacacctagcaaatgtatactcgggttgtttttctttttaaaaatattgtaaaacaggcaagtgaggcttagcagcattatggttcattactgggtttggatatatacctctttcagcttctgtaatgagcaagttgtgttttcaatccccactttcaatgtctatgggagggctgctttttgttttgttttgttttgttttaatcttttttaaacagggacagaatgatgctgctaaaattagaacaggagattctggaatttattaatgacancaagtaagttacttgcatgaaatatataattagaggtgggagggggcactggaaataaatttaggtacanttttaggagatgttccccttgaagtgtgatttttgaaaacatactgaagtttttaagttattatgtagatttgagttganaaataatttatatcttttcagcagcttgcacttgtcccagattttctgttctaaanntcttccttttctttgcaacatcatcaggtaggtatgatgaaggacg

SEQ ID NO: 694497 - DNA, 479 bp, Homo sapiens
  misc_feature (52)..(52): n is a, c, g, or t
ccttttggacaagaggcggtcatctaaccatggtcatgccaggaaaagaccnagtctaattccaagctaaagttggtgcgtagcctggcagtgtgtgaggagtcctccaccccatttgctgatgggccattagaaacccaggatataattcaattgcacatcagttgcccttctgacaaggaggaagaaaagtccacaaaagatgtctctgaaaaggaagacaaggacaaaaacaaagaaaagatcccaaggaagatgctgtccagagactccagccaggaatatacggactccactggaatagacctacatgaatttcttgtaaatacactgaaaaagaacccaagaagaattgggaaaacttctgtgaaagaagaatgcagaaacaaagaaatatgaagtcttgggagtatactgattaaaaagcacacattgggagtgatagtaagaagagctaaaataaaaagcacagaaggaaa

SEQ ID NO: 694498 - DNA, 387 bp, Homo sapiens
agctttctgaatgttcaccgagggaagaaatatataagatacattaaaaaaattgaaaattgttttttgtttttttcagtctaattccaagctaaagttggtgcgtagcctggcagtgtgtgaggagtcctccaccccatttgctgatgggccattagaaacccaggtaggtcatttgcaggagtaagtgtagcttttgcgcttggcagttgtttggtaagatgtagtatggcagtcacagcaacatcagacttgaaaatcagggtagaaggtacttcagaacaaaagctgttgtagtaaaacagggcatggtctctcctcccagctgtgggttccagtggcagtggcagtgctgacagacctgcaccagggaggagggggacccat

SEQ ID NO: 694499 - DNA, 342 bp, Homo sapiens
cccgacattaatgcaaacaggcttattagaatgaatgaactaaaggtgtctaccacgattatttttcgtaactggttggttaataaactgtacctgctctcaaattgaaaaaaaataaaatataaaagcagtgcttacttaagttgtcatgaccctcggggggaaccagaagcactgcctctccacgctccaggatgccgcagctggcgttgtccacatcggtcccacctcgctttacaaaacagtcctaaagcttaatcaattgaaacttattgtacaccacatttacttagaaaaaaagagagttgggtaataggaaagccgggccggtaggctccatgt

SEQ ID NO: 694500 - DNA, 146 bp, Homo sapiens
tcacctgcgtgcaattcaaaaccagcctggtcaatatagtgagaccacatccctactaggaagaattaaaaatatatatataaactggggccaggtacgatggctcacgcctataatcccaacactttgggaggccaaggccggtg

SEQ ID NO: 694501 - DNA, 304 bp, Homo sapiens
acatttattctataagccaggcccacaaccacataggacctttgggccaagttcaaaggaaagtaaagggcagaggaattttccacaatccgagggtcccagggctcacgctgacagctccacctgggcattccagggatgcagctacccccaacaccctttcccttgaggtcaagcggagggcgccatcttgctgggacaggtcagatcactgtgtctggtgttcacttttgcctaagcttcttgataaaggaaacctcatcttcggttccggatgccataatctctgaagcttcttccttgt

SEQ ID NO: 694502 - DNA, 325 bp, Homo sapiens
aaaaaaacgtgtgtcatttcagcctattcagtgcattctgcagcacctgctagaatatttatcctccttctctttccacttaagtcctacatttacataaaggctactggagggttccatgttgaagcaggttttatttgcaaaactcagcctccatggatgtgtctttctgcagcattcctttgtgcctctcattatcacctaagggtttataaaatgggcagtggtaactctagttttaaatctagttaactctagagattaaaatccagtaactctagattaaaatctagtaactctcagctattgtgaacaagttgaagtt

SEQ ID NO: 694503 - DNA, 149 bp, Homo sapiens
tgaggatccccaaccctgccacccacagcccgactttatggataggatttgggaatttttatagatgctgttccatctggtcccttaaacagccatggggaaggctggcaaatagctttcttttattttttgagatggagtttcactct

SEQ ID NO: 694504 - DNA, 201 bp, Homo sapiens
cgtgctgcatcacacaggcgaaatgtggcgggcgctggaaaacgcggcgctgccgtgcaacctggcggacggctttttattgcaatttcaacgacacgggcaatcaggcggtgcgctggaaagcgatcaaaaaattctacaaccgtttgccgaaatttttgcgcaaaccgtttgccgtcgcggtcgtcgcgcccgaagaat

SEQ ID NO: 694505 - DNA, 1893 bp, Homo sapiens
  misc_feature (1198)..(1198): n is a, c, g, or t
ggcgtgaggtttcacagaaggttctccgactgcccgagtacatggtgtccctcgagctgcctgcctcggaagcgcaagagcaggcatcgtggggaaggtgaagagctaccctaaggatgacccgatccaagccggtccaccgtcacaggccttcctggcgtagtacaaaggctggcgatgcagctcacgatcggtggcgggaagtcagacgatggccgaggatccaaggatgagatccgaaggaatggaggtggtgagaggctggtgaacgagtggtcgtagaacaacctatccgatggctgggttcgtgggctattgtggcgagcgtacgtgggaaaccgcctcgtgagggcttccaggaatcttcaaagcaatggtcttagctgtagcacatcaggggatgcaatggtcgagtaggcgttgcctataagaattgtgcattgaatctaagtaggaatgggcttataacgcaatgtactgaacagaagatggtcggagtgatggcctggacaaaagaatcagactagtggatgacgggacgtgcacgaagcatgagaatacggtactgcgcacagtcaatccggcgtcagtggggccgagtagccagtatgacgacctgcttggctgtgttgcgactagaaaattgggcaacctggatggaaggatccgaaggtgagccgtcgtagcactcggggcaggaggaatccggaattgggcctgagaagatggattgagctaggagagtccctagtcgaaccaaaaatgtttgggctccgggtcactgacccaccgggctaccgggtgcccccgggcaaagggtccacagcgacgcgctcggttagggggcaccagtaatgggcccgaacccaacggggcgcgagaaagacgggaagggccaaactgggggcgccacgagagacgggaagaggagaaaacaacagcgcccaacaggagaagacacgctagcaatagatagaatatacacagatacgattgttgtgtgtgtgtggtcgactgcggactcacatcaccgttcgtccaccaacagcgcgaacgcacaacgacaacacagcaacccgcaccacaccccacacacacgcaccacgacccacatcagaccaaacaacccagcaacacagacaacaacaacaccgagcacaacacgacacgcccacacccgactccacccaccacaacnaccaaaaaggacatacatgaagaccaccaaacgatagagacgacacgagacaccgagacggaagcaccggaccagacacagccgccaaccgcgtaagcatagacgtgcgagcagaagcaggaacggaaagaacgagtacaaagcgacaggagacagcgagaactatacgacgaacgaccgaatcaagcgctcgaacgccgcaagcgcgacgacgagctgtgagagaggagcagacgaaatgaggagataagacgaggtgcggagatcacagagagaaacgcacgacacgtaagaaggacaccaaccaactatccaaccatataccgaatcaatataactacaacaccatagaaccatatataatcatccaacatatcctcacataacaatatacatgatcaaaatcattagcatctctacaatcaccacccaataatcgataaccaaaatacaaacacgacaaactacgactcactaacagcacaagacagacacaacactaacaaatcaaatactgataaacaacccatataacatacctaacaatcaaacactcaacaacccaccaatataacacaacacaaaaagaacgatagctaaaaaaacactaaatctctaagctaactactagacacaagacacacactaagaccaccaatttaaaaatataaacataagaacaaaacaaccccaca

SEQ ID NO: 694506 - DNA, 254 bp, Homo sapiens
ggagcgacccttgtctcctgtgggtcgagttgatttcctgtggaaccgaagagtgcgcgcctgagtcagtgttcctatcacagcgttatgtagccgaaatagtgtgctgcgcagcttgctggcgccgtggagttatcagttcgtacacgtgcacggaatatgaatcgatgggactatcgtttccaaggttacgatcaatcgcacgtatgccgggatcgcggtgacgacacctgtcgaccagaggatgtgttcta

SEQ ID NO: 694507 - DNA, 419 bp, Homo sapiens
agagacagggttttactctgtcacccaggctggagtgcagtggtgcaattatagctcattgcagcctcaaactcctggcctcctcctgccttggcctcccaaagtgctgggatttcaggttgcaccactgcacccagctgattttgttacagggttttactctgtcaaccaggatgagtgcagtattgcgtttatagctcattgcagcctcaaactcctgggctcctcctgccttggcatcttgagtagctgggactacaggtatgtaccaccatgcctggctaattttaaaattttctatagagacggggtcttgctatgttgtccagctggtctcgaactcctgggctcaggaggattgcttgagccctaggagtttgaatccagcctgtgcaatacagcaagatctcatctctggg

SEQ ID NO: 694508 - DNA, 122 bp, Homo sapiens
tcttttcttgcccacttactctgcccgcgtatacccgcttccactgtgcacaatcctctcccttctttttcccccgcctggcatcgcccagccctctcgtagggcatgttccccactctgga

SEQ ID NO: 694509 - DNA, 378 bp, Homo sapiens
  misc_feature (172)..(172): n is a, c, g, or t
tgaggttgaggtaaactaatatactaaatattgccataagatctaagtgcctcatcagagatcactacaaggtctagctctgatcttccaagcagtcagtgcaaagaggataatttcaaaattcacgatacaatttacagtaaccataaaaaatgaaccagaagcttaggtnaagtagctctggaactttctcctgtggatcctcataaaaggacactgtgatgtgttgaaccatgtcctggacaacattcctaccataaatgcagtaaggagtctcacagggctgttccttaaagcattcctcagtgagggctggtggcacagcaccaaatgctcagttcagtaaaagcaattctttaaggggccaaaaccattcca

SEQ ID NO: 694510 - DNA, 250 bp, Homo sapiens
cgtcgacatgcgggccgattcctcggtatcccggatgagatcgaggacgccgcctatatcgacggtgcgggtgaagtgcgaaggttcttcaccatcttcctgccacaggtcaagggatccctcgtcgtcggcctgacagccttcatcttcgcgtggcaggactatctgtggccgctgctcatcactcagtcctcctcgaactacacgatgatgatcggtaacgcacagtgtcagcctcattcggaacgga

SEQ ID NO: 694511 - DNA, 108 bp, Homo sapiens
cgctataggcctgtctaataggtatcttcttttttataccacgataactacttccactcacaatgagatgaatcgtcttatttacagaatattagggattccaagtag

SEQ ID NO: 694512 - DNA, 252 bp, Homo sapiens
ccattttccttggaaccccccccccccttttttttccccccaaaaaaaacccggggccctttcccccccccggtttttaccctagcccgggggggggatacctttttccccccggaaccccttttcccctttggcccttttttggtccccctttaaaccatttttttccaaaaaaccggggggggcccggcccggatttcccgggtttttttccccccccgctcccccggacggttggggggggggttggga

SEQ ID NO: 694513 - DNA, 367 bp, Homo sapiens
tatttccttagctttagtgtttctgtagagaaaagagatggatttcaatttttttgcatgtcactctgacaaagttctgtttcccttacagcagccaagaaactaaaataaggctaggcttagtggctcatgcctgtaatcttagcactttgtgaggccaaaatgagaggatcgcttaagcccagtagtttgagaccagcctgggcaacatagtgagacttagtctctataaaaacatttaaggctgggtgcggtggctcacgcctgtaattccagcaccttgggaggctgaggccagtggattgcttgaggccgggagttcgagaccaacctgggcaacgtggtgaaacccgccccccatctctgt

SEQ ID NO: 694514 - DNA, 737 bp, Homo sapiens
gcctttgccgatccgccgccgtccacacccgccggtcagctcaccatggatgatgatatcgccgcgctcgtcgtcgacaacgggtccggcatgtgcaaggccggcttcgcgggcgagatgcccccggggcgtcttccccctccatcgtggaggctgccccaggcgaccagggcggtgatgcgtgggcatgtggtcagaaggattccgtatgtgggcgacgaggcccagagcaagtgagaggctgtcctcaccctggaagtaccccatcgagcacggcatcgtcaccaactgggacgacatggcgaaaatctggcaccacaccttctacaatgagctgcgtgtggctcccgaggagcaccccgtgcttgctgaccgaggcccccctgaacaccaaggcaaccggcgagaatgatgagccagatcatgttgagacgcttcaacaccccagccatgtacgttgctatccaggctgtgctatcccgtgtaacgcctctggccgtaccactgggctcgtgatggactccggtgaccgggtccacccgagaatgtgcccatctacgaggggtaatgcccatccccaatgccaatccttggagtctggacctggcttggccgggaccctggacttgactacctcatggaagatccttcaccgaagtcgcggctacaagctttcagcagccacaggcgaacggggaaatcgtgcgtgacattcacgggaacgctgtgtacgtcgc

SEQ ID NO: 694515 - DNA, 160 bp, Homo sapiens
ctgattacgatggggacggacttagcctccactgtgagagtaagccgaatctcggcgtcgctgatggtctagggggctaccgagggggtggggcagtgtcagtcttcaggcgggtaagccgagaagatcccacatgtcttctgtctgatgggtaccgagg

SEQ ID NO: 694516 - DNA, 585 bp, Homo sapiens
cacaacattagccgcgcgcacaacgtacagtagagccaccatgaaccaaccgcctgacatcaaccagtaccggccgccgaaacgccacggggctggatcgccgtcatcatcgtgacagcgctcgtcgtcgcgctggtcatcgttgcacgccgggtcacgaccgagccggcgaaccccgtcacgccgacgccgtcccccattgcgacatccgcgtcctcgactccgacgcccattccggcatcggctactgcggtcgcctcctctttacccttctcctcgaaggatgatgacaccgaggggaggtggtcaatcgaccacgtggaatggggacctaacaccgtcaccctgacggatgaccatcggcggtcaccaagggttctttgaccgactacaccttcttcatcatggagaaccagtcaaccgatatccatcaggcgagccagcccccctacaggctcactcggcactggtgtatcccaaggccacaaggttcacggcacgatcacgatcgattgtccacgaaccgatgccaccgtcatgcttacccacgggtcagggatgtcctcccccatttcggcattaatg

SEQ ID NO: 694517 - DNA, 299 bp, Homo sapiens
gtcctgactcggatatcacagcagagcctgtcggaaggctgccacgagcccgagggcagtctgatcacggtcttgcccagaactgggtctccacatccacattggagatttcagtcagtatcatgtcttaggaatcttgatcttgactgttgtccagagtactatggcaataggtgtccacacaccagacttcacccgagtcctaggtcttatgttgaacgatgtagcatcttcactgcatggaggcggccactagggtcggtggcagaagtgcaagcagaatggcctcctatgatgca

SEQ ID NO: 694518 - DNA, 1220 bp, Homo sapiens
tagcctcacaagctagtacagcacctgggactgggtaagccagtgacatagcgaatgaatcaactaaatagtgtagtattagtctgtatctcatgctgctaagtaaagatagtaccccaggaccaggcacaggtgaactcatgcctgtaatcccagacccttaggagaggtagatgcaggcgagatcacttgaggatcaggcattcgagaccaggcctggccaacaatgggtgaagacgccgtcgtctactaaaaatacaaaacaattagccaggcatggctggcgctatgcctataaatcccagatacttgggaggccgcatggccggagaatcacgtatgcacccgggaaggcagaggttgcaagtgagctaacgatcgtgccactgcacatccagactgggcagacagacgtgagattccaatctaaaaccacaacaactacccaacacggggataatcctctccacgcgacacgacggtcgacgcagacccacagacaccacaatggcctggcggacgcacctcacaactcctggcaaccagaaccccgggacatctaacatggccggcccgaaaagaaagcagctgcaagggtgattatacagccatgacatacacacagcatacacagaatctcaatgagcacaccaaatacacgataccgaccaaagaaataggacagagcgaaaaaaaccgcacccaaggtgaacaaaagcaaaaacacccgacaggagatacagcccacaggaacacaccgaaaggaactaacaaggaaggcaaccaacctccgcgcactgagactcggcatgacggacataaccaccaaccaaccacatgagcaacacccagtaacccaacggcaccacacacaccccacacaacaccacaaaaaaggcaaagacgcagacaaccgcgcacccaaaccaccagacacaaaccgcacgacctataaagcgccgaccaaggtccgcacacaccagactccgaaaaccacggcgagcagcaccgacgcacaccccagagcaaagcccacacccagcaaggcacaaaaccgggaaaaacatacacccaaaacgacaagaagaaaccacacaacagatagagtagacacccacacacggcgggagcaacagcgcacacacagacaaacaaacagaacgaaagaagacaaaacccaaaacgagaagaagaaacagccacagaccaagacagacgcc

SEQ ID NO: 694519 - DNA, 123 bp, Homo sapiens
cctctagacggatcccctcggaaggaggtacggacaagacgacatagggcctacttacacaaagcgccttccccggtaaatgatatcatctcaatttagtattatcccctcttccccagccag

SEQ ID NO: 694520 - DNA, 169 bp, Homo sapiens
gggaaaaattccccccaaaattttttttttaggggggggtttttaccccggtaaaaaccccttgtttttttccccggcccaaaaggaaaatttttttttgtttttgggggccccccctcccttggggtttaaaatccccttttttggttttaccccggcgccgggggga

SEQ ID NO: 694521 - DNA, 127 bp, Homo sapiens
tccgtactacagacagaagtctcagagctcagcagattaatgatcagtcgaagttggctttaagtatcatagagcaagattaacgaagtcccagaatcatcccaaagcggatattattgagaacttt

SEQ ID NO: 694522 - DNA, 1053 bp, Homo sapiens
  misc_feature (193)..(193): n is a, c, g, or t
  misc_feature (216)..(216): n is a, c, g, or t
  misc_feature (800)..(800): n is a, c, g, or t
ggtgggatcaggcagcagagcttttttcccctttgccttgatccttcgcaaggctgagccactgggctgtgggggaaggggtcaaggccatatcccaactacgtgtagggcgagggtccctgctggcacattcaggctgtgctgggaagaagagacctgggcttggaaggaaccggtccccgacggtttctgnttgcctcgcctcttccccctttngtcagctgagcagtttgtggtttctatgcccgcaagtttcaggaagtattcacaaaagaaaaatacattttcttcccccaggggtggggcaaggacagcggcagagcagtgctacggaaactgagctcccctgggcacaaggggcaccgggccgtgactgtccaactactctccgcgctcccaacgcgcaccggactccgcctagcgaccctccagcaccacacacgacttcagcacccctcagacctgccccggggccaggctggagaacagtgacgggccgctacaaggcacagtgaaactctctgagttgccggggctaagccctgaccccctcatccatgctccccgcccccaacccactctggcctcagtcacatcccccccctcagctctgctggtcgtccgcccccggctggcacctgcacgtggccgccactcttggcctcacctgcacctccacccttccgcgcctcaccccgatactccacccctcacccctcctgaccacccccgcaccgccgcgcgcccccaccacgcccggcctaacccccgcaccccccacccacacacgccgccacacnccgcccgccaacccgccccccacccccgccccacccccacgccaccccaccccccaccgcgacatcacgcgcaccccgcgccaccccacacgcccaggcccacgcccccccccggccccccccaccgcccccccgcccctccccacccccggccccgcgcccccgcaccccaccggccccacaccccgcccccacccaccccccccacccccccacccccccacccccccaccccccccaccgcccacacccc

SEQ ID NO: 694523 - DNA, 449 bp, Homo sapiens
gcgtggtcgcggccgaggtacggaatataatggaatggaatgaaatggaatggaatggaatgcaatggaatggaatggaatggaatggattcaactcgaatggaatcaacacgattgcaatggaatggaatggaatggaaaggaatagaatggaatcaacccgagtggaatggaatggaaaggactggaatggagtggaatggaatggaatggaattaacccgaaaagaatgaaatggaatggaatggaacggaatgtattggaatggaatggaatggaatcaaacctgagtgcaggggaatgtaatggaacggaatgcaatggaatggaatcatccggaatggaatggaatggaatggaatggaatcaaccctagtgcaatggaatggagtggaatggaatggaatggaatggaacaacccgtatggaatggaatgtaatggagagta

SEQ ID NO: 694524 - DNA, 261 bp, Homo sapiens
aggaaaaaaggatggagaaatatctaggaaagtgtcttctcagaaaccaccaacctttgaagggtacaagtagacgaggaagattctttttttgggaagccagagaaaacaaaggatggggaaaatctaggacagtgtttttctgagaaaccaccagcgcttgaaggcttcaaggtaagagaaagattctgtttttgaatatagccagagggaaaaagtatggagaaaaatctcaggacagagtttttctgagaaaccacc

SEQ ID NO: 694525 - DNA, 560 bp, Homo sapiens
  misc_feature (193)..(193): n is a, c, g, or t
  misc_feature (216)..(216): n is a, c, g, or t
ggtgggatcaggcagcagagcttttttcccctttgccttgatccttcgcaaggctgagccactgggctgtgggggaaggggtcaaggccatatcccaactacgtgtagggcgagggtccctgctggcacattcaggctgtgctgggaagaagagacctgggcttggaaggaaccggtccccgacggtttctgnttgcctcgcctcttccccctttngtcagctgagcagtttgtggtttctatgcccgcaagtttcaggaagtattcacaaaattagccaggcgtggtggtgcatgcctgtaatccagctacttgggaggctgaggcaggaaaatggcttgaacccgggaggtggaggttgcagtgagctgagattgcgccactgcactccagcctgggcaacaagagcaaaactccgtctcaaaaaaaaaaattgccgggcgcggtggcaaatgcctgtaatcccagcactttgggaggccgaggcaggtggatcacaaggtcaggagatagagaccatcattgctaacatggtgaaaccccgtctctactaaaaatac

SEQ ID NO: 694526 - DNA, 749 bp, Homo sapiens
caaagtgtagcgttcacgaaatatatactgctttacacacagagatcaagcatatccttttacaagtggctatacatgtcctaaaatgccataagaaaatgcaatatctgggtactgtatggggaaaaaaatgtccactcccccataaataccagtggcatttcagctgtgcaagtaactgaacacaataatgctgtcgttaatttcgtggttatatcagttaaaattcacaataatgtagatagacacaagattacagacgaagcgcaacagaaagaaacttgaatgaaatggattttacagaaagctttatgatacattttcgaatgcattatgttatttattcgtgccatgcattgtatattctcaccagagagtgaccttacctggtaatacagatcttgatttgtctgttatacaagccatgtatctattgcaatgtacatactgtacatgttcaactggtaacagttatctgttcttattaaaacatcatcccatgactgggaatggtgtcgatatattggaaactcttggtgagagacatgaatggtgtgtatacatacgtctggtaccattaatacaattactcctgtaattactagtcttaggttcacctttagaagcctcgatctaatcggaagaattgcaagaaacaactataaacatacgtaacagatctaataccttacgaaagacaagcctggcaagtcaaatggtcccaggctcggctttgcgttgaaaccaaa

SEQ ID NO: 694527 - DNA, 351 bp, Homo sapiens
gaatgcactcgggctatatatggatattgtgctgtatctgtgtttgtgtctgtgtgtgacaccatgaagataatgcctgtggttatgctgaataaattcaccagatgctttctgttagcttcagaaattattttaaggtttcttaaactcaagttatacaactaaaggcctttcttaagctaatgatatatagagtgaagagcacgactctggcaatggattgccattttataggagacctctatagaaactgtctagataaatggggctatctatactctgaatattattctattactccaggggacccagcagtgctctctcgtgtgtgtgtgtgtgtgtgtgtgtgtt

SEQ ID NO: 694528 - DNA, 532 bp, Homo sapiens
tgccactttggcataaggatgatttgagctgaaggcaattgagaaaaagcagacaggatgagctttctgccttttccctttctgcctgaaaaacagggtgtacatttccttgtgaagccccctcaccttgtccataccaggaaggggagaacggccttatcaccggagagagagatggcactgagaagcatctacacagacaagccttactaaatagccctatctaccatagtgtcccccatatgtttaccttcccacagcttactacccctaaaacattcagaagccactttcctttgccttgtcacttctccacaaatttatcatcctttgttagtatggtataaagccaccaagtctgctttgtggggtttctcttttatgaagcaccaccacctcccccatgccaggtaacacttttaacattagggagtcacgctgaacctattctggtttaggggtccacccgatttgaaaaacaaaaaaaacaaaacttttaacatgaaataaaatgtgtatgtaattaaaaaaa

SEQ ID NO: 694529 - DNA, 112 bp, Homo sapiens
cggagaactctgcaaaacaagaggctgaggattgcggttagaggataaaccagttcaggccggagcccgttaaggaaaggcatttccgttggttccgcccgttctcgggaga

SEQ ID NO: 694530 - DNA, 366 bp, Homo sapiens
  misc_feature (120)..(120): n is a, c, g, or t
  misc_feature (351)..(352): n is a, c, g, or t
  misc_feature (356)..(356): n is a, c, g, or t
ccccgccttgcagtctcccagccgtgcggggccggggaagccgaccggcctcccagacttcctaaggaccgccgggcccaactttgtactcatccaccccagccggcttgggactcaganaccgaagtctttttttttttctctccgatccttggacacctcctctgtctgccatttattagccatgtgaacttggccacatcacttcacctccctgagcctcagtttcctcatctgtcaaatgggggtttataaacacctacctcgcagggttgttgtgaggatttaatgcgataatgtatgtaaagcgccttgcacactgcctggcacacagtaggcgctcaataaatnnttantcttcccttt

SEQ ID NO: 694531 - DNA, 211 bp, Homo sapiens
gggagagaggttgcagtgagccgagatcgcgccattgcgcttcagcctgggcaacaagagcgaaactcgatctcaaaaaaaaaaaaaaaaaaaaaaaaaaaaattgttggcttttgtgggcattaaaaattgggattcggtttggtaaaaggaaagggaaaaagggcaatttaggggaaagcgggatctagattgatgtgagaaagaggtt

SEQ ID NO: 694532 - DNA, 137 bp, Homo sapiens
  misc_feature (63)..(63): n is a, c, g, or t
gctacctacgctgggcaggtcccaagtctgaagctagtattcatgatggtgggggatggagtntcttccgaggttcttgggggaaaacgaattgtaggatattatgcgggaggcaattaaccgtgttcggaactttt

SEQ ID NO: 694533 - DNA, 319 bp, Homo sapiens
agttgccgcacgtgacgatacgcggcggtacgaggccgaggctcgtgatgcgcttcatcgatcaccagcagatcgaggatcgggatggcagcgagatggttgtcgcgcgacagcgtttgcaccatcgcgaacgtggcgcgcccggaccaggatttgtccttggcatcgaacacggaggtcctgacgcccggattcacccgtgcaaacttggataggttctggccggtcagttcatcgcgatgagcgaggatgcaggccttggcatctggctcggccaacaagctgccggccaccgccgacagcatgatggtcttgcccc

SEQ ID NO: 694534 - DNA, 445 bp, Homo sapiens
ccggattacaacctcgtctggcgcgggttccgcaacgggcacgtcctccaaggtgagccgcagttccccgtctcgagtaacaagcgatcgcagttccaaggtgttagtacccataatctctcctttcgtcccagcgccgagctcactgggctatgaaattcgcccttgtgtttgccagatccccggccgcggcgtcggcaccaccctctcagaccgggtacggccccttggcaaacacctcgccgtggtagccctttgagcccaccgctcgcgccaaggggctctggaaatcctcaccgcggtgcaaactccccaccactgagttgaaatcgtaccgcggctgccatcccaactgggcgcgggccaattcgttcacatacacgcgatctatcgtcggcaccatcgaccagccacgccgccgaaattccgcctcgtaacccggaga

SEQ ID NO: 694535 - DNA, 288 bp, Homo sapiens
tggaataataatttaatgctcactggggccctgactgaaagtcaagctcaggcacaattagggccatggctgggctcccaccaatgaggatacacgcaggcaaggaggttggatgtggtggtgtgggatacacgataagggcaaagggagctcataaattgggcccagactggctctgggttcaaaggtggagggtccacgatggacaagtctggagggctaggcaccttaggaggagtgattaaattggctccctttcccaggactttacagacacgatggggggtt

SEQ ID NO: 694536 - DNA, 128 bp, Homo sapiens
ggttaccaggcaggaataactggcgacgcttgtgagaccccagcaggagagcggcaagttgtcgctggactcccgactcacggattcgttgagataatagagatggagtgtcacaatgttgccaaggc

SEQ ID NO: 694537 - DNA, 920 bp, Homo sapiens
  misc_feature (24)..(24): n is a, c, g, or t
tgcgtcaccaatattgcggtcgtnatgccgaggggcccctcttgaaaggtcgtctctcccatgcgcgcctcaccatatttggtgttgctcggatagcctcttattcggctgccgggcaaagactacggttccgggacagcaaacggctccctttggccaggaaacccaaaatgggggcccacaggactcgcgcggtggggtcgcgacccgtgtgtcgcgcgaatgtggaaggactcccctccccgcaagggggtactctgggtgctggggtggccacacagtgtttgtgttgcgccccacagcccgagtgggtccatgtagggtttttggagaagccctttaacactcctgtccttggggcgcgccccttaaaatttgccaattcccttccgagacccactaaaagcttcagagctcttatctctgggcccaccaaaactattgcccccgaaaccgcatcggccataacattacgttgggtccatagacctgtggcaccaattctccacccttgcccaatgcccaccagcgagaccatttttcggcttcccctcgtacacaatattcggtaaaaagcggtgcaatttacacaccacccatacttcaccaccatctaacctcctacaaactcgataatttgtcttctccccgttatcggaccccccgcggtccaggaacttaacccaatcgctcattcacacgggacattcacacaccacccttcccccttcacacggacacacattctccctccgcgcaccctggttatgcccacccctctaacccccctcggtacattctgccctccagtctccagacgtagacccaccacgctttcgccagaagggcgtaaactttcccaacctagcagttcggggcacaatctcccaaccatggccccacacccaaccgccaacatc

SEQ ID NO: 694538 - DNA, 675 bp, Homo sapiens
gcttgaaggtcattttataacaacatttgtgcataaagcaaagtttgactgcattgacggcatttgatgtggaatttttttcacatttgaagtacttggattttttccttttttttgagacggagtctcgctctgtcacccaggctggagtgcagtgacgcgatctctgctcactgcaagctctgcctcctgggttcacgccattctcctgcctcagcctcctgagtagctgagactataggtgcccgccaccacgtccggctaattttttaaatttttttagtagagacggggtttcactgtgttagccaggatggtttcgatctcctgacctcgtgattctgcccgccttggcctcccatagtgctggaattacaggcgtgagccactgtgcctggccggattttttcctttttttagtaaaaagtagagacagggtgaccaggtacagtggctcatgctgtgcaatcccagcactttggaggccgaggcaggtggatcttttgaggcaggagttcgagaccagctggcaacatgatgaaacctatctctactaaaaatacaaaaattaggctgggcatagtggcaggctttgtatcccagtatcagaagggtgaggcaggagattggtgctggatctgggagggagagttgagtgagcgagatgtgtgggta

SEQ ID NO: 694539 - DNA, 116 bp, Homo sapiens
ctacaggatccccctggctaagagaaccctcacaacaagttttgcctccttcatcgcacgaggctgcggtttctagtagtcagcagatacaagctgctcggagactcatagttgga

SEQ ID NO: 694540 - DNA, 502 bp, Homo sapiens
tgagccggtcccccccgcggaatgaggctagaagtatcacagccatccttcggccggctaggagagtcaggtgcaagaagggtttatggactctgagtaaggcaagcaggggctgcctgggaggcaaacgccgcggtctggttgcactggcctttgagatgggcggctccttcatgccatgggcaccgcagaggcattggctctgatccttcaacgctgtcgcagggctcctgaggcttagagacggaggtcacctcctgagtcatacacagctgagacatcagtgacaggagaggaccccaactgcgtggataccagagcccaaggccccggaaaaggccatttcgcgtgcctccagggtatggcctgcctgaggaagctgttaccccactgacgttttcgtagcaacaacagcttcctcacagaagaggaggggggccgagatattattcccattcgacacagtaggaagctggggcccacgggggccttcgggggcaga

SEQ ID NO: 694541 - DNA, 148 bp, Homo sapiens
atacattgtctgatgacaacttaattgaaggtggtggaacaaaatttgtctgcatacctgtagccagaaacattaccgtcatattccacccattactaagatttattcaggagattgagcatgctctgggtcttggcccagccaaaca

SEQ ID NO: 694542 - DNA, 242 bp, Homo sapiens
aaaaaggggggggtttttttttttgggggcgggggaaaaaaaaccaggggcccccccccccccccagggggtttgggggttttcccggggcccccccggggggggtccccccccccctttggaaggggggggggccccccccccccggggggggggggggggccccgggttttggcccggggcccccccgggcccccgccccccgggccttttttttttccccattattgttttttttttta

SEQ ID NO: 694543 - DNA, 203 bp, Homo sapiens
ctagattgacttcatagcaagcctcgctaatctcgcctgacctccccagtgattaacactacggggagaactctctgtgctagtaaccacgttctcctgatctaatatcactctcctagttccaggattcaacatactagtcatagctctctgctgcctctacatatttaccacaacacaatggggctcaggtcacccaccct

SEQ ID NO: 694544 - DNA, 1394 bp, Homo sapiens
ctatgtgtgctttgggggtcgtcacgggtcgttcgccatcgcctctgtgttatgctccggaggagtgatgtgtttgggagaggggcttgcccccctctcttcgcgtgctgctcggtgagcaggatgtaatagaggggctcgcttgtggcgcccacacggacgcctaagaagggtcacgggaggggcacttgctagacccactggtccgttgtcgtagtgccagcaggttatgttgttccccgaccgcgtgcgcagggagggtaggcttctccccccggcgcttgtggtggctacccccccgtgtgggtttgatatgccggtcggggtcctctgtgggggcttcatctcgcccgtgggtgtggtgtgcgcctcaccaaccccccctcacccaatgcctgcccccccccggggtagggggtggctgcgcgcgcccctccagcacaggagtttctgttggtagcacacgcgtgtgtggggatgcaaatatccggggcttttacgaggcgaaggatctctctctgtggggacgcacacattcgtccgcaagagccctcttctgctgaggggaagtattgtttacctcgcgccaaaacttgtgggctgccgacctcgaggcggggcgcacgcgtgttggacgccgcagcgattgggtgttggttcgcccgggggggaaccatttgttctccaagcgcacgaaaaccaccttgggggtgcgcgcccccccctccgccagagacgctcgcgccggtttgttgtttctctccccctacatgaggagagcgcgagcgctctttctcccacaaaagaggtgatattcttttggcgcgtgattgtgttgaggattttctcctgggtgagcgcccctggacgcactatctccgccgtgcgccaagtggaatttccccccggacatttctttcttctcgcactctccccccgaggcgccgggtggtcgttgtgacacttctgtgatcgcacacagtctccctgtctcagagtataagagggcgccacatctttctcacactggccacatgtgcgctgggtacacatggcctcttctcacaccccgggggatgtgccaacctgtcgtctgtagaccagacgtggggtctacatccccacgttctatctactggcgttataaacaagatgtcttgtgcgtttgtatataagccacaccccatgtgatgacgccacagcttgatgtacaccaggatttgggccagacaacacaccaagtgtctgcccagagatggtttggcacgtctaatggggggacaccagggggtgtacaataggccacgcatttaagattttggggggtttttacaccccccaaaaacaccctccgggtgggccctggttttaaagggaaccccccgactttccca

SEQ ID NO: 694545 - DNA, 375 bp, Homo sapiens
cggctttctccgtccataggcaccgcgtgaagggcaccgtaagaatcttcccgaatgctcctgtcacgcgtcgcggccgcctcttcttcctcaccgccacttcctcaggccaggcccgcggataacgcctcagttgcgacccagctctaggcagtccgcaggggcctccgccggggagggaaggcacgacctggggccgagcggggccaagccgcggggcagcacgccggggcaggctcgggcgggcgctgtcgccgcgcggactgaaggcgcgggcggaaggcgaccgcgcgggtgggcagggggcaccgctaggggcggggcttcggcgcgtcggaggcgcagctcccgcgccgttcacgtgacgggcccggc

SEQ ID NO: 694546 - DNA, 110 bp, Homo sapiens
gagacagatacgaattgatgtcggtgaccttttttttgtgtattataattcgtggtctatatatggatcaattgcatgatcatatgaagattggcgcgatgatatagggg

SEQ ID NO: 694547 - DNA, 537 bp, Homo sapiens
cccatccttcaaaatattcatatgtggtggtatctctatctgattcaagaggcctaggggtgcacatagaaggctatggtcataagtttgatactcgatccaactgcgacctttctcttacactttacaaagcattatccatatataaaatgttaattgaaaccttttttattacgtatatatctgatgctgctacatcattataatgcttttcattaaagaaaaaaaaaagctacaggtcttcacttacagtaccatgcactatgagtagctaaggcattcatttggcactagagagaaaattacagatacagctaattttgctttcattatcatttttaacatcaatagaaataagcatataactttcacttgaatttctgtaatgcttaaaagataatcacagaatacccttttagtttgacagttacaatgttgccattaaaacaaaacaaaaaaaccataaagacctctgtatagcctgtaggaataagttacattttggggttgaaaaatttgcggctctcagacacaatt

SEQ ID NO: 694548 - DNA, 834 bp, Homo sapiens
  misc_feature (518)..(518): n is a, c, g, or t
agctatcaatactattagaacgcatcgcgtggaagctgttcaatcagctttgtcatagactggatccaaggaaatcctggtcatgaatgaggttgggattgataattgaatgatggaaggggagcatgttagtgaagaagctatgggaggaaatcaaggctcgtctcatatcgtggagggatgatggaccgtggtcgtataaagaggcactctcctgtggctgagtgtcagtgttacaagaattgggccgagcgatcatgtgatttctctaagcatcaggataaagaaggctgacttgaccaaatcacaagtggttggactctaggactttcccgtggggctttaaattgcacttgtaccaccatgcggcacctcccctcaccagctgcccgagacacatgtccattatggcacaggcccatactctcgcacaacagattcccgcttgcgcgcaaccaatggggacttcctccgccctcattgaacaccgtctcacccagcaacctccctccccaagntttacgagggccagggcaaacggctaaaaggttcttggatagaactccctttgctaactttttgaacaagtcacagatgaagacttatatagatataataatccatacattgtattgtgtcaagaacttttagactgtaaacttaactctatttggcaaatataaggcgtgggaatagaatcggttgctttaagtgggttgagcaatcactgtttaacctattgctctgggttggaatagaagcctgagtggtataactaatggtttgggggattgggtacaactgtgccttacaacgtaataattggaatatggc

SEQ ID NO: 694549 - DNA, 1090 bp, Homo sapiens
ggagggtgacccatgctgcgcagtcagagagactgaaatggtgtctctgtggctcatgctgatgggctgagcttgggtctggggcggcattcatctcgcgtcacacttgcgtctccagcgtgcgtccatggtacacggcgtccctcacgttgatgagactcgatgaacaacttgtgcctgccacacagaggctgacaaccaaatggtatgaggtcccacatccaatgtcggtcgacccatgaaccgcgcagaatggcgtacgtgatagtggataggcgagtatctgtggacgcagaaagcgcgctgactaggctaagccctacagcaatcccatcctcactcgccgaactacatcgaatcacgcaatcgaaacggagttctgacgtgcggtccttgaggcctggttctcccttgtgtttgagacatatgttctcttgcagctgtcccaggaggcctcacgttccagctcgacagtgtggagttgcattcatcgcactccagagcccccatggccggagggagtcacttcctgggcacaaatggctgtcacacgttgcgtgtgtgtgactgagctctccgtcatggaccatgacagggctgcctgcctgacccgcgatggagctatggaggaacctgcatggctgatagagaaggacctggccctactattgctacgatgcctgaagtgtgtgggcccagtgagacccgcaggcacttccctcggagttcttccagcgccaagtcaggagctgtctggcggggaaagacctgtttggatgggggacgggcccggtccatgcaaggtggcacctccgccgcaagatggtccagtgacgtggggggatgggccggacgcacaaagctgagtaccttgtgggacatactggaccacctgagggccaccaaggtagtctggcatatcttgcggggccaggagctgtgcccacatggcatgaagttaacctggcttgaccagttcttgaaaggagagccagaaccgagtaagtggaaggagcccagtcctagagggagaaccgataggggcgaggtacaaccacggaggccaagacagacagaagaacaccccacc

SEQ ID NO: 694550 - DNA, 382 bp, Homo sapiens
gggtctatcgatgccacaaagaacttacattaaattaaaaaattctttttctagcataatattgttctactaacagttctttgtggcaggaaactattccttgaacatgcagtagttcttaaatgtatcccatttagatgagaaaactgatagatgtatttagattgcttagtcactgatttgacctcgttggatgactttttacatgttgctgttaaaactgttctattttcatccaaagcacattctgtgaactttaggatcaggatttcaaatgctgtctaccatctaacacggtatctgttaaaattgttttggatgattgggaagttggattaaatgaataaaaatggtgaactttattgggtggcatcgataaaca

SEQ ID NO: 694551 - DNA, 172 bp, Homo sapiens
gtctaccttgtcttgtaatcccagccactagggaggctgaggcaggagaatcacttgaactcaggaggcggaggttgcactgagccgagatcgtgcactgactccaacagcccaaagaatcctgtgcagctccgattttattcgcatccttgtgagacaaggtagagccgag

SEQ ID NO: 694552 - DNA, 347 bp, Homo sapiens
ggagatagagtcttgctttgtagcccaggctggagtgcagtggcgcaatctcggctcactgctatctctgcctcccaggtcctggttcaagcaattctcctgcctcagcctcccgaattgctggggttacaggcgcgtgccaccatgcccagctaatttttgtatttttagtagagatggggtttcaccatgttggccaggctggtcttgaactcctgagctcgtgatccacccgccttggcctcccaaagtcctgggattacaggcgtgagccactgtgccggcctatttttgctttctctaaaacaagattccaacagagtctacactgtatttagttggtatgc

SEQ ID NO: 694553 - DNA, 1188 bp, Homo sapiens
ctgctggggcctcccggggccggtaaagggacccaggcacccagcatggctgaaaacttctgtgtctgccatttagctactggggacatgctgagggccatggtggcttctggactcagagctaggaaaaaagctgaaggcaactatggatgctgggaaactggtgagtgatgaaatggtagtggagctcattgcgaagaatttggagacccccttgtgccaaaaatgggtttctcttctggatggcttccctcggactgtgaggcaggcagaactgctcgatgacctcatggcaggacagcaggaacagagcacagcttgcattctgtgcattgcacatcccagccatcccgagactctctgctgcatccgcaagcaatccccaggcaaggctgcattcaccccgaagagtggccgttcctacccacgcggcagtcccaaccctccaacacgcagcccatgcaaagccatgacctccaccggggcaacccgtgcatccgccgcatccagcatgatcaatgcacaccaggcctcgcccaaatccgcctgcaacgccatacacacacatcaaagccaaccccacgtcatagagtacatacacggaaacgggggatccactccagccctcgatgcatcccagcaccaccgacgtcgagctcgccagcctcctagcagacctcctccacaacgccaccatcctcgaatcacccagggcccggcgcagcactgccgacaagggcccctccaccccgccggcgtgcacccctgcgtcctcacgcgcacgaccagacgggaacgcgcggccaccgagacgaagcaccacacgccacgacgcacacgcgacaccacagggccaaccgagacccacacacccacgcggccacggcacccgacgcacataccatacccaccaccgccgcacacgcccccaagcggccggcaacaacaggagcaaaaacacccagctagcgcgcgcgagccacagccacaccacaggccccaccgcacagcggctcaccaccggcccggtacttaccaaacacacaacaccacagctacccccccccctcaccaacaccggacacggagagacaaccggagagcacagccaaccacccacaccacgacagcagcgaccacgacagacccctcactgccgagccaacgcgagagcacgcccacccgccc

SEQ ID NO: 694554 - DNA, 103 bp, Homo sapiens
tctagagatcccgcagtttaagggctaccccaagtacattatgaccccctcattcttctcttgaactggagaggggaagaaatgaaaggcatgccacgttcgt

SEQ ID NO: 694555 - DNA, 265 bp, Homo sapiens
gatggtgtctctttgtaaccaaaattttttgatacatgccatttaagactatcagagaaataaataagatacagtctttttttctctaggacttcacagtttatcagagaagataagcatacttttacttaaaaaatgactaatagtaacataagcccaagaaaagtggtagagacatttctctttaatgttgaggtgtaggatggaggacattggagaagacgatataaggcagaggaaaattatactgcacctgaacaagaag

SEQ ID NO: 694556 - DNA, 239 bp, Homo sapiens
ctcataggtcgcaggcacctgtgttttcgctaaacagtcgctatgggccttttcactgcggctcttcccatcggaagagcgccccttctccctgaagttacggggccattttgccgagttccttaacgagagttctcccgcgcgccttcgtgttctccacgcgcccacctcctgtcggtttccggatacgggacaccttcggcctcgctaggggtaccagagctcgcaattcagtaatc

SEQ ID NO: 694557 - DNA, 898 bp, Homo sapiens
aataatgaaatgaaaatgaaatggaaatgatgagatgagaagaaatgatgagatgaaatagatgaaatgactgacgactgacgactacaaactgacgactgacaactgactgacgactgacgactgacacactactgactgatcgactgaccactgaccatacactgacactgaaaatgatgacaatggaaactaactgaaaactggaaactgactgacgctgccggactggcactgacgtcgaccactgaagactgacaatgatgacaactgatgacgactgacactgactgacgcactgaacgactgtgactgaaactgactgacactgaaactgactgacatacaacatgacgactgaccatgacgactgataatgactggacactgggactgacgcctgacaactgaccgatgacaatgaatacgactgacgaatcccactgactgcctaatggaaaaatgaagtgaagaactgtacatggaatgcacgacgtgcaacgggacagcccttgcacaatcgcacctaggcgcaacgtgcaccaagcgcgagtgacggacacagcacgcccgcacccggcaaaatggcagcacatgaggggcaacgcacgacaacactgaaaacgcacggcaagtcgcgaacgccgaggaaacgaataaaagaggaccacgaagaacaacaacggaaaacaacaaacagcaacaagaaaccccccagaagcaacacagaccagacgaggacacacacagcaaagcagcaacccgaacagcacgaaccaaaacaccacacgaaaagcaaacaacgcaacaagagcaggacgaaccaaagaggcaagaaagcgaaacgcaaacggcaaaacaacacacaccgaacaaacagcgacgcgacgaacaccgc

SEQ ID NO: 694558 - DNA, 232 bp, Homo sapiens
  misc_feature (45)..(45): n is a, c, g, or t
  misc_feature (47)..(47): n is a, c, g, or t
  misc_feature (61)..(66): n is a, c, g, or t
  misc_feature (147)..(147): n is a, c, g, or t
  misc_feature (159)..(159): n is a, c, g, or t
  misc_feature (182)..(182): n is a, c, g, or t
  misc_feature (185)..(185): n is a, c, g, or t
gaatattagttggaagacttcacaaagactgctgataactatctntnattgataggaaatnnnnnntcttgatttctctgtgagaaatgtaatgctgacttttataaagcctggacttctactttatttaataattcattttttgcnttggtaaatganacatttccttggacatgtatttnatngcattaaatacaaaatttttggaaattcaggaaagttagcaattatg

SEQ ID NO: 694559 - DNA, 1054 bp, Homo sapiens
  misc_feature (34)..(34): n is a, c, g, or t
  misc_feature (348)..(348): n is a, c, g, or t
gctagctcttcacccagaatggagcttcgccttncgtcagcatccatgaaggtctctgaaaacattgatagactctcatgatgcatttccggctgcggatcacgtgcctacgatcgagtccccgagccgagaagaccattaggtatgctcgagctcgtctctcacatggcttcgtgatctgcgcagaagactgacttgcacacctggttctgctgggtcatgcgtatcaggtcgacgtagtgcttacgtgtctatgtataaatgcatctctgttcaccacggaaagagagcgcgacgcgcacctcagctaaggggcaagatctcacctcgcctatgcacccaggtgantccttcgcaatcctagaaggccgccgtcaatgtctccctccggtcctgcgcgtaggccaaggcctcgtctctgtagcggttctacctagggccattgtcatagcgagccctagcgtggtacccgactgcttatggccccacaagcgtgtgttggggaagcgcctacgtagagcggaatgggccttaggacgtagattcgacgttgagggcctctcgctttgttggcccttttctgcgaaatcgggccctcgaaattgccatattgccattgtgccgtttgggcgacctccgtgctaaggctaaaggctcgcaagaaggggattcgtactagggaagggatccctatgcttacatttgcgagggaaatggcgccaaatacactggaagtttgcccactttaagagggatagatttgcccaagacgggcattgaaaaataccacgtaacgcagtattatattctcacttccctgaggaaggtccccacgcgagggaactttgaccgccccaaaccgttggtagacgaggacagggccgcttgggcacaccaagggggcttaaattcgggggtattcgaaggttgaggcccatttgggcggtagctttgtgggcccgatgcgaacaagcgttcccaagagggcttgttcccaccatgggggcgcttttccttgtgggagtcgcaccgcacttttacaccggaggaaccc

SEQ ID NO: 694560 - DNA, 413 bp, Homo sapiens
gagatccgatcagtgcatgtgtgtgtgaaaagcgggttcagtgagctggctgtgtaaagtgtaatctcataaggctgcatgtggtgctggaggtgacatgttgacagaactgagctggttggctatgaggggtggtaaattcttgagcaaaagatgaagttgtgatgctgccaggggacagtgttgtctcagttgagcctggcttactgtggaaagttgttgattcctgactgaggcctgaggtggtggtgctggcagggaacgctgttgtgtgtgttgactctgcttggctatacaagctggtgggttctccactgatgctggagcttctcatgctggcaggtgagagtgtttggtctggtgatctggagctactgtaaaggatggtagattttgcacaatggcacgtggat

SEQ ID NO: 694561 - DNA, 960 bp, Homo sapiens
ggacgcgtgggctttttctaaaataggagatttcatgtttgcctgtatgtgctgctaattctataaaaacggaaaagtctgtaaatttgggttttgcttcattgatttctgaggtagaaaaccagataacctaggcaattgaaaacagccagatcaatgtcttttcttaatttataaataaatgatgatcattccattctgagagagtgtttcactcgagttcgcgtccacacgcgagcacagcctctttgcagctcctccgtcgctggtccatacccaccaccagttctccatggatgacaatataactgtgctccttgccatcatcaacaatggctccagcatgtgcaaagccggcttcgcaggtgacaatgctcatcttcccctccatcgtgggccaccctaggcactagagagtgatggtgggtgtgggtcagatggactcctacatggcgacgaggcccagagcaagagaggcatcccgaccctgaagtaccccattgaacaaggcgttgtcaccacctgggacgatatggagaagatctggcaccacactttctacaatgagctgcgtggggctcctgaggagcacctgtgctgctcacgaggcccccctgaacctaggcaacgtgaaagataccctgatcatgtttgagacttcaaacccagcttgtccgtagcatacaggtgtgctatacctgaaagctctggtcggtaccctggcttgtgatggctccgagaacgtgggtaccccaacttgtgccatctatgaagctatgtttttttacacatttgggctgaacagtggtggggacgaggagactctgagaactgcgagggtacttcttaccaggagggggcgcttataaaaacagggcggcgacaaagaaagagcgactctccgaaaaatggggccatataaaacgagcccatgggagcaacacaactataactgcatgt

SEQ ID NO: 694562 - DNA, 169 bp, Homo sapiens
actcaacggtttcgtatacatcgatcatacgtgcatgagacagaaattagcctgttagagttcagagcacgtgacactttcatgccttgtacaaggtagggtaaatctccagttcgtatttagtcaaagtactgtctttgtcctttgatcacacacaccccacccggcc

SEQ ID NO: 694563 - DNA, 283 bp, Homo sapiens
cggttttgttgcgtttcgcctgcacgctaccgctccgtagagatgatggcccaggatgtgccgcgccacgggcggcggcaccaggtcgtcaatggaaagtccagcggcgatccgctcgcgaatcgtcgttgacgacacgtcgcgcgtcttcgcctgcacgagcaggatacgcgtctgcctcgacaaatcggccgcctcgggtgcctcgcaggcgcggtactgcagctccggcgtgcgcgccaacgcctgctcgagcgtcgttcccggccgtgcgatcaccacg

SEQ ID NO: 694564 - DNA, 379 bp, Homo sapiens
  misc_feature (13)..(13): n is a, c, g, or t
  misc_feature (175)..(176): n is a, c, g, or t
  misc_feature (200)..(200): n is a, c, g, or t
  misc_feature (285)..(285): n is a, c, g, or t
  misc_feature (311)..(312): n is a, c, g, or t
  misc_feature (320)..(320): n is a, c, g, or t
ctcctagcatatnctggatgatttgttaaggtgatgatagccccaaaatccttccgaatgcctcatttttatcagcataatctcttttagcaggttgggcatggtggctcatgcctgtaatcccagcagtttgggaggccttgcttgagctcaggagttcgagaccagcctgggnnacatgacaaacccccatgtctgcnaaacatacaaaaaattagccagttacaatgatgtgtcccagctactctggaggctaaggcaggagaatttctggaggctaaggcnggagaattgcttgagcctgggaggcnnaggttgcngtgagctgagatagcaccattgcacttaagcctaggtgacaagaaaaaaaccttgtttc

SEQ ID NO: 694565 - DNA, 103 bp, Homo sapiens
tttttggggcccccctttggggggggggggggcccccccctttttaggggctttttccccccccccccctttcccggggccaaaaccccgtttttttttttta

SEQ ID NO: 694566 - DNA, 349 bp, Homo sapiens
agaaggttatgaaatgaaagagattgaccccactccccattactgtctgtataggtgcttacacttctgagacatacaaattgatatggaataatttgtgaaaatggaattgccttaaagaatttgaagtaagagcacaattctgggagtggagttcttagatgattcacaacattcctcttagaattaatttaagtattttgtttcactagggtgcaagtctatgaagttgtttatgccaccatttcagaagtcaaagcaccactattcattttacaacttctttctgcaaagcactgtaccaccttctgaatgtaatacgtagttgaataaaaaaattattcccgta

SEQ ID NO: 694567 - DNA, 267 bp, Homo sapiens
ggcccgctctccgacggggtgtgcagaatgaataggaatataaatagttgtaattaggctgggtgcggtagctcatgcctgtaatcccagtactttgggacgccaaggtgggtgggtcacaaggtcaggagatcgagaccatcctggccaacacggtgaaaccccatctccactaaatatccaaaaaattagccgggcatggtggcgggtgcctgtggtcccagctacttgggaggctgaggcaggagaatggcatgaacccgggag

SEQ ID NO: 694568 - DNA, 158 bp, Homo sapiens
cccctcgttggactatgtgatggctgctgtcaacctgtttgccctttacctacgtgtctgacaggctctcaggaccgagctgctgtggtcactattcctgcaggtctagtgcatgttccgcgaattcgccccactaagtctggcgatctaagatccag

SEQ ID NO: 694569 - DNA, 440 bp, Homo sapiens
aatgtcatcagagtggtccagtatagcagtgccccgagaagtctatactctgcacctaaaccccacagcagcccatccaccaaaggagccagaaagaaggagccagctgtacttgaactggagggcaagaagtggagagtggaaaatcaggaacatgttccaacctgatgatagaggacacagagctgaaacaggtggcttacatatacaagtgtgtcaacacgacattgcaaatcaagggcaaacttacctccattacagtagatcactgtaagaaacttggactggtattcgatgacgtgttgggcattgtgacgataatcacacaagtcaggatgtcaaagttcaggtaatgggtaaagtgccaaccatatccatcaccaacacagatggctgccatgcttacctgagcaagaataccctggattgtgaaatagtca

SEQ ID NO: 694570 - DNA, 121 bp, Homo sapiens
tcgaaggtgacggagcgtcgcgagcgctggtcaggtgaggcaggaaccgcagcacggtgccggccaggccgcagtcgacgacgccgccaccggcgaagttgctgggctggggtgatcctgc

SEQ ID NO: 694571 - DNA, 933 bp, Homo sapiens
gaagctatatccgcacgatgacgatatgctaagaaacaattagtgggctaacgcgctggactctacgcaccgacggggggaaacacaacatgggggggtcaaaaaataagagaggcggggctaactatatgcgcccgggggagaactttcgcccgccagcctaacactttggcccgccgttgcaggaaggtcccagcggtccaccgaagagaacagggaaaagaacccgagaacattgaagaagcctggactgtcaaaggtggacagcggggcggcatagaagcatataccgaccaggctggatacacagttaaaaagaccccgcgtgccctcatctagtaggtccagcttgcagccaccacctcccccaaacctcggggatggttgatcccccaccaaaagattccaagcggggctgcccacaagggactccaaaccagggggaagagtccctcttggtgaccaacgccacccctcaagggccacatcatggggaacgaaagaaggggccacacgactccccacgctcagtgacgagcgcaatgcccgtgagaccacgcccccccacgaagatttttgagcctcggggcggcttgataaaaaccacgcgccctaaggtaagctcactgtaacagttctcggaacacggggtcctgggactccccacctcctgcttcggagcaggtgtttattgtatcgagggcggtgatacgacagtgagacccactatggttaagcactgccacaagaacacgccgtggtttaataagtagagtcaacaagagagctgtttcaggcaacataatctaaatgacggtgagataatggacggtcggtcttctaaagcaagacagcctccagttttccatctctgagaaaaacctacaaaaaaaggagcccaaaaaaaagggcgcaaacccggggacaataaca

SEQ ID NO: 694572 - DNA, 106 bp, Homo sapiens
cggatagacaattcaaagttccaccacctaaatcatatacagcaatgactttgtcttctgatttgtctagaccataggcaagagcagcagctgtcgtggggtagga

SEQ ID NO: 694573 - DNA, 599 bp, Homo sapiens
aggagcttgagcccaagtggcctacaccggaaaagctctgggattgggacatgtggatgcggatgcctgaacaacgccggggccgagagtgatcatcctacgttccgatcctacacttggcatcgtcggctcaacatgaatggtattcacgagctactcagaacacagtcaacacggtccagtgtcagctcagaatgtggacagtctgaaaagaagcttatgagtggaagtcacaggctgctcagtgaggctgagtctggacacagaagacccttgtgaagatcttcctgccagacacagagggccacacctacgtggcctttattcgaatggagaacagatgatgacttcaccacctggacccagcttgccaagtgcctccatatctgggacctggatgtgcgtggcaaccatcggggcctgtggagattgtttcggaagaagaaccacttcctggtggtgggggtcccggcttccccctactcagtgaaagaagccaccctcagtcacccacaattttcctggagccaaccccaaaggaggaggggagccccaggagccccagaacagacatgagacctcctccaggaacctgcgtg

SEQ ID NO: 694574 - DNA, 389 bp, Homo sapiens
  misc_feature (359)..(359): n is a, c, g, or t
ttcggcacaggaatattttgaatgtcaaccctgccggtaagggataaggaactggtccttgatgtaccaagtgatgaggagtcaaggaaaggagaaagcaggtattttccaccaacaagctatattcgcagcagggaagattttaaggtagggctggatggtctctgtcagccacctcccacctctcaggtaccctctcatcccttttcaccaactctgtgtgccatagcagggccttgttctacaactttctcaaacatgggtctgattaacttatgaccttatccattactcttaaaatgcaagcaacgtggatttttcaagcctctcccagagtgtccagaactttataggggatncacagactaagaacagggaccaaatttgtt

SEQ ID NO: 694575 - DNA, 169 bp, Homo sapiens
  misc_feature (56)..(56): n is a, c, g, or t
  misc_feature (101)..(101): n is a, c, g, or t
  misc_feature (153)..(153): n is a, c, g, or t
tagtcgtctttatgaagcgtcaaaagtaatgggctcatacacctgattgccttgtngatcttgccattaccggcggtaggctaagagctccccttctaatnccagcattcgccttaagacagggtcctctaatagctgtagctggagtctccnttgccttttttgccta

SEQ ID NO: 694576 - DNA, 397 bp, Homo sapiens
gtcttttctgctcccgtagaacctcaattttagctggacagcattaggatggactttatttcccaggctccctcgtagtagatgtggccatgtgactaagttcgttgtcatgggagctaagcataaatgtgtacacttctggatcatgcctttgaaggaagagatgtggcctccattgtcctttactcccatttccctggctggaatacagaccttgtgattggaactggagcaaccatcttggggccatgtgacggaggctgcctgattattcaccgtgcagaaaagaccaggagcctgggtctctgatcatttgccgaaggcctgttgccgttcttggacttgtgggctttcttagaggagaattaacctctgttctccttaattgctgttattt

SEQ ID NO: 694577 - DNA, 1030 bp, Homo sapiens
  misc_feature (232)..(232): n is a, c, g, or t
  misc_feature (244)..(244): n is a, c, g, or t
  misc_feature (255)..(255): n is a, c, g, or t
  misc_feature (270)..(270): n is a, c, g, or t
  misc_feature (295)..(295): n is a, c, g, or t
  misc_feature (301)..(301): n is a, c, g, or t
  misc_feature (304)..(304): n is a, c, g, or t
  misc_feature (311)..(311): n is a, c, g, or t
  misc_feature (314)..(314): n is a, c, g, or t
  misc_feature (322)..(322): n is a, c, g, or t
  misc_feature (330)..(330): n is a, c, g, or t
  misc_feature (340)..(340): n is a, c, g, or t
  misc_feature (342)..(342): n is a, c, g, or t
  misc_feature (358)..(359): n is a, c, g, or t
  misc_feature (363)..(363): n is a, c, g, or t
  misc_feature (380)..(380): n is a, c, g, or t
  misc_feature (382)..(382): n is a, c, g, or t
  misc_feature (402)..(402): n is a, c, g, or t
  misc_feature (423)..(423): n is a, c, g, or t
  misc_feature (447)..(447): n is a, c, g, or t
  misc_feature (452)..(453): n is a, c, g, or t
  misc_feature (458)..(458): n is a, c, g, or t
  misc_feature (460)..(460): n is a, c, g, or t
  misc_feature (464)..(464): n is a, c, g, or t
  misc_feature (493)..(493): n is a, c, g, or t
  misc_feature (516)..(516): n is a, c, g, or t
  misc_feature (529)..(529): n is a, c, g, or t
  misc_feature (596)..(596): n is a, c, g, or t
atattatgatcttgctgcagccacagtgcagctccacattaactctacagaccaaaccatttgtatctggcatcacttactaacacacgacatgcggcttttctgcatcaactgctatgacggttaagaatgtcagtatacaagaaggaatagaaaactgatactgttttaaataatctgtaatttcaatttttttttttttggctgaaatactttatatggtacgttgganataattctagtnacaaagtatantaaacactagatgtntaataaaccctttaaatcatgggtnagtgtncangtggggnganctgaagcntttactgngacaaagtantngttcactctaagggtnnactngctcgtgcgttgccacncngtgtataattggcttcattnccttgctattggatacatagngtgcattctctgtcactgtacctntggtnntgcanantttntcatcttactggccaatcaaaatgacttngataggaatgaactccagaggcngggcctgaacagngaggtggtcgctcaggcctggtgctcagtcgtacgacctgtacctctcaactttggccctatctgtnaaatatatgctatgtcaataaacggctttaaataaaaaaaacacaacaccaaaaaacacaattttcggcggcggcacgacggccggagagagagtcttaaaaccaacttcgcggcggcgccgggcgcccacagtgggttacggcactgcgcacacaggcgtcccgaagaaaaccccggcgcagaacacagggcgggcgtctctcccaaaaaaaaagcccgcggggaccgcgcggttcgaaccaaccacagggccttggggcacaaggtcgactcccacggcacagaccaattataccgcccggacgacggagaccacaacacacaacgcaagccacaacacagtatcaacaatcaccaacagcatgacagccaacacaaactcccccacacaccacacgaccaccacacacggcacccagacactacacgacgc

SEQ ID NO: 694578 - DNA, 248 bp, Homo sapiens
tccagtacccgagcatgcatgcttgcttgcaggtcgacgtgtatacagcactggggtgcatgcatccctgaacaagttccgtcgacacgtaagccacgtgttgagctccaaatatcggaaagctggagcctggtcgacgtgtattcaccactgggggtgcattgcctccccttgtacagttccgtcgacacgtgagcaccgtgcttgacctccaaatatcggttcaggctggagcctggtcggactct

SEQ ID NO: 694579 - DNA, 377 bp, Homo sapiens
  misc_feature (329)..(329): n is a, c, g, or t
  misc_feature (361)..(361): n is a, c, g, or t
  misc_feature (367)..(367): n is a, c, g, or t
tgtacccattaaccatcctcacctccctacccaccccacccctattacactacccagcctctggtagccatccttctactctctattttcatgttttcaattgttttgatttctagatccaaaaataagtgagaacatgtgatgtttgagaccagcctgggcaacatagtgaaaccccatctctaataaaaatacaaaaaattaggctgggcgtggtgggcaggcgcctgttaatcccagctacttggggagggctgaggacagggagaatcactttggaacccggggagggcgggaggtttgcagtggaggccaagattcatggccantggcacttcccagcttgggggttgacagtggngaggantccatcttcc

SEQ ID NO: 694580 - DNA, 277 bp, Homo sapiens
tcctacctacgcactaggacagacccctatgtagagaacaacacacctgcccatacttagctctgcaagtgctactataggggtctagcctattctccctggagcttattttcctagctagcactagtgtcctaataggcaggacactaatgcatcagactgtagcagttggactcaagcagagggaaggtcattatagtggtaaaggatggacctggattcaatactaacaggtgtcttgcgcacatgatgtctgaagtcatccgaatccaccagg

SEQ ID NO: 694581 - DNA, 117 bp, Homo sapiens
gtttgcacggcagcatgttagtggagttgcagggcactggcagtggcagcagattgggtaggtggagttgagggagcatggggtaggtggcagttgcagggcaactggcagtggcag

SEQ ID NO: 694582 - DNA, 475 bp, Homo sapiens
ctactactactaaattcgcggccgcgtcgacgtaattttgtttatagcaagacttggttaacaatcgtgcccctcctctatccccaccctggtcatttgaaagcattatgcctagcataagtccctgtgagatttatacatagcaaagagggatctgaaggactgaggcaagccactaattttaagcagatgattccttaaacactttggagaaatgagaaacagcatgataatcttagtgtaaacattgggctttgaaacataaagttctaaaactgatggtctcattgatttcccaactctgaggttcttggagcttggttagccacagaattgggcacattaaatgttatttcgcatgtgtattgtaaaccattttgagcttgatggaaaaggtaatgtaaaaactaaggatttaaaactgcaatgtcattttcgtttttaaaaaccccacattttattgtcattaaccata

SEQ ID NO: 694583 - DNA, 321 bp, Homo sapiens
  misc_feature (177)..(177): n is a, c, g, or t
gtgagcccatttagaagtagtcttaggctgcctgaggtggaacacgcctgcaatcccagcactttgggaggcgaaggtggtcggatcactcgaggccaggagtttgagaccagcctggccgacacagtgaaaccctgtctctaataaaaatagaaaaaattagctgggcatggtggngcacacctgtaattccagctacttgtgaggctgaggcatgagaatcgcttgaacccaggaggccaaggttgtagtgaactgagatggcgccactgtattctagggcgacagagtgagactctgtctaagaaaaaaaaaaaagaa

SEQ ID NO: 694584 - DNA, 707 bp, Homo sapiens
ggaggggttgactgaggcgtgcgagccttagcttactcccgaaagccgacgctgaggacacgatgtcgcggtctcccgctcactgcgttaggggcgccagatgcctgggtgtgctctgagtgctgtccgcgggacagatgaacacgatcgcagcacccgatactgttgacagacttgttagacgccccatcttccaaaggttaacctcgtgtgcccagagtgagcagtacccttcccagatgtgtcactctatctcccgggcaccaaggagataccctgtgaatggttctgataaacacgctgactgtgttgccatgtcatttaaatggttacgacggttagtaacctactcaacatgcatataggggatgagacatgtgcgaatgatgatgagataattttggttgaacattagattgaaaaagttagagatggtccaaagtggggaaacacagacgtgagtttctcgttccgtataccacgagggcaaatccaagatggccaacaggacacaatgtctaacaagcatacacccgcacagggttcagaccgtcccccatttttaacaacttgccaaagaacagtttactatcatcgggggtaatgaatgaaataacaactgttgaatgcagaccttcaaatctgtgcgaaagtctagctttgatgcagggcagtttcctggcaggaatggtctggctggactgtga

SEQ ID NO: 694585 - DNA, 1321 bp, Homo sapiens
agctatggaggatgaggcgcaggcccagagggagagctcagctgataggggatcagcgctaagaaagtgggggaagggagatgcatgtgtacataggtatagtgggttataaatttcgtctaagattatatgagagaagtcagcggggtagtaagagtgtgagtaagacagggcacaggcaagctagtgttcaacgagagcgatgtgcaaggaatagttcttgtctttcctcaatgggttgtggagagttctgttggacattgtattagttgacttaggtagtgcatgggatcgcaaaagtggttaccccatttggtgaaagtaggctgtcaggtgcataaccaagggtatcacctaggcaggatagtggagatgagtagaaggggctgagtgccctgtgcgctagttatacgtgtgacgcctgggacttagatctgtaagtgtcctcactggccatatccgtgtcgacttcatatgggaactaggcaaagagcctataacattgtcgcccaggtgaagtatgtgatgagcaatagaggaggagtaggaagacatgggcatagaaagtgcgggaggacccagactagtactgccagacggtcgtgtgtgtctatggcgaggaaagtgcgctatggggtggggcattcaacctgagcagatgcagcattgtaggaggagtgaacggtcacatggctgaggctggtggatgtgactgagggttgactataaaggaataaagaccctggggcattggacaaatggggcccatggtagtagaccaacttggaactgtggggggccaaagtctcctggggttgtgcccaccgggggaacagcgctcccaaactggagagagaccgtccaatcctgcaaagcacagcagagagattacaagggggcaagcgaccccttgcgactgtggacagcacactgtgacaacgcagtttatacacggttacccgcccagcgggtcccccgggcgatcgaggggcccacacaaccacgcagggggggcgccaccgtggaaggacaccccacaaaagagcagagaaaaaaaacgggagagggaaacacgcgagcgagagacaaccccacacgagatatgacgatgggaaccaacgacgggagcgggggaagagacacaacaaggaggacagcagggcggtgagacagcgagcacgagacagcgcacagacaggcgaagagacgaaacaaaaggatcaagcacgcagagaacgccagacacgggtagcgcgaccgccaccagacaggcagaacgggcagcacacgagcgagcacaacgccgtagtcgggaccgagc

SEQ ID NO: 694586 - DNA, 489 bp, Homo sapiens
tagaggatcctaatcagtttacacaagttccactcaagggatgcaaaactttgtgcccagatcagctgcagacgatgaacaaagactttcaaatttcaagtggaaattttaaacaagtaggatcaagaccctgaagcatttctgtgaagaactataacaggagatgaaacatggctttaccagtacaatcctgaagacaaagcacaaccaaagcaatggctaccaaaaggtggaagtggttcagtcaaagcaaaaacagactggtcaagagcaaaggtcatggcaacagttttttgggaagttcaaggcattctgctggttgactttctggagaaaccaaggaaaatactgcttattataagagggttttgagacagttaaccaaagctttggcaggaaagcttcaccagagagtcctttctactgcaacaatgctcctgctcattcctctcatcaaacaagggtaaatttgaaagtttcagtgggaaa

SEQ ID NO: 694587 - DNA, 1084 bp, Homo sapiens
  misc_feature (3)..(3): n is a, c, g, or t
  misc_feature (47)..(47): n is a, c, g, or t
  misc_feature (60)..(60): n is a, c, g, or t
  misc_feature (69)..(69): n is a, c, g, or t
  misc_feature (74)..(74): n is a, c, g, or t
  misc_feature (81)..(81): n is a, c, g, or t
  misc_feature (93)..(93): n is a, c, g, or t
  misc_feature (113)..(113): n is a, c, g, or t
  misc_feature (217)..(217): n is a, c, g, or t
  misc_feature (237)..(237): n is a, c, g, or t
  misc_feature (249)..(250): n is a, c, g, or t
  misc_feature (256)..(256): n is a, c, g, or t
cgngtagcgctcgtctccgtcgcctccaacccccccggtccgaccanggaaggtgggatnctctgatgnccggncctgcgngctgagctggcnggcggcggcgtgctctggcngccgcatcgctcctgctgcgtcgtgaggacccggggccgggggctggcccagcatggccgaaacagaagccctgtcgaagcttcgggaagacttcaggatgcanaataaatccgtctttatttngggcgccacggnngaaacnggcagagtgctcttaaaggaaatcctggagcagggcctgttttccaaagtcacgctcatgggccggaggaagctcaccttcgacgaggaagcttataaaaatgtgaaatcacagaagtggtggactttgaaaaagtgtggatgactacgcctctgcctttcaaggtcatgatgtggattcctgttgcctgggtaccaccagagggaaagctggggcggagggattgtccgtgtgacccgagattatgtgctgaaagtctgcagagtttggccaaaagctggagggtgcacaaccattttcaactttgctatcctctaaaggagctgataaatcaagcaatttttatatctacaagttagggagaagtagaagccagggttgacagacttacaaattgactcgtactctgtattaggcctggagtctgtagtgtgataggcaagaatctcgccccaggtgaatggctggttagaaagttctggctccttacagactcttggccagggggcatctgtggcctgtggtgaccggggttagagcaatgctgaacactgtggtgagaccaggagaaaagcagatggaactgctggagaacagggcatccatgacctgggaaaagcgcatggtctctcaaagcatgacacactggagaatggtttaatggtaaccttacacccatcacaaatgcgatccgggctaaaaaagtcagaggttactttgggtacaatctcaggccatcaacagaaagagggccgccacgggacagcggtacataaaaccgggggtggaaaaaatggccctcacggacaaagggggccacggactttc

SEQ ID NO: 694588 - DNA, 257 bp, Homo sapiens
cccggcttattctctgatcgctccacacacacacgcagtatacacatatacaccctaaggatccaagtggaatacgtgaaaagaacatcacttccttgaaacttttattaaaaaacaaacaaacaaacaaaaagcctgtccacccgttgagaatccttcctctcctgggacacgtcaagtgtgatgtgtagatagaaacctatctcactgctctgctggctccagggatttcgtgtcacatattatatgcacgtggg

SEQ ID NO: 694589 - DNA, 329 bp, Homo sapiens
aggcccggggggccccaaaatttttttcccccccaaaatttttttttagggttatggaaaagggggccccttttttgggcccccttaaaaggtcccgggtgggcccaaggaaaaaacccggggggttggggccaattaaataaggtccaacccccggcccccccccctttggcttgaaccttggggggttggggggcctggttggttgggggggggggggttccgggcccctgccacccaaacggggccccttaaaagaaaaggaattgtggggattttgggggttttgggtggattccccttgccccttaaggccttttgggttccca

SEQ ID NO: 694590 - DNA, 209 bp, Homo sapiens
agcaacagtgtagatagtccgaggatgttacgctctgctagactaggttaggggtgtagagcacctgcagtagtagtagactgtacagaggatagtaacgctactatgctaggctaggttggggtagtgagcacctgcaagtggtagtagatagtacagacggatagtagactctacctgactagacgggatagggatagtagagcacc

SEQ ID NO: 694591 - DNA, 843 bp, Homo sapiens
tgaagagcattttatagccttaaggatattccctgggggctttaaggcgaatttccgcgatagatttgtcgaagggggaaaaacagttgtggtgcgaaaaacccttgctagacccatttgggaagtcgtccatattggagaaaagtcgttatatcaaggttcgggtctgggaccccgggtgtttaataataagagcgtatatatgcgcttttctttacttattcggagagtggttgtcgaaatcgcctaatatcatgtttggaaatttaaccccttgtccagaaaggttggttttgccagaataataatgtttctccatattctgccaggttgtgtccctttacgtctggttccatatatatttttgtgagtttatgccagaagaactttgtaggatttcgatagtgaataccccagatttggcccaatatttgcttttgttgcttgtcaatattgggggacaataacaccccatagattgagttttaagccccaagggctgagagaaagtcgatttgggtgcactaattataaaaaatcccttcgcccagatcccatattatggaggtgtttttttctagggttttcctttctggtgaaagtttatagtgttcaacggtgcttaatgtttaaagtctttaaaccacttttgaagttgacttgttttaacacaaagtgtgagagatgaggggttctaattaatattttttttttttgtaaattgaccaattatagttgtaaatatttatgggggacaaagcaatgttttggtttattaataccatgtggaattattaaatctaggttgatattaaatccataaaattgacatccatcacttta

SEQ ID NO: 694592 - DNA, 231 bp, Homo sapiens
agtccccatagacgtgcacgcaaggcacagggccacgcatgggtggggtctggcggcagtgaaaggtcacagatttgcagcaaggctacggagcagctgcagaagacagctgtcggcaccggagtcactgctgctgcttatgtctcccagcatggccttcagggtgcacagccgcaacggcaagagttacacgttcctgatctcctctgactatgagcgtccagtgtggag

SEQ ID NO: 694593 - DNA, 329 bp, Homo sapiens
catggaagatgtttacggcacagaggctgtagttgttcacatcaccactctaaagaaatgcagaaacgaaactgaaaagcattcagagtcttacaagtttctaggctcctgtttcaatgtttattccacaaaagggagaggaaaatatacaaaatatgtagaatgcatatcaatcatatttatttggtatgagctaagctctgctggagaggaagttcttggctattattaagtttgtgaatttttcatttattcatatgattcttatattttactacagaataagcgatcaggccaggcatggtggctcacacctgttatccactgta

SEQ ID NO: 694594 - DNA, 504 bp, Homo sapiens
  misc_feature (296)..(296): n is a, c, g, or t
gggcagcctgcgtcgagggggggcgcgggaacgagcggcgggcatggcgggctcgcgggcccggagtgtcgcagactgggtgctctgtgtcccggaggatgccattccggctacctttcttcactgcggcggctctcggcatgcatggtttccgtggcactcgcgctgttcccttgcgtgcatgcaggccccgtggcggcccgtcgggcgcgtcactgctgagagtctcggagcgtcgctttcggcacactggtcatagctttgacaaggctgggtagaccctagcagtctgtggntcgtagcgaagcaaatcgccaaatctgccgcgtggctgtcctggacggccggcctaatccatgcgaatacctgggggcggcctatttggctaggtccaaaagtttcagaggtaggagaccggtgggcacgcgtgccgcacagctgggtatcgatcgaccgtgatcttcagccagcttctccgctatcatcttcctgtcattcgaggcg

SEQ ID NO: 694595 - DNA, 132 bp, Homo sapiens
ttgtggcacaaaataaaccagattacacaaccacgccttactttatcaaatgtataagaagtaaatatgaatcttatatgacaaaatgtttcattcattataacaaatttccaacaatctgtcaatcataat

SEQ ID NO: 694596 - DNA, 752 bp, Homo sapiens
  misc_feature (159)..(159): n is a, c, g, or t
  misc_feature (290)..(290): n is a, c, g, or t
  misc_feature (292)..(292): n is a, c, g, or t
  misc_feature (734)..(734): n is a, c, g, or t
cccaggctggagtacagtggcacgatctcggctcactgtaacctctgcctcccgggttcaagtgattctcctgcctcagcctcccgagtagctagaactacaggcatgtgccaccacgcttggctaatttttgtatttctagtagagacggggtttctncatgttggccaggctgttctcaaactcctgacctcaggtgatccacccgcctcagcctccctaagtgctgggattacaagtgtgagccaccgtgcccggcctaacttaggtcttttatttactgacacatncnctgcataccttataatgcctggcacatgttaaatgatgaataaaagaatgctatgcttggctgaactgaactaagaaagatattcatgttttcattttagatccaagaatgtaagatattctgtaatagaagaaaaaatgattatataaaaactggactgggataaaacagtaacttatggagtttgtgtggttcttgatcaaaacaaaagtcatgggaaaaaagtcttacttttaaagacttggatttggctaaaccccaaagatgggattcagtttgatctgagtcactattaataaggggttccagcatataattagccctcatagaaaactcaatgggggcaggcgcaaagggtcatgcttgaatcccagacttttggaaggccaggggggcgacccaggtcaggaaatggccctcctcggtaaaatgggaatcccgntttactaaaaaaccaaaa

SEQ ID NO: 694597 - DNA, 923 bp, Homo sapiens
gattgacacctgagccccaatgccagtccgagcttagtagcaatgacaaccttagatgaacccatttaaccagaatagagtatagtgggaagatgaagtcgaatgctggtgccctggatatcgatacgcgcattcgagggaaagatgacaaacatgatagaccagagcactagatatagcaatatggactaatgctcgcgtattcctctctgtcttaattggaatttcatctagatgatacatcttccgcaatggggagccgaatgctatagacccgcacgaaagtcctacgtagggagctatccgtaagaagactacgcttgaagagagatgcaccaagccgatgctgagtggttgcaatgctagattggggcacgcactttcctatcgagtagaagaatgcagtaccgaatgattatcagaggccgtggtgattagtgcgtgagagttggtccccagagcgattgagaaatgctttcaagtgtgcgaagcttgtttcatttgttgcccccgcgatgccattctctgctagaaattcgctccgtgttgttaaaatttttcaagctttgtttagttcgcaaacagaaggaaacaaggcgtctgttgggagcaacttaaggaagacaaaacctctttgtacgaagaggaagtaaacaaatcagttgtaggacaaccccaattagataggggggcgttagagaggcaaggccacccaaatgtagaggaatagcggtttccaacgtctcaaatgcacactccacgtagcctaaagaaaatgccagtggacaatattaacttgaaatgtttccgtcaaaagccccaattggaggccaaatctattcaccccttatttgttaaggaaacctaaagtgttaaggtattacagttacaaccatggaagaacattgcttcctttcccgcca

SEQ ID NO: 694598 - DNA, 989 bp, Homo sapiens
  misc_feature (1)..(1): n is a, c, g, or t
  misc_feature (70)..(70): n is a, c, g, or t
  misc_feature (88)..(88): n is a, c, g, or t
  misc_feature (148)..(148): n is a, c, g, or t
  misc_feature (150)..(151): n is a, c, g, or t
  misc_feature (396)..(396): n is a, c, g, or t
  misc_feature (491)..(491): n is a, c, g, or t
  misc_feature (582)..(582): n is a, c, g, or t
  misc_feature (629)..(629): n is a, c, g, or t
  misc_feature (639)..(640): n is a, c, g, or t
  misc_feature (646)..(646): n is a, c, g, or t
  misc_feature (689)..(689): n is a, c, g, or t
  misc_feature (697)..(697): n is a, c, g, or t
  misc_feature (708)..(708): n is a, c, g, or t
  misc_feature (717)..(717): n is a, c, g, or t
  misc_feature (725)..(725): n is a, c, g, or t
  misc_feature (739)..(740): n is a, c, g, or t
  misc_feature (749)..(749): n is a, c, g, or t
  misc_feature (754)..(754): n is a, c, g, or t
  misc_feature (773)..(773): n is a, c, g, or t
  misc_feature (777)..(777): n is a, c, g, or t
  misc_feature (802)..(802): n is a, c, g, or t
  misc_feature (805)..(805): n is a, c, g, or t
  misc_feature (815)..(815): n is a, c, g, or t
  misc_feature (817)..(819): n is a, c, g, or t
  misc_feature (834)..(834): n is a, c, g, or t
  misc_feature (843)..(843): n is a, c, g, or t
  misc_feature (846)..(846): n is a, c, g, or t
  misc_feature (851)..(851): n is a, c, g, or t
  misc_feature (855)..(855): n is a, c, g, or t
  misc_feature (873)..(875): n is a, c, g, or t
  misc_feature (877)..(877): n is a, c, g, or t
  misc_feature (881)..(881): n is a, c, g, or t
  misc_feature (884)..(884): n is a, c, g, or t
  misc_feature (889)..(889): n is a, c, g, or t
  misc_feature (900)..(900): n is a, c, g, or t
  misc_feature (925)..(925): n is a, c, g, or t
  misc_feature (928)..(928): n is a, c, g, or t
  misc_feature (977)..(977): n is a, c, g, or t
ncgagtgtgttctctaccatgcggtaatgctttggtactattcatacagggtcttgcctatcctaaaganttgccatttccccaagangagctttgattctgctttagaagttttacataaattaaaatctttatcaaatattaatangnngggaggcacaggatgcaacatatatagtcaagttacctctctgtatatttagaaattactttctcctccaaggtatttgcaacagaaagctcagtctgtcctgcttaataatcagtagtacaggtgtgaatcatcagaagcttggcaagaccttaatatttcaaaattattaacaactacctctaggggcaagttcatgttactgagttatgacaaatttattatcatgagggaaaacaagagtngccagccatcttaaaaatgccccaaccactgcttctcaaaacagaaagactaaaaactacatacagtttatcatacaacaaatcccatctctgtnccctgaaattcccctagtttcattcattagaaggggattaaaaaaaaaaagacttaaagagcactttacagcagcattcagctttcctatnaaatactcagcatcttaaatattatatacaactctttttttattaanctatacactnncttcanatttttttttatttttttaaatcaacccattcaaaactactcnagaaattntcttttggcanaatatcatntatccaanttaaaaataagatnntcatttaanaccancctttccaacttttttaancccntcttctactaaaactaaaaaattanccnggtctggttncnnncacctataaacccanctacttttnatncttangcangagaatcactttaacccnnnanactnaanttcanttatccaatancactccacttcactccatccttttnaanatatcaaaacccttctcaaaaaaaaatattttattttttatcttttttnttttcaaaatca

SEQ ID NO: 694599 - DNA, 282 bp, Homo sapiens
cccccccccccccccttttttttgggggggggggggggggttcaaaaattttttttttcccgcccccccctttttttggggaaaaaaggggggttttttaccccccccctctttcccccccccaaggggggggggggggtgttgtgggccccccggggttttttttttgggggggggggggttttattttttttttttttaaacccggcttttttttgggggaccccccccccccaatttttgcccgggtttttgggccccccttaaagggtttttggggga

SEQ ID NO: 694600 - DNA, 235 bp, Homo sapiens
agtgcagtgtcgtgatcacagactcattgcacgctcaatcccctaggctcaagcaatcctcccacctcagcctcccaagtagctgggactacaggcatgcgcctctatgcctgactaagttttaaggtttttttttttttttttttttttaaaaaggggccttcccttttttgtccccaggcgtgctctcctcaagtggaggtctccccattccttatatagggagaacacaaaa

SEQ ID NO: 694601 - DNA, 211 bp, Homo sapiens
tggaaaacaagcaataaaataagactggattcgaactccagatgtgctgttaatattgaacagtacactccctgaccatgtgttaatcctcttttactaaataaaacagaaaggcgcttaaacaactttattaaactttatttgaaaattatcattagtgtttcttttcgtttttctcttgaactgaagaagagtcacacttttggtacca

SEQ ID NO: 694602 - DNA, 481 bp, Homo sapiens
acggtccacggaactttgatatgaaaagaagtgacaatggaattgaattgaagtgtgtgtatgtattgggggagcctgaaaatatggggaaaacagatataggcctataaagcattgtgctttgtgtctattttatgtagagatcaatagtcctacatacctgagcattctttgagtatgtgacagcctcagattgactgatgttgtcacaatgatgaagtggagtcatccaaaaaccatttaagaaagcagaaagctgggcatgatggcatatgcctgtagtcctagctgctcaggaggctgaggcaggagggttgcttacgtccaggagttcgagtccagcctgggtagcatagtgagaccttgtctctaaacaacaccaccaccaacaacaaaaagaatgcagaaaattaaatgttagcttagctttccattaaaatggttaaattacaaaagttccgttgaagccgtcgggtaccga

SEQ ID NO: 694603 - DNA, 90 bp, Homo sapiens
gggcagagtcacggcacgctcaaggctcctccacacacagcacccgctgaaccctgatgcaccctgatgctgctgagatggggcgggccg

SEQ ID NO: 694604 - DNA, 768 bp, Homo sapiens
ggtatacaagtatctgtttgaatcctactttcagttcttttgggtatatacccaggaagtagaatctctggatcatacggtcattctatttttacttttttgaggactaccaaacggttttctgtagcaactgcaccattttatattcccaccagcaatgcacaaggattccaatttctccacatccttgccaacatttgttattatttatttatttattgagatgaagtctcgccctgtcgccaggctggagtgcagtggcgcgatctcggctcgctggaacctctgcctcccgggttcaagtgattttcctgcctcagcctcccgaatagctgggactacaggtgcctgccaccatgcccagttaatttttttaatatttttagtagagacagggtttcaccgtgttagccaggacggtctccatctcttgacctcgtgatctgcccgccttggcctcccaaagtgctgggactacaggcatgagccaccgcgcccggactagggttttttaatatattctagatattaatcccttatcagatatgtgatttgcaaatattttctcctattctgtgggttgtcttttcagccctcttgatcatgctctttgatggtacaagacattgtagttattaggtgaacgtacaatttatctttggttatataatggtatggagcatatggggcatatatccaagaaatttttaataaaatccagttgtaatgaaatttttgcgagtaaattaatgtaagaaggtttaaagg

SEQ ID NO: 694605 - DNA, 1441 bp, Homo sapiens
  misc_feature (314)..(314): n is a, c, g, or t
  misc_feature (368)..(368): n is a, c, g, or t
  misc_feature (416)..(416): n is a, c, g, or t
  misc_feature (496)..(496): n is a, c, g, or t
  misc_feature (627)..(627): n is a, c, g, or t
  misc_feature (1347)..(1347): n is a, c, g, or t
  misc_feature (1409)..(1409): n is a, c, g, or t
  misc_feature (1411)..(1411): n is a, c, g, or t
  misc_feature (1413)..(1413): n is a, c, g, or t
ggcccaatggtgcgcccccgctataccgcgtcccgtaaaggggaaaccagccacccctgacaactcagagccaccgtggacagaccagaggctaaaagcacctctcgctcggcctgctcaccctacgcaccaacccaaccctgcgctacaaaatctatgagagactaacaggtcggggtacaaacccccgccacccctataccgccagccgccacccccacgcggcacagacgctaccctcagcccagctataaccagtatcagcagtgatggcccagcagtggaaccacgtacctactcagaaccacgggccnagatggccgccatactacgggaactacgactacgggagcctactccgggaacancacagggtggcacaagtacacagtagccagtgtgacccagaggctccncggaggcccctgccggcgttccgtccaccgagcgcctgccatcggcccctcctcgtgcccccagccagatcccgtggtgnctgggcgatggggtcatcccagggctgccatccctaccagcccactgcctcccctcatgaggggcttccttcccctccatagggccaggcatttttttctggaattcaaacaggcaacaatgaccttttanttttctgtttgtccccacctccccagccttccacctcctgttcttcctaccttcttcctttttgactaaataatccccacctcccttgatcatacagtgaggctacagtgactgaggggagaatcccctcctgttcactctcccaaccctgctccagcccctcagcttcccagaccctcatgcagttggttgtaaattctcccaggagctgttttactgtctacttttcaggattaaaaaaaaaatcaaaacttaaaaaaaaaaaagtttaaaaagcaaaatggggagggggaggaagcagtgactttttttgggtaattatgcgcttttttttaatttttagaattggtctttttactggtgggtgggctgttgatatttcatcaagataagcatttctttcctgagttcaggtgactgaggaagagccacaaaacaaaacacaacaaaaccaaaccacagaatcatctttaacccaactttttatacgatgccccagttccccataactttgcacacaagcttctgtgttcagtggaatcgtaactgctttggtattcggagagagtgactatggaacttgaaaccttttattccgggcgtctgggagtactggggggatccagggggtgagagggaagaagggaaggtggggggctccttcccttcagaacttgaagtttctcccagtgctcctctccaagtggtctcccagggtgncagacccaaaagttttcctacagtgataccctttatttttacttccccttgactcatatgtntnancatgatttaacacgaggcccttattaga

SEQ ID NO: 694606 - DNA, 391 bp, Homo sapiens
  misc_feature (373)..(373): n is a, c, g, or t
gtgcaatacggctaatgagtcgttttaattgccgcataacacggcactcgccaaccaattgttcaatatgcggttcatcaggtgcatttgctacagaaaaactggtatgcgattggtgaaacgccattaaaaataattgtcggccctgaatgttatgcaattgaccaatgattaattcacttttatcgtcccatgaaacaatatgctgcatatgtccatgggtaaaattactctcaaatgttaatggtctgaaacggataggttcccaataatattattttgcacaacaccaagtgtttttaaggcagtctgattaacaaactgacccgattttcatcatctacaactaatacgccctgatccatattatcgntcatggtcgaaaatattt

SEQ ID NO: 694607 - DNA, 184 bp, Homo sapiens
  misc_feature (90)..(90): n is a, c, g, or t
  misc_feature (119)..(119): n is a, c, g, or t
  misc_feature (150)..(150): n is a, c, g, or t
  misc_feature (175)..(175): n is a, c, g, or t
ccatcactcactctcttctctacctaaccacttaagaagtaaatggaggaattgagataatccagtgtgaaggatgataaaaataggttnagagtgggtccaatcaggcattaaaaaanatagttatgaaaggtaaattaggatcagttncaagagtttggggacctaaaacaancccaaatta

SEQ ID NO: 694608 - DNA, 375 bp, Homo sapiens
  misc_feature (51)..(51): n is a, c, g, or t
accggcacgctatccggttcaatattcaaaaaatcaattaacgtgctctantaacaccctgagtacaaattaatagataaacagtggtttctagcctgggcacggtggctcacgcctgtaatcccagcactttggggcctgaggtgggaggatcacctgagcctaggtgattgaggctgcagtgagccctgattgtgctaccgcactccagcctgatggatagagtgagaccctgtctcaagaaaaaaaaaacaacaacagcagcaacaaaaaaacccacaaaaacaaaagccgaaaagaaaaggaaacttagttttatcttgacaaagatatctaatttgcttctaagctttttaaattgaaccggatagcttg

SEQ ID NO: 694609 - DNA, 87 bp, Homo sapiens
  misc_feature (36)..(36): n is a, c, g, or t
  misc_feature (51)..(51): n is a, c, g, or t
gatcaagttgccatgaaaaaccatctactatatgtnagacatgacattctntttctctccttcctgaaaaataaagtgtgggaagag

SEQ ID NO: 694610 - DNA, 321 bp, Homo sapiens
ctgaccaccgaccccagctgcatgcctttgggcaacgcctccagggcgatcttgacctgcacagtgccggtgttggccgccacggcgggcgtcacttcgcgaactttgccctgggccttgatgctggggttatccagcaggctgacggtgatcggcgcatcaggcggcggctccaccaacaacgactcatagacgttgaacaccgcatcgcgctcgccgtcctgggccaggctgaaaatcggcacggtggcttgcaccacttggcccacttccgcctggcgcgcagtaatcacaccgggcgcgtcggcgatcaaggcggtg

SEQ ID NO: 694611 - DNA, 268 bp, Homo sapiens
cccttgcaccttcctgtcaccaatggaaagtgcgtcatcctaacggaacatctgactaccccagcccttgctgacagtctacacatgagcacgcccatcaggcttgtggtggtcaagtatgcgcccagcggattctacattgcctccggagatgtgtctgggaagctgaggatctcggtataccacgcggaacaggagcacctgttgaactatgagtaccagcctttcgctgggaagtatcaaagactttgcttggactgaacactgt

SEQ ID NO: 694612 - DNA, 129 bp, Homo sapiens
tggaccgggcgaacgtgaacaggagtctggctgagggcggagctggctgcagcgggctgtccgccgacttggccaggccgatgccggagatgggcgagaaggtggacttccacttgctgctattgactg

SEQ ID NO: 694613 - DNA, 141 bp, Homo sapiens
tgggtgtatccatttgcctccgtgtgggagtagttcctcctctgggaaggtactgcagccttcccgcgacagaaaatcgcgatccagtacccaatccataggcaccaccgccatttacaactatctataataccatcaccc

SEQ ID NO: 694614 - DNA, 128 bp, Homo sapiens
ggccccacccccggcccctcccctgaaggggaggggggagacgtagaatgcgttacctacctctgactcagtccgatcgcgaggcgatgctcggcgtgatcggtgccgcctcgatcgatgatctgttc

SEQ ID NO: 694615 - DNA, 259 bp, Homo sapiens
ccaacagtactgccagcttgacttcttcaatgaccaccaccgagaccacctcacacagtactcccagcttgacttcttcaatgaccgccaccgagaccacctcacacagtactcccagcttcacttcttccatcaccaccaccgagaccacctccaacagtactgccagcttgacttcttccatcaccaccaccgagaccacctccaacagtactgccagcttgacttcttcaatgaccaccaccgagaccacctcaca

SEQ ID NO: 694616 - DNA, 423 bp, Homo sapiens
accaaacacagagcacagctgtgtaaggtattcactcccgagcattaggcaaaggagtcccacagcactcttacatgtcattatatttcaacagatgattcacctggtcctgtagatccgatgactgttcacacattcttctgaatagcttcttgcgtggtattgaagatgtgtgtgttattatcgccatctctccttaacctatcttctgagtgcaagatggcttcttcgtggagtcctatgtttcgagctgcctgacataacagctcgagagctccggaacgcctttcagcacgtgcttggtgagcgcgattacgtcagtaccacaggtggtcactttctccgtgaggagccctttcgcggactgaccgacgcgcgcttgagtctctggcgttacagtcgccatcatttcagatagcgacc

SEQ ID NO: 694617 - DNA, 365 bp, Homo sapiens
aaggccagaagtggcaggcccagtaatatatcagacaggcaaaggcgaaggatggtgagaacggtcagatacagtccacagaccacctccaaagacatacaacatcatcctgctgcagatggtgtcactgtgcatcgttcaacaattcagcgcactttgcacaaggagaagctgtatgggagagtgatgcggaagaagccttttctgcacacacgccacaaacagtcgcttgaggtatgcaaacgcacatttggacaatccagcttcattttggaataaggtgctgtggactgatgaaacaaagattgagttatttggtcataataagggacgttatgcatggcggcaaaagaacacgtcgacgc

SEQ ID NO: 694618 - DNA, 305 bp, Homo sapiens
  misc_feature (42)..(42): n is a, c, g, or t
ggatttgtttacccttggtcaaggctcttgccaacagtgggnccaaaaaccagaggttcccagaaactacaatagtccccgtgagtcaggccagtttgcccaaaggatggcctgcaggactgcccccagcatttggaggccaggcctcaactgcattttttaagcccaggcaaaggcggccctggggaaggtggaaccccagcatttttactgatgctttggggtcctgcagaaccctgactgtgcccagaccttttggaccgtgtccctttccatataatttaataaatccttttttcaaagga

SEQ ID NO: 694619 - DNA, 237 bp, Homo sapiens
cattacagtgtgtcacaccacacctgctaattgtaatcttttagtagagacggggtttcaccatgttggccaggctggtctcgaactcctgacctcgtgatccacccgcctcggcctcccagagtgctgtgattacaggtgtgagccaccgcgtccagccccagagtgctaggattataggtgtgagccaccacgcctggcccacccataggatagaccccccagagtgttgtcttg

SEQ ID NO: 694620 - DNA, 195 bp, Homo sapiens
aaatcaacatgtcctggttggttaatttggtcaatggatggctgcggatctgttcggtgctcgaacgtttcatcaatgcacttgcaggatcaccggctgacgtgcattcggttgacagtcttgcgcgacggttgctgacacgacggaggacctttcgacgcattggccgggtcgttccacgtggggactcctcta

SEQ ID NO: 694621 - DNA, 270 bp, Homo sapiens
gtcggcaatactcattttgttgtgctgcactttactgcacttcacagatactgtgtcttttactaattgaaggtttgtggcaaagttgtattgagtaaatctattagtgccattattccaacagtatgtgctcacttagtgtctctgtcttacattttggtaattttcacatttcaaaacttttcttatatctgttatggtgatctgtgatccgtgatcttttttttttttttttggaaacgggttttcacccctgtcccccaggataga

SEQ ID NO: 694622 - DNA, 645 bp, Homo sapiens
tgtggtggctcatgcctgtaatcctagcactttgagacgccgaggtgggcagatcacaaggtcaggagatcaagaccatcctggctaaagtggtgaaaccccatctccactaaaaatacaaaaaaattagctgggcgtggtggcgggcacctatagtcccagctactcgagaggctgaggcaggagaattgcttgaacccgggaggcagacgttgcagtgagccaagatcgcaccattgcactccagcctgggcgagacagtgagactccgtctcaaaaaaaaaaaaaaaaaaaagaaaagggtattttgggaagcccaaaaaacaaaaaaccgggagatatccaaatatttttcccacccttgttgggggagaaaaccgcccgggcgatattctatcagaacaagaaattttactctacgaggttgcaagcaaacgcaaccacctgcgcatatagttctcaacaagtgttgcggaacaagggaacgcgagaccccagggattacaaaccgggctggattcctattttataccacacacaacggggaaggactatctcggatgacccagcgataggggcgcaatcggcaagggaaaaatgccgagaaggggccgcaaggaaccatccgggctctgcaagcgccca

SEQ ID NO: 694623 - DNA, 725 bp, Homo sapiens
  misc_feature (630)..(630): n is a, c, g, or t
cctgtgcccagctttcagtatcttgtgtgagtcgatcatttctcaaactaccgagcggtctggccacaaagagagagccccggagcatagctgctactggccatgatgccccaatacggtatgttctctaagatctaggacaagatagaacggctgaccttgaccaccgttattaaacatactgctgccaatcctgtcgagaggaataaactatgatgatgaagggcgtccaaactgaccaagaagacagattctgcagaagacaggagcttatatacttaataacctagagactgcaccagaaaaccgctagtactgagacatgaattcagtagtgctgcaggatacaacatcaacatatcagaatcataacatttaatatacactaacagcagataacctgctaaaagaaatcaaggacagcaatcacacttaagaagctactaagaatagaaaatagctaccaagtatagaaaatacctaggaatgatgttaaccactgaagagaaagatgtgtatgaggaaaactatgataaactgctgaaagaagtagaagatgacacacacaacaggtgaggatattccatgctcatgcgttagaataatttgacagcactactcagagcaatntatagattcaatatgatctctatcagaaccacacaagagcctgcgtagccaaaggtaatctgagccaaacagcgcctggagacatcatattcctg

SEQ ID NO: 694624 - DNA, 715 bp, Homo sapiens
tggcccaacctcgattgtttattccaacaaacttccctggtttaaaaaaaaaaatgggtgggggggaggttcaccacattttatcacccctgtgacagacaagcaaaactctcccacccaaaaattctcaggagcccctctcggaggcttcctacacacgcttattggttagccctccaggacaacaagggagcgttgaattttccatacgctggctaaaaaacaaatctcttctcaaacatagtgttccaactactcgcaaaggcaaagggctgtggagccctctggggaaacagaaagactccgggcgcatacaacgcaccagctgtggaggctcccaagaaggtagacaactgtggggccccaaggcacacctgtggcctcgcccacgacagacactccagtgggaaccgcaaaccagcacccgcacaggccctaataaaaaccgcacatatcatgggcagacatgcgggcatctctatgcaccgagggagactaatgaaaaccacatagagctcacccagtgttgaaacccaagagtggtatcccatatccaagaaataccacagaacttcccacgagaaaccacgtgagagccctgtagaagaaaacaaatacgaaaaaataagtgaagacaacaccagtgagaacagtataaccaccaccaccagcgaatgcacgagaagcccattgataatgaggaagtgacactaaa

SEQ ID NO: 694625 - DNA, 204 bp, Homo sapiens
cccttgtttccctgggtgccttttttgccccttgtccttaaacccaacgacacaaaaaggggtggggcgggtttattgggaaaaaaggaaccaggtcaaaagaaggcatgggttggcaaggtgggcgtttggggccctttatgctggcttttcaccccaaaggacacaggcagcttcccaaatatatttattttcttcccggga

SEQ ID NO: 694626 - DNA, 157 bp, Homo sapiens
ctcatttgcatggctcactcacacaccacatcaagcaatagggccacaccgcacataggaagacccccccagagagagggtcagcaggggggcccacgcatgcgcctcccctcactatagccaccatggtggggctaggctacgggctgagcgccca

SEQ ID NO: 694627 - DNA, 143 bp, Homo sapiens
ttgtgattgagcgtgtggcgtataagccgcttcgtaaatcgactcgtgtggctgcattaattacagccattggggtttcatacttattagaaaatgcaatgagttatttctttggagcggagtctcgtccgtttccttcagat

SEQ ID NO: 694628 - DNA, 304 bp, Homo sapiens
attgttttttggttttttttaaaaacccccaaaaaaaaccccggatggggcccctgggcccttttgggaaaggggaatccccccaagggcttaaaagggggtccccttagggccaaaaaaacccaaaaaggggggggttttggaaagtgggcctttttttttccccccccttcccctcccccaaaaaaccccctgggggggtgggccccccccgggtttaaggccaaaaaaaaaaagccccccgtttggggaaccaaccctttccccccaaaacccggggaggaaaaaaaagaaaaagggttta

SEQ ID NO: 694629 - DNA, 548 bp, Homo sapiens
  misc_feature (71)..(71): n is a, c, g, or t
cgagatagcggcgaggtccgctttcagtgtatggttttccctgccaaacggttctggctgtggtgtcatcncatggagggcgtgcgcgtgggccttttccttgcggcactgtggcttgccgagccggagccgaatggctggctggcaagtggcgatcgattcagcccgaggagcaaggagcgccatgggccgagttcgtcttgtgcccggggagcgctaaggcagcctatggcgtggtcgtcgtgatggatacggaacattagtttgcagagaaatggaatatccctgtggaatcatattcgttgtgcaaagaactgcaaaaggaaaacccagttctgtgcaaaagggactcatcgaatccttacccgaatttcaactttaacatctctcatcagggagacctatgcagtgctgtgctgctgaacctgagctggcaagtgtggcactggatctactggaagactagttttccaggtcgtggttcaattccagaattctttcatattatgaccacgaacgtttaccaacaaagaatgggaaacaatcag

SEQ ID NO: 694630 - DNA, 116 bp, Homo sapiens
gctacctatgtgctaatgatagataagagtgaaagcattgggaagcctgagaagagtgcagtcagaactgtcagttcctggctgtttcattgagcagcttggcccttatcgatggt

SEQ ID NO: 694631 - DNA, 576 bp, Homo sapiens
tctccatctgccccagcgtcctctctttacaggcagacccagggagctggaggtctgtgcaggctgcctgagtttctttacaatttcagtagttctgtcgagcctgttccacaacagacacaaatgggaatacaacaagcaaaggtcttgctaagtgagactagaaaacgatgctgaggaatagcaaatagctctcatgctgcagctggtctgcttgaagagttaatggttaagagtttataaatatgcaaacaccaaggtcgaacagcaggagttcccaagatagcagagaaacaggaacctaccacaaaggattatggtactaaaaggttaaaaatccgcccatccacatggcaaagggcagggaataaataaaccacgacatcctgttagagggggattcacagagaaggcagactcctgggaataggaaagaaaaagaaaaaaaaagatacaagacaaaatagaccaaggctaagtaccaactttgtgtagttaagaatccgcatatcctcggagtgaccttaacaataaaaatccaacactaaaataaacatgtaagagcggagttacatc

SEQ ID NO: 694632 - DNA, 288 bp, Homo sapiens
tccatatgttgcccaggctgtctcaaactcctgacctcaggtaatctgtctgccttggtttctcaaagtgctgggattacaggtgtaagccactgtgctcggtctttttttggtatttttagtagaaactaggtttcaccatgttgcccaggctggtcttgaactcctgagctcaagcaatacacctgctttggcctcctaaagtgctgggattacaggtgtgacccactgtgcccggccctatcttcttttcattcaacaaatattttttgggcacacattatggag

SEQ ID NO: 694633 - DNA, 300 bp, Homo sapiens
  misc_feature (28)..(28): n is a, c, g, or t
  misc_feature (32)..(32): n is a, c, g, or t
attgagcccctggagcctcagttgccangtgncagaattcacttgccattttcattcttcttggtgggagcctccgactccaactgtttctagtcggccatctgcgccccttcccctgatggtttttattgaaaatgtctatctgtttagaaaagttttcattcatatcctgaattttaaaaaatttctttatattggcttttacctttctcttgtattaccttgagtaacttaatgatcaaccttttgaattatttctctggtatttcaaagatttcatttggtttggatccactgctg

SEQ ID NO: 694634 - DNA, 967 bp, Homo sapiens
  misc_feature (6)..(6): n is a, c, g, or t
  misc_feature (65)..(65): n is a, c, g, or t
  misc_feature (131)..(131): n is a, c, g, or t
  misc_feature (157)..(157): n is a, c, g, or t
  misc_feature (159)..(159): n is a, c, g, or t
  misc_feature (163)..(163): n is a, c, g, or t
  misc_feature (170)..(170): n is a, c, g, or t
  misc_feature (191)..(192): n is a, c, g, or t
  misc_feature (212)..(213): n is a, c, g, or t
  misc_feature (216)..(216): n is a, c, g, or t
  misc_feature (225)..(225): n is a, c, g, or t
  misc_feature (227)..(227): n is a, c, g, or t
  misc_feature (230)..(230): n is a, c, g, or t
  misc_feature (242)..(242): n is a, c, g, or t
  misc_feature (249)..(249): n is a, c, g, or t
  misc_feature (251)..(251): n is a, c, g, or t
  misc_feature (257)..(257): n is a, c, g, or t
  misc_feature (259)..(259): n is a, c, g, or t
  misc_feature (263)..(263): n is a, c, g, or t
  misc_feature (267)..(268): n is a, c, g, or t
  misc_feature (271)..(271): n is a, c, g, or t
  misc_feature (282)..(282): n is a, c, g, or t
  misc_feature (284)..(284): n is a, c, g, or t
  misc_feature (290)..(291): n is a, c, g, or t
  misc_feature (313)..(313): n is a, c, g, or t
  misc_feature (321)..(321): n is a, c, g, or t
  misc_feature (326)..(327): n is a, c, g, or t
  misc_feature (332)..(332): n is a, c, g, or t
  misc_feature (334)..(334): n is a, c, g, or t
  misc_feature (403)..(403): n is a, c, g, or t
  misc_feature (406)..(406): n is a, c, g, or t
  misc_feature (445)..(445): n is a, c, g, or t
  misc_feature (455)..(455): n is a, c, g, or t
  misc_feature (486)..(486): n is a, c, g, or t
  misc_feature (540)..(540): n is a, c, g, or t
  misc_feature (567)..(567): n is a, c, g, or t
  misc_feature (571)..(571): n is a, c, g, or t
  misc_feature (576)..(576): n is a, c, g, or t
  misc_feature (586)..(586): n is a, c, g, or t
  misc_feature (589)..(589): n is a, c, g, or t
  misc_feature (601)..(601): n is a, c, g, or t
  misc_feature (610)..(610): n is a, c, g, or t
  misc_feature (613)..(613): n is a, c, g, or t
  misc_feature (660)..(660): n is a, c, g, or t
  misc_feature (663)..(663): n is a, c, g, or t
  misc_feature (669)..(669): n is a, c, g, or t
  misc_feature (671)..(671): n is a, c, g, or t
  misc_feature (681)..(681): n is a, c, g, or t
  misc_feature (709)..(709): n is a, c, g, or t
  misc_feature (716)..(716): n is a, c, g, or t
  misc_feature (772)..(772): n is a, c, g, or t
  misc_feature (786)..(786): n is a, c, g, or t
  misc_feature (795)..(795): n is a, c, g, or t
  misc_feature (803)..(803): n is a, c, g, or t
  misc_feature (808)..(808): n is a, c, g, or t
  misc_feature (810)..(810): n is a, c, g, or t
  misc_feature (821)..(821): n is a, c, g, or t
  misc_feature (837)..(837): n is a, c, g, or t
  misc_feature (845)..(845): n is a, c, g, or t
  misc_feature (856)..(856): n is a, c, g, or t
  misc_feature (878)..(878): n is a, c, g, or t
  misc_feature (933)..(933): n is a, c, g, or t
ggactnagcattcacagacgacaccacacaccactgtcacgagcggcaagaaagaccccggcgcnagccagcctggagccccgaggaggcggccccccctccaagagtcggagggggcagggcctggagtntcgggggcagcctgggaacacctccncntaanaggcgtnggtagagacgaagagggactnnctggcagccgccccagcctnnccncccggagtntnccncccttgacaggnaaggctntnggccangncccncctnncanactcctccccncnccttcnngttctccttctccccgccccangcctccanggcanngcctncngggctcggccgtggagaaggtcagggcccagggcttcagcagggggcacttgttaatggcattgaggtnganggacgcctccccctcactctggcctccagaaaggaaggngaccccagtnacagcggggggcactgtgcggcgcacgctgntaacggtcgccatggcaatctcctcaagagaaaacttctgagttccagcatggnctggggtgaccatgttgggcttcagcnaggngcctnccaggtagangtngtggtcactcanagccttgtnganagccgccagccccttctcggtcacaaactggcagcgcttcaagttanggncccatnanggaggatctnaggctccacgatgggcacaatgccattntgctggnagaaactggcataacgggccaaaacattggcattttccatgaaggcgaaggctganggggtgtgtccccnaatcttcancacaaaangccantnggcgaagtcanccccgtccttcttgtnctgggcanagcgctcaaanagccaaccaaaccttgggtggnagtctcgcaattgtccctccaaggggacaagccctttttacttgaagccaaaaancgccttggatttaaaattgggggaggaggcataa

SEQ ID NO: 694635 - DNA, 217 bp, Homo sapiens
ttttttaaaaaaagaggggggtaagttataccccaagcccccctttcaaaaatttttccccgggtttttgcggaaaacccccaacaaaaaagcccttttaaaaaagggggttttttttttttaaaaaggaagcccccccaaaacaggggcaattttttttgtttgtttttttgggcccaggaccccggaaaagccccaaaaaaatttttgttgggga

SEQ ID NO: 694636 - DNA, 470 bp, Homo sapiens
tctactgggttcgtgttcacagtctgataagtacttaacgtttttatcctcaattgtattaaatatcattgggggtggcttaacctttttaaaaaaatcccttggattttcctccctgcttaaaagatttcaccagaaaaccttcatataaaaattcaggccctttttggacaatttttaaaatttgtatctttactagaacatgagaatctttttcccttggaagcttgaattataaatgtggtgtttggcctgcctcagcagcaccagttgactgctcgtgtgccagcggtgtggggaggacggggcaggacgctgcagctctctccagccctgttggcgtcctcagtgcctgcaggcctctcgctgcctgttgggctgtctggggggtggccatttagggatcgtggggacgggggccaccccaagaagaaagaaaggcccgtccacaggcccggctctgggcacgt

SEQ ID NO: 694637 - DNA, 979 bp, Homo sapiens
ggactatgtcaaacgaagtcaccaagatggaaggaggtccttggaaccagcctctcccagtgtctcctactccacaatgctcatccacaataggcagagtcagcaagtctgggaggcagctcgcagcatgcgaagtcgaacaggctccagaaaccaggcgggcggaatgtcaagaaaccgacaccaggaggtcctatcagtctacagaatgcttgcttctcgttatgctagcgccatgggccaggatgcgtatggaaaatagtgcacacaaatgttactagaagctaaataatcctttagccatgtgttatagccaaccgagtcttcaaaacgaagtaacaagtggattaccttgggcaggcacactggccccttgtctatcatagtctgtatgtgttcagcatcctagagtgagtcgagctagcccgctgacatctgttctccattccgtggtgatgctacggtcgtgcctacgcgtagcttcgttgcacctattgccaaaggtgtttctcgagggacttgctccccgaggagaaaactagcgccgactcgagaactggcttagagactgtcaaaaccagcagaggtgaaacgtccctgtgatcgccttgcagatgccatacgctgcggatcggcctatgcccgagaggtctgatctctgatgctggcatgggtggccgcctcctccgttcccatgacgtgtgctgagatggcgttatatcagcctactcgaagtggctgtgctgaaggcctcctgtgagatgaatgttcctttccaattgcctgtactcgggcaggggcataccatgggacacggacgaagacttcttttggcctttgggtttcaattcccaagcctgaacttgagttgccaagtaaactattggggccaggtttgaacgtaacttggttgaaccctcccagatatctgggggttgaaagccatccggttttcccacatgctatattttaaccggta

SEQ ID NO: 694638 - DNA, 286 bp, Homo sapiens
  misc_feature (264)..(264): n is a, c, g, or t
  misc_feature (268)..(268): n is a, c, g, or t
  misc_feature (277)..(277): n is a, c, g, or t
aggggtgcccccagcacaggagagagactcagctcctctagcccccacgcacggtggggtgcctgtcaccctggtctctgcccaagcggccccgagggacagcatgtggtgtgtgagaggcaggcccccggccctccccaagagcagttgagaggggatcccctgcgggaaatccgggcctttgggtgcatccgatctgatctgagttgtttctgacagtgacagagtgacaatctatcagtatctcaagatcaaatggttaantaanacataaganatttaaacg

SEQ ID NO: 694639 - DNA, 1332 bp, Homo sapiens
  misc_feature (379)..(379): n is a, c, g, or t
  misc_feature (474)..(474): n is a, c, g, or t
tgtggtggctcatgcctgtaatcctagcactttgggaggctgaggcaggtggatcatctgaggtcaagagtttgagaccagcctgatcaacatggtgaaaccccgtctctactaaaaacataaaaattagccgggcatggtggcagatgcctgtaatcccagctacttgagaggctgaggcaggagaattgcttgaatccaggaggcagaggttgcagtgagccgagactgcaccattgcactccagcccgggtgacagagtgagactctgtctcaaaaaaaaaaaaggaatataaaatgttgctcctaatgtctgctgttttaggtggaagaaatatcccaccacacagaaaagagatgcttaaaaagcaaacacccnctaccttctggagcattttagaagactctgaaatcacccagacatttgagtcgtcagctgtgaaaggcttcctgactggacagtgagaaattgtncttatgcttattatctcacttcttaagaaagtctgagaataaataagaggaaaaatatgacggatgcccatgatgatcacttgagttgaaagactttgaaaatggaagtcttaagcttttgaaggttcataggtaaatataaaatgcatgattattttgccacagattttaatggttaattttggatccaactttggggccatttaataacatttggcctttttgaggaaataaacttggctaatgatacaagctggtttacccaagccacgaagagttttaaaggttggtaaaatgcctggtatttacttgcagaatatattctctgggttacctcaggctctttttaaaggggacctctttgcttcccctcgaggccaaatttaggggacctaggttaagtgattaacctattgaactctctctaactcaaactctattgaacatttggcccaccaaaggtctaacgctgacatctgcaattgtgatgctccgccgtgttctcactcgggccaggtcccgaccatctcttcacatcgcggataagtttctttctacaccaatactccactcgtctgggtccattccgctgctcctccttagtcgctgtgcgcgagaacttctatcctgctctgtgtctcactcctcgtcctgctcctctctgtgtctacgattcgcttactacacaccatccatcatctgtgcgccctgtctactcgtctcggcatgttatctctccatctctctctcgtcgttctcatctagctgtctcgatctcttcctgcttactatctcaatcacgctatcgtctctcttacgtgtccatcatcgaacctcgtcacgctatgctactccctc

SEQ ID NO: 694640 - DNA, 81 bp, Homo sapiens
ttagttgcattttatggggtaatttgaattactttttaaatgacatggagttccattttgacctggtactgcacttgaaga

SEQ ID NO: 694641 - DNA, 470 bp, Homo sapiens
  misc_feature (13)..(13): n is a, c, g, or t
  misc_feature (75)..(75): n is a, c, g, or t
  misc_feature (79)..(80): n is a, c, g, or t
  misc_feature (131)..(131): n is a, c, g, or t
  misc_feature (143)..(143): n is a, c, g, or t
  misc_feature (173)..(173): n is a, c, g, or t
  misc_feature (227)..(227): n is a, c, g, or t
  misc_feature (241)..(241): n is a, c, g, or t
  misc_feature (245)..(245): n is a, c, g, or t
  misc_feature (255)..(255): n is a, c, g, or t
  misc_feature (261)..(261): n is a, c, g, or t
  misc_feature (282)..(282): n is a, c, g, or t
  misc_feature (285)..(285): n is a, c, g, or t
  misc_feature (289)..(289): n is a, c, g, or t
  misc_feature (292)..(292): n is a, c, g, or t
  misc_feature (294)..(294): n is a, c, g, or t
  misc_feature (302)..(302): n is a, c, g, or t
  misc_feature (307)..(307): n is a, c, g, or t
  misc_feature (414)..(414): n is a, c, g, or t
  misc_feature (443)..(443): n is a, c, g, or t
  misc_feature (446)..(446): n is a, c, g, or t
  misc_feature (449)..(449): n is a, c, g, or t
ataagtagaaatntgtcttcatactgcaaacaatcacacagattttatattgtccatggaattaatacttaaaanaatnnttctttttagttaagaagagtcttcagagcaccattattctaatagaagtnattttggatatnagagttcatctttggtctttttcctatggnaagtacaagggaagaggtcgtcctcagtctgtggttctacccttttcatgcccnctcggatttggggntcantcacttgtancatggnctattcctggaaaagtttganatncatnccngnatatgtcntcgcncatgagattatttcttgcaaattcttgtcctgcttttgctatctttttggcctcttcatcgtgatctttcgcccatttaagtttttctagcagatcgctcaggttgntcttaactggaatgtagtttttccagggntgnagntcattgtaaaaatgttcatag

SEQ ID NO: 694642 - DNA, 191 bp, Homo sapiens
agctaacatgactaacacccttaattccatccaccctcctctccttaggaggcctgcccccgctaaccggctttttggctcaaatggccattatcgagaattcacaaaaacaatagccttatcatcccaccatcatagccaccatcaccctccttaacctttacttttacctacggctaatttattccacc

SEQ ID NO: 694643 - DNA, 327 bp, Homo sapiens
aggaggcacagactgctggaaataaggcggagccaaccaccatctgctaagtgtgctacatagctaatgtttccacgtattatctcatttaatcctcagcacctctgcaaggaaaaggctaacttccttttgaagttaaagaaacagagacttagagatgcaaagtagttgaattatgaccagtggaaccgaggccggaatccagtttgaatctaaggagtcttttttgtttttctgtattagtattgtttagagagagtttcactctgtgtcccaggctgcagtgccagtggtgcaaatctcagctcactgaaaacttcatctccc

SEQ ID NO: 694644 - DNA, 1128 bp, Homo sapiens
tagggtacattttaaatacagaaatacgtttaagataacaagattattttagatatctggtcatattttcggatcccagatcatttaacattcatcttcttctggaacaacatccatcggcgatggcacttcaacataaattcttccttctcttctatcctatctatctttcttctccttccttccttcctctcctctccatcttatccactcctgggattccagtccttacctcctcgcattgggtcttcccaggcgtggagcgtgcaccgtgggtgacaactctacagccctcattgtgcaaccttcgtgacctccgtgggctcacaagcgacattcgtgcatgcacttcagccctcccgagtatagctagagacgtgcagggccatgcacataccagccccggcgcaacattcgcgcactattcacacgtacaaacacgggggattcccccacagtgttgcggccacgcgtggctcctcgaaacctccgtgaccctggctaaacccgtgccgtgccctgtggcccctcctaaaggcgaccccccaactggcccccctggcggccacggcataggcacctccaggcgtacacccgacaacgctctcggtcccacacaacgtcaaccactactgcgctgtgacgacaaaaccgcttcctcagtacgctacaaaactcacagagtcacccaatcgtgtgcacaacatttattcccccttttacgtccgcccatccgggcaacggggaacttcctcccccataatactgcaaacactccctccgggggatccctatagttgttcctgacaaacactggatttccccataaggagaacccctactcccaacaagctgtcatgtccgcaaccaaatctaatctcgcaccactttgcgacaacggcttatacgcaacccttctccctccccccctttggagcgatttaggacgtccggcgaaatctcggccgggaccaacacacggccacttccagcttttcccgggtttccgtacgtgagatattttacgcctacgttagtctgtacgccacatcttctgccacacttaccaaaccttctcttccacaactctcctcctcgctcagccctagcgatgaacaagcctacaag

SEQ ID NO: 694645 - DNA, 260 bp, Homo sapiens
aaggcttcagtttatatagaacagaaattgaatgagagctgaatgagtgagccttccatttaagtaccagatcactcttccaaatttcagcagtgtccagacagtctgttatcatctttgcttttggaataaacacctataaatacatgttctgatagtttttttttccatcaaaactagtgtccaacgcttttaaggtctgactgggcaattttccacagtgctctatttaatgcagtctaaatgtatcaccaatgaga

SEQ ID NO: 694646 - DNA, 231 bp, Homo sapiens
  misc_feature (227)..(227): n is a, c, g, or t
cctgcctggtcggagaggagagagaggcttcccttggtcttcctgtgccctctggtgaaccttgtgaactaggtccctctggagcacgtcgtgaacgtgctcccccttgtcccatgtgcccccctggattggctggatcccctggtgaatctcgacgtgaggtggctcgtggtgccgaaggttcccctggacgagacggttctcctggcgccgagggtgaccgtggngaac

SEQ ID NO: 694647 - DNA, 239 bp, Homo sapiens
tcagattcacgatctgacagcaattaagaaagagtgaacaaagacaagattgtatcttatacttactaaatcatacaataacaaaagatccaggaccttataaacaaagatactccaaagaaaaaccatactttcttcactctacaacatgtcaatagacaccacattataactccaacagccaggaaacactttgacatgggagattactagcgccatgtattacattgcagacagat

SEQ ID NO: 694648 - DNA, 963 bp, Homo sapiens
  misc_feature (650)..(650): n is a, c, g, or t
cgcccagcctcccgcctcgcggcctcccgcctcccgcctccctccagactgcgatgtgcggcctcggctggcggcggcctctggccttcagtttgtaaggcgatcttgtggctgtcaggatggcggaggcacgcaggacgttctcccagtctctgcaagttgcctgcaccaggcctcaaacccacactgtggtgaacaacagctaccggagcgcacagcactctccatggctctgctccgtagggcatgtctggcatctcacgggatcagcaggcaatcactcattcgcagtgattgctgctggatggctggacggagcatactacattcagaggtcctctagtcgcgattcgcatgctggtctgcggtgtccatgctgagtctcactttcacgagcgaactagtgctgctgtggggagcgatcttgagagtcgaggagtcggcaactgaggaacgacggtccttgtagtccgatcggtgatgctgattcctacagaatgctaatgatgccgaagaatctcgtcactattgtacaagtatactacgcgtccggagcatggcagctcaagtcctgagcaaggttacaggagacactggtggctgcctgccagcttcagatcccgagaaattatccatttctgctgtgattntcctcatgtcctgggtggacgaagagaacattctcgatgtctaccggctggcagagctgtttgacttgagccgcctgactgagcaactggacacctatatcctcaaaaactttgtggccttctctcggactgacaagtaccgccagcttccatttggagaagggtctactccctccttcagcagcaatcgcctggaggtctcctgcgagaccgagggtatatgaggggggcccttctctaccattatagcctggagcaggtgcaaggctgaccagaatctcgctgcacgagaccccaaagctccttgagacag

SEQ ID NO: 694649 - DNA, 205 bp, Homo sapiens
tgatgttgcggctatactgtatgcggctatactgtatgcggctatactgttcgcggctatactatagcggacccttcgcctcgtctgtctcatgtatcatctgtgcattaaaaccccttcccctagttgcatgtttatacttgaaaccccgctcctcatggccttggcccttgctgaagctgcttcctcttataaaatagctttt

SEQ ID NO: 694650 - DNA, 440 bp, Homo sapiens
gaacgggtgatgcggtggggggggggaaagagagagagagagggaaagaaggagagagacagagagaggagagagagagagagagacagacagagagacagagacagacacagagagacggagagacagagagagagagagagaaagagagagagagacagacagagagacagagacagacacagagagacggagagacagagagagagagagagagagagagagagagagagaggagagagaagaactcggggggggtcccattcctttaaggggtcgccacccactcgagtgccacggtgagatcctagggagctccccagagggggagggcggggccttcccagagcgcagtagccagggtggacacgagagcgtgccgtataagcctagtgtataccacgcgtatcacgcgtgcggggtacagagctcgatattcg

SEQ ID NO: 694651 - DNA, 373 bp, Homo sapiens
  misc_feature (299)..(299): n is a, c, g, or t
ctactactactaaattctgcggccgcgtcgaccttttaacaggcatttttatagcaacattgttttgtttttgtgtttgagacagagtctagctctgttgcccaggctggagtgtagtggtgcaatcacagctcactgtagcttcgacctcctgggctcaagggatcctcccacctcagcctcctgagtagctggggcccacaagtgcatgccactatacctggctaatttttaaaacttttctgtagagatagggtctcacacctgtaatcccaacactttgggaggctgaggccgancagatcacaaggtcaagagaacaagaccatcctggccaaaatggtgaaaccatctctactaaaaatacaaaaat

SEQ ID NO: 694652 - DNA, 937 bp, Homo sapiens
gtgttggtcatgagcacagggtcgcatggatgcgacgccgggcgaaaaacgacctgttaggatggatgaattgtgttgccgcgccctccgtgttcgacctttgaggaaaggtttcccgagaggtaccgcccaattgagaactctggcgtgaattctgcaaagatgggggcccccttttcccgtggggacgcagtcatttcagagtggagatgtgacccattgaaaatggtggagcccctaccggattccagctgtggagggaaggaattccacattctttggaaaagatattgccccacactccagccagatgaaccgctagccagaggatgggcattacagggtgcgatacgtttccccggcatttttaagttagagaattttccgtcacagaagcaggttcctttttcccatatctctgatctggaaccctgattcagaagatactgaaggtgttcatgaagatctttagtcgaaaccatgctgctcccttctcccaaggtcgtcacccttctgagaagggggccttttgagctagaagctttctattctgatcccccaggagttccatatccacgaagccaaaataggccgctttgtagttcagaatgtgttctgcaccagaaagatggagaaaaatctagagtaaagtcacaagtgcgaagtccacaacccactggcattttcaccatctctacggcatctatggtggagaaagtccccactgaggagaatgaaatgtcttctgaagctgacactggagtgtctgaatcagagaccaccagaaacccagacactgattaaaatgtccagcaagacaacagtgaagctgggacacagccccaggtaccaactgatgctcaaccaacctcacagtttcccccttcacctggacttacctcagaagaaaaccaaatccccgatgctgacaaagcca

SEQ ID NO: 694653 - DNA, 137 bp, Homo sapiens
cctggcctccgcggacgcgatgccctttgcccccagggcgttcctactcaagaagcctggctgcaccccccctcacgcacagcctcggtcgtgacagccgccccctgttaatcacgccttgtgtgtacaaggaaaat

SEQ ID NO: 694654 - DNA, 648 bp, Homo sapiens
ggcttgcctggttccgccgtagagttgtccgttgttgggtggtacagggcggttgttgcggacagcgttgtgggcgttggggggtgcttccgctggggaggcttgtggtggaactcctgcgttggatgtctttgttctgcagttctcctggagaagtttaacgtgcccactgcgtgttggatagcgtgctgttgtttggaaagaatttggggtttataatgttgttctctaagatgatctgttgctgctttccagactttgaaaacttttaagcttcttgacggcctcttaccggaatacttctggggaaacttgcagggtccccaagtgtcgttgccatacaggttcactagagttctttgaaccacagctgaaaagagctttgtattatttttgtaatgtccctcccccagatatcgatttaggagtattatataaaggtggtggcgccaaaatacctatgtaaggaacgcctgttcccagtgttatctgtgatctgccagctctgtgagtttctgtgaggcccgaacaccctgtattttacaagtccaaatatatttacattaatcactatgttaatgagtatgtaaacatttttttgcattgatgaattttgtatctgcttccatttaaagcatacagccatta

SEQ ID NO: 694655 - DNA, 1237 bp, Homo sapiens
gtgttcttggtgttcccgtttgtggcttccttgtgctgcatttgttcttgtatgtgctctcttcattctgtgctggtgccattttgtttgcttcaggtctgcttaaggttattgctcatgtgcctcctcttacttttgtcggtgtgaggtttcctttcgctttgttgtcctttggtctttctctacaatgttgtctttggtcccgtctcagcgtgttcttttccgggggtttgctctccctggtcagtgtccttgtcgtttttgatgtgtgactgtgtttctctaggatagaatctggcttgtgcattgcttcctcactcaagtagtgcgatgcgcattcccttcatgttgcgatcttctacctaggggctttccagtgaactttctgtggtcatcattttctgcttgctgtggtatggtcaatgtaggtcttggcaacatccttggtatgcaatattgatcttactctccacttcatgggatttctatggattccaacaatggacttactaccaagcatattgtaaactatcgtgatgcccatcagttgaccaggtgaatctcagagcttcatgacttcatgcagagtgctgagtagggaaccatctttgccctcagctggctcgatcacctgatttgggcatgatcctgtctgacttcaggcacgtcgtgcggtttatatgacttcttccatggcctgccatcccactgatgccgatgatactttgcagccgtgattgtgcttgtatcgcgagcaggaagtctctggactgtgactgtgacatggcctcggtccaccacgctgttgtcaccagatccctcaggacttgtccctatgagacactgatcagcagagcatggagacctttttgttcagtttcccccatctgtactgtgctcgggaggcacgctgcccaacagcaagctgagagcgacggcagctctctactggtcaaagactttgagctggcatcagctcagcagaggcctgatatggtgctacggcatacggttatcggggatttctgtcggcctaaagatcgcacaaaagatgtcctgaccaagccaaggaccctaaccgctttgtgaaattgtcagtgatggggctgacagtggcacttggattcggctgcactggctgtaaggtgtaaaaggtgcgcctggaatgggcccctaagtttcagtctgcagctcgtttacctgaaagccagagaagaccttcctcttacataaatcc

SEQ ID NO: 694656 - DNA, 715 bp, Homo sapiens
tgcaagggtgatgtgtgctgcggcatcgcgaggtctcgcatatgtctgccatatacaagttttcagagtctatggagtgtcatcttgtctgctaatatgtacctgtgctaatatacgatccttggcacccagacctcctggtacagaaataacaatggcacttgtcgggctatatccaggaaagtgtcgccatgagattgtgaaccggaagagtccttatgttgcagtatgctgtcataagctaatggccttccagaattcctcttcatacagtacgctggggaacacttgccagaactgtagttgccactcagagttgatgtgtgaaccaaggacctgacttgcagaacaatcctggacaaggatgtttaactcttttatctccgaacatttgacatgagactaaactttccagatgctgttctctattttcaactgcttacttggacccaaatgtttctgtataaacaattaaagattgtaacgcattacaataggtctggtaaccaactccacccttcaggtactgtgtccatctaacaaattatttacacattccttggccaacttgtaactccgtggtaggtcctcacgataccacacattataggtggagggtattcctcttacagggcacccatagtacgaacaccaaacatggcttaactcacctccaaagtcctttcactgtgattgggaaactgtccaacttcaa

SEQ ID NO: 694657 - DNA, 724 bp, Homo sapiens
ctctcgactccggccagtcagtctcttcttcttctctagcgagcgagcaagctaggcttggaggtgaccgaaaatgccggtcagcaggatcgccgtggggagccaccgtgaggtgtacgaggtgggcgccctcaaggcggcgctcgccgagttcatctccacgctcatcttcgtcttcgccggccagggctccggcatggccttcagcaagctgagccccgacggcgcggcgaccccggccggcctgatctcggcggcgatagcgcacgccttcgcgctgttcgtggcggtgtccgtgggcgccaacatctccggcgggcacgtgaacccggccgtgaccttcggcgccttcgtgggcggcaacatcaccctcttccgcggactgctctactgggtcgcccagctcctgggactccaccgccgactgcttcctcctccgcttctccaccggcgggccgcccaccggcaccttcgggctgaccggcatcggcgcgtgggaggcggtggtgctggagatcgtgatgaccttcgggctggtgtacacggtgtacgcacacggccgaggaccccaagaagggcagccatgggcaccatcgcgcacatcagccatcaggcattcatcgtgggcgccaacatccatggtcggcaggcgccttctccggagcgtccatgaaaccagccgacatccttcgaacccgaactcgtcagctgggagatgggggga

SEQ ID NO: 694658 - DNA, 159 bp, Homo sapiens
ccctcttcctccagagtcacattgactcggaacgtggctgggatacgtgggctgaggagatcccctaggctgatcctgaacctccgcctcaaatccatgtaccaccagagtaaccacctctctgcccctgatcccagctcgaccctatatgattgtggc

SEQ ID NO: 694659 - DNA, 635 bp, Homo sapiens
acgtggcttctctcgccggggcaggggggcgcggcttcatcttactcccagatctcagcatattccacgccgtggtacgattaccagagagtgcatgttcgacttatgtccctcaccacttgtcagcgcatagatcatcgcgtaacgggacatcgcaataaatattggaagtgggacttaacatggatatgggagtagattttcctgtggggggggatgatatatgtatgctgacacagcactactgggtattggaaatgttctatttgtagccgcattggcttttgtatttgctttaggaagaacatgcacactcttcctccaatatcataaaatgaaagctacaggttgctctctgagtggcgaattcgtagttcttattgggtggcctcagataggcaagatcttcgcaatttatggacaggactgcacttgtccagcaagcttatatggtgacctgggccgaatgtataagacgagtcctcactccttgtattcctttctaaaatgacctgcaaaaagattttttggaagtaaaattcggagaaggcgaccaaatggggtaaccaccagagattttaaagagtttttagataagggcggttgttacaaaggcatttgagaatacccgcggg

SEQ ID NO: 694660 - DNA, 794 bp, Homo sapiens
ggagacgccagcctgcgtctgccatggggctcggggtgaggggctggggacgtcctctgactgactgtggccaccggcctgatgctgcccgtgaagaccacccgggcatcctgggggagcccagatcatcggggggccacgaggtgacccccacactccaggaccctacatggcatccgtgcgcttacgggggccaacatcactgcggaggcttcctgtctgcgagcccgctgggtggtcgtcggtcggcccaactgctttcagccacagagacctccgcactggcctggtggtgctgggcgcccgaagtgctgagtactgcggagcccagcgagcaggtgttcggcatcgatgctctcacgcacgcatccccgactaccagcgccatgagccgagccaacgacatctggctgctgcggctgatcgggtctgctgtcctgggccctgcaggtggggcatgctgaggcatgccagggagaagggccaggaccccacagcagcggggacgcggcagccgggctggctggctggaggctgacgtgtctgactctagaggaggcatgccgccatggaactgatggcaggccagaggtccgagctgctggtacccggtacgtctggcgaacgagctcctggaaacaggggcaccatgactcttacacatggctctggcacccgtaagtggggggacaggccaacagaacgggggctacttgcaccggccgacatccggaggtgccccttggtgtcgacaggaaacaggagcacgatggacttcgtacacattatcgggc

SEQ ID NO: 694661 - DNA, 781 bp, Homo sapiens
  misc_feature (1)..(1): n is a, c, g, or t
  misc_feature (86)..(86): n is a, c, g, or t
ngaaagaagcggcaggttcttctcaaccaaagttgccgccctttggtgagcttgaccaggccattttccggaaggcgacattagtnggtccccccaaaaaggtgcccagggtccaggttccacccctggagaggtctcactaaacgtagaaaggctccgcagcaaatagttgtgaacgtcttcacgagaaaataatccctgtcataacaaactgtctgtccgtggacgtcaacgacttatgtatgtagcgtcagcagctgcaagtaactgtcaaactctccaaaggctgcccggagtcattggtgcctgtcccccatcgcttagtggttgtgcaagcctataaaacgtgtgttcacatggtcttaaggaccagcacgttctcctcgactctcctaaaagcatgcgttgtgggaaggaggctccagtcactcacgaagtgcacttgctaagctcgtaaaacgcaagcccaaggcagcaaaagagggctcaaagctgttatggatgatttagcagcttttgtatggcagtgtggcaagtctcacgataatgggccctgcttccccgaggagggtaagggacttgttcccgcgagtcgatgggcctgagaggcatcaaatcacattttgaggcctatcagcggtctcttcatatgacacttaactaaattgaggtcggcaggtagggccctgagtgtccagtaggttggcgtgttgtcaacagggggtgtccggagggaggggttccggcatggatatgccggttttagggtttcttcaatcaa

SEQ ID NO: 694662 - DNA, 103 bp, Homo sapiens
cggtccagaatccctttcatcaacgaggatcattggagggctctggtgccagcagccgcggttctattttgttggttttcggaactgaggccatgattaagag

SEQ ID NO: 694663 - DNA, 497 bp, Homo sapiens
gattttttccgttttttattaatcgaagcactcagtaaagttggggaacgatcgaagatatgtatgcctcttgaccgggtggtggctttacaccaacgtataagaaacccaggtgaataatgcttggaacgtgattttcttttgttattctaatggtaggctgggatacttttaaacgatatgttctaggctcagggagtttggcttgcaccaacaaggtttataccctgctacgctgagcaagtgtgaatatagactggcttgcctcactggtttgcaaaaggtgtaaaatcatacctaacagatttgaactgagctttcgttgaattgggcttgagctgtacaagctcaacaggtgcaggagagttcatgatatgtatctccttgtcacgaagaagacatatatctgtatgggagggaaatgtttgggatttaaaattttggagaccgtttgtttataaacctcctcaacttgaagaggatgggtctctcggtca

SEQ ID NO: 694664 - DNA, 142 bp, Homo sapiens
attacgttggatactcaggccctaaactgccagcaattttcaaacctggccaccaggttatcattctcaaccagttgaacatgaggccacgtcagacagatgcctcctcaactcatgctgcatgtgtacacgcaccactatc

SEQ ID NO: 694665 - DNA, 459 bp, Homo sapiens
agtattgtatggcggaaagggatgatactggatagtgttctttggcagtatgcatgagatatgtggcatttgtgggtgcagtgttgttgttgcttgccgctggttgtgactgttgttgtggtggcattggatttcttcatatctgttacaaaatgctgccttcggacagaaggtgaactttggacttgccatttgtagatctacctatgcaccgttgaatctgatgaactggttgtagttcttgggcttgacaggtttacgaacctggttaatttatccttgtaaaacaatgctatgctgattgctattgcgagacaccatgtgaggcttaggcgagttagtagctctggcagggctcaaaggcctgacaggaaacggaccccaagtggattgagctggtggaaaagtacctccaaagtgggtcatgggcaaccttggtggacggatctgctggaaagt

SEQ ID NO: 694666 - DNA, 138 bp, Homo sapiens
ttttggtctgttttggtcccccccctcgtgggcttgggctcgggatcaaccccttttggcctgttatgattttgaacctttgccttgacccccaagtgaatctttttcctggggacccaaataaaagtataattttta

SEQ ID NO: 694667 - DNA, 1332 bp, Homo sapiens
  misc_feature (66)..(66): n is a, c, g, or t
  misc_feature (68)..(68): n is a, c, g, or t
  misc_feature (113)..(113): n is a, c, g, or t
  misc_feature (118)..(118): n is a, c, g, or t
  misc_feature (120)..(120): n is a, c, g, or t
  misc_feature (138)..(138): n is a, c, g, or t
gggcgagtggcgagcagggcctcggccgccacccacacgccccgaagcgtgctcgtcccccgcgcngnggctcccggccgccgccctcggccatcggactgctccccgtgtgncccangncctcgtgactccgctggncggcccggcgcggacccagaagccctcagggatcatggaccagtgtagcagtgtccaccctgcctgttgaagaagagtcctcctcagagaccaggatggtggtgacattccatcgatgtccatgccctcgaatccatgtgtcaagaactggccaagtccaaggcagaagtggcctgccatcgcacgttgtacgcaaccagacgtgtctgtcggccggaacccgattcgagcgatgcgcctttccgtaatgccaggccgcgcatatacagcacacgacttctacgcaacccatacctgtacggatgctttacattacaaatccatttggtatttccccaacatctcccaaagcaggagtcgccaggccacagcactatccaccgaggaattgtgccatatctctagcacttactgactacatgccagtttccatccctaaacaaaacactgaattctccataatccaccacgtcgttaactacgcgccaattacccacgctatcctctaactctcaccccacctggcccctttaatctcaccttcccacacacccacacctcacccaacaacatacctatcagcacaccacacaccacactcacaaccactccatacgctgggcactcacaaccagccagccaaggcagcgaggatgaaaaaaccacacaggcacccacatcagccgcctcattcgttcccaccaaacagagtcatccaccgccgctccatctgctcgcactcgcaccccccacccacaactgatgtaagctctttgttactccgcacaaactcagagcacgtaccacccgtccagccggcccaccccccacccacacacccgtcgcagtcctcattactacgctccccacgccctcacctaccaccccacgctagcttatctacgctagattataatatctcgtaccagtctcatcagatcaatctcacttcctatcccccacccccccactcctacggatctcttccgctctccattcttcgacacacacaacaccacaacacccctccaacccatcacacctccttcgcaccttactagagattcttaaatcaccaatcacacaaaccactacacacacatcactactatcacagtataacatatactacctcctacactacctatcgatagcccattctccaccgatctcatctcctctcacaccctacac

SEQ ID NO: 694668 - DNA, 302 bp, Homo sapiens
ttcctccaaagagatcactgttgacttttggtccaatgatgcaaagggctgcccctggggggtgtttttaaatggagaatccaaattattaacaccgacagcttgaacctctttcaaccttcctgctgcatagaccccaatgaatttcctatcttgggcaaaattcaagcccccaagggcttcctatggcaaacatctgaccaaaccgtgaccggaaaaaggaatcaagaactggcttggcccaagtgtcataagaaacactttcatttccataacttgcctcaacttgagaaaaagctttt

SEQ ID NO: 694669 - DNA, 382 bp, Homo sapiens
  misc_feature (8)..(8): n is a, c, g, or t
  misc_feature (10)..(10): n is a, c, g, or t
  misc_feature (20)..(20): n is a, c, g, or t
  misc_feature (344)..(344): n is a, c, g, or t
tcggcgancnttcttttccnttaaacctcatgaaccaacctctgctggttttctgcttttcttccgcagcttccctcacccgtctcggccttcatagaattgaggacggttaggaccttgctgtggattcagctttggttgccagtcacaccagccgtcgggcaaagttgttgttttaatctctccagaccactcagacttcttccacatcagcaataaggctgtcttgctatcctgtcatttgtgtgttcactgggagcagctcgtttaatttccttctgggggcttttcctttgcattgccgcttcagccgtttggatggcaaggagggcccggcttttctngacttgagtttttaggacatggcgtttccttcacaaag

SEQ ID NO: 694670 - DNA, 478 bp, Homo sapiens
tggagggtgcactttgggagatgacaagatgcacacaaacctcctctcactaattatccactaccacacactcaaaacaaccctgtgctccagaaagggatacgtgcctgccgaaacaaacagagcttaagggttttattacctggtaaatatactgcccaaaaccacacgtttcaggaagattagctcagaaatgttcaccaattgactgaagggcagtggcgggtgaggtgatgggacagcctcagggcgcacatgaggagggctccctcccccatgcaggcttttctccaggagcttcaccaggaactcaagggggatcagggagaattctgagaacaccctactgtggagctgcctagagaggaagaataaatgatgaaaaataaaactctgagtaacgtatgggcatttgttaatgaaaactgtttttctgaaagcttgtgaaggtcttgaaatgcccctgagtagctgaggg

SEQ ID NO: 694671 - DNA, 961 bp, Homo sapiens
cacttgctgaagcaggcagtggtgctgaggcggatatgctgagatgtcgggaacacaggctgccgatgaatgactgaaagacacaagatctgcaagagagttgccatggccctaggtccatgcacccgcatggatcccggcttgtttgcgctgctccagtagtccctggtgtctgtctcgggcggaggcacgtcatctctcgtgagtttgtaggagggtcttgtggtcacgatgaagaggtcgcatgggcctggtggagtggctgcggtgatccttgtgactcgaggtgcagggggttggcttgcgctcgtcttgcttggtctggtgggagtttctccttggcgagaggggtcactgtcgcggaggaataagatcctctcccgagagtacgtcgagtgatcgatcggggccttctgcaatatcatgaggggattcttgctcatggagtctctcttatgacggattcggaaggattcattgaaggaatccgtgggcaaaggctttgtttccatgatgctgatgtccggttgttcccgatgcagcactcagtaggaggtggcgagttggtcatttgctgtcctccaaagtatcagagcagggagccgttcaagaggcagagatgctgggagtgtcgccgaaagtcggcaggcattccttacgtgtgatcttcagcgaaagcttccaggtcccttgcagcatggtaatagggctccgggtgaatggcagtggtccaatggccatgtggtttgggccctgggggctctccagaggcggggcggaaaaatagcgcccggggaggccgaaatcgcgcggcacaatcgaacagggatgccgcgagagaaatgggcaggtgtgaaggtgggggaaacattgtgcgccacgacgagcccagtgaacaggagagcgccgcgaccagattagcgagcgcaaataataaggcacccagtgaggaaccagatcc

SEQ ID NO: 694672 - DNA, 554 bp, Homo sapiens
  misc_feature (259)..(259): n is a, c, g, or t
  misc_feature (391)..(391): n is a, c, g, or t
  misc_feature (510)..(510): n is a, c, g, or t
tacgccaatcctcaggggcagactggacaacataaccagtaagacgacgaactgcctcaacatcaaacccctcaatatcagtgtaaaaagaacgaggaacagcaccagacttaacaagagatttatcaatctcaatctgtctaattaaccaatcaacagcatataaagtcttaccattgcctggagcaccagtcacaagatttaacattaagtagtcgccttcactattccaacatggagagattgcaaggctaagcgngtcaacatggcactaccaataattgacaacgcctcaccaaaacccattaacaaagcaatatttaatacatccgcaggaataccagagatcttagaaacaataagattcaacgcagaagtaacaagaggaatnaaaggaacagtagtcactaatgcaaggccagcacccactaaaccacgtgcaaccgtctgacccaagatattacgcaacaacattgctaaccaactaaacattcttcacccccagaaaancaccggcaatataagcagcaagaatcgtagcaatcacaatcaca

SEQ ID NO: 694673 - DNA, 236 bp, Homo sapiens
ctgtatagggagcctaactgctatttcccagggacttaaggcctttgtacaactgagtagccctttcatcctccagaataaagggaccctcttgagctcagtgccttctcagtactggcatgccccagggatcgtcctccctgcctggatactctggccagctccattgataacccagcccagtcactcctagtccaggtgaatcccttcagtgacatggcccatggcttgcatgg

SEQ ID NO: 694674 - DNA, 884 bp, Homo sapiens
gcagaacccaaggtgaacgtcatggaggccactatggggccatccggctccctcgggatggctccggctggactttagaaaccccggggtgccttcaacgtccacattccaggtgaccacacgtgtctcctcctcctcatcttagcttgccaggtgtcaccctaactcgctggtacttaacctgactatggttgggcttgagaagaagactatggtttctggtcgggtagataggagagacggggcctcgcatgctacgcctgttgaccagcaggatccccgagaggccatcgaccagtctctggatcatcaccgcccctgggaactggggccaccaggcctgggtcagcgagatttgctctgactttatttatatggcatgaaatctctggttttatattggggactatggtggtggttggtgtggatcaacagttcgtatgtaattcatagagtagtgtgattatatatttgacatgttacatttcaaagaaaggtagtgttggctaccaggggaccaacagaaggtagtctgactatctgtgcccgcttcgactggaatactatggatttgaaaagagaactgtaactgctggctgatttataaagatgtcatgagtttcctgtgcttgttacactctgcacggtggccgtgcaggtgtcgtacgagaccggtatcgacgttggtgattcctgtaccccacaaacctacgatttcatccgagcgtgggtgggcccggtgtttacgaactccgctctctttggagttgactgggtaccaggggcttgagaggggggccagcccagggtttggaagctggaggggggattggggcccccttgagggggccctgttcccccgggtttaagggtcccggggaacc

SEQ ID NO: 694675 - DNA, 182 bp, Homo sapiens
ccgggagcccttaaccctagatgacgcagagaacctccgagagcgcttaaccctccggaagcccttaaccccgccagcccttaacccttggctgagatttcgctggagagaaggtagggacagcgtgaatctagatcatacattcatgcgcgtcactaattagatgacgaggcatttggcta

SEQ ID NO: 694676 - DNA, 674 bp, Homo sapiens
acacacacacacagagagataaggaacaagaagtgttttctggtgttgtggggaagtgaaatatgtggttggtaggaagaggtaccaatgacttccaaacatgtgattccgtcttaaaagttttccatttttacccgtgtcccccttcccttttgcattacagaagttagatatttcatattcatcgcttttcgttgtaaagataatctctttactccccgtgtgagtgattcacgtgcgcttgtcattattacagatagatgtgtgtgtattgtttttattttcgtagatgatacgtagatgtagatgaatttttaactctattatgagagtgtggtagagtcggggaggtcttcagggttttattccccctcttttacttgtccattgaggaagggaactgagctcctttctcctctccttcagaccaaatcattatcaaagtgttccttcagccctgcaggttgccccaatataaccctttttacagcatcctctgttcctcagtcatgcccagtgctggatcatgctccggtagtcgccctggtgaccaaaacagttgtctccagattattaccccttaattttggcttttacacgtgctgtctacacggtactgagaagggatcacaaaaccaaacagaagcaaggggagtctcagactatgatgatgc

SEQ ID NO: 694677 - DNA, 981 bp, Homo sapiens
gagagacaatgaacttcatggctcttggtttcagagccacggggccatccaggcatagttctgcgtcgtgcgtgaaactgccataaatgaactggcgcggcataagcaacatgtttgtttggcgacatctccatctgcgcattcatgcatccgtcggtccatagggcctggtcagcaccaccgcaagtggtcagatcatccacactgtaggggctatgtcagcacattccgcaccagcaacagtaagctaggatccccaaggatagcatgttggttcgagcaagagccctggctgacttacgggtgatctatatgggagtgctattaacctgcgaggagatccaagcctggcgataggatctaaagcaattgagcgattccaacgctggtctaggtccctaggggagccatatcacggaacgagataaggggattgtcttttggggacctcagatgacggtttgatcggggcagaataggtggacaaatgtctctgtcagtaagggaacttcgcagttattatctgcgctgtcttttgggttattcaacgtcctacgaatgagaactgggaccagtcatgtctatcatacttgaagaacgagtctgaatatcccagaagcaagaacaaaggggtcagtctgcatacataaacgttgaacggcgtggtcgtcaataggttcgccctctgttaccctattgatgcactagtgttgtgtccacgttgtgtctccttgggcaagaattggaaccggccactcaaagaggccccagggagatgtattcgctgagacagcttccgatggcatggcttaagatgccacactgttctcgtgattgcggttgctcacgaaatatccggtatcctgtctggcgggcttttgtcgccttggggtatacctgcaaagagtggggccagacagcgcggtttgatggggtctttgtgatatggctctccctctaagccgattttgtagctatccg

SEQ ID NO: 694678 - DNA, 368 bp, Homo sapiens
attttgaaaactgtaagaacagataatcaagagttgacaatatcattatttgtagcgactgctggtacataaaaactaccaatccggctgagcacggtggctcatgcctgtaatcccagcactttaagaggtcgagatgggcagaccacctgaggtcaggagtttgagaccatcctgttcaacatggcgaaaccctgtctctactaaaaatacaaaacattagccaggcgtggtggcacgtgcctgtaaacccagctacttgggaggctgaggcaggagaatcgcttgaatctgggaggcagaggttgcagtgagccgagatcccaccactgcattccagcctgggcaacagagtgagattctgtctc

SEQ ID NO: 694679 - DNA, 214 bp, Homo sapiens
cgcaatgatgtcggggcgatccagagatgactatgagcgagatgctctatgaacttccactgcatgggtggacgtcgtggataaccatggccggacctgcagccggggtactgagggctggcaggccctggacccacatgccccaggagcaagagcgaagggacgtactagctgaggaccaagtaccagtatcgtgccatcacaggagggcgac

SEQ ID NO: 694680 - DNA, 161 bp, Homo sapiens
tgttttaggattagaggctcaccgattcatgtcgggatggtcagaaaaccactctccataggacgtggtttcagaagcaaccttgggcttagtccacccttttaaggcactcttgagattcagagtgcctaagaaagatgacactcacgcaccgcgtttac

SEQ ID NO: 694681 - DNA, 202 bp, Homo sapiens
aagatccatgaaggattacctacccccgtcctctatcgagaccccagatcctgatgtggaggaagagccacctgcaagatggacacgagaccacaagctgcactgatgaaccatggcactccgcgccgcatccaccggcctgtgggtctctgaagggacccccccccaatcggactgccaaattctccgcgaatcgaagtgt

SEQ ID NO: 694682 - DNA, 919 bp, Homo sapiens
tccccaggctcaagggatttctcccaccccagactcccaagtagctggaactacgggtgtgcaccacaacaacctggctaatgttcttttttggtagacacagagtctcactatttagcactgatgggtctccaactcctgacctcaagcgatcctcctgcctaggcttcccaaattgctgggattacaggcatgagccacaatgcctggctctgtagttccgtactctctagcagtggtctttacttgtgtgctagccgtgtccctcattgtgctgatcctctgtaaaaattaaataccttttttttttttctccgcacacagagttcccttcttggttgcccaggctggcagtgcaacgggccgcaatctccggccacagagaaacttcacacttgcggggttcaccgcagttcttctgtgctacagcctcccgggtaacgtggcactttcaccggcttgtgccacccatgccccaagctaatttggatttccagcaaaagcagggcgtttctccactgctgggcacagggctgctcctcagaacaccttgacctggaggtgactctggtctgcttgggctccccaaactgggctgcgtctacccagggccttgcacacctgtgctcgctggccaacatcaacacttttattctcacttccgcttctcttatcgtgtccttgggccaccgggtttccacttgctccccccggtggcgtcgggggccaactctgtctcaggtggctccactggcggcaaggactctctgtcgggcccccgggtagtgtcgtgccgagtgcccccccgtggttgggtttgtgcacaggtcctgcccctgtcagctgcgtccgccccgtcaggggtcggacgctctcaacgcggggccgcccacggcccgcacaggctcgccccttgtcg

SEQ ID NO: 694683 - DNA, 454 bp, Homo sapiens
gcaaaacaaaacaaaagcaaaagcacagctgctcacgcctgtaattttagcactttgggaggccgaggtgggaggattactccagcccaggagttcgagaccagcctaggcaatctagtaagaccccatctctaccaaaaataaaaataaaaaatattatcaaggtgtggtggtgtgcgcctgtagtcccagctactcgggaggctaaggcgggaggaccgcttgagcccgggaggtccagggggcagtgagccatgaccccaccaccccactccagcctgggcagcagcatgaggctctgtcccaaaaatgaatgaatggccggagtgcaatggctcacgcctgtaatcccaccactttgggaggccgagacgggcggatcacgaggtcaggagatggagaccatcctggctgacacggtgaaaccccgtctctactaaaaatacaaaaaaaa

SEQ ID NO: 694684 - DNA, 571 bp, Homo sapiens
  misc_feature (434)..(434): n is a, c, g, or t
atccccagacttacccttactgagcggcctctactatagtctgtcattaaatgtaccaagcaaggataaggaaggggaatggattgagcctcgggagatcatagtcatcaatccttgctcatagctgtttggggtcagtggaggagcaaaacctatatgaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgancaaaccagtgagagccccaatccctgcagttttgtggcttcaagtgtgggtggacagtcctaatggggatctccagctccttccctgtgggctgtcacagacaggtaccccagaaggtcaatgtgggagtggtgtgc

SEQ ID NO: 694685 - DNA, 271 bp, Homo sapiens
  misc_feature (22)..(22): n is a, c, g, or t
  misc_feature (75)..(75): n is a, c, g, or t
  misc_feature (172)..(172): n is a, c, g, or t
ctcatgccctgtaatccccaanactcccgggaggctgggatgggagaatctcctgagccccagggattcgggaanagcctgagcagcagagtgagaccctatctctacaaaaagttaaaaaattagcccgcatggtggtatgttcctcttgttccagctactcaggaggcanaggtgggagggttgctcgagtccgggggggttgatgctgcagtgagccgtgatggcatcactgcactccaccctggtaacagagtgagactctgtctca

SEQ ID NO: 694686 - DNA, 1463 bp, Homo sapiens
acttttcgaggtacaccgatacattttgtaatgtgcaccaattttagacttcagtttgatgaatcctcacttacatgtatacattggggcagtcaccctccagatcaagatacagaacattgccaggtccctaaaacattccctcatttcccctcctactcagtatcccccagaagcaaccacgtatttcgacctcgatcattatcgcattagctcttagcttgctcttgcgcttcatactaaaaatggaactcatacatatagcacaatattcgcttgtggaattcacccatgtcactgtatgtctcagaacgttcacgttattctctctcttctcagccaaggcacccagacggctcatgccatgtaagtcccagactcttctgcgcgacggcccgcagcgcgagcacacacctaacattgcaagaatcaaacgaagaccaccacgtcaaagcaagccatctacctgcaaacacaatggaaacacccccaccgcgcgaaaaacaaaagaggtagaagcacacacacatcaaacaacgcagaacgatacgcagaataggaaagagaatgcatcaacacacgccgcacgagacacgcagacaacaagcagcaagagaccgacgaccgaagaagacatcacaacagaaagagagtgcgggacaacacaccatcacacaagccaacacacatcaaccacaccgccccccacaaaccaacaccgcaccacacagcactaagaaacactaacgaaacatcagcgcgaccgaggaagcgacataaccaagcacgcacaacagccaggagcgcgcacagaaatcaacttcaatccgacagaagcgaagagcgacgatcttgagctacgatcatcaagccccagacgacgatcagccgccacagtagagcgaccgagatgaaagcgcatgacaagaaagagaaaaacagcaacagcaaagtaacgtacaacggtccatcacgtagatgcagcaagactacttaaacagtccacatagctaccacactcgacctccacacgcgcctagccacttcagcacccatcactaccccacactcaccaccacccacgcagagcaaagacactaacagccacactaacactgcaaccgtccacacaaccgattgcggagcgaaagagggaacacgcagactgaggatacacagaacagacagcaacagacacaacacacaccatgaacataacgtgaatcacgtgaccgaagcacacacaacacgagagcacacggagagaaacgactagaacgcacggcgaggacaaagcaacgaccgaatgaccctaaaacaacacagtacgcgtggacgagcagatcacacaccagagatgacccacatatcacgccacgaaccacacgagcaacgaagaacgaaagccaagagagagagagggcccgcaccacgcgacagaaccagaccgacctcacagtcag

SEQ ID NO: 694687 - DNA, 423 bp, Homo sapiens
  misc_feature (276)..(276): n is a, c, g, or t
gcggctttgcgccacttctttatgcacttccagtcgctgggtctcgataggcttcggctgactccgccgtcacgcttgagcgtcaattcccaggcgaacaggcccaggcgctccgcttcggcttcgaaggcttcgtgcaggcgttcggcgcggtactgcgccagggtttcgcccttggcctgggcggcgagggggttgagggtgtcgagctgcgtgacgacctcagggtgttcgttcaagaaacggtccagcgcgcgctggtggttatcgccgggntgggacaatgcgtgactccaaatagaaaaggcttcaagcgccgctgcgatgtcggcgccgggcgtttttgcgcaggcggcgctggatggcgttgcgtatcggctcaagcaaaaacagcagcaggtaagccatcagcaccgtgaccag

SEQ ID NO: 694688 - DNA, 521 bp, Homo sapiens
agacggagacttgccctatcgccaggctggagtgcggtggcacaaactcgcctctggggttcaagcaatactcccgcctcagccccccgagcagctgggactacaagcgtgcgccaccatgcccggccaactttttgcattccagtagagacagggtttcaccacgcaggccaggatggtctcgatctcctgacctcctgatctgcctgcctcggcctcccaaagagtcaaaaataaaggcatgagccactgagcctggcctccaatttacctttagagactgagcccagctctgtggcccaggctgaagtgcagtggtgcggtcatagctcactgcagcctcaaaccccaaggtgaagccaccctcctgcttcagactcccaaaatgctgggattacaccacgtgagccgccccgacccgctggggcactgtgattattaaaaaccctcaagccaacccagttgtctacaaacccagggacaaaaaaagcttcgggacccccctctctacaaaaaaaaag

SEQ ID NO: 694689 - DNA, 708 bp, Homo sapiens
gccggagatgtagacttaagcgtttagccccgactaggctgcgtgcccacttgtcatccgtccgcctatagataccacggactttgacttgaaagccgtgaaggggatttgcgttcctctggttagtgtaaagtttctgcggtgtgttgctgttaatgtgaagacggatgtacacgttgtgtgatagtgtgtgtgaccctgcttgcttttttcttggaactcctcagcaccgtattggagggatttgttcacggtttgcacgcactgaccactgggcttcttggctgtctggtgctctctgctgcacgtaccacgttcaaaggtgtagccagtgtacccaccccacgagtagcacttcaaaccaaagctgcctcaaactttttcgagaaaaatactttattcataaatatccgttttattctcatgtacctaagttcgtggagaaaataattgcatcctataaactgcctgcaagacgttagcaggctcttccaaataactccctggtgcaccacggagcaccctgcatcccagagcatgcttaccttttactgttctgcatattaccaaaaataacttgccacttcataacttctttgaccaagtaaattacttttttgattgccgtttatatgaaaatgtactgatttttcttttaataaactgcatcgagatcccaccgactgaattgttaaaaaagaaaaaaaa

SEQ ID NO: 694690 - DNA, 876 bp, Homo sapiens
gggagccacactgaaaaaaaaatttccccctgcaatctactcttaactgatagtcgctaacttggttatgtgtgtctattcagactattaccataatgatttctcaaacaaaggtcctttctgaaatggtatctatgattcagctattcaaaacctaatgaagtgggtgactatgacaatgtggagaaatcatgacagaaaatgtggttgtactggggctgtcaaattgctgtaaagggaagttggggaaacaaagcactaaagaaactcaatgaagacctgaagcgaagagaaggaatttcaacaaagctagtgcggatctgggaggaacgagtaagacttaaccaagctaagagaaaacaggtcaccagggaagattggaagagtcatttggaagatcgacacacgcaggcatggaagacctcccttcttctctgctgacacttgaatcacttaaggactggcaattcatagacatggtttgctgaaaatctgaattccttggaacgatccagaacctccatggtgtcagattatctcgaaaacaatttaagagataccagacaggatgggaatgcattactaagacattcagggacaggggattacacacgctaccaacaaaaatcagagactgtacccgagggcactaagtccatcgggcagcctggggaaacataaaagtggggtcacaagagatactttgtgacgtcaaaaggagatacaatagcgtcaatgcacacctggcacggagacgcaagtaccaaaacccttgggggtagattgctgcctgaggggggatggcgaaagaattgacatcgacaaaagaagaaaacaaagaggggacaagaaacgggcacacaaaaacacgagggc

SEQ ID NO: 694691 - DNA, 122 bp, Homo sapiens
  misc_feature (31)..(31): n is a, c, g, or t
ccagccgcgtccgtaatcaggtaagtgaacngtgtttacatatgcgtgtatgcatacgtgattcgtggtcatgaacgtagtgcgtggaatactcatctaagtaaaaaatgcctggatgtaaa

SEQ ID NO: 694692 - DNA, 393 bp, Homo sapiens
  misc_feature (155)..(155): n is a, c, g, or t
gcgatccgagtcacgagttgtacagggtacctggtgacgacgttctgttggcctgggggccgcttgttgaacgtagcggttcatgcatgatgatgcgagggctgacagttgagtgccaaatccaaccccgtgatgaccccagtggtgaggtaganctggatgatgctccgtgcaaaaggacgcagccaaccatgcccagtgatgcacagagaccccccaaaagcatgacggtgcctgtgcagcccaaaagcggttcatgcacacacttgcagaagcggacctgtcccgtacacgcatgggccagcaggatggaggaagatccaggcttgtgtcgcttatagccgaatcccaaaactccttgtattagcctcctttacaagaacagacacttga

SEQ ID NO: 694693 - DNA, 523 bp, Homo sapiens
ccggatttctcccccccctcccttaaaaatttctcccccctcgaaatctgccccctgaaattagaggacttttctcccccggtgttctcctcctctcagagcttcatcaaaaactactccgcgcgcgcatacaaatctgtctataacgaacttcaagttccacacactcgtgtattattaaacaacaatatgccgtcggagatcatgccttttgtgaaaacacacccatcttaaacgattctttcttaaaacaggattttattatatattcttcaaaccacgcttctctctttttaaaacaaatgtgttcatataagtccctttccgtcctgtaaatcatgcggtgagtaaaacaaccattttttctagaaaaatttcgcacggctttccacacagattttccacaaccgtgatgaagagagaaaaaattgagataaaccaccaccccgctttctccctcttagcggccgacacaccaccattaaacttttctgaattcaaacgccccataatatacaaactt

SEQ ID NO: 694694 - DNA, 463 bp, Homo sapiens
  misc_feature (14)..(14): n is a, c, g, or t
  misc_feature (117)..(117): n is a, c, g, or t
  misc_feature (141)..(141): n is a, c, g, or t
  misc_feature (145)..(145): n is a, c, g, or t
  misc_feature (153)..(154): n is a, c, g, or t
  misc_feature (156)..(157): n is a, c, g, or t
  misc_feature (159)..(159): n is a, c, g, or t
  misc_feature (162)..(162): n is a, c, g, or t
  misc_feature (170)..(170): n is a, c, g, or t
  misc_feature (180)..(180): n is a, c, g, or t
  misc_feature (207)..(207): n is a, c, g, or t
  misc_feature (254)..(254): n is a, c, g, or t
  misc_feature (277)..(277): n is a, c, g, or t
  misc_feature (293)..(293): n is a, c, g, or t
  misc_feature (297)..(297): n is a, c, g, or t
  misc_feature (302)..(302): n is a, c, g, or t
  misc_feature (337)..(337): n is a, c, g, or t
  misc_feature (365)..(365): n is a, c, g, or t
  misc_feature (370)..(370): n is a, c, g, or t
  misc_feature (380)..(380): n is a, c, g, or t
  misc_feature (388)..(393): n is a, c, g, or t
  misc_feature (402)..(403): n is a, c, g, or t
  misc_feature (449)..(449): n is a, c, g, or t
tttttataaaaatnatccaagtgttcaatgcacaaatttttctctcaaacagcagaataagatgcacccaggaattctcatataccgcaatagaatgaagaaacagtactttcaganaattatctttaggtgaagaaattnaaantgtcaatnntnntntantgtacatnaacatatacntaaaaagtctaaaaaccaagctgtganaagggacctagaactgaaacaaaatttgagaaaaacttacttaaaancatttgtttcctgtaatctctanaaataattttagaagnaganatttntgaactcaactgttatgactaatacaaccaaaaanttcacttaatggcattttgtgtaatggngccgntatccttggngtattaannnnnnaaattattnnctttttctttttcaaattcagctatttgattaaatatattcagtanattctggggtaaat

SEQ ID NO: 694695 - DNA, 84 bp, Homo sapiens
  misc_feature (26)..(26): n is a, c, g, or t
  misc_feature (49)..(49): n is a, c, g, or t
  misc_feature (54)..(54): n is a, c, g, or t
  misc_feature (75)..(75): n is a, c, g, or t
ttactcaggaagggaactgccattgnccccaaggcttctgtctactaantctantggtcttgtgttttgcttgantgcttggca

SEQ ID NO: 694696 - DNA, 149 bp, Homo sapiens
actatctaaggtgtagatgtatgcctggggctgtcccccaagtcctccccaaagccactcccgtgcccacgatctgctgccaccaaacacccagggactctgcccaaagtcccatttataagcctatttacatgaaaagtaataaaatg

SEQ ID NO: 694697 - DNA, 474 bp, Homo sapiens
agggggagggtgttagggagagtagcctttgatcctttgttactttgggtgggaagatggggtttttccttttagtctagttttggaaagttcgcgttaattggttttagattccctgcctccctagacccaggacccatgtggttttttttgtttttgtttttgtttttttgatggagatggggtcttactctgttgcgcaggccgaagagcggtgaccggatcacagctcactgcagcttcaacctcctgggctcaagggatcctcccacctcagcctgcagagtagctgggaccacagccgcgcgccaccacaccgcgccaatttttgtgttcttggtagagaccgggttttgccttgttgtctaggttgggctccaactgcagggctaaagcgatccaagagcatcagcctcccggggtgctgggattacaggcttgagccaccatgcccgccttattatattaatttaa

SEQ ID NO: 694698 - DNA, 685 bp, Homo sapiens
agcggactcagtccccacatcaatgggcactgcccacccagacagcacctactcctgtgggcagcacccagaaccggtgctcacgatggggaagtcaggactgtggagaagcgggaaactggagcccgagggcagggtgctcaggagagacccatccagacagcaatgctcaaggccaagtgagaccaacgacctggaatccagggagaaagcagtgccagtcctgtttctctgggcctcatcctctcctccatcaaaatgaggaaccgtggactgcaggagcattgaggaagccacgtggagtccccgctctgtgttgagccccgtagggtgcccttcctgtgggcggccattctgggcgtggcgccccctgtctgaaatcagcagcacaccagctccctgtgctccgtgtgacaagctgccagggacaaagagaaactcccctgggaccacagcagtaggcacggcattcctgtgacagaaatcaatgccacagatcgagggatggagccaccggcttcccaggttgagtccccttccggtaacacgggcacactcctttctccctccaagaagatcccagggagggcgatcccgcatggatgcgttcctcactccctttcaggtggccccagacgctgggcattgggaggtggccacgtggggacatggacatgaaggctgg

SEQ ID NO: 694699 - DNA, 162 bp, Homo sapiens
cggggggccaaaaatatttatggggggtttacggggtccaccgaaaagggctgaagggtttgggatgcaaaaaaaaaccccccccctgggaccctgcagctccaggcccctgggggggtctttgctggatgggacacaaaactggcccctctttccaacctt

SEQ ID NO: 694700 - DNA, 211 bp, Homo sapiens
catgcagtatactggtggtgccgacagacagcactgagtaggcgtacaggtctaagcggatgtccacgtcacacttcatgatggagtagaaggtagtttcgtggatgccacaggactccatgcccaggaaggaaggctggaacagtgcctcagggcagcggaaccgctcatagccaatggtgatgacctggccgtcaggcagctcgtaact

SEQ ID NO: 694701 - DNA, 701 bp, Homo sapiens
aaatttgccatccttttgccccctaagaagtttgaggccaagtttaacccaaactacctcccttgacagagtgttggaccggaaaacaagtttgtctcaaggtaaaacaacatcttgtattgcaagcaaaaggaaagggcccagtcaacttcagtttgttgtgcctcaagctgaaagctttcagaaaccagaaaaaagaggaaaggcttacctctcctaccaaagttaagtgttcaaagggaatgtaagggcctcacttgaacaaggaagcaacttgtgtaatcttatgtcagcttttttaggaagcccaagtacttatattgggcatgcacttgcctttaaaaacaatgatttgtgagtccaggaacaatttactatttttaaaatattttgctgcttctgttctgggtctgaattcccttttgtgccagatgccagtactgtctgcccattggctccaggggctgtatgggcagattcagtctccagagggtattcagatcatctgcttctttgaaggagtaaatgtgttttgttcctagggccagaggagcttgtcttccttgtcctctgttcccaccctcccctgaacagaacccagcccataagagacattctcagatgaaactctgttttcttgccccagtcaggctcaagccctgtggttgtaggaataaagcctgtgatctccagaaaaaaaa

SEQ ID NO: 694702 - DNA, 436 bp, Homo sapiens
  misc_feature (52)..(52): n is a, c, g, or t
  misc_feature (174)..(176): n is a, c, g, or t
  misc_feature (178)..(178): n is a, c, g, or t
  misc_feature (188)..(190): n is a, c, g, or t
  misc_feature (193)..(193): n is a, c, g, or t
  misc_feature (199)..(199): n is a, c, g, or t
  misc_feature (206)..(207): n is a, c, g, or t
  misc_feature (209)..(210): n is a, c, g, or t
cccagccgggttcgtgtcgccatggggcagatcgagtgggccatgtgggcanacgagcaggcgctggcgtccggcctgatcctcatcaccgggggcatcgtggccacagctgggcgcttcacccagtggtactttggtgcctactccattgtggcgggcgtgtttgtgtgctgnnngngtaccccggnnnaanaggaanaagggcnncnncatggacgctggggacagaagcacatgaccgccgtggtgaagctgttcgggccctttaccaggaattactatgttcgggccgtcctgcatctcctgctctcggtgcccgcggttcctgctggccaccatccttgggaccggctgcctggccattgcgagcggcatctacctactggcggctgtgcgtggcgagcagttgacgcgcattcgagctcaaagccccggg

SEQ ID NO: 694703 - DNA, 376 bp, Homo sapiens
taccagggtacgagcagtgctatagaattgataatgctggtacatcgctataccagatgaatgtggactgactattcaatgcgtcccattgggactgtatgatagagagctcgtcacctcaatgcggtaggtctactgcttctcgtagtgctcgtgtagtatacaccactcctttcaggttttcatccctcaaggcaaaaggaacagtctgtatcctcatctaccatgaggaccgttgtcctgggatgcatcactccatcctgtgtgtatgcacccagccggatacaaatcttgattggtggctattccaaattgggagggagacgagatagtattccaaagggcatctgggctcaaggcaccattccaaatccat

SEQ ID NO: 694704 - DNA, 257 bp, Homo sapiens
tatcaccgcctcggctccgaagtgctaggattacaggtgtgagctactgacctggccaggcttagaaacttttttagactaggcctcattcttggacctgtcctctagagcccagttttagcaagaatcctggcagtttaaaaagaatccccttgaccctttatatctgaccaagctaacctgtacttaagcaagaatcctgtctggtcacatgtagcatgaatttcccttacccttcattggaacacggtctctca

SEQ ID NO: 694705 - DNA, 636 bp, Homo sapiens
  misc_feature (288)..(288): n is a, c, g, or t
  misc_feature (294)..(294): n is a, c, g, or t
  misc_feature (361)..(361): n is a, c, g, or t
  misc_feature (586)..(587): n is a, c, g, or t
  misc_feature (593)..(593): n is a, c, g, or t
  misc_feature (596)..(596): n is a, c, g, or t
  misc_feature (598)..(598): n is a, c, g, or t
  misc_feature (620)..(620): n is a, c, g, or t
  misc_feature (629)..(629): n is a, c, g, or t
gagacttaagctgaggatcgttggatctctggggggtgcagaactgagcccaggccacagtaccctattcacgctctgtgcttgtgccaaggtttcaagtgatcctcccgcctcagcctgcccaggtgctgagattacatgtatgagccactgcaccctggaaaggagccagaaatgtgaagtgctagctgaaggatgagcagcagctagccaagggcaaaagggggcaacggccgggttcccggttgtctaatggcacatcgtggcccacaaagatgcctctgatgntctggntacctggaagagtgagcctggtcaggtaaaagcagctgttaagtatgcccttagcgtaggctaccgncacattgattgtgctgctatctacggcaatgagcctgagagtggggaggccctgaaggaggacgtgggaccaggcaaaggcggtgctcgggaggagctgttgtgacattccaaagctgtggaacacccaagcaccaccggagatgttggagccgtgccctcgggaaagactctgggtgacctccagctgagtatctggaccctgtacctgatgcactgccttatnncttttngancnggggagaacaacccctttcccnaagaatgcntgatggg

SEQ ID NO: 694706 - DNA, 904 bp, Homo sapiens
  misc_feature (749)..(749): n is a, c, g, or t
tattctggtctggttctggcctcactcccggagctctattggactcccaaaagaagcgcccaaaaagaaaaagggccataagtggagtcccgtggtgctaggattttttcattcatagctggtgctgatgagcgctcaggaatcagtgggctatcaaagaagaacttgtgatcatccaggccgagttctatctgaatccgtgaccaatcaggcgagtttatgttggactttgagtggtgatgagattttccagtggtggattattggcaaagaaggagacggtctgggggtttgaagaattgggacgattggccagcttgtgaggcctcaggggtgcattgggccaacatatagctgtggacaaagccaaccgtggaaattttgtgacaaagggcctccaattattacttcggattcaccagatgtggtaccctccgagagaggttaacgtggtgcctcacgaaacaggcccttggtggacacgtgagaagaagcccaaggttccctcaatcgtggtttacatcgaccaagtttcaccccaaccgagtgggtctcaagtgtccacggtgggcttctcgaaaatgtggaaaacccgtgtgtcacccacgagggagtgtgttcgagaagaacgaggtctttcctgtggcccgggggggaagaaccaccttttttcgcgcaagtttccacttattctcccctttccgtggctctcaatgtggggacgttttacgacgtgcagggtgtggagncacttggggctgtggtatgagcctctttctcagagcactggggagttgtgatgctccagagccctctcccagagatctacggaagaacgtggctgtgtgccctgggcctgactgggggctctggggggcatcactcatgtgggaccatcttcatc

SEQ ID NO: 694707 - DNA, 496 bp, Homo sapiens
  misc_feature (148)..(148): n is a, c, g, or t
  misc_feature (154)..(154): n is a, c, g, or t
  misc_feature (221)..(221): n is a, c, g, or t
  misc_feature (446)..(447): n is a, c, g, or t
  misc_feature (453)..(453): n is a, c, g, or t
  misc_feature (456)..(456): n is a, c, g, or t
  misc_feature (458)..(458): n is a, c, g, or t
  misc_feature (480)..(480): n is a, c, g, or t
  misc_feature (489)..(489): n is a, c, g, or t
gagacttaagctgaggatcgttggatctctggggggtgcagaactgagcccaggccacagtaccctattcacgctctgtgcttgtgccaaggtggcaatggcggcttcctgtgtctactgcacactgggcaaaagatgcctctgatgntctggntacctggaagagtgagcctggtcaggtaaaagcagctgttaagtatgcccttagcgtaggctaccgncacattgattgtgctgctatctacggcaatgagcctgagagtggggaggccctgaaggaggacgtgggaccaggcaaaggcggtgctcgggaggagctgttgtgacattccaaagctgtggaacacccaagcaccaccggagatgttggagccgtgccctcgggaaagactctgggtgacctccagctgagtatctggaccctgtacctgatgcactgccttatnncttttngancnggggagaacaacccctttcccnaagaatgcntgatggg

SEQ ID NO: 694708 - DNA, 164 bp, Homo sapiens
cgatggaaccactactcaagctcatctcaggtagaacttcagaagagcttgagtaggccaaatgttgaagttaacgttttccaataatgtgacttcttagaaagttttattaaatggggacggggcagacttattggcaattagtctggcagtgcgcctgttca

SEQ ID NO: 694709 - DNA, 209 bp, Homo sapiens
cgcccggcgtgggcagagcgccctggcgcgcatcttcgggggtgtggaggacgggcctgaagcagaggcagcaggacacacctatgatcgctccattgtagtggacggagatgaggcatcactcatggtctacgacatttgggagcaggacgggggccgctgtgttgcccggcccactgcatgggcatgtggggatgcctatgtcgatt

SEQ ID NO: 694710 - DNA, 171 bp, Homo sapiens
atgtttttttaaaaaaaaaagccaaaaattcttatggcggagttttttgtttgtttattttaggagctgatgcgggcccctccttttgctggagagttttttataaactggagcccgatttcatattggtttttaaactggggggaattaaaaacaaagaatttccttcca

SEQ ID NO: 694711 - DNA, 194 bp, Homo sapiens
ccagggcagctagggaggtataatggtggggtactaggtgggtattggtcttatggtttctctactaagaaactcttccttaaaggtggttggtaatggtagcacttttaacacggaaactatactggaacagttccaacggtacatacggtatgaagctggtcctcactacatgccaggggtaccggagctcg

SEQ ID NO: 694712 - DNA, 124 bp, Homo sapiens
gtggacgtgttacacgcagagggtaataagagatgggcagtatggacactccagatgatggtcagtgacgggctagcctgcaccaatgctcactatgtggtcctctggtgtttctcttgtataa

SEQ ID NO: 694713 - DNA, 142 bp, Homo sapiens
gatattagttgccgctttgacattctttcttgggaaagatgaagatgaaaaacaggacagtgactccgaatctgaggatgatggaccaacagcaagagacctgctagtacaatatgctacagggaagaaaagttccaaaaac

SEQ ID NO: 694714 - DNA, 850 bp, Homo sapiens
taaaaacggtctcactctgtcacccaggctgaagtgcaggggcccgacctcagctcacggcaacctccacttccggggttcaagtgattctccgtgcctcagcctcccaagtagctgggactacgggcaaggcaccaccacaccaagctaattttggtatttttagtagagatgaggtttcaccactgctggccaggcgggtctgaactccgtgacctcaagtgatccacctaccacagcctcctaaagtacggggattacaagcatgagccaatacacccgacctcatagtagtttggattcacacttccctaatgatggtgtccagatctacgggccattggttaggggtttacttctctctttaaagaacggctgagacctccataaacattttcaaaatgcaggctctgtatccagggtcaaggcacctgtttctgatgtgttttccctgtgtctctatcaccaaatactgtacatataaatagtaagactgcgctcgtgtttgtccatggttaatcctaattgcacaaaccctgggaacttggacaaatccttcagaatacgctatagccaacaatgggctaaagccaagtgtttttcctaactcctgaagcggataagtgccagaataaacacacggatgatcctttgcgggcctggtcccccgaaccttctggcacttccggattggacacacacttggccgcccatggggcaaccttgcagggaacaatgtgctaccacgctcagacgtggatggaagcgctcaaggcgcggatttggcagaataagactaccctaggaggcctgatacgacgagaaaacagacctctcactctgttctaat

SEQ ID NO: 694715 - DNA, 143 bp, Homo sapiens
cgacatcctacaatagcgcggctatgcccctgtatgtaattgcacacggtcacgttgcatgcagtttgctgagctgaaggacaagattgatcgccgttctggtaaaaagctggaagatggcctaaattcttgcaagtctggtg

SEQ ID NO: 694716 - DNA, 347 bp, Homo sapiens
tggttttttaatttaaattttttgttattttttaaaaaatatttttaatccatggttggttaaatctgtaaatataaagggccaactgtactgttagacacaagggtttcgaggcttgcagataaagactgaataaccctttccatgatgatcccttagagttcccccactgtgcctttttttttacatgggcatgcaaacatgtgtttccacatacattttttttaacaaaaattgaattatgttgaaatatgtcctgtaatttgtgttttaaacttaataaattttaggcattttccctgtgtgtgtgtataatgcagctattaaaaatgagtttgaggccagga

SEQ ID NO: 694717 - DNA, 413 bp, Homo sapiens
tggagtcggggggtttgggcggggcctgtcttcctggggacaggccgtttcttcattcaggaaacaaaaagggcctttgggcttcacccaacaggactcttgaggtgaagtgcagatgccacattcaagggaagaaccttttgccccagctttgcaaaatgaaaagctttcccccttgggttttatttttccacaagagctttgtcaggaccaggttgtttctggttcagcaactttgcaaaaaatgtccccccctggggcttccttagctcctgtttttggcctgaagcctcccagctttgatggcagggcctcattttcaacttttggggttccctttacctaaactgtcctgccccccgggcatttggactccccttgtgccccccattgcatttttaaatgttttccca

SEQ ID NO: 694718 - DNA, 993 bp, Homo sapiens
tgtgatacgggtgctctacctaatgcggactaggcttttaccgcgggtcgttatgccgctttctgatactccatgtgcctgcacggttctcagagagtacataacgtgcgctccagagactgcgtgtgattttccgagggaacgcggtcctggacagctctgcgcgtggcgcgctggtgcgtcgggacccttcacaggttgtcgctttgggctcgtggtcgacccgtccgctgcttaggcttacgaggttggtgaagtagacatcatgctcgctatcagggttgcgttcaggtgcgggagatagacgtccttaatcattcactcggaatcggaggtaggagtcgccagggcagaacgactaatcgctagggacgagagaggggctatcggtatatccatgagtcaccgtaagagatcttgcacattatccaattttattgatactcgaaacatctaacggggactttatcacccctcggtacacaccctatctcatcccgcgcgtcatcatgtgacatcccaaaaaaaggatccttgacgaaaaaatcgagttgacatattgcgtccctcgtagatgtacgttgggtggcccttctgatgctcaagagagtcttgctagcgcatgcatcctctttaatctaatgttttaactatacagccacgtaagggactcgagatctatcgtagggagaccagaagtggattcctcgctgctgaatctgccctgggcgggacgtggtggcgccacgggacgattgtgggcaaggtctacagctatcatggttgccctcaaacaccgtgggatcttagggctcgacgcccgcgaaccccgtggtattttcgaattgctctcgactctcaggcctctatgtgatggaacatcaacgatgtggcgcatggtgagcgtgttatgcctttccttctttggcgtatgatgtgtgcctactactttacccttagaggtgacaagcccgagaaggtacttcgggctgt

SEQ ID NO: 694719 - DNA, 1213 bp, Homo sapiens
aaagagcaagagggcagggagggagcacagtggtgtggccagcgtagtggtccagcactgtgtgggtgtgtaccccatgtgcctgggtcagacatgggacatggcatgggtgacacatgtgacagagtgggtccccagctgccacctcacccacctgcaaattcatttagtagcatggcacatgggtgcatgctcctgtgcactggcgtttcctcatgtgccttatgcctggacgcctctgatgggcttggagatgctgggaatgacagtgcatgttgcatctggtgagagttatgcagcagtgactgtcaccatgtgatggcgcgaatgctgggccacgtgagacgggggggcccctgtggaccattgcggcaggcaagggaggtgctggcagtgggctcagggccctgctgaggccggccgggtcccaacagatgcgcacttgctgggcccaggggatcataggatagcagagagcaggggcccgacaagtgtgcgacatttggagatgacctgcttgtattgccgctgtcagcgggcatcaggcccccttggggggcctgcgctttggggcaggaaccaggtaaccaaggcattcccagggggcaggtccaacagggggcattaggcggccgaagacccaggactaagagccgaaggccgggacacgagaggcgcgagaacgtttgcaacctgaccgcgctcttcaaggggaacggcgggcacgcggaatgggttgccacaggcccatgtggcggcatgaagcggcacgcacggcacacgccgtcaggcacgtgcccgtcacgacgggtgacagaagtcccctttgggcccattacccaggaagtccaccgtggttgagccacaaacgtggccgggggggcacaatcccgctgcagaggaccaggcgacaaacacagcggggaaggcacccggagaagcaacaccaggaaggaccccacacaaagagacgacaagtcaggagcgaggcccagtgggcgcacgcacgcgaagaggagcccgaggggtcaacacccaagaagcatgaggacagactgggtagacacgccgtgccccaccacagaaacatgcgcaccgcagagggcgcacaaggaacaagcgcacacggggcaccacccgaggagagtacccacagcgcttaaacaccaggcgagccagagagacaccgagagaaactgtgtagcacaacgag

SEQ ID NO: 694720 - DNA, 954 bp, Homo sapiens
ccatatgacaataatcgaatccttcaatgtgtgcaaaggaagtttctagaagtatgtttagaatgaatacaaaaggtgcgatggtcgggattgacttcacttaggaatgtaagtgtgaggtagatatgtttaaaacccttcatggatcagcattattctcaacgaggacacacacaggtgcttgtaccgttacatttgattcattagactctggtattaagtcagatcaagttataacagctataaatgggatacaagataacaatttcatgctgcactacgagtctcctccttatgcacctaatgacaattggccaagtcactggttcaactagacaggagaactcgggccatggtgctcttgctgagaaagctcgcgtatcctgttattccccgagattttcctttcaccactcacgagtcacactctgcaaacgtcctagagtcaccactggctcatcttcctactggcactctgctgtgccggcacgctccacccattcacaggattcacgggcgctccaacatccactctgctgttgcacgcgctacccaaccacggatggtcacccacaaccgatcctgacaccgccgcacatcgccgatcctcgcacgccgacaccactatccgcccactggagcattcacaagggacagggacctacacaccagccggcccctaaattaacagggactccacgccattcccaggccggaaactccaataaccgggactacgccctccacctgcacggaggccaccaccaccgcttcgcggccacaacggaccttgtaccgagtcagaccaccgcccccccacccagccccccaacggacatagcccgtgcaaccgacgccccccccacgggacaccgcgccgcgccacccaaccacagcccgccgcacacccggccaccacgcacgcaaccgccacgcggcaacgccccgcgcacc

SEQ ID NO: 694721 - DNA, 183 bp, Homo sapiens
agctcgccctggttatggcatggatgggaaataaatccgactaatatcaggcgcttccacctcagtaaaatgtcaggggtccagcggtgtggggcctgtcgagatattccttttaagatgaaggacaagtcgctgcatttggcccctcctccaacagtctaaataggcccactaagcaggggt

SEQ ID NO: 694722 - DNA, 864 bp, Homo sapiens
tcgctgcgacgataccggatctcattgtcacgcgcccccgaagaccgcccgacgtgcattcccgattccttaagggttccaagtccaatatggcaactctaaaggatcagctgatgttataatcttctaataggagtaacagatcccccagaataagattacagttgtaggggttggtgctgttggcatggcctgtgccatcagtatctctcactggaaaggatcctttgtcgaggatgagagcttgcgtcttgtttcgactagtcaatacgagaggacaaaattgataggggagtagcactgaatagggcactcgtccacacagttaggtcagcgctttctatcctatagacacgacctaaagattcgtctctgtgcacaagaacttagtaatgtaaactggctaaaactccatagctggttcattatcaccggttgctgcacgtcagctggagggagaaagccgccttaatttggtccagcgtaacgtgaacatctttttaattacatcattcctactgttgtgaaatacatgtccgagactgcaagtcgccgtgtatttgtcttgcaaatccagtggagtatcttgacctacgtggcttggcagatacgtgggtgttcccaaaaaaccgtgtttattggtcagtggtgtgcaagtctgtgatgcaggcgcgattctggttaacttgatgggggtgaaaggctgggagttcagcctattaagcttgtcatgggtgggtccttgggggacaatgggatattccaggtgtgccctgtatggcggtgggcctgaatgttgccggggtctctcggaaaaccttgtggcaaattaggattgctcaataagatcgggaaggtcaacgg

SEQ ID NO: 694723 - DNA, 758 bp, Homo sapiens
tgtcatggactggctccgtgttaatcggccgagggggacgcaagattgttgcggaaacgctagctgtacagtttgttagtgactgctgcttctgggactcctgttacccgcaatgtctgacctgtgcggtgtcgtggagcctgaacctggatgtgagctgatgtgatgatgcgttatgtgtgatcgatgatcctgcctgttgcctgtcatgggagtggcagagccaatcttctgtgacgtggtgattgtctcctctaagtacaaacagactgctatgagtgtcacctgccagctggagctatacacttccagcgtgaaagggaggagagaaacacctgcttaccaagggcctgggatccctgagtatgttgagcccaatgagagatgctccctgcttgctgaagacaaagtgactggtggacatatgaattctgttattggacgccacatccagcaataccacatggaagatacagagatcaaaggtgaagtcctctatctcggatactaccaatcagacatcgactggagatgatgaaacagccaaggactccaagacagcatcgtcttaaacgcaaccacagacagacctattgcaatagggtccaagtgcgaccttatgggagtgcccgagatgaccaaggaacagggatcatctgtaaacaaaagtgcaagtatcactaggaggaataaataaatcgagatgaaaaaagccatataacagcaatatagagtagacaatcgaaactataaatagc

SEQ ID NO: 694724 - DNA, 923 bp, Homo sapiens
gagccgcgccgcaggagaggcaggctggaccgggggctccccgggcccgcgagccctcacgttgactcccagcgatgcgcctccaagctcgtcccccaatgatgatgaacgaggcagctgcaccgcaatgcggcagtgtgcgtccagacggagcacgcattgcgagacagcaccccgcgagaccgcttgagattcctcggggtgagcgaccatgcgtgcatggctacgaactcagcggcatgagacgcctggaccaaggctggcgcacgcctcactatactatccatcaactcaggtctgcacgcgccgttgttcctgcaagaggtccaagaagccgggtgcagcactatggcacacagcgcgtgtgcaagcacagccttcccacttctatgggcctcatgtctcgatccatcgatgcgctcgcacgcacgcttcacaggcacgcctggcaccccttgtcattcccacgcccattgcgcgcgaacgcgcgctttcggccgactcgaccgctcgtgccattccaccgacctctatgcctgcgcctcgctctcctctcgcgccgccgtcttcgccgcttcgacccttgtgctgcgcgcgtaccggtcccttgttcgcctcgcgttcagctctcgcgcctgccagcctgcagcgtagggaccgcttgccctgtgcccatctccttcctgcgccctccccacccgctgccctcgcactcgcaccccctccgctgttccccgacctgtgcgcacacgcaaccacccatcccaccaacagccagcgccttccagtcccagtgccaagcccacaaccaacctttcacaggccacgccatattctcacgggcccctacactgaagcgccagcccccgcgcgttacgttcaccacgccaaaacagcacccactggcccaacccccaccggtg

SEQ ID NO: 694725 - DNA, 511 bp, Homo sapiens
  misc_feature (17)..(17): n is a, c, g, or t
  misc_feature (27)..(27): n is a, c, g, or t
  misc_feature (247)..(247): n is a, c, g, or t
  misc_feature (286)..(286): n is a, c, g, or t
tggaaaattactgggangagagattgnagccagggattcccagagctggagcatctggatgtggtggagagaagaacccggaggactgggctccggaatgcctggcagagaggctcccaccctttgtccacagaggacaggacagagtgaacattctgcaacattccccaacagcctgcagagtggagaatgtctttgccagctatgcctcagacaggggctgggcgtctagaatatataaagaacntgcagtaattaaacttcaaaatagctagtcaataaatcnagccaatgaatggaagataccgttcgcaaaagtaggaccacatatggacaccagagattaaaaaggcgttcagcattcttagttaccagctgagtgaaaattgaagctacgttttggattccatcttcccctagtgacaattactaagataaagaaaagagacagcagtgctgttgaggtaatgtaacctagtacagccattatataaattagtatacatttcta

SEQ ID NO: 694726 - DNA, 149 bp, Homo sapiens
acaataccaatccattactctccacttccgttcttgcccttatgctgacttacagcatagttgagcctccatgtactgcgtagtaatcttctccatttgctctctttactctatttcatgctcccactttatctataccagcttatctg

SEQ ID NO: 694727 - DNA, 127 bp, Homo sapiens
cacgtggtaagagaacaagaacaagaactgctgcggcagttctctgatcttctccatttggcgtggtcagtcctctactcgggcctataagggcggcggtgctcttctatggtgccagagtagagta

SEQ ID NO: 694728 - DNA, 220 bp, Homo sapiens
ttcagcccatacaaacatattgcaatatatagcattctaggccatcgtagggtgtttattcaaacatggaataatcattcacatttctgtaactgctctttctctcttactatattattgacattccttcagatcaatctacagagattatccgtataccttttaagagctccatgttattttatcatatgggtttatgctaatgtgttaaaccagtccc

SEQ ID NO: 694729 - DNA, 1426 bp, Homo sapiens
tccgcacacaaggacggttatattgggtcaaaagagcaacacgcaggcaaaattaaaaaccccaatataaaaagtgtagagtgtggtgtggaaaggttgaaaactgtgcggcccgctgtggactttggctttgaccttgttaaggggtgtggagaggggaggattagccaccgaaaaagtgcttgctctccggcgcccaaccaccacccctgtggccagggcttctctcccctctcccaggggggccacggcgcccagtgtctcccacagggggggcttcgccaagaggccctgtgtgtgtcgtcgccttgtgcacggatattctcccctgtgtatgtgcacgctttttgtggcaacctgtgaagaggcgaggggtctctctctcgctgtgagagtgtgaccacctgtggagggtcttctcctgtgagagagcaccctttctgtgtggcggctgtgcgccccacaccctctgtggcccctatagcgtgtggctgtggagtgtgccagcctgtgtctgtgtcagagacacagagggccccctctctctctctctctctctgacgtgtgcgcacgcacttgtgtgaccacgagtgtgtgcgccgagtgtcgctctgcgcgcggacatgtcgcccaggcgccagagggcgtcgccacacgcgggtcgcttctccttgaggagaccgccccacacgaggcgtctcaacacacaagcacaaagcgggtccagtcgtgggggagcacgagagtgtgtggagagcgccccacattctacagacgccctcttctgagggcaaacaccttgttgcactaatctctctctctcggagagagggccgccctctctgtggatgttatcaccccttatatcaacaacgagacacatttcatcacccgctctctgtggacccgtgttgtgccacgcgggcacaaaagatgcggcggggactctccccgcctgtggtggcccgcctcattaggaagcaccatatccttctcgacaaaaaagttgttcgcccacagggtggcaccacaaaaacagcaggcctatctcgtgggggcaatgttggcgcggtctcatccgggatacccccctctctttcggtggtttctctcctgttggcccctactccgcgtgtgccttactatcttgtgtgcaacccatactagtggagggcccctcgtcgggacgggcggcaacttattttatgcctaaacggccgaccctctccacgtttctcgtggtcaaccacactctcgtgggcgaccgcccccccaagagcgggctgtctgtctctcgcacgaccctcttcccgacgacagatctcccctacacaagccctttttagggcgcgtccctccgtgcgcgtggtgtcgctctcttcaacccccccctttggtgggtcttctgcggtggcgggagccccta

SEQ ID NO: 694730 - DNA, 307 bp, Homo sapiens
  misc_feature (1)..(1): n is a, c, g, or t
  misc_feature (29)..(29): n is a, c, g, or t
nctcagagtaacttcaatgagcttcttgnaggataccagactctataaccgccaccacaatcaagatatcaaagttttatcaccccacaaaattccctcatacccctttgtagaaaattctcgcccacacccagccacagacaaccactaatctgctttctgcccctatagttttttgcctttttcaaaatattgtgtaaatgaaatatcgccttttatgtctggcttctttcatttttcgtgatacttttgagactcacccaagttgttgcatgtatcagtagctttgatccttttcattcgagca

SEQ ID NO: 694731 - DNA, 427 bp, Homo sapiens
tctagcaggacctgtggtcgatcactgtactccagcctgggtgacagagcgaatccgtctcaaaaaaaaaaaaaaaaaagattaggcttggtgggcacacgcctgtagtccctagctactcaggaagctgaggtgggaggattgcttgagcccaggtgttggaggctgcggtgagccatgattataccactgtagtccagcctggacaacagaacgagaccctgtctctaaaagtttttttgtacacataccataatacccagctactgaggaggctgaggcagaaagagtgcttgagtccaggagtttgatgtcagcctgagcaatatagcaagaccctcacctcttaaaaaaggtagattaaaaaaataccacaatggctcaggtagatggaaaaacaggcttatagtacagtgatcgaccaagg

SEQ ID NO: 694732 - DNA, 177 bp, Homo sapiens
gctccctctgtgtcagtgaagcctccggacccaggctctgctctgccctgccctgcaccccctcgtcagaagtacatgaggggcgcagagatgagcacacagcttttggcacggtccagggcaaacttaaatttacgccttaattttttaacagaggttttaatgcctttttttcaa

SEQ ID NO: 694733 - DNA, 122 bp, Homo sapiens
aatcgagctcgtacctctttcaccttctctcctcgagctggctgtatgacctcacctcccgtccccaaaaatcccacaccgtgcagcgcctgcagcaagccgggatctccctgtccctggca

SEQ ID NO: 694734 - DNA, 299 bp, Homo sapiens
  misc_feature (23)..(23): n is a, c, g, or t
  misc_feature (51)..(51): n is a, c, g, or t
  misc_feature (66)..(66): n is a, c, g, or t
  misc_feature (145)..(145): n is a, c, g, or t
  misc_feature (182)..(182): n is a, c, g, or t
gctcctatgtctgaaaacatctntatttctctctcactttggaaagattanctagtctgatggttntcagaaaagagaatcagaagttttctagatcttccactgaggctattgacagggaaaagggaggggaaactgttaagcnggtaggatatgggttctacattccagccgtagcgatnccctctttattacttatatatatatttacatattgagtttctacataatattgtttagaagaaaggatcttattaatagataaaatctaaaagatgttattataatctaatccatct

SEQ ID NO: 694735 - DNA, 564 bp, Homo sapiens
  misc_feature (2)..(2): n is a, c, g, or t
  misc_feature (150)..(150): n is a, c, g, or t
  misc_feature (154)..(154): n is a, c, g, or t
  misc_feature (182)..(186): n is a, c, g, or t
  misc_feature (207)..(207): n is a, c, g, or t
  misc_feature (222)..(222): n is a, c, g, or t
  misc_feature (226)..(226): n is a, c, g, or t
  misc_feature (237)..(237): n is a, c, g, or t
  misc_feature (248)..(248): n is a, c, g, or t
  misc_feature (257)..(257): n is a, c, g, or t
  misc_feature (284)..(284): n is a, c, g, or t
  misc_feature (300)..(300): n is a, c, g, or t
  misc_feature (306)..(306): n is a, c, g, or t
  misc_feature (318)..(318): n is a, c, g, or t
  misc_feature (324)..(324): n is a, c, g, or t
  misc_feature (337)..(337): n is a, c, g, or t
  misc_feature (385)..(385): n is a, c, g, or t
  misc_feature (414)..(414): n is a, c, g, or t
  misc_feature (431)..(431): n is a, c, g, or t
  misc_feature (460)..(460): n is a, c, g, or t
  misc_feature (551)..(551): n is a, c, g, or t
cnctttaattaaaaaaaaaaggaaaaaggggaaacagaggtaaataaattaggaaaacacacacacggagaaaacaaacaaaaataaaataaaataaaaaaaaaaggtgttaactaggaaggatgggttaatccaaaacccagccctgantccnggctcccccccagaaaggtggaccaggnnnnngggggaccccaggggactttnaggcccagggaagtnattnataactcaganccagaggcctnctggaagcngtttccatggattctgccccaaaaccnggaatggaagagggcnccgccnccggctgaggangggctncggggggaccggnggcagccaggcccccctgagccctgagggaggcggaggtcaccgcccncccccatgtccttgttagtggacacaggngaccgggaatccgggcnggcaggcggggcgggccgtggcacctgcngtcttgggaaacacaggtcaatacatccacacacacacacacacacacacacacgcgggggacgccggcccccaccacccccccacccacnccatggagaggca

SEQ ID NO: 694736 - DNA, 179 bp, Homo sapiens
gtctgaaatgtgttctgtcagcattcactgaagcagaaaggggtgtgagagatgggagggaggaccgtgaagtacaatgtggcttccatttatccaggtcagatgacacactgggacacctccacactatccctggctgaatccagtgctggctctggaacacgagtcgcctaggacct

SEQ ID NO: 694737 - DNA, 210 bp, Homo sapiens
gtggttcggcaacgccggatcgttgacccatggagcaagggcagggaccgaacccgcaacctcatggctcctagtcagattcattaaccactgcgccacgacaggaactcccccatttcttattctgatacttgcttgtggcctgagtctttttcttcaactgcaaagtggtgatgacattaacatttacctcaacgacgacgacgacga

SEQ ID NO: 694738 - DNA, 187 bp, Homo sapiens
gctatgatctttgtacctttcatcattataggacagaaatgtagtatctattcatcactcttcctctcatttgctccaacgttattcatttcagatcgttacaagtcttaagtaaatacactagtatcctattaacatgacactgatatccatatcacacccttcccttcctttatctgctgtaccc

SEQ ID NO: 694739 - DNA, 331 bp, Homo sapiens
  misc_feature (121)..(121): n is a, c, g, or t
  misc_feature (128)..(131): n is a, c, g, or t
actgtctggcaaagggtgcgaaagggagcttgtgctcaggagtccaaccgcccagcctcggggtgtaggttttttaggtgtgccattggggcctcagccttttttggtgacaaagggtcanctgtggnnnncacacacaacccccacacacccaaccacacacccaaatgggggcaaccacatccagtacaagcttttacaaatgttattagggtccttttttatttttaatgccttgtccttttaaaagttattttatttggtattattatttgtttttgactgttaattgtgaatggtaatgcaataaagtgcctttgttagatggtga

SEQ ID NO: 694740 - DNA, 329 bp, Homo sapiens
atttgacacctttcttttgttttatcaaataaataaataaataaataaagaccagtgcgtgaattaacctcagtggagcctcatttgcagaagaaccattattttactcaaatatctagaaaacaagccttggcagggtgtgggggctcacgactgtaactccaacaccttgggaggccgaggcaggcaaattgcttgaaccccggagttcaagaccagcctgggcaacatggcgagacttcatctctgcaaaacatataaaaaatggtggtgcatgcctgtgatcctagctactcaggaggctgaggtgggaggatcgcttaagccca

SEQ ID NO: 694741 - DNA, 916 bp, Homo sapiens
gtgacgcgtgaggtcgacccacgcgatacgggaaaagctagtcttccagcagcctccgtgtcctcgggttcctaccggcttctctgcattcggtctgctgatcatgttgccagtaatgtgtctggcaagtgtaacacattcttactggttaaagacgactaccaggtatctaacttgtttaacattgagtttgtgtgtgtgtgtgtatgtctgtgtgctaggtatatcgtaatacattattgagaggtagcattctgtttcaaatgctttcagtacttctgacagtatagtagactgggatcataacatttacgagctgtaggttagagtggatcatcaattcaacaagatttcaacaaggtacatacgctgatgctatcttcaaaacctctgagtactggcccccaatttcgggcatacaaatgtataaaagctattaatcttgagattcaatacaagatctccttactctatctatataggctcatggtatcctactccggtctgacagcttctgaatgctagagaaagtggaactgatcccccaaagcgctagcactgacacaccacacatactaaaacaccataggagaccccgccacacacatacacatggagccagccaaagaggacatacgccacgcagacagctgaacctgccccacaagcctcactcccctggaggcacaagaaacacacacacggcctaaaccagctctacgaatgggcaatcctccagcacacaaaggtcggaaaacacccccaagcgaacacacaaagggcaggtgacgacaatccgaaggaacatagggcatgacataaggaagaacgcacaccaggcacacagcgcatacacgagagccgcggacttcctgggccggtggcaacacaaggcgacaacacccgtaacagcacc

SEQ ID NO: 694742 - DNA, 692 bp, Homo sapiens
  misc_feature (126)..(126): n is a, c, g, or t
  misc_feature (138)..(138): n is a, c, g, or t
  misc_feature (140)..(140): n is a, c, g, or t
  misc_feature (151)..(152): n is a, c, g, or t
  misc_feature (156)..(156): n is a, c, g, or t
  misc_feature (168)..(168): n is a, c, g, or t
  misc_feature (174)..(175): n is a, c, g, or t
  misc_feature (183)..(183): n is a, c, g, or t
  misc_feature (189)..(189): n is a, c, g, or t
  misc_feature (199)..(199): n is a, c, g, or t
  misc_feature (201)..(201): n is a, c, g, or t
  misc_feature (204)..(204): n is a, c, g, or t
  misc_feature (206)..(206): n is a, c, g, or t
  misc_feature (212)..(212): n is a, c, g, or t
  misc_feature (215)..(215): n is a, c, g, or t
  misc_feature (218)..(219): n is a, c, g, or t
  misc_feature (227)..(227): n is a, c, g, or t
  misc_feature (230)..(232): n is a, c, g, or t
  misc_feature (234)..(234): n is a, c, g, or t
  misc_feature (243)..(243): n is a, c, g, or t
  misc_feature (255)..(256): n is a, c, g, or t
  misc_feature (272)..(274): n is a, c, g, or t
  misc_feature (282)..(282): n is a, c, g, or t
  misc_feature (288)..(288): n is a, c, g, or t
  misc_feature (293)..(293): n is a, c, g, or t
  misc_feature (307)..(307): n is a, c, g, or t
  misc_feature (310)..(310): n is a, c, g, or t
  misc_feature (312)..(312): n is a, c, g, or t
  misc_feature (318)..(318): n is a, c, g, or t
  misc_feature (321)..(321): n is a, c, g, or t
  misc_feature (324)..(324): n is a, c, g, or t
  misc_feature (332)..(332): n is a, c, g, or t
  misc_feature (335)..(335): n is a, c, g, or t
  misc_feature (337)..(337): n is a, c, g, or t
  misc_feature (347)..(347): n is a, c, g, or t
  misc_feature (349)..(349): n is a, c, g, or t
  misc_feature (352)..(352): n is a, c, g, or t
  misc_feature (354)..(354): n is a, c, g, or t
  misc_feature (357)..(357): n is a, c, g, or t
  misc_feature (359)..(359): n is a, c, g, or t
  misc_feature (361)..(361): n is a, c, g, or t
  misc_feature (363)..(363): n is a, c, g, or t
  misc_feature (367)..(368): n is a, c, g, or t
  misc_feature (370)..(370): n is a, c, g, or t
  misc_feature (381)..(382): n is a, c, g, or t
  misc_feature (396)..(398): n is a, c, g, or t
  misc_feature (404)..(404): n is a, c, g, or t
  misc_feature (408)..(408): n is a, c, g, or t
  misc_feature (422)..(422): n is a, c, g, or t
  misc_feature (435)..(435): n is a, c, g, or t
  misc_feature (443)..(443): n is a, c, g, or t
  misc_feature (447)..(447): n is a, c, g, or t
  misc_feature (452)..(452): n is a, c, g, or t
  misc_feature (477)..(477): n is a, c, g, or t
  misc_feature (483)..(483): n is a, c, g, or t
  misc_feature (500)..(500): n is a, c, g, or t
  misc_feature (523)..(523): n is a, c, g, or t
  misc_feature (540)..(540): n is a, c, g, or t
  misc_feature (542)..(542): n is a, c, g, or t
  misc_feature (546)..(546): n is a, c, g, or t
cgcggcgactggtgggcttggcgtccctccgggctgtcagcacctcatctatgggcactttaccaaagcgggtgaaaattgtggaagttggtccccgagatggactacaaaatgaaaagaatatcntatctactccantnaaaatcaagcnnatanacatgctttctnaagcannactctctntcatanaaaccaccancnttntntctccnaantcnnttccccanatnnntnaccacactnaactcttcaagnncattcacaactctccnnncatcaacnacccantcctnaccccaaatttcanacncntccacncanccntcaccaanaantnctactcaatngnctncnacnanancncccnngnggacaccattnntgtgggcaccccannnatcatnaaanacatgctgtctgcngtcatgcaggaantgcctctngctnccctngctgtccactgccatgacacctatngtcaanccctggccaacaccttnatggccctgcagatgggagtcantctcgtggactcttctntngcangacttggaggctgtccctacgcacagggggcatcaggaaacttggccacagaagacctggtctacatgctagagggcttgggcattcacacgggtgtgaatctccagaagcttctggaagctggaaactttatctgtcaagccctg

SEQ ID NO: 694743 - DNA, 359 bp, Homo sapiens
  misc_feature (5)..(5): n is a, c, g, or t
  misc_feature (100)..(100): n is a, c, g, or t
  misc_feature (102)..(102): n is a, c, g, or t
gactntgcgacaccaaacactttacttccaacggtattattaatatgacaacgaaatacttctgttcaccttttcaatacattcaaaaagagagagtaananagagaatgttcccatgctctggggtggacgtggctcagctcagagaggaagccctggctgaaaaggctgcagcttaggctgttactcttcttcactcagcccagcatgtgatcacatcttctgtcactcaggtcctgagggggcgggaccttaagaattatccaatcagggacgctgggctggaaacgtccaatcaggcaagcagccggaccgaacagggcggcttctggtttggcgggcccttctgtcgtcttctc

SEQ ID NO: 694744 - DNA, 111 bp, Homo sapiens
acacagcgtgatgtcccactaaggacgtactggataacgcgtgagcaggtagttacctactgatatgtgttgtgcatggtatctgctcgtacgagagacgagtcagacttt

SEQ ID NO: 694745 - DNA, 1690 bp, Homo sapiens
ctggttctggttgctttttctcgttgtttttcggtcgtgttttgatgatgtgtagtcttgctgtttgttctcctgtcatttgtcctggttttctttcccccgttggttagctcctcccggttatgtctcctggtgcctgttccctctcttgcttagttgttgctgtcctagttgtgtcctctcggtctcggagtttgcctggtttgtacctgcccgggttttacttgttctttttactccatttttgggccctcactgttatggcgtgttctctatgttgtgattcacttgttgtggctgcctgctatgtggtcctgtgtgctgtgtgttctcctgctttcgccgtaacttgacccccgggtactgttttccgtttggttccctatcgggtgttcccgttgtttatatggcctctttggctctgtttggtcctcagttgtcctgggatctatatccttttttggtaaaatgtctacgattgccgggatatcctcttaatatacggtcaatcttctgacatatgttcctaattatactaactcttttgattattatactctttttcaataattctcttccatacctcttccgaactctttaactcctttttaaacattccaattccttgtgtcatttttatgtgaatactccttcaagctatgtctaggccaaagtcgtgctggaatcttccctctgtgttgtcctctgggatttttcctcttttttttacagtgaacttagtagtcttttgtggtcgtcatgcccctatctcattgtgtatcaatgaatatttatggtgttagtcgtgtgtgttcggtctcttggagatttttgattcttttgaggtgggctgttccatggatagttgaattgtgtttggtaggtcatttcgtatacaattttgggttattgcagcgtaatccatatggacctgcatttttgtgtgttctactcttggtgggctctcttttgggcactgtcttgactgatcgaacatcgtgtactcgtctgagtaaaactgtgcgggtttagaggtaggcatacacgcccagaatgacttttcgagaggccttcgcttgtgattttgaccttaaactggattgaaaccgtttgcaactgctgtcttgtgttatatgtggctgttcaggtatgactatactgttgttttcattgggctcttttattttaggacgaaagaatcctggattgtgcactatggttgatgtgcttgcttaaagctgaacatgtggattgaaagatggtgaggttgtacaaagattaggattagtattgtgtaatgctgacacttaatagatatgggttgcctacggctagactctcctttcagtagacctgcccagagcagaccatgcctgtgactgtgctctgcagtgatgtattgaattgtgcactctcactgtgtaactggggtgccaagtgtcttgtgcatttggaagtgaacttacctgccagtgtattgaatgtttatcatatgcataatgttgcattgttgtccaacattgataggtaattttaataagtcactaagagattcattcttttacttattcaaatacaaaaaaatagtgtaatgatcagaatttaagatgtgtgattctttttcttctgtaagtatgtattgaacctgctaattaatactggacgacctgttcctttctctcctttcctt

SEQ ID NO: 694746 - DNA, 163 bp, Homo sapiens
aggggggggcccccccccccccccccttttttttccccattcccggcctttttttgccgggggggttttttggtccccccttttccgggggggggggttttggcccttttgggggcccccctcccccgggtttttttccccttttttttggggggccctttta

SEQ ID NO: 694747 - DNA, 433 bp, Homo sapiens
ggagcatgctaagcagactggtgtacaaggcctacgaaggagcggcgggaaagcatcaagcagcggcttcgcaccggttcatccagccccatggaactcctatcctactatcaagcagccggtggcagccaccatgacggcggcgagggccgctgactacctgcacgtggctctagaccgtgcctggagagcgaagctcgcggtctcctttcgcgatcgccttccaatgtctcgtgctcttctgatgcccgtccttctgcgtgtcttgtccaggtccagcggctccgcctaccaagacgtgagcttcacttgccccgagcaggccaaataccgcgccaatcaccgggatctgcaacccccggacgccgcccctcgctgggggcctccgccgcgtgcctttttgcgctggctgccggccgcatatgaggactgc

SEQ ID NO: 694748 - DNA, 203 bp, Homo sapiens
tgctcacagattgagcgaggtagcacctcctaccagcactcaagtttatcagggccgcgttctaaacattctactgaagtttgctaagaaaccattaggtgaggctgggcacagtcgtcacgcctgctatcccagctgctcaggaggccgagacgggagaattccttgaacctaggaggcagaggttgcagtgagcctagatc

SEQ ID NO: 694749 - DNA, 121 bp, Homo sapiens
cctttgtaattttttcccccaaaaaatgggcctgtgatatatttttaccgctgaaaaacgcaataagagaagagacagcttgcatccttgatcatagacacgcagctattacattcaggta

SEQ ID NO: 694750 - DNA, 219 bp, Homo sapiens
tctattttcattctttttgtctttagatctgctaattgcgggggtttcttaacgagaaattcacacacccagtgaggctcctcataactttaaagattatatagaacttttcaaagccttggtgttgatcgcctttgctcacaatctttagtatagttcattttaagatcatgtcatctataaattgtttctcttcatatcttctatctacacatattt

SEQ ID NO: 694751 - DNA, 306 bp, Homo sapiens
cgacgtttttagaaaagcagaaggaaaaaaaaaagaaaaaaaggaaaaagcaagcctgctagagccatgtctttgagctggctggacttcctgtcagttatgaaccaccatgtgcgtgctaggaatgaaacctaagtcctctgaaagagcggcagcaagagtctctaaccacttagccatccctctaagcccgacagtgattattttcataaccttctggaggggggttagatttttttttaatctgggattgttcttactatatcagaaagtaaaagggatctaaaaaaaattttttgtcgacgc

SEQ ID NO: 694752 - DNA, 1410 bp, Homo sapiens
ggacgcgtgggctcggcaagaaccagcgcaagagggaagcggagttatagctacccctgtgtctgctggagcctggctcactgcactaccccacgcccccttcttatcctccagacagcctgaagatcgctggtgctgctcaatgtgctggtgccttggcaggtacatgttctgcgatcgtagcagctgcacggccaatcgaccgtgcatggccagtgactgctgctctgtcttgcattctatgacactctgtggaacgatggtgacaccacaggtataccttgcgcgcttgggcgtgtcaggatgaccatgcactgaggtcacccaatgactcaacgcaagtcacgcacactgctggccagactgtggttgggaaccaaccaaatcaaaagcaccttgtcatgtccctccgcgtcatgcaggtcatccagggcattgggtccaagcaacagcctcccttgttgcaacagccatccaccagtggcagcagccagccatgcatcactccaatgtgactgggcactactggctcacgacgcacaatgtgtgccagcacttgaaaccccatggaactctggggctcgaccttcatatccgactgccaagcaaacacacctggggctgaacattccacccagggaccataacaatgacagcacgtgacgggacgctctcaggatcctccgctaactaggctggtctggcacaatccactccacacccttactcccatgaggcaactggcggaaccaaacgtgctacactggtcacagcacggttccaccaaacggggagaggttccccccgcatgccttacgcgcccaagacaaagagtgagacacaacacatcccgagcacattccctcccaacacagccataccaacacagccaagacgggcacagccccccccatggtggagaagaccccgagagagcaccgaaagctcgaacggaaggaaacagaccaaagaacacatatgaggcaccacggagcacgttcgacagaccgataacaaaccccggaaaagcggacgcgccaaggacgacgatcgacgcgaacacaaggcgacaaaaccgacacagaaaggcgtggtacccaggaaggggtagccccatggcacatgggacaagacgacacgagcgagcagacacacagcaaaaggacaacaaaggcgaaacaccccaccgcagagcgtagggagcaaaagatgcaccaacaagctgcaacagaacagaagagagaagcgactagaccgcagcggtcagcgagagaacagagacacgaagagacgctagagaacaagcagcaccaccgcgtcgtgcggccgtccctccgtaccccgaacacgacaagcacagaacagagcagagaacaagagagacaaggagcaacaacaacacgcaacgac

SEQ ID NO: 694753 - DNA, 370 bp, Homo sapiens
tagtgcttatacttaggataacagctttacttagaaatgtgagttacactgaggacatagccgtatcatcgcaaggccaattactatctcacccatcttttatcattacatccctaaatatcaacaaacgatgtgtcactacctgagtacagtgcactgtgctggacactgttgagagcacagaatgacacaccttgatctaaatgtcatcctaacttgtcccaagctcttgataccccatcactctagggctggagagaggatttgcattagagttcttaccagtgagggcctctgaagctgtgcagtgcttaacctgggccatcatatgcaatgggctgattgtcagcgtgtgattggaaacgtatag

SEQ ID NO: 694754 - DNA, 274 bp, Homo sapiens
agtaccctcccaagcgggtgggactacaggctggtgccccatacccaaagaattttttgtagaaagagggtctaaccctgttgcccaggaggggaaggctgtaatgagccatgactgcgccactgcactctaccctgggcaacaaagcgacaccttgtctcaagaaaaaaaaacaagaggactgacaatagggtgaagaacttcctatacctgtgaaaggattaagttaccaatgtaattcgcatgaaaactattaggccctgtttggactctg

SEQ ID NO: 694755 - DNA, 302 bp, Homo sapiens
tctccacactggctctctctctctctctctcactctctctctctctctctctctctaccccagttggaagtatctctgcaatagagtggaaagtaaagaggaccaaggtgaaaataaaggctcggaaggaggagcactcttcgcaaacatgtcatcccgttggtggtgggaagtccctggagaatatcaggagaaacacagtcataggctgcaagtctataagcataattccattggggagggcgcccatttgtcatgcatggctgcaaggggcagatcaccagtgtggcagcagaggggtc

SEQ ID NO: 694756 - DNA, 1082 bp, Homo sapiens
agatcttataacttgggttttattggcagcataaaccatgtggagcgatcctgtcgttagcgtggcattgcctatatacagcagaacgtcagctgttgtcactggtgatgcgatccccactgtctgcgtcggccttgcttttgtggatcttcctctgtgagtcagacacgttatcatcaccaagacctcactgatagtgctagtcgcccctttcatccccgtatcagtgtttatcaagaattaactgaacagtactttcctgctgtatccgcatgatatgccgaagatggtacgaggcgcgctatgcaatataaatgagtcgtaagtgcattgtgattctttcaggcattcttctaatctaagtcttgtcttgattcatgtaagatgtctcaatggtgtgccatttacgggaattagaatggtggcatacgatgtgaagacgtctctggatctagatgatatggtcccgtgtttgttgcttggactttcggatctccgtgtaacgtgggcagttgtatttatccacaattgcaagactagaccactatgttttcactatagtcttccatttgtaggcattcctacacccatttctattattataaccattcctcacacgtctcccttgacagtctgtctgacccatagtctgatgctgtgctcgtcctcctgcttcatccctctgaaaagagatagtggtcagatcccacttttgagaagccatggctgtccctatcctccctggaagaggctccgccgtgggctgttctttgtcatgtgccgccgctcttgctagcaggcatttttggggccttgaaatggttgagccctggtttagcacgaacccttggtccaagcctcctgaccgctgcttaccagcttgcgggtcttgcgtggcgggcggtgcccgggacttgctggttgggcacacggactcttggaatttcgccggggtgggttacgcgccccacctcggggcgacgggggtgcttcctcgcgccgggcgcggggttgcagcccggggtacccgttggccccgtgatcgcgggtacttggagggcccgccttgtggaccccgtcgg

SEQ ID NO: 694757 - DNA, 311 bp, Homo sapiens
agccaacggccacttattcagtgaagcactatcacgaaggaaaagtactacctctactatactaatactcggctacaaatctccttaattataacattcacaggcacagaactaatcatatatagtatcttcttcgagaacacacttattcccaccttgggtatcatcacccgatgaggcgaacaggcagagagggctgaaagccggcgcctacttcctattctacaccctagatagtgctccctatcccctgactcatacggctcttttgacaaccaaacgcctgttacggtgtgagcggacgaggggga

SEQ ID NO: 694758 - DNA, 271 bp, Homo sapiens
gactctacaggatcccctaatctgtactcattgcgcgagtacaggaagaaactgagacccctaagatcgtatgctgcttggaactgtgaagacgatcatggtgtattactcttagactgtcactgacattctcattaccatctgtgcccgccttggcctcaccaatcatgatcaatattcattggttcgagagctgattgacgagaccatggaggatataactcgtaccttatcacaggacaagacattgctgcgcactgagtacagatta

SEQ ID NO: 694759 - DNA, 806 bp, Homo sapiens
aaatgtattgaggatctgtgaaatgctaagtgcccaaaataaaatatgctgattgtcttgttattaaaagtacaatttcctcattaagccaaccttgccttctgtaacgtcacagtgcttaagatctcaggattggttcattaggaagagacctgtcgttgaaggacttgtggtaggctagtaattgcttagcctccattattgggtggcttgggactagagaggttttagattttgtgtttttttttgttctgcctcaaagctcagtttattgacagcacaatttgtaagctatgggatcatcactgaatcaagattttgactaggtgagcttaagttgtccatgttcttacaatttcaaaggttacaagtctcagaaatggttaattttaataactgtcctatcgataaattaatgtggactaaattgaagtggttgataaatacttcatgaaaactaaagtctgccaatagattacttgttgatgtccaatagctactacatttgatagaacagtttgaggaacatttcagttcttgaacgcggcatctgacatggttctcagcaggtgggaactagtagaggattatcggcttgtatccgatggaggtggaagcggacatgtttgaaggcatacgagcttattgcactaatcttgggctggtggacttgaaacatttgtttttaaccaattctcagggagccgggggagccctaagtgtgactactttcgccatggatgattgccccttaactgtgggagaacaaataactcgaaataaggggcacttcaaaaacggggggt

SEQ ID NO: 694760 - DNA, 765 bp, Homo sapiens
ggacggtggcggtgcgaactggactccccagtgagaccaagaagactgggaagcgcattgggagctctgagcttctctggaatgagatccctcattttcgaatgtcacggcacagagtcatttagatttaaaggtctggagctgccataccttgagaaatgaactgctaggcaccgatctgtcaacctctccaacgtcttgaagagcaatgggggcaaaatggagaatcatgcagctgaccctgaacctgcagacggagaacaaaggcagcgtaagtctacaggcggagagctgacaattttcctggacgggccaacttgtgatctgggaaatgtgcctaatggcagtgccctgacagatggatcacagctgccttcgagagactccagtggaacagagtaagctcagagaacgggacagctcccagcacaaaaccaggctaggaggaagatcccggacgcaccagaccatacgggtgcctcagccagaacaaccctagaagcggcgagcaaagccccggtgctcggagccggcaccgcagccgtcaagaactcacgccacagtgggttaggccatggcacagtggatgagaaaccccacagcactgaaccggaggacttcccgagagggagagtcccactggacactagaggaccgctccaacgattcaccgccacacacgggaaggagaccccctacgcaacccgagacacgccactccgagaagaccggggcgcatcacagacccaacggggcctccggaca

SEQ ID NO: 694761 - DNA, 659 bp, Homo sapiens
tggcccttgcggagataatttgggtgggtgaaatggtaatgtgtaatggtgaagtttccggggcgggcaaattgctgttgttcgtcagcaaggaagcagtccctgagaaatgagaattgcgttccctgggggcgttaatgggtctctttgcagttgtgattgtgaatttttgtgtccccgggtcttgttgtcggggtgggtggtggccatggccccggttgcctgttgttttaattcgggtttccggatatggtcttggtaacgggtaatgatatataagcgcatgcatgtctctccgtatgcggcttcccagggcttattaggaagtaggaatattcccgcactaataaatgtcttggtcataccagttgtctgctctcaaaacctgtctcctgataagatgcttatcaatgacaacatgtgcccgataacttcattagcgattttaattttgccccggtcctgtggtcctgtgatcttgctctgcctccatttgccttgtgatattctattaccttgtggagcacgtgatctctgtgactcacaccctattcatacactccctccctttttgaaaatcactaataaaaacttgctggttttgcggcttgtggggcatcatggaacctgctgacagttgattcgtgagccaagctccc

SEQ ID NO: 694762 - DNA, 156 bp, Homo sapiens
gtcgatctagaggtccggatcgagacagctggaacatagtgagactcgttctacaaaattaaaatatagctggtgttgtggtgtgtgctgtggtcccagctactcaggaggctgaggcaagaggactgtttgagcctgagaggtcgagctcttttt

SEQ ID NO: 694763 - DNA, 109 bp, Homo sapiens
agtgttaaatccagtgacaagatggaacgctagcatcacccttttatgacctagcttatggaagttacacagcttcagtctctgctgcattctttttttctttcttaaa

SEQ ID NO: 694764 - DNA, 528 bp, Homo sapiens
aacgccataggatctgggaatgatctggacatcatccttaggttcgccatccaggacatctccgtggaagagacctcggcaaggaatgggctccttctctgaatgccagagcaaagacggccccgttatacagaactgtcacatgtgcatgaactatccacaatacagcttggaagggataggtacttgcacttcacatgccactgatccacgcggcacagacacagagctagattgagtatgacaatgctgaggaaggacgaacctgtcaccaacctgaacaatgccttcgaagtggctgagaaatacctcgacatccccaagatgctggatgcagaggacatcgtgaacacggccctgcccgacgagaaggccataatgacctatgtgtccagcttctaacatgcctttttcaaggagcgcagaaaggctgaaactgccgccaagcggatcttgtaaggtgctggcatgtaaccaagagaacgagcacctgatggaggactacgagacagctggcagagacctcat

SEQ ID NO: 694765 - DNA, 367 bp, Homo sapiens
gactctagaggaccccctgttgtctgcatctggaacaggatttcggtctgagatgctggggtggggcacttctattacgaactaggtgtccaacattatcgaagtgtgcctgcgctgaagcatcggaatggaggtctgataactttggaggaactacatcaacaggtgttgaagcggaaggggcaagttcgcccaggatgtcagtcaagatgacctgatcagagccatcaagaaactaaaggcacttggcactggcttcggcatcatccctgtgagcggcacttacctcattcagtctgttccagctgagctcaatatggatcacaccgtggtgctgcacgtggcagagaagaatggctacgtgact

SEQ ID NO: 694766 - DNA, 151 bp, Homo sapiens
cccttttaaattgacgtatttcaagtgctattatagtactatgattacttttagggagagaatgtggtagaattgactgataatatatcagtagaatgtacgttgagagttgactgccacataagacataaaaataagcaaaatctgcgtg

SEQ ID NO: 694767 - DNA, 376 bp, Homo sapiens
catctatgcttccccttaagctctgcgatttcaatgtctgagacatgaatcttctcatgtccacaagagaactcgagtgcttcctgccaccctcctataaagctttcagaattacccttgtaaccttgcactgatgaaggctcgtctcgacttacagagcctaaggaggacccgatggccggcttctgcacagctgatacaccatcctgtgaccccacggccgccctgcccacccatctctcacggagcagacactgtcctcaagttatgcgcacagattgaggagaaacgagaggctgtggaaggcaggacagaaaggccgagagacgagtttgtcatattgccaaagtctccttcccccatagatagttacagc

SEQ ID NO: 694768 - DNA, 239 bp, Homo sapiens
tcttctatgacttgaggttaatcatgtgaccgcgagatggctggcacgaaattgaccaaccctgggcgttagtataacttagttaaacttatcgtttattgctcaaggttaatcactgctgtctcccgtgaaggtgtggctaggcataaacgttttgagctgaattgctgacgctgacttgatgcttgtcccttatagatcgtggtgatttacagggtgcctctctcgctacagcacgc

SEQ ID NO: 694769 - DNA, 311 bp, Homo sapiens
ttatcgatgccactaggcggaactgcttcagctactgggattcttgctttacagctcttgttcagtgcactcttttcctaaggcaaaaagcaatacgggggtctctttttctcgcttcataccaactcactcttcctaacatatttactttccaccttctacttgagcacgcatggcaggaagagctcacagtctttagagccgaacagcatgtcttcaaaatctggctttgccacttcccagctgagggacgtgaacagcttacttaagtgctcaagtagaaggtggcatcgataaacaccgggtaccga

SEQ ID NO: 694770 - DNA, 409 bp, Homo sapiens
cgggtccaatagttgttttactcaagtgcagtatttgaagtcgccactggccgcctttgccctgctcttcagaataactccggcccaaaaagcttaaatgtattttgccgcttcgcagaattttccgcttcttcgtgggaaaagcagacaagagaaagtcaccctggagcacacatctgcctataatatcgcgtggctgaggctgggattcacctgggctgttttgaccacatgtggcttcctctggtcattgactcctgtgaaattaactttgtaaaaaccacttttttttttcttgatagagacgggcgggggtctcgctatggtgcccaggctgatctcgaacttctgggcccaagcgatccttccgccttggcctctcaaagtaaaccacttatttaaaaaggca

SEQ ID NO: 694771 - DNA, 472 bp, Homo sapiens
  misc_feature (3)..(3): n is a, c, g, or t
  misc_feature (19)..(19): n is a, c, g, or t
  misc_feature (35)..(35): n is a, c, g, or t
  misc_feature (65)..(65): n is a, c, g, or t
  misc_feature (462)..(462): n is a, c, g, or t
  misc_feature (467)..(467): n is a, c, g, or t
aancctcttcaaactcccnaccttgtaacccccancaggaccctattttcccgaaaattgaaaanctctgaaggtcccccacaattcatggtatgtacaggggcctcggaggagggaaactgccccagctttcccccggcacagcctgccaggggtagggggtatagataagaggagccaggccttggcccaggcgtgcgttgtcacgccctgtaatcccagcactttgggagggggaggcaggcagatcacgatgtcaggagatcgaaatcagcctggccaagatgatgaagccccgtctgtactaaaaatacaaaaattagccggacgtggtagcgtgcacctgtaatcctagctacccggaaggctgaggcaggagaatggcgtgaaacccggtgggaagagtttgcagtgagccaagatcgcaccactgcactccagcctgggcgacagagcaagatnatggnctcaa

SEQ ID NO: 694772 - DNA, 1065 bp, Homo sapiens
ccacccacagacatctgttcccaactgcatctgctcttcacccattctgctccgtctgtatttcacttagcaacccatctctttccaccacaaacactgatgctggccctgtctctgtgctgtctggcatgcactccctgtcatgccactactcactgctttctccatggccctgaagcacatcaaggtttcatgcatgacagctgtcttcaaccagcccactgtgccccatatcctacctcccagatggtgtcctcagaccgaagccaactttccatttcatgcccacatgaatgctcaatgcccaggtgtagtctgcacgcacacaccacctataccacatgacagcacacagagagacatcacacatgaaccactacacatgaaaacatgacccagacgccaccctggagagcacccctagaccccgaaggcagcgaaacacaagagacaagcacatcactacaaacaaggcaccagctcatcaactccccagacttactacaccagagaccccaaacggcctcactccgaaacgcaaaccaacacacgtcgccaaaaccccaccaacactgctggcggcatatacagacccccagccaagcacacaaaccgagcaacgcaaaaaaaaacacacatagccaagtaacccactcacaaccaaagcgctgcaccaccctggacctcgcccctaacatactggctgtatccaccgcacactcgcaactttggccacacgacccaccatatgacacacagtcgcctgcaacgaacaccaaactcccccccagcgaatatctcccaaacactttcgcccaaggcaacaagttacctccgtccacacctcactaccactatccatgtccagcacgtaaatcttatataaacgccaacccaaacaatgcattgctgaccatacatcggaataccatccacaatacgcacttccctatacagtgaaaatactctcccgatatcaccactgtaaccgtaaacaagacccccaatagaaacaacactatgaactacaacaccgctcaagtaaaccgcacattggatgcacaa

SEQ ID NO: 694773 - DNA, 146 bp, Homo sapiens
  misc_feature (9)..(9): n is a, c, g, or t
tccggagcncaatgggggctacgcacccaccacattagcaacataaaaccctcattcacgggagaaaacaccctcaggttcaaacacctatcccccattttcctcctatccctcaaccccgacatcattacggggttttcctttta

SEQ ID NO: 694774 - DNA, 209 bp, Homo sapiens
aggtatacactagccagcgagaacataaagaactagtcgtctttaggaatttcttgcgctttgattatatacagggcttgtgccctgtatcacttatagggtctcgaatgcttgtgtagagtaagagcggagatgcccaatattcaaagctgctaagtgttctctgtgccatgaagactccgtgtgagtgtgtagcaagttgaacgggg

SEQ ID NO: 694775 - DNA, 172 bp, Homo sapiens
aaaaaaaaagaaaaaaaatacttgggcatgggggggggggcctgtagtcctagctccttgggaggttaaggtggggggcccccttgaccctaggagtttggggctccagtgagctccagtggggctgcagtttctttttgcctgggggagaagggggagcccctgtttccca

SEQ ID NO: 694776 - DNA, 425 bp, Homo sapiens
ttgtgtaaagtatagcaaagcaaagtcaacaagcaaaaagttgttagtttcaatgaactaattgagaatttgagaatcagaccatagctgagcagaaaatgaatagaagtaacattgacaggatgaggttgcctagctttttaagataaagctttggccgggcgcagtggctcacgcctgtaatcccagcactttgggaggccgaggctggcggatcacttaaggtcaggagttcgagaccaggccaacatgtgaaaccttgtctctattaaaaatacaaaaattagtcggtcatggtggcgtgtgactgtaatcccagttatttgggaggctgaggcaggagaatcgcttaaacctgggaggcggaggttgcagtgagccaagtccagcctaggagacagagcgagactcagtctcagaaaaaa

SEQ ID NO: 694777 - DNA, 406 bp, Homo sapiens
gaagggaggcgaacctgacttccaggcggttgaaccctacacgaagaaagaacttgctggcggttactttccctgacatcattcgcaattacaaggtcagggcggcggagaatattcctgagaatcccctgaagtatcggtatccaaatatggacaaagaccaggccttgggaaagtataactccaggccaagggaagcaccagagccaagggaactggatggccctaagggaacgggatatatcaggacggagtggatttcggtgtctgaagggtaagtgaacacagaagagtgacatgtttacaaacctcaagccagcctggctcggggctgggggcctggtggaagatggtggtatttcacttttccatggtaatgggtatcggcatcacagctgaactggtg

SEQ ID NO: 694778 - DNA, 357 bp, Homo sapiens
ttaaagaaaggcaaagtagaccagcacattcaaattcagaatagcattgaagcatcaagatgaagcaaatccatcaaacgtcaatgaacgctagttttatctaaggtgaaatcctctccccacacccatacgggcgggaggtttcagtgggcaaggatccctacagtccgggggtaagatgtcaccgtgcgtccgggacacacccatcgctgtaaccactgggcaggaggaaccacaaagtacgtatcacagatcaccgccctcattaggtgttttttttttttttttttttttagcaaagaaaaaaactgcacccccgggagggggggaccgggaacgggctaacaaacctgccgg

SEQ ID NO: 694779 - DNA, 286 bp, Homo sapiens
ccgggcctttttggcttttttcaagggggcccccccgggtttttttttttccccatttcccttcctttaaagaagggcggggtcccagggtccccccttctgggggggttttgggtgggggggggttttccggttcccttggggggcccccccctttccccccctttctgggtttattttttttcccgggggcccctggccaccccctttttggaggggggggggtttttggggccgggcccccccccccccgtttgccttcctggaataaaattgggttttggga

SEQ ID NO: 694780 - DNA, 992 bp, Homo sapiens
cacgtggggtgaccatgtctacacatgtgagtcctaagcgggtgccccgtctctgtcgccctgcgcgcagccatcaagtactctggagaccttctgtcgactcccgggtgactgcaagcaaacatccccaacgttttctccatgcagatgtgtggagccggcttgcccgtggctaggcatcgtggcgtagccaaacggcaggtcatctgggctggacattgtatacctgaggattggtcataagaggacgacatctgtgtataccgccatattcaatggaacgagtagtgctagctacctatgcataagaagagttcctgagaatttggaaccttggatgggcaatagaccttacatctggtactggatgcacgagttataatcgacagacagagggacatcgttggatcaggggcatccgagcagctagctgctgccgtgcacccaggaagggtgttgtgatgcgggtggtggaacgcatgtggctccgcgcgatctctgatttccagagatgctactgagtgggtttcgtggacctgggtcgccagcctggcggtgctggggagagaagtgtcgggaagaccagccttgggtcttaacttccgctaatagatcgtccgagtctaagcctgagaggacgaggaacttccagcagggtcagttcccgtagtcacagaatccctgcgcatcagccgtttacagttcagtgcgcatgatgggcggccggccgtgaattatgacatgtgaccggataacgggcatttccccgatccacaagatgcgctggtggatcggatgccacggtgatggagggcttctaggagtcaatcttcgacagagcccagaagacggttgggcattcgcatggaagccccctggtgcagacaattgacaggtgctgccaatggactgaaaatgtccgtggcctttactcaacagaggaatgtaggccagacaatgtgtccccgaaccagtccttatgagacgagcca

SEQ ID NO: 694781 - DNA, 388 bp, Homo sapiens
ctcaggatctgtgggctggtgtgggggctccaaggttgcttgttgaggagctcctgagactcattgtccagcgagaaggaatgtcacccgatcaattgatcagtcagggtggagcaggaacaaatcacaatggtggaatgtctactcagtcttcggcagagaactggtctatttcactgtttataggttcttcagttgcttcaggccatctggcatatatatagtgcccggtcacagggttatgatggcttagcttgggctcaggggcctgtcattcaggattcttttttatcttcctctgatgctcttctataagaatgactcaagttttagatgtccagactccaagtgcccgttccttcccggtgttcagccactgcgttgatcc

SEQ ID NO: 694782 - DNA, 293 bp, Homo sapiens
  misc_feature (6)..(6): n is a, c, g, or t
  misc_feature (11)..(11): n is a, c, g, or t
tgtttncattngtcttgagcatgttggctcacacctgtattcccagtactttgggaggctgaagcaggaggactgcttgaggccaggaatttgagaccagcctgggcagcatagcaagaccccatctcagcaaaacaataaaaattaactgagtgtggtggcatgcctgtgttcccagctactcaggaggctatggtgggaggatcgcttgagcccagaagtccaaggcctcagtgagctattatcacgaccgctgcactccagcttgaatgacagagggagactctgtctca

SEQ ID NO: 694783 - DNA, 1001 bp, Homo sapiens
ggtgccagaagacatgtgtagcggatcataaccctaaatgtcacccattgtaaccataaaataatctatatcaacaagtatgtcgtcaggggacacttctattcctgcacaaatactgcaatacgtgtatggagtctctatctcataaatgtatagtgctttgacaacataaaactatcctgtcgatttaataggttacgagactggttctgatttaaaaatggtgacagagggactcactctccaagattattgtcatttgcctatctgtggaatggaccatgaagaactgaggacgatgataggatgcctgtcgacacatggccacatctcctcgtggtgaaattatggagttccgagtaaagtgtactaggttgacctaccatggtatgtggcacccaaagatatggctgccttcgatgtatatgattaaggggtacatgttacatgagccagggtgtgatgactgctgcgtgcattgttttgcaaaggctcgagtggtttgatgagttatgcgagtgctgcgaattttactgatgagtgagaggatgatgcctggatgcacacaggggtgtcataatgggctaaacgggaatgaagtgtggaacaatggttaattgttcgggtgttacaaaaaatgggattcccatggagccaaccaaaagggccagagagcagatcatggagggaccttcgttcaaggaacgtccgacaacttacattacgagagggggtacaacccggaaaagtagcatacggggcactggcgggggaatgggacacaggcgcccaagagctaaatgcctggctcaaggaaagcaaacacggagggtggactgccgtgaaacagcgctgaggctgaccggcccaccacacggtcgcaagaggcacggcgcggcgcccagatggcaaccggggaggaaggcagaggaggaacgcgtctcacgggggccgggccgtaacagcacgaggagaagaccgcgacacaagggacccgcaac

SEQ ID NO: 694784 - DNA, 1031 bp, Homo sapiens
  misc_feature (1017)..(1017): n is a, c, g, or t
ggagtacatcatcgtgatctctgcgagtgcaaaaggcttaagggaaactggtccttcagtcatgtccgtgtgacactcgatggtcttgaggaggtgccatgggttgtcatcagtcaccatgccgcgagtaaaggtgcggtctgacaaagaaattctatatttagacgttcgtggggtcagtccaagggactatctcaacatggtgaagtccgcgacggagggtcagaatagtggactggactcacgtgtccggaggcctctgctttgggaacaaacgtagcaagtgatcgaatgagatgaatcagtgagtccatgttgggtgaactagcaaaaaggatgaacatccttgcattggaattggaaagttgaagtcagaccatctgttaggtgacccagaaggcatgaaggatggtgagccaccttactttgagaggaagaagggtcgagcagaagaaagcgaattcctgaaagtgagtgaggacacaatctggcgggctcttcagcggaagtgtgcactctcaattgttcaatgcgatgttgtccccatgaggccatacaggagaggcgtgcctgtaaagtcatggagccaatcttgtacggaggatgtgcgccagtgaccttaactgcggagtacgggcgacctcttgacgggcacacgtttttggtgtgattcctgtaagggtaagtcgtggcccgtcgttgggcataattaatgtagtttgcttgcctatggcttggtatttgaagtaccataaggctgggatcatagcagtgcgcgtatcgtcggcaagtttgtccaaaggcgttgctttagaggtgacaagtagtcctgccacggaggcatggcggtggcaatgggacccactatatttgtgcctcaaatcagctacgcgctcaagaggtttgtgcagttagaagaccagctgttttatgcgccatggtgtgtcacatattatagattccacgcggtagagatcatctgcgccacaccaggcatcactgctgacaagcacatantctatgcatccctt

SEQ ID NO: 694785 - DNA, 286 bp, Homo sapiens
ttcaaaacagccctatcaagaggaatgtttaactctgtgagttgaatgcaaatatcataatgcagtttctgacaatgcctctgtacagtttttttgtgaagatatttctttttctaccgtaggactcaaagcgctctaaatatacacttgcaaattccacaaaaagagtgtttcaaaactgctctaacaaaaccaaggttaaattcagcaagctgaatgcacatatcacaaagtagtttctgagaatgattctattttttctatgaaggtatttccttttctacca

SEQ ID NO: 694786 - DNA, 579 bp, Homo sapiens
  misc_feature (34)..(34): n is a, c, g, or t
  misc_feature (36)..(36): n is a, c, g, or t
  misc_feature (60)..(60): n is a, c, g, or t
  misc_feature (243)..(243): n is a, c, g, or t
  misc_feature (361)..(361): n is a, c, g, or t
  misc_feature (410)..(410): n is a, c, g, or t
  misc_feature (413)..(413): n is a, c, g, or t
  misc_feature (420)..(420): n is a, c, g, or t
  misc_feature (426)..(426): n is a, c, g, or t
  misc_feature (471)..(472): n is a, c, g, or t
  misc_feature (490)..(490): n is a, c, g, or t
  misc_feature (503)..(503): n is a, c, g, or t
  misc_feature (523)..(523): n is a, c, g, or t
  misc_feature (538)..(538): n is a, c, g, or t
  misc_feature (554)..(554): n is a, c, g, or t
  misc_feature (568)..(568): n is a, c, g, or t
ttcagcggccactaccattcctagcctctggtantnattcttctactcttggatgtccantagttcaattgttttgaatttaggtcccacaaataagtgagaacatgccatgtttgcctttctgtgcctggcttaacttcatttaacataatgatctccacttccatccatgctgttgcaaatgactggatctcattcctttttatggccgaatagtacttcattgtgtatacataccaagantttccctttatccattcatctgctgtttagacatttaggttgcttccaaatcttagctattgtaaacagtgttgtaaaaaaccataggagtgcagatatctcttccatatactgattnttacttttttgagacagggtcacacttttgtcacccaggctgggagtgncantggcatngatctntggctcacgtgcaacctccgaccgtgccatagcgggtattcagcnntagcatgctttgctgaantaccggctgcacnttgctgttctgcttcgaagntattcaataccgccncagtattctcaaatgnaagtgattctaagnatttggtttgg

SEQ ID NO: 694787 - DNA, 150 bp, Homo sapiens
ctttcatgttgacactacatgacttctatcttggacacacagatatcccaggctcggtcgtgtttgtcgcctctacctatagatctatcccactattttgctacatatgggggtgtgctcttttagctgttcttaggtagctcgtcgtgt

SEQ ID NO: 694788 - DNA, 106 bp, Homo sapiens
ttctatgctcagttatctctctgcaaaatgggataacttccgcatggttgcggtaaggattagataagatgtgtaacatgcctagcctagtacctgatccatcaat

SEQ ID NO: 694789 - DNA, 318 bp, Homo sapiens
  misc_feature (254)..(254): n is a, c, g, or t
  misc_feature (303)..(303): n is a, c, g, or t
tctcactgttgcccaggctggagtgcagtggcatgatcatggctcactgctgtcttcacctcctgggctcaggtgatcctcccaacttggccttccaaagtgttgggattacaggtgtgaacaactgcaccgggttgagttgaactattaaacggtttatatgtaggaggtgagttactactatttattttcaaacaaacttcaggaggaaaaggatagtttgaaggtgaaaaaacatattagttgtttttccntggggaatcttttttttgattctacataattacattatctaggaggtcngttttaggaccatca

SEQ ID NO: 694790 - DNA, 137 bp, Homo sapiens
ttttttaaagaagtaagcctttatttccttgttttgcaaataaaactgagctaagattggttgcaaaatggtgaaaaaatacaaagagaccgtatcccatatcaaagtccgactcctccgaaacaaccttgtcgacg

SEQ ID NO: 694791 - DNA, 649 bp, Homo sapiens
  misc_feature (551)..(551): n is a, c, g, or t
  misc_feature (625)..(625): n is a, c, g, or t
aaaaaaagctgctgcccatggctgtgtaatactcctctgtgtggatgcacaatatttctccattcatctatagatggggtatgagggctgtctccacctcttggctattgtgaataaagctgcttgttccttttcatggctgtgtaatattccactgtgtggatggacattatatttttccattcatctatagatgggtatgagggctgtctccacctcttggctattgtgaataaagctgcttgttccttttcatggctgtgtaatattccactgtgtggatggacattatatttctcccttcatctatagatgggggtatgagggctgtctccacctcttggctattgtgaataaagctgcttgttccttttcatggctgtataatattccactgtgtggctggaccacattatatttctccattcatctatagatgggtatgagggctgtctccacctcttggctattgtgaataaagctgcttgttccttttcatggctgtgtaatattccactgtgtggctggaccacattatatttatccattcntctatagatgggtatgagggctgtctccacctcttggctattgtgaataaagctgcttgttccttttaaaaaanacaaatctaacagcccgggggatc

SEQ ID NO: 694792 - DNA, 429 bp, Homo sapiens
  misc_feature (331)..(331): n is a, c, g, or t
  misc_feature (405)..(405): n is a, c, g, or t
cactttctgtctctgtggattgcctgtatctggacatagggaataaatggaatcatacagacactatgtatcttttgtatctggcctctctcaggaagcatgatgtcctcagcattcacccacatgccacctgtggcagagcctcgttccttttcatggctgtataatattccactgtgtggctggaccacattatatttctccattcatctatagatgggtatgagggctgtctccacctcttggctattgtgaataaagctgcttgttccttttcatggctgtgtaatattccactgtgtggctggaccacattatatttatccattcntctatagatgggtatgagggctgtctccacctcttggctattgtgaataaagctgcttgttccttttaaaaaanacaaatctaacagcccgggggatc

SEQ ID NO: 694793 - DNA, 817 bp, Homo sapiens
  misc_feature (719)..(719): n is a, c, g, or t
  misc_feature (793)..(793): n is a, c, g, or t
ggagactcgcccttgtcgtccaggctagagtgcagtggcacgatctcggctcattgcaacctctgcctcccaggttcaagtgactctcctgcctcagcctcctgagtagctgggattacaggcactcgccaccatgcctggctaatttttgtattatttatttatttatttattttttgagacagagttttgctcttgttgcccaggctggaccacattatatttctccattcatctatagatggggtatgagggctgtctccacctcttggctattgtgaataaagctgcttgttccttttcatggctgtgtaatattccactgtgtggatggacattatatttttccattcatctatagatgggtatgagggctgtctccacctcttggctattgtgaataaagctgcttgttccttttcatggctgtgtaatattccactgtgtggatggacattatatttctcccttcatctatagatgggggtatgagggctgtctccacctcttggctattgtgaataaagctgcttgttccttttcatggctgtataatattccactgtgtggctggaccacattatatttctccattcatctatagatgggtatgagggctgtctccacctcttggctattgtgaataaagctgcttgttccttttcatggctgtgtaatattccactgtgtggctggaccacattatatttatccattcntctatagatgggtatgagggctgtctccacctcttggctattgtgaataaagctgcttgttccttttaaaaaanacaaatctaacagcccgggggatc

SEQ ID NO: 694794 - DNA, 117 bp, Homo sapiens
tgggtgcaggttgccagaatgcagggtgggtggatggatttcaggaaagcaacagaggaagtggggaggaggttggtgcagctgcccacgtgagcgattatggtgtcttgggaccag

SEQ ID NO: 694795 - DNA, 165 bp, Homo sapiens
ttacatacactcgacgctcggtaccagtactggtcttcgcctgcgtgaggttgcagccgggacacagttaaacggctcgttcagctgctccagcaaggaggaggtgtgagcatcttccacgggtaggactttagcagctcgtggtatttccgggtcaacctctca

SEQ ID NO: 694796 - DNA, 317 bp, Homo sapiens
ccagacctccaaatatctcatcaataccgactaatcaccaaccaacaatgaataatcaaactaacctcacacacacagacctcacacacaacacacacagacactcacacagacaccacacacaggacatcacattgacactacacacagaactcacacaccaaacacacataccacacccacaaaatcacaaacaccacacacagacctcagaaacaccacatacacacatacagaacacacacaccacacacagcagacctcacacacacaacacacagagaccacacacacagagacctcacacacagacctca

SEQ ID NO: 694797 - DNA, 159 bp, Homo sapiens
caacatcccttgctccttctgcatccttctgcaccgatgctggtatatgggtcttgcggtctcgctgactcattctccactggctcatacttaggggtccatgggagctatgtccaaccttgacatactagattagttgcggatgtagcatgtggatat

SEQ ID NO: 694798 - DNA, 237 bp, Homo sapiens
gcaaaaagggggggggggcctttttcaccaccccccttttattgggggggaatttttttttttgcgggttcccccccccccttttgaaaagggggccccggggccttaggggggccaatttttacattcccctgggggggcccggggggggaaaaaaagggggttttccgggggggccccggggggcccttttttttccccccggtggggggtgtaaaaaaatttttttttttttta

SEQ ID NO: 694799 - DNA, 550 bp, Homo sapiens
  misc_feature (378)..(378): n is a, c, g, or t
  misc_feature (549)..(549): n is a, c, g, or t
tctggagttgctgggggtattcttttagttgtccccaacgtcatgggcatgatgtgttggtctcctcctcttgacaagatgggcaacagtgttaagggaattcacttttgtcacgatcttgtttctctgtgtaacttccataactatgataatttgagacactttgcaaaaaaacttgatcctcggagagaaggaggtgatcaaagggtgaagtcggtgataaaccttctgtttgccgcatacactggagatgtgtctgccctccgaagtttgctctgtcagccatggacatggagcagcgggattatgactccagaacagccctccatgtcgcagcagcagagggtcatgttgaagttgtcaagtttttgctggaanttgcaaagtaaaccctttccccaaggacaggtggaataatacccccatggatgaagcactacactttggacaccatgatgtttttaaaatccctcaggaataccaagttcagtacacacctcaaggggattctgatgatggaaagggaaccagactgtccacaagaatctnt

SEQ ID NO: 694800 - DNA, 1107 bp, Homo sapiens
  misc_feature (873)..(873): n is a, c, g, or t
ctagagaaggtcggttgtaccgtcagattgccttcgtaggaccatctgaatagatggttcttagagtagcctcactaaagatagtattcagggtgaccatggagctgttaggtattcagctgacgtgcgtgtagggatcggttgcggaaaagactgaggcgatgaattgtaccagtatctctccgcataggatggtcatagaaagttcagttaattaggtgtacttgattcatatgatcaatgttacacatggggatattggcagattactccatgaatcaacagcattcgatgattgaaacataattgtacgcccacaagttctgcggtggcaacacaccaattaaaccacagtcttcggaaggcctatattgggtaaactctcttggagggcatcgtggcgctccttaaagcgagagcaaaagtgcatttcaatacattaagcagaatttaaggttaaggaactctcgtggcacacgcttcgtaaccagagagtggcaggccgtaccgtatagcaacaacgccacgaacacccttccaacccaaggtgtccatttctgttgtaaccgttatatatagaatccccccccgttaaagacgcttttaagtcacactcatgggtacggattactccgtcttggcaacggcccatattactagacttactcatggggcgattatccaatttctgtacacaacaagttcccgaaggacaaaggggcttagctaacttacggacacacaaccccatgtgttatcccaggacacttatctcttcaaccaatatcccttggaagttcagctgggtgtctcctctttggtccaaggacacatcagctttgctattactcagctaaagtaccacacacggcngtattaacccggttgtaacatcgttatacatccccttgtaccacaggacctatttcttggttaggcacccacgggcggcgaggtatcaaccatggcgtggcatgcattgtaaggaacgcacaatacttcatatactctcacacaggtctcaactctgaacacagaacgcccttggccaccacacgcccaaagtctcctggggcagtagtctaagttgtctatagcccgaacaag

SEQ ID NO: 694801 - DNA, 252 bp, Homo sapiens
gtcgacaaaaaagagagagagaaaagataaacctcttaaaccctaaatttagtaaaaaccccaaaggcttttgttctgaacatgcatcgcatccatacttgaagagaaacaaaagttcatgatctcacaatcagaatgccatttctactgctgcatgtttcagataggtctcaggctgataagcctacatgataagtgatcagaatactttggctactgtgatggttttcaagcatataacaaccgtcgacg

SEQ ID NO: 694802 - DNA, 500 bp, Homo sapiens
ttggagccacttctcaggccagtctagtgcctaacactccgggatgtccagcatcggactgaggtaggatgaaagcaggatgctcggtctgtaaggttctcatccccccacatcagccctctttggttcaaaataacccttggtgtggggtaaaaagttctgcagctcatttcactgaaagcttttctagcgcatacttaactctctggtcaatgcttaagatatataagacaccagtgcaattgctataaagatctttaaattcgcatttagtgtgtggttctgctcagctcccttctgttcctgtgtagtatcagcatgtgatcctgaggacattctagatattggagtaaataaaatcttttcttaagagcaaactcagccgactttggacacatggggtaattgtgcatttatgaccagaattatttctagatggctggatttgaattgagattttcttttcatgtattaggtgtataaatgaataaaaagatgtt

SEQ ID NO: 694803 - DNA, 340 bp, Homo sapiens
atggtcagctgatccaattgagcacgcggggatcactctgtctcagtttgaagggtctgacaatatgagaaccgtcgtattaaaatacaaaaattagccaggcgtgtggacatgctgtaatcacagctactcaggaggctgaggcaggagaaccacttgaaccttggagatggaggttgtggtgagctgcgattgtgccattacactacagctgcactccagcctgggcgacagagtcagggtctatcttaaaaaaaaagaaaacagaaaaggcgcatgttctacacggatgtcccttgctcctttggagggtcctacctccttacccaggaaggaggaa

SEQ ID NO: 694804 - DNA, 179 bp, Homo sapiens
aggatttttctattgacgatctattagaattgagcaggatgagagcccccaactcactcaggcacttggtgtagacaagacagacagaacagataaagggagacaggataccgcctgccttggctggtgctggtaggaagttgttctgtgaatgccctgttccactgatgccactaggg

SEQ ID NO: 694805 - DNA, 158 bp, Homo sapiens
ccgttctgaggtctctttctgaaacccattttccgctatccgagttagtgtgttggtcgcatcctgggggttgacccttgcgctgtcctgagtgtgctttggagatttgcatgactgctggcatcggtgctttcacaagacccattggtctcaccgtc

SEQ ID NO: 694806 - DNA, 135 bp, Homo sapiens
gatagttggggctagtggttgatgatgccaggctgactcatcacgggagcactacttatggagtgaggaagactctgataggagcttccatctgcgataacgccacaggcaccatgtgaaaaccaactagtctaa

SEQ ID NO: 694807 - DNA, 441 bp, Homo sapiens
tctagaggatcctcgttactggcatttatagaagaatcagtgatacacaaagcactttcatacctgcacgtgctctccactgatatttgtcacttccctgtgaggtaggaaggtgccaccccacagtagttctgagctgttcaccctggctctgtggtttccagtccaatgttctgccctacttaactgaataacactgatttttgtatagctgcttaatactgaggctgacagcctggaaactttcaaataattcttggtacatcaggtgcacctctgattcagccactgctcatttgacagacacaaaccaccttgttctcctaactcatctatcctctttctcatttctgttgttgatgtggttcattatcccattagattcacttctaaggagaccaaacataaagtttcattatagccaactaacttacacatgta

SEQ ID NO: 694808 - DNA, 906 bp, Homo sapiens
  misc_feature (39)..(39): n is a, c, g, or t
  misc_feature (69)..(69): n is a, c, g, or t
  misc_feature (77)..(77): n is a, c, g, or t
  misc_feature (89)..(89): n is a, c, g, or t
  misc_feature (258)..(258): n is a, c, g, or t
  misc_feature (323)..(323): n is a, c, g, or t
  misc_feature (333)..(333): n is a, c, g, or t
  misc_feature (369)..(370): n is a, c, g, or t
  misc_feature (378)..(379): n is a, c, g, or t
  misc_feature (381)..(381): n is a, c, g, or t
  misc_feature (389)..(389): n is a, c, g, or t
  misc_feature (461)..(461): n is a, c, g, or t
  misc_feature (485)..(485): n is a, c, g, or t
  misc_feature (495)..(495): n is a, c, g, or t
  misc_feature (497)..(497): n is a, c, g, or t
  misc_feature (654)..(654): n is a, c, g, or t
  misc_feature (665)..(665): n is a, c, g, or t
  misc_feature (669)..(669): n is a, c, g, or t
  misc_feature (735)..(735): n is a, c, g, or t
  misc_feature (797)..(797): n is a, c, g, or t
  misc_feature (807)..(807): n is a, c, g, or t
  misc_feature (842)..(842): n is a, c, g, or t
  misc_feature (880)..(880): n is a, c, g, or t
aggaaaggagttggttcgcgcaggtgcgggcgcctgggnccccatggcgctagtggcgcggctccgcgnacgcgcgncttcctggcgcnggaccgtgaggctgcgctcttcctgctggagccgagagctagccaggctcggcgctcgcgactctctctggagctcgctgtgtctggggcccgcgcctgcgccccgcgcggtaccgcgtctgcccccgagaggccgagttggcagagcagcctgggacgcgcttatcgngcggccagtccggcgctggcgcgcgcgtggcagatgggagtcaatgcatgtgttgatgtggtgcnctcaggggtnaagctcttgcaggcacttggccttagtcctgggaannggaaagannanagcattcngcattcaaggaatgatctggaagaacgccttcatatcgacttcatggggaagggagctagctgctgagcgcntcgttcagtgataaggaaactttncacgacattncncaggttgcgtcagagtctcccaggagcccaggttcttctttgcggtccagttggtccaaagctacatgagcttcttgatgacaatgtctttgttccaccagagtcattgcaggaagtggatgagttccacctcattttagagtatcaagcaggggangagtgggggcnagtnaaaagctccccatgccaaccgattcatcttctctcacgacctctccaacggggccatgaatatgcnggaggtgtttgtgtctagcctggaggagtttcagccagacctggtggtcctctctggattgnacatgatggngggacaaagcaaggagctcagaggaagagatcttnggaggttgtaactccatttctgacatcccactggtatncagttcacctagagctggcagtatga

SEQ ID NO: 694809 - DNA, 302 bp, Homo sapiens
agcccagtgactcacacgcaggagcatgttggtcagttcagcaaatattctacccagggcacagggaacaagaaattaggccgggcaggtacagcccgtagctcacgcctgtaatcccagcactttgggaggtcgaagtgggcagatcacctgaggtcaggagttcgagaacagcgtgggccacacagtgaaaccttgtctctggctaaagaatacaaaaagttagccaggtatggtggcatgcacctgtaatcccagctactggggaggctgaggcaggagaatcgcttgaacccgggtgg

SEQ ID NO: 694810 - DNA, 229 bp, Homo sapiens
agagaccgtatagcttgcacagggccatgcacacacgtatgtacacctagatgcctaactaggagctctgactcatgaatgtgagacataccacattccataccgttgcttcatgtcagactcatactcccacgacccatatgatacagatatgacgccgtggactctgacctgacggaccgaggatactgcacatcagctgattaacctagtatctgttgtggcctgc

SEQ ID NO: 694811 - DNA, 105 bp, Homo sapiens
cctgcttcaccgagagaggagtcgccctgctttagacgagagaggagtcgccctgctttagcgacgagaggacgtcgccctgctttagcgacgagaggagtcgcc

SEQ ID NO: 694812 - DNA, 129 bp, Homo sapiens
taatcgagtcggtaccgctcacccgacggggtggggttgtcgctttgagggaagttacgcttatttttttttttggtctttggtttttttttttccctttttcgggaaaagggggttctcgttttttgg

SEQ ID NO: 694813 - DNA, 183 bp, Homo sapiens
gaagttaaccgagtagtacggaatcccaatttgggttgccaccttggcaacgtctttatagtcttccgtcgcggtacaaaccccgttctcatcggtgtcgtcccagttcttcataaaaaccccgacaacatcgtaaccctgctgctttaacaacaaggcggtcacggaggatctacgcccccg

SEQ ID NO: 694814 - DNA, 313 bp, Homo sapiens
atgcgaggttgatctagaggatcccggttcattcagtgtatcagccttgtccccagtagaggggacaaggccagagcaatccagaagtcgtcgggtggatcaaaaactagccatgagctattggatcgatagggttcatgtgcttcggtaaaaacagccttaccttcctatttatgtctttaggtacacactctagttggtaagcgcggggtcacgggtcctatttccctctggactccagtggacctagaaatccaaaaatcccctccagaaagtttcccggtatgggagcccaaggggtacggagctcgat

SEQ ID NO: 694815 - DNA, 283 bp, Homo sapiens
ctgaggggagggttcccttacaatggcacctaagagctcttggtggtcttttgaattataccaggtggtgatgtgaaactagagagcaataagtgaaggttcaccgcttatcccggactccttagagaagcaacgaggtcactcaaacagaatctgagagttcgaataggggctataggatataaagcattcactgtcagcgtatctcaggaaatagcctatttggctaagcagcaagtttgatattactttggatcctgtcttgagttttaaaatgtgtcaa

SEQ ID NO: 694816 - DNA, 194 bp, Homo sapiens
gtttaaacaaagtgaacaagaagaatataatcagagttccagaagcctccttcttccattcaattaccccgtcacctttcagcataacttacgtacatgtgacttcgtgacattacacactatgttgagttttagccacgttttaaacactttatgatatatgacaacccacacagataacgcttttacttttt

SEQ ID NO: 694817 - DNA, 1479 bp, Homo sapiens
  misc_feature (738)..(739): n is a, c, g, or t
  misc_feature (741)..(741): n is a, c, g, or t
  misc_feature (746)..(746): n is a, c, g, or t
  misc_feature (756)..(756): n is a, c, g, or t
  misc_feature (770)..(770): n is a, c, g, or t
  misc_feature (773)..(773): n is a, c, g, or t
  misc_feature (787)..(787): n is a, c, g, or t
  misc_feature (918)..(918): n is a, c, g, or t
ggtcgaagctcccgggagagctgcgaaccgacggcgagaggctgcggatcagggcgcggctgcgcgggtcggcacaggggcccagacgccagcttggacacgcgcccgagagggctggccccggcatgccgtgctcggccggcacgaggcgcgtcgcctcaagccgggggtgtccgtgtcctcctccctcagcccgggccgccgctccatgcgctccagcagcttgaacgagacgctgcggtaaagctggggccaggggtgccccgtccgccatagtggcgtaactcactccgggggggctggcctcgggcagccgcggccaaccccccctgcgcccccactccctaggagcgcagcggcccacgccgaaagcagcgcacgggagtgtgggaagaggacgcagagaccggagcagaggtttctctgccgcggctcaagtttctgtggccaccggccgcaacgtctccatcccgggcggcccctcccgcctcagcgccgacccccaggcccagcccccgccgcggctggagcgaccaggggcaccgcggcaccgcctgggcgggatcccagcgcttggttcctcgactctgcgtccgcctgcccaacgcccttggctgctcgctcctggcacccttttgttgcaaataaactttgcggcagaggcaagggggcggggggcggggcctcgcgcccaaaagagggggtgggctccgggcgtgcgcgagcctggaaccgcgnntnggagngaatcaggangagccgaagaaganaangcctgctggagacntgcagactgaggcgaccctctggccctccagagacgtccctcgggagcccagcaggccgagctgcccccagggagtcgctgagacacacacaaccgctgaccgtgctcagctccgcagactcgcagccagngcgccgcgtccaccgcgggccaccagcctccgcgcggaaacacctcctgcccaggggctccaacatggcaacctcggactcacaaactctcgtacacactgacagctcaggatgcatcgcagacgcacactcatctgggccgggaaaggggtgggactcggcgccagggagagcccggggagccgacgggctaacctgaagggtgccgtacgcgccctactccaccgcccaggccacgcctcctccccttccctccccctccccgcccgccctctgcggcgaatttagctgtagccacgccctagtccccccatcgtcgctgcccaagcgccccgccatcccacctcccagccgcatgtccggctccgaccggcccccaacccacccagcgttgctccagaagtcccacccttcacgaccgcgcccccaccctacttttgccagctgcaagccttccacctgccactgcagtctgccggctcttctcctggactctccgcgctggatccccgagccttttcttcgtgctctggagacgcggtataacgcccggcccgctga

SEQ ID NO: 694818 - DNA, 222 bp, Homo sapiens
  misc_feature (19)..(19): n is a, c, g, or t
  misc_feature (188)..(188): n is a, c, g, or t
gagcttgaagatgcatgtnccacaccatcagacgtcagaacacagccttgagagtctcaggtgcacatgagcatggatgtggtgatgggcccctgtgcagatgcaggggtcgcagagcaggccctcgtactgctcagctgtctcagtgacgttgggcaggaccccgacattcgtccaacacagtggtnccagcctggggtcggcagctgacggcccagatgg

SEQ ID NO: 694819 - DNA, 213 bp, Homo sapiens
  misc_feature (7)..(7): n is a, c, g, or t
  misc_feature (32)..(33): n is a, c, g, or t
  misc_feature (47)..(47): n is a, c, g, or t
  misc_feature (50)..(50): n is a, c, g, or t
  misc_feature (52)..(52): n is a, c, g, or t
  misc_feature (55)..(55): n is a, c, g, or t
  misc_feature (118)..(118): n is a, c, g, or t
  misc_feature (143)..(143): n is a, c, g, or t
  misc_feature (163)..(163): n is a, c, g, or t
  misc_feature (189)..(189): n is a, c, g, or t
  misc_feature (203)..(203): n is a, c, g, or t
tatatangttgctccattaagatataagcagnntgagtgtagagctngtntncanctttacacctacagtgtatggcactgtgactagcatatatcaagtgatcaacaaatatttgtngaattaatgaattaataactgtctnaagctgtcatgctgaaaaanggaagccatctgttatacttggcaancgataatctctgcnagaacagctt

SEQ ID NO: 694820 - DNA, 566 bp, Homo sapiens
cccaccgcgtcccgaggagtggccaccctggcgtttttcgggaagctggtgaccctctggattttatagcctggagaggcccccttcgctcacgcgtatcgacccgactcgggagaagctgacaccccgagcacactgcacttccactgcggcacggcggagcttgccccagtggcacgaaggtcctaccccggcggcgaacccgggacactcgtgcccgggcctatggcactcggggccctggtgttggctaatttatggttacaccttctactcgagtttccccggagcgtttcctagatgagctagaagacgaggcccaaggctgcccgagcccgagctctggcaagggcgtcagggtcctaatctggatgggtattgatcatgtcccacctgctggagcccctttcacctggtggatgatgccccctgaccctgtagaaattgaatcctgctcacaaccttgttggcctttttactaaccttggaccgtgattgagccccagaaacccgggacttacgcatttggcccatgtccaaagaacccagaactttgccccctgcca

SEQ ID NO: 694821 - DNA, 176 bp, Homo sapiens
cggatcgaactatcctactgctgtatagcttcatggctaaaatattaactacaactgtgagatttgtggaaactacacctaccgagggccccaaagccttccagcgaacactttgcttgaatgggcgtccatgctccatgggcatggagggtgtttaggcgcatccccaaaacact

SEQ ID NO: 694822 - DNA, 305 bp, Homo sapiens
ccttcactctcctcccactcagcctttgagtggctgggatacaggcatgtgccacagtctggttaatttttctgtattttttttgtagagatgggttttcaccaagtggctgaagctggtctcaaattcctgggctcaagcaatcctcccgccttggcctctcaaagtgctgggattacaggtgtgagtcactgcacctgacccctaagcaaattgggaaattagtagaatctcttgagctaaaccaaagaaaagctgggactcaggtttgagatcctcatgcttggtctggtggcttctccacg

SEQ ID NO: 694823 - DNA, 1019 bp, Homo sapiens
  misc_feature (7)..(7): n is a, c, g, or t
  misc_feature (184)..(184): n is a, c, g, or t
  misc_feature (191)..(191): n is a, c, g, or t
  misc_feature (205)..(205): n is a, c, g, or t
  misc_feature (222)..(222): n is a, c, g, or t
  misc_feature (226)..(226): n is a, c, g, or t
  misc_feature (264)..(264): n is a, c, g, or t
  misc_feature (364)..(364): n is a, c, g, or t
  misc_feature (369)..(369): n is a, c, g, or t
  misc_feature (381)..(381): n is a, c, g, or t
  misc_feature (492)..(492): n is a, c, g, or t
  misc_feature (506)..(506): n is a, c, g, or t
  misc_feature (508)..(508): n is a, c, g, or t
  misc_feature (515)..(515): n is a, c, g, or t
  misc_feature (517)..(517): n is a, c, g, or t
  misc_feature (521)..(521): n is a, c, g, or t
  misc_feature (523)..(523): n is a, c, g, or t
  misc_feature (564)..(564): n is a, c, g, or t
  misc_feature (578)..(578): n is a, c, g, or t
  misc_feature (641)..(641): n is a, c, g, or t
  misc_feature (645)..(645): n is a, c, g, or t
  misc_feature (874)..(874): n is a, c, g, or t
  misc_feature (882)..(882): n is a, c, g, or t
  misc_feature (898)..(898): n is a, c, g, or t
  misc_feature (926)..(926): n is a, c, g, or t
  misc_feature (954)..(954): n is a, c, g, or t
  misc_feature (994)..(994): n is a, c, g, or t
acctaantcatataattaaaatttcctcaagcaaggaccaaatataagtgtaaaaatcagtgtctctccccccaaaaatgtacaaaccccaagtaattaaaaaaaaatcaatgtggcagcaacactagaaaagtccaaccccaaggctatgggccgttgctccccctttccccccaatcccaanatttacnccacaaaaacgtanaggcttaaaaaagtacnagcnacaaaactccaagtaggaagtaggggtaactaaaggcnggggcggggctacccccaggtccagtgtttcaggtgaaggaggaggaaaaagcccaagccgaagacaaatacaggaacaggcacaaaaaaacattttccnctccntcttgtcccccncacccccaaattctcagccaatagggtccaatatgtaacaagaaaaaaaaaacagggggctcacacctctccagaaatcaatatagtccaatagggcccaagtgcaccaangggccaaatccaananctatccnanatancnccccacccttccccaaaggatggctaaaagaaggtggaganaatcccatccacanagaccaacagggtaggcgacaggggcttctaggaaggaagaacaggaaggggacatgagagtntgtncaggaaggggagaaggggcatcagctccctgggtgggcccagcccacctggcagtctcactgcctctattagaggtgatgggctgtcgggaggggaagggcagaggtgccattgtgtcctcttgttttagtgtcactggcttcccctggatcgctccctgagggaggggcagctggatgtgtgattcacaccgtgttgagtgcatcctctgccaggaaccgatgcagcngggaaaanggtggtcgctgctcanactcccggctccagcaccgaagcatcanctcatatatgcccttcggcaggcaggcngccgggacaggtacacctgccggccctggtcccggaaaantcccccgcgttctcgatgacttctc

SEQ ID NO: 694824 - DNA, 360 bp, Homo sapiens
  misc_feature (22)..(22): n is a, c, g, or t
atgccagtgaatctttctgatngggagtacatgtacagatgtcgtgcatttatgcttctgaatgcagagtcaacgattctgatctagagtttgtaagtgatagtcctttagcacctactaacatgcgtctttgaagccttccccgatattagtaatctcgaccagcaatgacacgaaaaaaggggagcacctttacgaagcagttgatatccaacattaaaataattgtggctttaaaaatatttctttaaattctagcgtaacacttttctttttaaaccaatcttccaggagattaatcaatgaaatttataagttttatcaacgtataaaatatttttcatcttctgggactcatag

SEQ ID NO: 694825 - DNA, 214 bp, Homo sapiens
  misc_feature (46)..(46): n is a, c, g, or t
gttgggcggaccagcaggctgggcccagattaagatgtcagactcntgtagtaatctcttctggatcagaaaaagacctggaaacagaaggagattctccacagatgcaattttcctccacaaaatatggttttgcagggccatttcaaaatatgtcaagaatagattttggggtaaaatacttttatttccttcagggcccactatctattct

SEQ ID NO: 694826 - DNA, 413 bp, Homo sapiens
ggggtgaggatatgtcatggttagttgtcaacatggctctttgataattaatacacaaattactgttcagatcttacaatattgttttataaatagaatctattttttagagtagttgtaagttcacagcaaaattgaatagtacagagagttctcatatactccctagccctcgctgcctagccttccctactatcaacatttcacaccacagtggttacatttgttataaccaataaacctataatagcacaccattatcacccaaagtccagagtctacattaggattcactcttggtgttatatattctatggattttgacaaacatgtaatgacatgtacccaccaatatagtattatagaataatctcaccaccctagaaatcctcagtgctccttctcttcaacca

SEQ ID NO: 694827 - DNA, 305 bp, Homo sapiens
ttgccattgtggcccgaaaaatgactgctgaatttttgctgcacatgcttaaaaacgcatagagtaactgctgaacttcagggttagatatagattctctggttcattgagcatatccaagtgaactaagcacctaagatgcgccgccggacctacagagctcatggtcggattaacccatacatcagctctccctgccacattgagatgatccttacggaaaaggaacagattgttcctaaaccagaagaggaggttgcccagaataaaattatatcccataagaaactgaagatacaaaaact

SEQ ID NO: 694828 - DNA, 429 bp, Homo sapiens
ctagtaggtagaggcaggaggattgcttgaggccaatagtttgagactaacctgagcaacacagtgagaccctgactctaaaaaacaaacttagccagatatggtggcacatgcctgtagttcaagcaattcttcttgcctcagcctcccgagtagctgggattacaggcatccgccactgtgcccagctaatttttgtatttttagtggagacagggttttgccatgttggttaggctggtcttgaactcctgagttcaggtgatccacctgccttggcctcccaaagtgctgggattacaggcatgagccaccatgcccggcctgttatctttttgctggtagagggtcttatactgatgtcaatgactgctgactgatcaggaacctggtgaaggttgctgagggttggggtggctgtgacaattt

SEQ ID NO: 694829 - DNA, 143 bp, Homo sapiens
tggctttaaagagcatgaagattagggggcagggctattgtcatatttaaggaattgggctcatacacaaatgccttgagacaactaccaggatttccattttatggtaaaccaatgcgagtacagtatacaaaaaccgattc

SEQ ID NO: 694830 - DNA, 547 bp, Homo sapiens
cgacattgctagatgaactaggcagctatgccatgaactgaagagatagtttaagaaagtcatgccattatgtagacatgattacggaatatctggagaagatggggcctcgtttttctggataagcaataagaattggatgaaaaggctgtgcttatggagaatatagtctatctgatctagtgcgcttgagcgagaacacatagaagtgaatgtttgcctccgacagcagaagataaacatcagggaagactgttgtcctgggaaacgcaacttaaattgtgattagaatagtaaccctggtgtgtccgtttctctaactcatcatgtatgatttatgcttgatatacacactttaaaaatctagattatctagcgtggtattctgtattggccagcaatcactaatacgttccttcttaccagggttaacgggccacggtcatagagaggaagggagtatccgagactgtacatagctgattccatgcctggtcaagacaagaatcctcaggagaccgcctgtaggcatagcaagctcgctact

SEQ ID NO: 694831 - DNA, 191 bp, Homo sapiens
caaacaaaatagttttttttttcttaagtaacagtattagtggaaaagtcagcaagacagcctcttccatatagtcctttagagactcaaaataacagtagcttttttgttttcaacatttggcctctgagaaggtaaccatagtggtcatctccactccagcctgggggacagagtgagactccatctca

SEQ ID NO: 694832 - DNA, 461 bp, Homo sapiens
aggctgatgatggaggactgcattgacgccctggagacaagactcgcgtctggcgcaatacagagagatcttgtttctacaaaacatttaaaacttagttgtgtgtggcagcctaacgcacctggtctcagctacttaggaggctgagggtgggaggatcatttgagcttgggctagtagtgggctgtgcactgcacctactgaaactcccagcctgggtgacagagcaagaccttgttcaaaaacaaacaaggaaaagtcaagtcccaagcccctaaagccccgaaaacaaaacaaaaccaaaaacccacatacttgataacagacaaatgtgtaaagaactcttaaatctcaacaagaaaacaaacaacccaattttaacaatgcgcaaaagatctgaacatccacctcaccaaagatatacagatagcacacacgtctacttaaacgattctcaacat

SEQ ID NO: 694833 - DNA, 799 bp, Homo sapiens
cccaggcttgagtgcagttgaatgttgagatgcccttcagctgatgaagctacactttatcaccaaggaacgttggtgctgcagctgagagtgtggatggtggatgtgtggatgatgcatggacaatggcctggcaactttatctgtgctgtgcttgcacatctgactggtgccaacctgtcctgtcctgctggtggatgcactgctgctctccaatggtccacttcacctgcctgcaactgcatgctcctactacaatgtccctgcatgtctagcctgatgtgatgtgcctgcgaaatgcgagaatgagaagatgaatggtcttggtgcccagctatgagagatgcagccctgtggaggagtgtgatgcacagatgcttggatgtgacgaatgtgagctggatcttgctagctacacattgcccgtgttttgtagaccggaagatcactgatgacctgcacattctactgttgcatgtgatgtggatgacctggaacccacgtatggactgacagcatgattgtgagaacattgcgccaattgacatattgtcatggtcgacccccccatgattaagagcgtgctccataatgtccccccgtcatgggggtagcagttctttgcataatgccaaagattattgtaagattggaagaaatggtacctgtagccctgaagtataagaaaagtcgagtctacttgcaccattaacatgtcttctacatttgataagtgcaacagagaggtctgccatcaacctccttggtccctatacacatgcttaacattcggtactta

SEQ ID NO: 694834 - DNA, 727 bp, Homo sapiens
agcgggcggggctcggggaggccagctgggaggggagggggccgtgggggcggctcggcggaaccagccccggctgggcagcagcggggacgccgtggggccggggccagggctttccggggcttcgtgtgaggcctgccgtgggccccaatctttccggcggtcgccggagtttgtggtgattgttgctgccgcctgcaacgccccgtgtgccatctcctcctcctgggcctgcgcttcctcctctttcctcctcctccgtgggcctgggctgatccccttcccccgttgccgcctcctccttgggcttgggcccggggtgtctcagtcccctcgcggagccgttcttgccggcgccgccgccgcttccttcattcatcctcgtgcaccataggcggcaacaggcaccaagatgttccaaccgagtggtctgcgaagaaagccagttcacgcgggaagctgtacacagcctcaggcaccggcagctgaatgcacagctacaaagggtgggtttcacaaagtacagtctacaaaaagacgctgctagagccatttattggccaccaatgcagggatatacggtacgtgtggggtcttgtgcgtgccaatgttttttaaacaaagtggattcggtctatacccggaaaaattttattcttggggctttccatcatggtgccttcttgatgtggatttcagtgtgggtatatttgggaaactttgtttg

SEQ ID NO: 694835 - DNA, 387 bp, Homo sapiens
gaagatcttttttatttggcaggaaaacgagacagcagcagcccaggagggacaggtggacttaatcctcctcctcgtcgtctccagccccagcccacctggccttcttggattcgtcctcttcacgcgggccgggcggacaaccccgatagggagagcgcagagagaagtcgatgtgcttctgggaatccaggcggacaatgaaggacgggatgttcaccaacatgcttgcggagcctgaatattgcgctggaggatcagacacgcgagacgtagtgagatggacttggccaagcccagcttgaacgacctgggtctgcaggcgttctctctaaagaaatcctctatcttcagggccaggatgtaatccagcttcatcttgccctc

SEQ ID NO: 694836 - DNA, 287 bp, Homo sapiens
  misc_feature (3)..(3): n is a, c, g, or t
ccnaaaaaaaggggggggggggcccctttttttttaaccccccgggggggtttttttttcccccccccccccccccttttccggggggggggggggctctttccccgccccccaaaattggggggaaaggactttttttttttcccccgggggggggggggggggttttttttttttttgtggtctttttttttaaagttttgggggccggggggtttttttttttttttggggtttttttttttccccgccccctcttggccaaaaaaatgggcggttttttttta

SEQ ID NO: 694837 - DNA, 420 bp, Homo sapiens
aacacttgtagaatgcttactatctgccagacattgttttaagtgcttttcgtatattaaatcacttaatcctcatggaaccttatgaagtaggtggtatgatcatttctattttataggtgaagaaactgaagcacagaaaagttaagttgcttgctcaagctcccaggggagatccaggcttggacagtctgattcagaaactttgctgataccaccatgctgtactgtccttcatgtatgggcacacataggcgatacaggtctgagtcaagaaaatttgacatcacttcctaaacacacacactctcctttttctccccaaataaagcatctatgaatgaatgttgtttctgtggttagacgtgtttggagaattttatctgcagaatcttccaaactgaacattgtctgataata

SEQ ID NO: 694838 - DNA, 399 bp, Homo sapiens
  misc_feature (72)..(72): n is a, c, g, or t
  misc_feature (390)..(390): n is a, c, g, or t
cgggtaggccacgcagcaggagaccctgttcccaggttggaaatcatgtggaaccatgaagaagacctcacntcacccgtggccctcgtgctgagctctgtcttggtgaaatgataagcccctcatcccactgtttccaacaccccccaaccaccagcagagctgcccaggaacccagagttcaatgcacccttgtgtgcacagccaagggaggggggcggacaccatctggcagtgcgctggacactttcagaagcccacagcctttttaaaataaagctggccagaggaggggagaggtcactgcaaggcacatgggggctctccagatgctgaggagagacgtgctctgcccaggatgcaggagccccagcccagtggggagacgcntgcaccttt

SEQ ID NO: 694839 - DNA, 229 bp, Homo sapiens
ttttggacagagattaaaaaacacacaagtgaggcttcagtctgaagcctgggcgacagagcgagacttcatctcaaaaaaatatagacagatagatagatagatagatagatagatagatagatagatatagataaccaggcaagctggctcacacctgtagtcctagctacttgggaggctgaggtgggaggatcacctgagcctggggaagtcaaggcttcagtgc

SEQ ID NO: 694840 - DNA, 941 bp, Homo sapiens
gcgagcagacccggcctggcgccgcctgcggcatcaccatgggcgatgcatttcatcattctcagataaagcggtgctatctgtatgatttctggagtgtcacagtcctgctggcatggcctttcggtgtggtgctcctgttctggctgtactgtatgaaggcatcaaggttggcaaagcaaagctgctctaccaggtactggtgaacctgccaacctccatcagcagagacatcgcagagacagacggggactctgaggctcagattcattccctgttggagaacccaccacaggtggtattatgtgtcactttggccagtctctaatccatgtcatccaggtggtcatctggatactacatcatgcttgactgtaatgtccctacaagacctggaattttcctttgcgttgtgtgtcttgggctctgctgtgggctactacctaggcttacccacttctcagcaaagctatagctggtgaggaacgtgcaggcactgaggctggagggacattgaagccccctcttccagacactatagttccaatgacctttcttctgatggctattcctccaccttattccccaggccctggaaactttgaggccgaagcccagcaacttggtccctgacagtacggaagccattgcaggcaccgctaccgttctcagccagcccataatagcgcccaggcatggtctagtgtcttaaggaaagttgctgtgacccaacgggagaatggagcataacagggggtgggcgcattgatacatgagcccaggacaagtgcttcatctgtgattacaaaccaaggcatatcgccaacgaattacgctaggcagagggggtccgggtgaaggcgtgcagtgcgactgtgaccagcccgcgagttatctgtttgtggcatatcatcaggcagtgcgtcctgaatcatagacag

SEQ ID NO: 694841 - DNA, 225 bp, Homo sapiens
gcccacatctcatccctacatctcatagcgcttccaacatctcatagcccttccaacatctcatacctccttccaacatctcattactccttccaacatccatccctcctatccaacatctcatggctccttccaacatctcatgtcccttccaacatctcatgtctccttccaacatctcatcactccttccaacctctcattgcgtcatgagatgttggaagg

SEQ ID NO: 694842 - DNA, 954 bp, Homo sapiens
  misc_feature (108)..(108): n is a, c, g, or t
  misc_feature (150)..(150): n is a, c, g, or t
  misc_feature (175)..(175): n is a, c, g, or t
  misc_feature (205)..(205): n is a, c, g, or t
  misc_feature (227)..(227): n is a, c, g, or t
  misc_feature (251)..(251): n is a, c, g, or t
  misc_feature (279)..(279): n is a, c, g, or t
  misc_feature (281)..(281): n is a, c, g, or t
  misc_feature (304)..(305): n is a, c, g, or t
  misc_feature (309)..(309): n is a, c, g, or t
  misc_feature (315)..(316): n is a, c, g, or t
  misc_feature (338)..(339): n is a, c, g, or t
  misc_feature (354)..(355): n is a, c, g, or t
  misc_feature (366)..(367): n is a, c, g, or t
  misc_feature (378)..(378): n is a, c, g, or t
  misc_feature (383)..(383): n is a, c, g, or t
  misc_feature (403)..(403): n is a, c, g, or t
  misc_feature (422)..(423): n is a, c, g, or t
  misc_feature (431)..(431): n is a, c, g, or t
  misc_feature (434)..(434): n is a, c, g, or t
  misc_feature (585)..(585): n is a, c, g, or t
  misc_feature (589)..(589): n is a, c, g, or t
  misc_feature (603)..(605): n is a, c, g, or t
  misc_feature (610)..(610): n is a, c, g, or t
  misc_feature (614)..(614): n is a, c, g, or t
  misc_feature (617)..(618): n is a, c, g, or t
  misc_feature (626)..(626): n is a, c, g, or t
  misc_feature (629)..(629): n is a, c, g, or t
  misc_feature (634)..(635): n is a, c, g, or t
  misc_feature (637)..(637): n is a, c, g, or t
  misc_feature (640)..(641): n is a, c, g, or t
  misc_feature (644)..(644): n is a, c, g, or t
  misc_feature (648)..(648): n is a, c, g, or t
  misc_feature (666)..(666): n is a, c, g, or t
  misc_feature (673)..(674): n is a, c, g, or t
  misc_feature (684)..(684): n is a, c, g, or t
  misc_feature (691)..(691): n is a, c, g, or t
  misc_feature (694)..(694): n is a, c, g, or t
  misc_feature (697)..(698): n is a, c, g, or t
  misc_feature (705)..(705): n is a, c, g, or t
cagaggctgggatcatggtagatggaaccctccttttactcctctcggaggccctggcccttacccagacctgggcgggctcccactccttgaagtatttccacactntccgtgtcccggcccggccgcggggagccccgcttcatctcntgtgggctacgtggacgacacccangttcgtgcgcttcgacaacgacgccgcgangtccgaggatggtgccgcgggncgccgtggatggagcaggacgggntcagagtacttgggaccgggcagacacngnagcgccagggacaccgacagcanncttntccganntgaacctgcggacgctgcgcgnnctactacaactcagnngcgaggccggnntctcacacccntgcangtggatgcatggctgcgagnctggggcccgacaggcgcnntcctccgnggngtatgaacagtatcgactacgaccggcacaggcttatctcaccctgaatgaggacctgcgactcctggaccgcggtggacacggacggcctcagatctccgagcaaaagtcaaatgcatgcctctgaggcggagcaccagagagcctaccnggangacacaatgcgtgnnngtggnctcnacnnatacctgnagnacggnnanggnnacnctgntcacctggagccccccangacaccnntgactcaccnaccccantcnctnnaccatgncgccaacctgacgtgccgggcccgacgctactacctgcggagacccacatggaccggcacaagaaggcgcagagccatacccaggacacaacaccgagaacacccgccaaagggcagaacatcgaagggaaacggaggaacaaagacacgaaaagaagaggtacacacaacaggcaccgaacgacaaactcaacgcaccccagccccacaacaaacaaccgaccgcaccggacgacgaagacaccagca

SEQ ID NO: 694843 - DNA, 274 bp, Homo sapiens
gtatcatcagccaggagcgcagagaaaagaaattcggggttcagagattatagaagtcttatcgacacaagatgtgaacagaagagatcgaacagaacaagttttatagaaggccaagaataatccagggattgattttacttcatagacattgtagatgaccatacgtgtatgtattgattttgcatttcaggcatatgtaccaaggcaatgcagtgcatttcactcttccccgtctctttcatcatgtgcatggcaaacatgaagtggcatg

SEQ ID NO: 694844 - DNA, 524 bp, Homo sapiens
ccttattttttttatttggcaggggcccaaaaataccctcccgttttagccctttgttttgtcccccacccttttttcttgggggccatggacttggaaaaaggccgcaagatttttttgggcccccccagggtttaaggccccctggttcctttggttggatccccccaaatatttcccccctcctattttctgcagcaaatttttccctaggtgaagagacgggggttatttccccttaaaaccccccccatcccgaaagggttggcattgtttgcccttaaaaaccctccccttttttccccccctattttttaaaaaaaaaagggggtaagttaaaccccaaggccccttttcaaaaaatttccccaggactttgcaaaaaacccccaacaaaaaagccctttttaaaaagggggatttttttttttaaaaaggaaggtccccaaaaacaggggcaaagttttttggaaggtttaatgggcccaggaccccggaaaaggcccaaaaaaattgagagggga

SEQ ID NO: 694845 - DNA, 1274 bp, Homo sapiens
gatcttcgcgtggtggagacggggtttcacctagtgttggccgggctggtctgggactcctggcccatcaggcagtccacgtggcctcgagcgctccgccaagaggtggctgggtacttagtagtggccctaaggccaccgtgtaaccgaggccagaaattgtatctctatgtcttgtgttgataacggccacacagcatagcactgggtggaaaaggatagggtgctctgttagcacatgtggatgcctgtcacgaaaagacgtggtattacaccgacagttcgcaccacagcacgtggagagtcttgtgcacgcgcattacccttttatcaacctactattccacagagaatccaccagacaacctgtagtctacgtgacatgtaactcgatctaagaacgcttggagacacaaaacccccgccatcaagacccttgtgacctaccttggccgttcactcgcgtcccctgtgtcaggagcacccggaccagagacgggagacaccaaaccaggcggccgacgcgggggacagacgaagcgggaggcactccgcggtgccccccgggagagtcgtgtcgaaagagaatagacgataagggcaggagctcatacaagcaaagccgtgcgggcgaaagcgaccccgcccagtatgataggcccgcaaagaagaccgggtgcgctgttacgaaagacaatgtcgtgagcgcattatgtgtggcaacacgtgtgccagttaccatatgcgccctacaattcgatgactaacctctcaacctcggcacgatgtttgtgccgcccaagtgttctccgcccccggtgacctcccatatctagcaagcgttgggtacatctggatggaaaaggagagatcccccgggagtgcttttgtcgtgtgcaacgctgcgtgccagaggaacatccgtgtgggccccaacctgtcgcgggaaatattacacgcacggtgatataccccggagcaaggcgctcgtttgggagctccccagcgactgcacccgatatatttacgcttagagacgtcgggaataaaattccctgtggggtccccggccccattaaagatcgccgtaggccgcagtttcgtccaagcggcctcccctcggaaattaactatccagcggcacaatagcgctgtgggagaggcccgtggtcggctaagatttccaaccaaatggggagtagtggtggcctaaacaagtggaggacccgtgtttcgcccccagagatgccaacgacccaacttcctggtctccg

SEQ ID NO: 694846 - DNA, 970 bp, Homo sapiens
ccacgcgtccgcgctggagaacactggtgacagtgggtggagcaggcctgtctttaggttcttggatggcacatatggacatactggtcctcaggccccctgaaggtgcacacaggcatgctgttgccctgctgagaggggcaaggttctgttggtggcattggtgttgggaagatggctcccaggttctgggagcttcagctccctttttcctggggtagcctccctggtgtgctatactgcctgttccctgggatataagacacttcatgggtcagagtactggggacctggctgcactgctgggtgattgtgatactgcaaccttctggatggatgtgggaggatgttcttgggggtccaggatgtggactgcaggggcttattggaccccaagtgggcaggatataatctggtgggggctagcctcttaaaatggtgctgtgccacagcagcatgtttcttgggatgtgagtaggatccagtggaattccctttctggaagaacgcatttgcatggattccaggcagctccgtatactggactcagggcctgtgaagctgacggcatccctgtgggtgccagcatctgtgctgcgaatgtggaccactgcagttcttgacttttcttttcccagaaatgggattccccttcctggttctgaagcagtccaagaaatgcgggtgcttattacgggtccctgtggccagaagttcccggggaataagggcgcgtggggcgctacctggactggggactactcgcctcgggccttgcgtgacggagctaggggccacagccagggttgggacacacagctgggggtggaacccagggacctcccactctacgtccacagtcgcgggggaacaacacgcgcgtcagagggagactcagagggcgaccgcagcatagaagtagagggggggagcaacaaacacaaagagcgaaatgctcactgcgaagaga

SEQ ID NO: 694847 - DNA, 293 bp, Homo sapiens
atctgtgttcctggatggagctatgtagagcccgctgtactgcaaactctgcaaggtcacctatgaactctgcacagagaaggcgcgaggctcaatgtaatcatggggtaaaagatcatggtaagaaactccgaagattactagtgtgcagcaacatagctgtcctcctcctgctagaatgagcaatgtggtcgagcctgcagctaccccagttgttccagtccctccgcagatgggctcctgtaagccaggaggccgagtgatcctgggcacggagaatgattactgtaagc

SEQ ID NO: 694848 - DNA, 263 bp, Homo sapiens
  misc_feature (17)..(17): n is a, c, g, or t
  misc_feature (45)..(45): n is a, c, g, or t
  misc_feature (67)..(67): n is a, c, g, or t
  misc_feature (75)..(75): n is a, c, g, or t
  misc_feature (169)..(169): n is a, c, g, or t
  misc_feature (220)..(220): n is a, c, g, or t
  misc_feature (239)..(239): n is a, c, g, or t
atcccatcctgtgtccntgcgtgcccctccttcctctgtgtgaanacacatcccatgctgtgtcccngcgtggcntccctctctccgtgtgcacacacatcccatcctgtgtccccgtgaggccttcctttccctccatgtgcacacatatcccatcctgtgtcctacngtggcctccctcctccgtgtgcatgtacaatccacgctgtgtccatcgtgncctccctccttcctccttntgcacatacatcccatgctgtgtc

SEQ ID NO: 694849 - DNA, 148 bp, Homo sapiens
atgggtgcccatccccctgtgccatatattctcaattgttcaactcccacttatgagtgagaatatgcggagttaggttttctgttcctggtgttagtttgctgagaaatgatgggttttttaaatgtttcacaaagtgtcccaagca

SEQ ID NO: 694850 - DNA, 295 bp, Homo sapiens
agatgcccaacgcgatcaattccggcgcttgtaaactcgaaaaaccggcacacccgcttcggcacgttgatcagcacgtccggcgggtaaccggcaatcttgtactgcgccaacgaggtctgcatcacttcgaaactctggttgatcaggtccagcagtgacgccggcccaacgttatcgatgatgaacgagccggtcgcggactttggcgcaccttgtttttcaggcgcagccgcaggttgttgggcctcgggttcggccgactccagccacgggttgatttcggcagcctgga

SEQ ID NO: 694851 - DNA, 482 bp, Homo sapiens
atgacccaccaatcacatgcctatcatatagtaaaacccagcccatgaccccataacaggggcccgtcctcagcccttccttaatgacctccggcctagccatgtgatttcacttccactccataacgctcctcatactaggcctactaaccaacacactaaccatataccaatgattggcgcgatgtaacacgagaaagcacataccaaggtccacacacaccatgctgtccaaaaaagtgccttccgaataacgggggcataattcctatttattacctcagaagttatacttcgcaggatttactgagccttttacgatccagctagccctacccccaattaggagggcactggccccaaaaggcatcacccgctaaatcccctagaagtccattcctaagaacatacgtataactcgcatcaggagtatcattcatctgagctcaccatagtctactagaaaaccaacgaaagcaaac

SEQ ID NO: 694852 - DNA, 214 bp, Homo sapiens
caatgaggtcagagagatgaggggacaggatgactgtgcaggaccttgttgggccatactttgatccctaactactgtgtgcgtgtgtgtgttggtgtgtgtgtgtgtgtgtgtgtgtgtgtgtgtgtgtgtgtgtgggtctctctctctgtcgcccaggctggagtgcaggggtgtgctctccgctctgtgcacccttcgcctcctaggttca

SEQ ID NO: 694853 - DNA, 140 bp, Homo sapiens
catggtcacaaatggtcacatttaatgttcttttaaagacagatgcctatatttaagaagaattggtttttcctaatatctcaggttcaaattactgatacaaatttgccagagaaacaattacatgttttaccgtaaca

SEQ ID NO: 694854 - DNA, 543 bp, Homo sapiens
  misc_feature (10)..(10): n is a, c, g, or t
  misc_feature (92)..(92): n is a, c, g, or t
  misc_feature (210)..(210): n is a, c, g, or t
  misc_feature (293)..(293): n is a, c, g, or t
  misc_feature (407)..(408): n is a, c, g, or t
  misc_feature (463)..(463): n is a, c, g, or t
  misc_feature (518)..(518): n is a, c, g, or t
agtgtgcacnggcagcagcctgggcggggctggggtggagcccggggtctgcttgggcctgagccacccacaggtccttttcttccccttcntccttggaaggcagaactgcccaccaaggcagggatctgtctgacttgaagctccgttctggggtctgggaggcgtgggcaggagtgagggccccaggccctctgagcgctcaccccngccggggacaggccccgtggttttcaggcacaagacggtagcccggcctccagcaaccccaaacagccgggctgccgcccccntcctcctcctcagcccagagggtctcccaggaccctgagggccatccacagaagaagtgggccaagttgcgggacaggccccggtcgaaagggttgccggggcgccggcggagnnaggcgaggcggggtgaggagatgaattcccagggggggggggagcaggccaccanggagaggtgcgagacgaggagaaggccgaccaccaacgagaaaagagacagcagngggaaggtggcgaacaggagcccgc

SEQ ID NO: 694855 - DNA, 739 bp, Homo sapiens
  misc_feature (612)..(612): n is a, c, g, or t
gtggatcccccgggctgcaggctcggccaggccaagatatcagtcccatcggccatgacattaaaagaggggaatgtgttttggccaaaggaacccacatgggcccctcagagattggtcttctggcaactgtaggtgtcacagaggttgaagttaataagtttccagtggttgcagtcatgtcaacagggaatgagctgctaaatcctgaagatgacctcttaccagggaagattcgagacagcaatcgttcaactcttctagcaacaattcaggaacatggttaccccacgatcaacttgggtattgtaggagacaacccagatgacttactcaatgccttgaatgagggtatcagtcgtgctgatgtcatcatcacatcagggggtgtatccatgggggaaaaggactatcttaagcaagtgctggacattgatcttcatgctcagatccattttggcagggtttttatgaaaccaagcttgccaacaacatttgcaactttggatattgatggtgtaagaaaaaatatctttgcactacctgggaaatcctgattcgctgtggtcacctgcaatctcttttgtcgtgcctgcactgaggaaaatgcanggcatccttggattcctgtgccaaccatcatcaaagcagggttatcatgtgattgaaggaaccactcccttgtgcacagagttcaagtaatcaaatgagcaaaccgctttttgagccttgcgccccg

SEQ ID NO: 694856 - DNA, 106 bp, Homo sapiens
tactgatacggatcgacgctcggtcccctgagctgatcactggtgggcgcctgtagtcccagctactcgggaggctgaggcaggagaatggcatgaacctgggaga

SEQ ID NO: 694857 - DNA, 545 bp, Homo sapiens
tgttgtcgctacagggagggatgacgggaaagagggcatacaaaaattactttggtctaagaatctgacatctgcattccagagaaatttaccagctgtttgaccttggataagacactgaagccactgtatgtgggtttcaattcctcatatgtgacaagtgccaaaataatctatcttgtcccttaatacacaacagagtaagcttggccattacttaacaatgacaatgacaactgacacctggaagtagccttctcaatgttcaacatgctgctccttatcttttttcgttgagcttcacaataaaactctgaacatggcagagcaggtaaagtcacgtccgttttacagatacagaaatctcagtggagagaggggaagcttcctgtgctacagaggagctagctaacagtaacaacctgggctggatgtcaccctcaccaactctgaatctgtgatctttccctgaaagcagaggtgaaagcactttggaaaaaatctaagtggggacaggagctaatagtcattagcgacagcaggca

SEQ ID NO: 694858 - DNA, 102 bp, Homo sapiens
ctgagtacctaggactacagaaaatgatccacagtctatttctcataaactgttccggtcgacatatttctagagaagcactcgaagagcgttgttgagcca

SEQ ID NO: 694859 - DNA, 1101 bp, Homo sapiens
gacgtttgcctgtaagcctcttggcgttgccattggcccgtgcgggttttgttgtgccctctccccggtggttggcccgtccttttcgtccgggtttgctggaccggtcgccccgtttcctatccgcccttatgccttgaaccctatcgcccccccttttccatctcatgtggttttgccctattgtgtgaatgctatcttggctccctcataacgttgtgtgccctttgcctcccaccttggtatcctcgggccgttccggcggcctttctgtttgtgtgtcggtcacccctctgggtccgggccttaaccccttcgccctttgcgactccttcgtggccccatgggtccgcatattccgtggtcccactgcccctttggtgggcccaaacttggttgcctgtaaccccttatagcccctagctaccgctcgcaagttggcatccgggtcctctttcggcgcctccatgggccgcccttggcctaggggtgtgtcccctcgaattcgggatgtcacacgatgttcttggacttgggacaccaggccttgtgtatatcatcctgcttgaggcctcgcgtctcctcgtctcgggcttcccttgtcgagccatgcccgtcctttggtgggcatgtcgtcctctcagtcccgctgcaccccgcgtcattctcccgtctacctagcctccctaactccagcgctcccagctagacacctcgcttgttctggtctcgaccgtcgggagccgcatagctcctccacgtcatgtgctgatggcccaggcgcccgtggttgggggcagtctttgctggataccgtctgccatggaatcttggtgccgtgacgtgggccctgatcacttccgatcggccagcccatcatccagcctccgtggccctccatgcggtcctcggcactccactctcacagcctcccaagactgaagctcaactgtgacttccttttgaacaacgcagctgccatgatgccttgggatccctggtcctgtggggactccggtgcctcactgattcctgtgtgaaccccgggttcagggccaggcctccttggaataaatggttattactactaggccccacctc

SEQ ID NO: 694860 - DNA, 208 bp, Homo sapiens
  misc_feature (192)..(192): n is a, c, g, or t
  misc_feature (196)..(196): n is a, c, g, or t
atgtgctggcctgtcaaggaacgtgctcatgtaggtacaacacgagggtcacgtgtaaccaggttcctaatccacaccacaaatgtcagacaatctaattaccggaaggtatcatacaaatggttatcggaataataccagcagtgaacctgcttcagatatccttgttctcgacccgtgtcactcctgtgnaacnagcggtgtgtcc

SEQ ID NO: 694861 - DNA, 949 bp, Homo sapiens
gaatcctacctgctctgacggaccgaaatgcaacgagctaagctgctcggcggctagccgattgaggctagttagggtggaacgctcgtagtagagtttatatcgttgatgccctgtatgtgaaaccaagaggatgcactccgagcggcatagcacgcagggtcttacagggagcataacgatacccattcagctgataatccacgccagttcttcatcaagaacaaacagatcagtgctgcgaagagggccaaggttcccgaaaagaagtcgaatctctcagagaaccaaccgacgcgttggaggaatgacgctaagaatcagtcgggtggtgacttgtgaacgcggaaatacgagagagcagttatgagaacacagactcgtggtattctcccaagatgaagttcacagcacttgatgcccaagaaatggcaacagatcacaggtgccaagaagctgtaagacatgccagacgacagaagctggtgcagaacatcatgaacatgctgatgcgaggacctcagtctgacctgcttgctcgttcgatgtcagttggaagtgcagttatatcccaacaagaaaattagagcgaccttttcagataatagggagaagatcagccagtatctctcaaaggagagccttgaaacttgcgcaggacctcaattgagagtgggtgagtcagaactgtagcaaattgcagagtgaagaacatcgttcacacacacctgctgatgtgacacactgcacaactggcacaggaaaatccagaatcactaagacgcttgagcagtacgcctacacagcgcagtactgcgctcggatccgacaaaaaacaagtggggcattacacgtaacccaatcagaacgaaagataagtggaatacaaataaatgcggacggaacacgacacaccaaccacagaccgtgaacacactaaagcagacac

SEQ ID NO: 694862 - DNA, 1083 bp, Homo sapiens
gccggctgcgcagtcctcgacgaggccttccagcgctatcgtgacctgcttttcggttccgggtctatgggccccgatccgttaccatcacagggcacaagcggtatacactggagaagaatgtgttggttgtctctgtagtcacacctggcatgtaaccatgcttccgtagcattgtgggagctcatgctggacgcaacttagtaaccactgaaccctagtaaactgactgtatccagttgttttactccctctctgtagactgtctgggtgcagctctccgaggctctggagcactttcagaccggcttggtttggcactctgctgagggccaccatttctcttaatcacaccaacgtacatgtagcattgaggactttccccgcgtttccctctgaccgggtgctgcctgctcggaatacattctcgccgattacctgccactctcatatcgtcctggacactctggatgtcatgggcgtacaataagattgacaccgtgttccacctgtgcatctgggtagcatgactccgttcgcttcccccaatactgacgagcttcacttcttcccagagctcatgagaaaggggtcctacaaccctgttcacccacatctacacagcacaggatgtgaaggaggtcattcgaatacgcacggctccggggtatccgtgtgcttgcagagttttggcactcctgggacacactttgtcctggggaccaggtatccctggattactgactccttgctactctgggtctgagcctctggcgctttggaccagggaatcacagtctcattatactattatcctgagccccattcttccttagccaaggcaggcctgggcttcccaggactttaaacttcactcggaggaacaccgtcgcgtcacccccgctggaaagccaaccccgcagaatcccgccctctcacccgacaaaagccccccggggcaaccaccgggagcctacaacaacgcgcggcacagccgacacgggggaacgtggacgcacgcacccaccgccccacccacacccggggaggacagcaaagagacgcgctcgcggtgcgcgcaaa

SEQ ID NO: 694863 - DNA, 922 bp, Homo sapiens
ggaccactgctgactgagcggtggaccgaattgagaccgctggtttataagcgatcatgtttctccagtattacctcaagcgagtcaggtagatcgagtctatacgctagaagaaatttgacccgatgggactaacagaaccatgattcgagcccatcgcgtgctcggttctccgcctagatgacaaatactctcgacaccgcaatcgagcatcaagaaaacgcttcaaggtgctcgatgacctctagcgaagcctgttgccctgtccatcatgagggtcccttaaatactgatgtcgttttgcctggcgcaactgttacccctcgggagagctccgttacgcagacacctctttcgggactgttggagccctgatgcctgtgtgttgccaggccagtgacctcttttggtatccagtctcttcgtggcgattgatttattgcttgtgtgaggcaactcatggtggtcattcgcccattaatgggacacactctttgaccttgtatctttctctcatattttgtaatagttgagctaccagatgagtttatttagtacgaatacactatgaattttgaactaacagaatacgcaataattgggacctcactgacatcgttgtttcgcgccgagcaatgctgtcaaccacaaattatagtgtgtatgagaatactacccaccggataggggctcacggaggtcccttcctaagtgagactacgtacgacttgggtcttcatcagtcgccacgccagaggacaacgctgggttaacagaagcatggatccggtcggattatccacaaccacgagtttagaaagatcccccgagggagcacactctcatagtgtttttttcgtcacataatggccgaacttggggtattattgcagaggcggacatctcgggggtcttatgtacc

SEQ ID NO: 694864 - DNA, 116 bp, Homo sapiens
aatcaagaagtggtggactttgaaaagttggatgactacacctctgcctttcaaggtcatgatgttggattctgttgcctgagtaccaccagagggaaagctggggcggagggatt

SEQ ID NO: 694865 - DNA, 305 bp, Homo sapiens
ttaaaaaagggggcccccgggggggccccttttgtttaaaaaaccccaaaaaaaaagggccccttaggttccctttttttacgggttaaaaaagccggggggttttttttctgtttttttcccaaaaccatttggggaagggtgggggggggggaacccccaaaggggggtttttgggccccttttttgggccgttttccccgggccctttttccccaagggggggggcccccctgtggggcaaggcttccaaaaaaaatgggggttttaaaaaggggtgcggatttacctttttttttctttta

SEQ ID NO: 694866 - DNA, 698 bp, Homo sapiens
gacttgctggggtcggggctgcgcgacgtgtgcagggtgctgctgggagcgccgcgcaggccgtgcagttcctagcgaggaggcgccgaccgccattgccggtctctcggagggcagctgggcattgttatgctatggtgggagcctatggtcttcatcacttagtgatgacgtagtgaccgactgtcattatggaagatgtgatacacgcatcatccacgtgctgtagtgatcatagccttgtaggaagcacctggcttttcatcattggaggctaagttggcgtgcgtgtgcgcacaaatccgggaagagtccgcgtgatggaccttggccaacgttatgatcatcattccgtgctctttggtattatggtcacagaagattgtatgatagatggatttaggggcatatgtattacagacgcaaaggatggagaaatgagagatatgagtcggcgaaagaattcagaaaaagttgtattaaggacacgtaagaactgagaaacacaaaccccttgcaattggcctggcgttacagacccagggcgacatacatcggaagctactgcgtcgcaagcgaagacaacaggcacatgccaagtatggtatcgtcgaggatacttgcaaacgagagcgtacccgtacaagacactaggagtaacttaaattcccaagacaaaacgcggattccaacaagaa

SEQ ID NO: 694867 - DNA, 1112 bp, Homo sapiens
  misc_feature (67)..(67): n is a, c, g, or t
  misc_feature (70)..(70): n is a, c, g, or t
  misc_feature (157)..(157): n is a, c, g, or t
  misc_feature (170)..(171): n is a, c, g, or t
  misc_feature (535)..(535): n is a, c, g, or t
  misc_feature (690)..(690): n is a, c, g, or t
  misc_feature (800)..(801): n is a, c, g, or t
  misc_feature (877)..(877): n is a, c, g, or t
  misc_feature (1058)..(1059): n is a, c, g, or t
  misc_feature (1085)..(1085): n is a, c, g, or t
  misc_feature (1108)..(1108): n is a, c, g, or t
aagaaaaaaaggggggaggggggggggggggggggagagggggagtggggtggggggggagggggangangagaagaggggtgagttagagagtaatgaggggaggggggaagaggaaggaaagtggggaagtagatgtttaagaggaggaaaatgnaaaatgtagtggnnagtaggaataatcaacagtcagctcgttggttctttctttcttttacaattcacacgttgagtacagatcaaacataactgtctcggcgcggagatagttcgagagctgatatgcggtggggaagagtgatttatctggaggaattagaacagacgtgagttaatataatattttctcgaatgacgcgtcaatgttgactaattaaaggagtaagatctcgcactgggtcacgtgcagctgatcgcgtcggcagactagccagctctgtgtccgattcaatctcctcccgacgactcctacactctcccccgcagccaccaccccaacccaccccgcccccccaaatatgctcccacgttcatnagccacaagtaacacatgaacagtatcctccgcctatggatcgacacccgcacagtgtttcacatattctactcccgcgctccgtcatgtcacctcctctctcactacacctattaatcatcctcccccttccatcatctcgactcgtgtgtttntagtctcgagattatgctatagtccctctgatagattctcccctcacctcaactatttcacgactatgcaagcggactcgcgcttctgtcgcatcacgcacacgtgagtnnaatgtattcgctatacgtcccacacgtcgtctagcacagtatattccaccctctgtgcgattgcacgttgtgatanttcctaccgtgtaggttcatagtcagtcacggttccccctagcaggtgacggtgtcgactgagcgtccacatcgtgcagtagaactcatggagagtgtcaaaagggatacgaggcacggttggtagtggctagctgtctgcgagtggtgtgctcccaagttcacgtgcaccatctacggcnnctgatcctagtctgtgttatgtagcncatctatagtacattaatgtgtnccag

SEQ ID NO: 694868 - DNA, 686 bp, Homo sapiens
gggtctgtagtgttgtattattttcaataaatctgggacaacagccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatttgtgggcggtttgggccaagtgatttttaaattggggaaggtttttgaatggggccgaatttggggttaattgggcaaattggccttaaggggggtggtttaaaattaaatgggcggggttttaaaaaggtgggaatgggaaaaacttgggggtacccaaattaaatggtttggaaaaaaatccctttttggcaggtgggggaaataggaaaagggccggaacggagggcttttcaaaaaagtgtggaaccttgatggggaatggaaatttgaaggggtaaaattttggtaaaaattggggtaaaattttggtaaaacaagttaatttttaaacaaatgggcgaaaatgggaaaaatcctttataattaaaaggattgcacgggaaagggtttgagggttgttcaatttggaaaaaggggtccttttttaaggaagggggcttaatgtgaaagggggaaaaaacggtttttagggcgaatggcccatttggggcatataccttagagtttttgggggcggggggtcg

SEQ ID NO: 694869 - DNA, 570 bp, Homo sapiens
tgcatagtctatcagcttaataaattctactttgtagtggtagagaatgcaatgtcattatattctgctaattatggtattacgaggatgaactagacacttaaaagtagaatctataaactgagtagaatatgagcgggcagaagctttaggagccatctgttccaatcgtcttccatttccaaatgaggtccaaagagcttcgatgacttgtttccaagttttcgacagaaagttaattgcagaagacaggactagatcttgcgtccctccctacccccaatcctgctatacccttcgctttagctgtcacattacacaggcatggcgaacgcatgtaatattctaacagatgtaagcagtataacaatgaaccgtcgaattcaattgcatccaattaacaagccgaaatcagcgctttcatgatgtacacgtattaaactagtagtcgtgccttccagaaagagagataagaacactgtcttcaaataagatctagcgtgtgagctgaacaagagctacttacagcttgaaaatacaccttatcctataagtcttctttatatggca

SEQ ID NO: 694870 - DNA, 401 bp, Homo sapiens
cgagagacgtgttgcactgaatcaatcataatgaatcaacagcagccgggcacagtggctcatgcctgtaatcccagcattttgggaggctgaggcaggcagatcaccttaggttgggagttcgagaccagcctgaccaacatggagaaacctcatctctactaaaaatacaaaaattagccaggtgtggtggtgtgctcctgtagtcctagctagttgggggcttagatgggaggatcacttgagctcaggaggtggtggctgcagtgagccatgattgtgggattggacttcagcctggatgacagagtgagatcctgtctcacaaaaaaaaaatctcattctttttttttggtactcaatttcctttcggctttggacagccctttctggtatataaa

SEQ ID NO: 694871 - DNA, 903 bp, Homo sapiens
gcttgaacctgggagtggaggttgcggtgagccgagattgcaccattgtattccaccccgggtgacagtgcaagactccatctcaaaaaaaaaaaacaaattgggcattcatttccaattccatagaatttacgggtgaagggccttctctagttgaaatgtgggggtattggggatcctaattggttaacccccagaagaagggtaattagctggtattcatttaaaacccaatttagcctttacttatatcgggtagaatcccagtgatcatcctaatagggtatattcagaataattttttttccttcagcaattaccttagaatcagatgctataagggctcctaggagcagggtgaaatttccgtaaagataccattgtgaatgttcgtaccccaagttttatatttaacaccaagagggccattttccactattgatctgggggcctttacacctggtcgaggtcccctaagagaatacatgcatagggcttggactccatctctattgagcataatgtatggcccacaaacagtccacgtttcaacttatccagattaagcctaggcttcccgatagtggccacggcacagtgtgaccaggatcttgccagagtaattaaccaccagaaaccttgcaaatcctcctttccgtcttaagcccccagaacgcaagcgaagggcctcttcacgactgcctctgtgccctactggcaggtttccaaacaggagtgacatggacagcccatgtgtgacccatatttgcaggtctctatcagggggtaatcttctcagaaacaactcgagaaccggtttcctagcacagacacacgctttgtagtagcatctcgacacgggcaggcccccatctggttgtcagtatacgcgcccatatggca

SEQ ID NO: 694872 - DNA, 302 bp, Homo sapiens
  misc_feature (135)..(135): n is a, c, g, or t
gttatttcatctgtactaatgaggatacgcataggtgggaaggatgggactttccaatgtgcttcataaagtctgatttcttccttcgttttaggacagtcaaatacactttttttacttgcaaacagaattttntgggaatatcttacttcataggtgatcttgtctttatctactttcttcagtaaactctggaagaaaaaaacttcctggaagtttgggcaatcatttgccattattttcctttccttgaatttcttgatatcatggaatactgctgtagtatgggacattatgtattt

SEQ ID NO: 694873 - DNA, 1073 bp, Homo sapiens
gcagggtgcaggagctgcgcccagagagcggcgaagaagcagtcactcttgtggagcgtatgcagaaagaacttgggaaactgaggcaacaggtcacaaaccaagggcggggagcagaagtgcttttggaggagcctttgccactggaaacagcaggagagtcaccgagcttcaagctggagccaatggagactgagcgaagccctggccccaggctgcaggagctgctagaccccagcccccaaagggactcccaggctgtaaaggagagggcattatccgctccctggctctctctcttccctcctgaagggaatgtggaagataaggatatgactgggacccagttgcccgagagcctggaggacatggcaatgtatatctctcaggagtgggaccatcaggatcctagtaagagagctctatcaaggtatatggtacaagatagctatgagaactcggggactctagagtccagcattcccagtcaggaggtctcaagcacccacgtggagcaaggagagaagctgtgggattcaagtgtccagacctgcaaggaaggcatgaaccccagaaacccagttccaggagtggaacaagtttgagaaccaagaaagaaatgttgagtctgtttctcctgaaagtacccatcctccagtactattgcctggccaggctacgaaggggagggtgctcctgggaagtccctgaagcaccggaagacattggcattaaccgcacgaaggccctctgcgaaaggttcgcccaaagaacaaaatacacgcaccctcacggggaaccccaagtgctaaggagacgcgtgccgccaaagaaaggccaagaatccatggagcaccgtgttggaagaaaccttcttaaaggccaacctaatatgtgcccccaaaaccgtgccacacagtgcttggcgcatcaagcggtagaaccatcctggtgcacacattatgtgacaaaacataggtggaaccataccgcatataaaagagactaactacctaggacacaggagaaactgctacgcagagatcagcaccaccacggtaactgtcattgta

SEQ ID NO: 694874 - DNA, 677 bp, Homo sapiens
  misc_feature (3)..(3): n is a, c, g, or t
  misc_feature (135)..(135): n is a, c, g, or t
  misc_feature (144)..(144): n is a, c, g, or t
  misc_feature (194)..(194): n is a, c, g, or t
  misc_feature (223)..(224): n is a, c, g, or t
  misc_feature (238)..(238): n is a, c, g, or t
  misc_feature (268)..(268): n is a, c, g, or t
  misc_feature (277)..(277): n is a, c, g, or t
  misc_feature (327)..(327): n is a, c, g, or t
  misc_feature (339)..(339): n is a, c, g, or t
  misc_feature (370)..(370): n is a, c, g, or t
  misc_feature (430)..(430): n is a, c, g, or t
  misc_feature (453)..(453): n is a, c, g, or t
  misc_feature (459)..(459): n is a, c, g, or t
  misc_feature (494)..(494): n is a, c, g, or t
  misc_feature (497)..(497): n is a, c, g, or t
  misc_feature (539)..(539): n is a, c, g, or t
  misc_feature (541)..(541): n is a, c, g, or t
  misc_feature (544)..(544): n is a, c, g, or t
  misc_feature (549)..(549): n is a, c, g, or t
  misc_feature (611)..(611): n is a, c, g, or t
  misc_feature (616)..(616): n is a, c, g, or t
  misc_feature (669)..(669): n is a, c, g, or t
cgngtgggttccccgggcccccctgcctccgctcctttgtccccggccgacatagtaagtgccctctctcacaaccctccctcgtagatattccctatttcccgtggcttgtttgtttgcctgttattgggaccngggcaaggnaaggcactgttttctcccggtagttgtttttgggcccgtgagggccagcnatacccctgcctcagtacttcgtggctgnnaaccctccctccgnagctacccctgtccccgcgggtggggcccncccagcgcnctaataatgtgtcatccttaatgaaagttctttgtcttagggcttccagntgcctccccgtnacctagccccccccttttgggttccgtgggnttgtgggtcgctggggagcaagcggctctggtttggcgtcccttatctcttcgcggtttngccttaccggtgcttcagactgntcaagnattgtcaggcggatgggccccgggggcgcgggggnggnggctgtcatattctccttgcattgtgtggacaaaaagggatntntantttgnacagcgctgagcagtcggtaactgaaggtgcaagcgcctgcacagtttgtacacgggtttgncagtntagaatccagggctatgtatcacaacaggtttctcctcttcttgacatttcanatgcattc

SEQ ID NO: 694875 - DNA, 373 bp, Homo sapiens
attccaacttacagctcaggttcagcagcaagcagtgcatagtctccttgatgagagatgttaaaggcagttctttgcaaccgaatatgattccaagggatatctcaatttctctgcaactaatttccttatcatcagacgaccagccatgtctgcctatagcgtcccggacaaagacgacctggccaatgcgctccttctcctcgggttgaatcgttcgcactgccagcagccattcggctcggctcgacagccaagtgccgcaggaaaaggcacagcgcacgccctccatgtatggccccaagcagacccgtttgacagggaaacccatactctgaaagcggacctcgccgctatctcgggcctgatggcg

SEQ ID NO: 694876 - DNA, 832 bp, Homo sapiens
  misc_feature (68)..(68): n is a, c, g, or t
  misc_feature (72)..(72): n is a, c, g, or t
  misc_feature (266)..(266): n is a, c, g, or t
  misc_feature (274)..(275): n is a, c, g, or t
  misc_feature (277)..(280): n is a, c, g, or t
  misc_feature (284)..(284): n is a, c, g, or t
  misc_feature (287)..(290): n is a, c, g, or t
  misc_feature (306)..(306): n is a, c, g, or t
  misc_feature (308)..(308): n is a, c, g, or t
  misc_feature (312)..(312): n is a, c, g, or t
  misc_feature (336)..(336): n is a, c, g, or t
  misc_feature (348)..(348): n is a, c, g, or t
agtgcttctccgggcaggggcgcgagtgcgaggggaggaggggggttttcattgaacagggactcacnttgntgccttgactggactggaactccttggctcaagaaatcttcttgcctcagcctcccaaatagctaggactatatgcacatgctactacacctagtggaaaatgaagcacagagaagttcagtgatggacctcagatactaccagcagaaagcagaagagctaggatttcaacttaggatgtctggatccacagnctgcactnntnnnnactntgnnnnactgcctctaactatnangaancaagggcatttttttttttctggngactaaaaaganaagagtgagagggggggggtgcgtggcatcggacttatacaccctcgaaaaatcgatgcggcctagacgcagactgtcttattgaattgaacagcgcctcaaatgcgcttggagtactggggcatcctatctgccccaacttaacacgcccagctccagaacattttagatggggcgatcttagctgggggtgatacatctgcggagcgcgatagcccggatgtggtcgttagtggggaggtggcgaccgcggagagggggccgggcctagcggagtgtaaggagggtgggtgggggggtgagaatttagggggagagaggagcgggggggatgagatgtgaccgaggggcacggcgggcaggactgaaagacgaacgaactgggggaggttgggcggtattgcgaggggatgggccagagaggtcgggagagcgacgaacgtgaacgatagagtgaaacttcggggggactaaccgcacgcag

SEQ ID NO: 694877 - DNA, 259 bp, Homo sapiens
ggagtacttgtcttccgtatggaacttgtttgacttctacgggacagggtgcgccttactggaactgctggcgctgaccctcaacatggagcccttctatttcatggcggtcctgcgccccctccagctgctgaggtggattaagatgaaggagcgctaccgcaacgtgctgcacaccatgtccgagctgctgccccggatggccagcctagccctcaccctgctcatcttttactactccttcgccatcgcggacatg

SEQ ID NO: 694878 - DNA, 614 bp, Homo sapiens
  misc_feature (9)..(10): n is a, c, g, or t
  misc_feature (13)..(13): n is a, c, g, or t
  misc_feature (16)..(16): n is a, c, g, or t
  misc_feature (20)..(22): n is a, c, g, or t
  misc_feature (25)..(25): n is a, c, g, or t
  misc_feature (27)..(27): n is a, c, g, or t
  misc_feature (29)..(29): n is a, c, g, or t
  misc_feature (47)..(47): n is a, c, g, or t
  misc_feature (51)..(51): n is a, c, g, or t
  misc_feature (245)..(245): n is a, c, g, or t
  misc_feature (253)..(254): n is a, c, g, or t
  misc_feature (256)..(259): n is a, c, g, or t
  misc_feature (263)..(263): n is a, c, g, or t
  misc_feature (266)..(269): n is a, c, g, or t
  misc_feature (285)..(285): n is a, c, g, or t
  misc_feature (287)..(287): n is a, c, g, or t
  misc_feature (291)..(291): n is a, c, g, or t
  misc_feature (315)..(315): n is a, c, g, or t
  misc_feature (327)..(327): n is a, c, g, or t
gggggtcannttnccntccnnnagncngngtgtgacacagactcacnttgntgccttgactggactggaactccttggctcaagaaatcttcttgcctcagcctcccaaatagctaggactatatgcacatgctactacacctagtggaaaatgaagcacagagaagttcagtgatggacctcagatactaccagcagaaagcagaagagctaggatttcaacttaggatgtctggatccacagnctgcactnntnnnnactntgnnnnactgcctctaactatnangaancaagggcatttttttttttctggngactaaaaaganaagagttcaagtatgtggctcctgataatctaacttatacagcctggaaaaattgataggtactatatccagactgtctcattcaattaacagtttctcaagtaatcttctagctactgtcgtattttatctgtatcaacttagcaaaccaagcccaaaacatttttatggggtgctaatctttccctgctgctcaatatatttgagctagccaaatacaatcaatcttttctgctacgtggtgatatctaccaaaaatagaaaaaaatggccttcggtgtcactaa

SEQ ID NO: 694879 - DNA, 961 bp, Homo sapiens
  misc_feature (1)..(1): n is a, c, g, or t
  misc_feature (614)..(614): n is a, c, g, or t
ntcgggccgatccctttttattatttattttgttttttaagtagaagatgaacaaacaaaaagccaaaggtgaggttacaaaactgacttatttttaacttctatgctacgcattgagccatagctcaatcttgtttttagttttagtatgtaatcttggttttggttacagacttatggcaattagctatacaaaacatacccgttctgaaaaaatttaaaatatgtggtctgtacaactcataactgggagtattatacccaggaggctttgtcacaaggtatcattattcctgtcagtaattattttcttcttttaccagttgttcaggcatctttgtacccatccttgatttggagggtctgaccttgacctaattatatccttcaaaactcgcccttacactctcatgcgacagtccctgggcttagagggaggatgcctgtatagtcttagtagcaaggcatttgcagtgaaaaacagattgggcccagtgggattgttacaggtaattaggcatgagctgggcaggagagagggctctcctctaccaactagaatgtcgggtgatggttcagcatttattgcattgcctgtctaaaaatgatatttnggcgcaccagggagaggccctttgctgatgggtcacacctgtaacatcatcaactgtaattgactgcgagcccacgggagagcaggttccttggcatgcgtattatgagacaaaaaagaacagaggggagtgtatagtcttgggggggcctctcctgggaaaagggaagagaccctaatggcgctttttaaactccctaatactggggtggtgccgcccaaagataggaacccttgcttggggaagtcccctaaagaaaacgggaaaagggacttaaattctgagaacgggacagaggcttgcgtttcttatcttactgcctttgtctttaagccattctgtttgtt

SEQ ID NO: 694880 - DNA, 192 bp, Homo sapiens
ttctgaagagacgctgttgggccttctgaacagcatggctaattaacagaaagccattatcattattgcccccatccttttaactgtctttcttatttgggtggggaatacaggggcttactctgttgaccaggctagagtgcagtaatgcaatcacagctcactgcatcctcgacctccttggctcaagtc

SEQ ID NO: 694881 - DNA, 221 bp, Homo sapiens
ttgtgcacagcacggagaagggctaatccatggcagtctggaagtcccagacaacggcgagtatcatagcatgcagctgctggcgctatgccacagctactagcatgtaacagttcttgagccacatttgtggcctacacctcagctcacagcatggccagatccttagtccactgagcaggaccagagatcaaacccattccttctccgtgtggcgtggt

SEQ ID NO: 694882 - DNA, 393 bp, Homo sapiens
  misc_feature (20)..(20): n is a, c, g, or t
ttactgcattttatgagganaattatatattataatgatacttggggatttgagaaggtcttgggacatatccctcatgaatatctaagtctcagcactagtagatttacttttccccaataatttcttgttaatttttcagtaattgcaaaaatttggcttacttagcttattatggaactctacttttttgaagatgcagagttttcttgcaagttattttaaatttgacagtaaaatgcctaaaaacttaagacttaagatgctagaggaactgcaactgctccagatgtacaagtgctagcatggggtatggttgaagttataacccctgctcttgctaattcctgctgcatggtcattgttcaactcatctgtctacattaaaaaaaa

SEQ ID NO: 694883 - DNA, 462 bp, Homo sapiens
aaccaatatttcgcatgtctactcatctgagagatgagttatctctatagtttagcttttttttttatattttatttattttcttattggttccttcacagctagacaaccttacagactttggggtaatccagcagttaaatataataaacttttaatccccaacatatttttccctgctttgggagaagggaatgtcctttgccccatttaaagatatcacaagggctatttaaataaatagctatgtgtttcctttaaagaaattggagtctggtatgagatttaaactgaaggactcttaacaaatgtaattcagctgagttttggagcatttaaggtgaataagtcatgtatccctcgacctcgtgtggtgttgtccttcattttttatccaacacaggaagagagggggccagcaaggtttcgccccttgaggaggtgggcactctaatagggggg

SEQ ID NO: 694884 - DNA, 249 bp, Homo sapiens
  misc_feature (5)..(5): n is a, c, g, or t
caagncgaactgcgggaggagcatgaatcagctgttccttcgggaggagaaaaaggaaacacgtcagattgatctctggtctcggacatgtgggctgtgcagcggctttttggatagactgggcctttccagcacaaaggaacatgaggaaggtgggtcctgctggatgctggttggcacacaagacggcttccttaggaaagacggacacataccaatcacaaatggtgggtctgctgagagaagcca

SEQ ID NO: 694885 - DNA, 257 bp, Homo sapiens
tggtacgattgcgtgagaccaggagtacgagatcaacccgggcagcaaagcaagacctcatctctacaacaacaacaaaaatctcagcaggcttagtcattaattggttccttttggtttttgtagcaaatgacgagatagattcaaaagcaaaacaactttgaaaagggaacaacgttggaaatcttttagtacctgaattataaggctgatatatcaaaggtagaagccagaaaacaccagcggtgaaattagca

SEQ ID NO: 694886 - DNA, 321 bp, Homo sapiens
ggtcgaccttactctgttaagcaatatagatatatcttatctgttcagttggcggggcgcagtggctcacgcccgtaatcccaacactttgggaggctgaggcgggcagatcacctgaggtcaggagttcaagaccagcctaaccaatatgatgaaaccccatctctactaaaaatacaagaattagccgggcgtggggacatgcgcctgtaatcccagatactcaggaggctgagacaggagaatcgcttgaacctgggaggcggaggttgcagtgagctgagatcgcgccagtgcactccagcctgggcaacaagagtg

SEQ ID NO: 694887 - DNA, 458 bp, Homo sapiens
agctggccccgtaatgctcaggttctggcttgctcaggttcctggctgctcaggtctgggttctgagacaggtctcccttctcagagtcacattctagtgactccagattttaagaatagcacatagggccaggcgtggcggctcacgcctgtaattccagcactttgggaggccaaggcaggcggatcacctgaggtcgagagttcgagaccagcctgaccaacataaagaaaccccgtctctactaaaaatagaaaaattagccaggtgtggtgacacacacctgtaatcccagctcttcggaaggctgaggcaggagaatcgcttgaacctgggaggcagaggttgcagtgagccaagatcatgccattgcactccagcctgggcgatgaaagtgaaactctgtctcaaaagacgacaacgataaaaaaaacaaagttctgcgggaagaagacaa

SEQ ID NO: 694888 - DNA, 318 bp, Homo sapiens
cattctgcttgggggccatgttaattggcaatgattgtgccttggataaactgcattttggccactgcacaaagcttgagggcctttttaaacagcagaatttctgtagcacgaagtaaacatgtgaacaggatgcttgtttacaggatgaggctgaaatgaaaaggcggggtaagtgtcaccttgttccactgcagctagggatgtgtgtcaggcaacttgagtttgtcatcattctgtgtgtccaaggaccttaaagtggttacaaatgaagtttggcagtgaagccagtttacagatatgtaatctgtgaaaaaa

SEQ ID NO: 694889 - DNA, 559 bp, Homo sapiens
  misc_feature (1)..(1): n is a, c, g, or t
ngggcaaaaatgtggaaaggggaatcgggagaggcgtatgtggaattgaggcagcaaaagtcaaaaagttgtatatcaagggacagtgatgtgcaatggacgtcaatatagggggaattgggtacggggacacccaaagagttgttagagagtaagatacaatataggagtatgaattggaaagccagcaaggaagacaagacacctatgaaagcttacaggaaagcacgcaagaagcatgtttagaaaatgttaattaaggagaccgggtgggatggctaaggagggtaaagaaagcactgtggaaggccaaggtgggcgaaggacaaggtaaagagttcgagaacagcgagagagaaatggtgaaaagacaaaaaataactaaatatacaagaataagataagaaatatgaatatataagaaatactaagatatataaaaaaagagagaggcctctgtctctatctatatctatatatctctctctctctctatatatatatatctactactactactactactactactctccgcgtgcagaattcgtacagcccg

SEQ ID NO: 694890 - DNA, 211 bp, Homo sapiens
gctgggctgcggaggcagcgacccggaaacagcgtatcactgacaccgagtcgccttatcaagagctccagggtcagaggtcggatttctacagcgacctcaacacacagaggccgtattaccaatgagcccgaatcatgacagtcaggaacattataactgtgatccaggcattacccaagccaatttcccaggggggccggggatcctc

SEQ ID NO: 694891 - DNA, 639 bp, Homo sapiens
caaaaggcaaatagctgcttacaccaaaagcagctatacataccacataataggaacaaaaagaggacctataaacaacaatgatggtttattgctacaagtatgcagcaaagcaaaaactaaaatagcagcaaatccacaaggcaatacctccacagaatcatcatcccatggttcatgcaatgcctacaaagtgctcccagtgggatatacaagtctaattcacaattaaaaaaaaaggaattctaagatgaacacacaggtactttgaaggctgattagtatggagccttaaaacatgtccttttccaagggcagggtatgccggtgatacagcccttgagtctttatcacgggtccatacggggaaagaacccttttcttacatggcaccagcaacctataggcggcacaccaccagagtggtttaccctggatgggcggctgtacgttccaccgtgagcccatcttaaaaaagccagctggttagattaattgaacgctgaaatagatcttcacattcgcttcactgtatcccataagtccattcgtaaactgtggccattggaagtattgcacgttcttcgtatcacctagtctcgtccggccggcggggaaggtgccgaaagagtgcacgca

SEQ ID NO: 694892 - DNA, 235 bp, Homo sapiens
taccagatccactcattatcaaaatctgataatttcattagcacacagctactttctaagttaaaagacaaaactattttaacagttactgaaaattattacaggccatgcgtggtgactcatgcctgtaatcccaagcactttgggaggccgaggcaggtggaccatctgaggtcgggagttcaagaccagcctgaccaacatggcgaaaccccatctctattaaaaatgcaaa

SEQ ID NO: 694893 - DNA, 341 bp, Homo sapiens
tgggagacagagtctcactctgatagccaggctggagagcagtggtatgatctcagctcactgcaacctctgcctcccaggttcaagtgattctcctgcctcaatctcctgagtagctaggactacaagtgcctgccaccttgcccagctaatttttgtatttttagtagaaacagggtttcaccatgttgccagggtggtcttgaactcctgacctcaagtgattggcccatcttggcctcccaaactgcttggattacaggcttaagccactgtgcccagcccccacttcttctttatctagaaagagataatggttcctttcccccagaaaactgttg

SEQ ID NO: 694894 - DNA, 800 bp, Homo sapiens
aaggataacactccaaactcacgttataatcgtgctactgtgggtaccgctatgtagaagggctgagaagcgattcagggtactagaagcagggcgagcagctcctgatgctgcgtctagagggcttaggtcctgagcctccgctgctgccctatagcccaagctcagtcgccctccaaggtgcaaaagagctgggttggttagaatcggataggagcccaggctagggagatctatggtgatgtccgttgagtctaggagagtgcagtaaacccttaagcaagggaaatcctactaagatgtcagacctggcagggcattgcaaggcttgggcactgaggccagtcggtattatacaaccattcatgggactggggaaaaaccccttggggagagaaggacgaaaaagaaaaaccaataccacacaaaggaaacgcccaccgaaagcataagaggaagaaaaaaagcagaaagaaaaagaccagaaaaacaataagaccaagagcaaagccaacaaaatgagcagagaaccaagaagcgagtgtgcggcgtcacggaggcgtccgtagagaagggaatgcacaaagaggaaaaacaaaggaagtagaagaggaaaaggaagcgagtccgaaagaggaggtgagaaagagggcagacaccctacccgccacaaccaagagaggagaaagagaacgaggagggaaaaggtaagcaccgcccccagaaagatagcaagtaaagacgacactacgaataggaggagaaaggggtagaaggggacgtaagtcaggaatcgcacg

SEQ ID NO: 694895 - DNA, 578 bp, Homo sapiens
agtgctgattcttgatgtatcctcatgctgcagctatcgcagaactagcgtgctataccgtgcggacgccagtccctgtggagagtggcgatgcggacgcttatgagcctgacaaggcgcagtctcgagtgagacccagatctagagccctatgccttccattcaataggcagctcacacttccaccaccattcctggctgcacactccctccaagctccccagctgtagagcaatctgttttcgagttccagtgtctgtcggaacaggctagggagcccgagttcctccctcttctggttccctttcccttggtgtctcttggaggacacgcatggaaagcactgggcatagatgctgagctaaatcatcacccgccttgccgtcttcacccatgcttcccactccctcccagtctgctcctctgagaaactgaattgcctgtcaggaagagttctccgattctgaagaggagggagactggggcgctagaactcttccaagttcatcaaagccacgagagtccaaacagaggttgaacagagaagacccgaggggagaaagagtcccgagagggga

SEQ ID NO: 694896 - DNA, 368 bp, Homo sapiens
atttttccccttggttttttttacttttgtcacacagtcctccttaccgttcccttacaggcacaccaaccatgattttgcctaagggcctttgcactggccattttttttgtttaaaaagtttcctcaaatggttacaaaggtaactggtcatggacttccacttttttggtcaaccacccaaggagacttaccttgattaacctatttcaaatcataaaactaaatcaactttccttattccctacccgtttttactgttttttttttcctttttttgtagtatgtaaaaccttttaacaaattatggaattatttattaaatttattggggattttcccctaataaaataaatttccataaggga

SEQ ID NO: 694897 - DNA, 418 bp, Homo sapiens
cgatctagaggtccccccctattcaaccagacccttactcattgcaaacaggctaagacatagtaatattcttaagatgccataatttcggttcagctgcttggtcatccaactcacgaagtctagaatgtagataacgctacaaatctaggtatacacagatgtgtcttaggctagggatggtaacaatctagaagcattctgtttacaagagtgccaccaaagcatttaaaagacaccaatgttaatgccaccaaagataagcctgctataacctgggaaacaaaaaatctcacacctaaatcctagcagagtaaacgatcccaactagaatgtactgtctatccatatggcacatttatgacttggtaatatgtaatacataatacaggttaaggtagtctggttgggaaaaggg

SEQ ID NO: 694898 - DNA, 121 bp, Homo sapiens
tacactgatccacctactcggctcccaggcagtgactgggattacaggtgtgagccactgcagctggcttagatttatgggtagttattgtacgggtagccagattaaggccatcatctct

SEQ ID NO: 694899 - DNA, 209 bp, Homo sapiens
catctgagccccttgtatcttcaacacctggagacttaggaagacatggatttgttggaacgacgatagcttagttcgaagaacatatattttcgtggaaacgcgtaggatcttctgtgatagacatgagcttggtttggaacgacgttggactcttcttggacacgacgataccttcttggttgtgaccgacggtacacttttgtttg

SEQ ID NO: 694900 - DNA, 127 bp, Homo sapiens
gtctacacttttttaaaaggacccagtatttcaggtaccaggtgattgactgtcttgtactgtcctggcaatgggactgatggtgccattttcttttagtatatttccacagattggacagatacag

SEQ ID NO: 694901 - DNA, 707 bp, Homo sapiens
tcagtccgtaccggcatgtgattctgttacatgtcaatgatatttttggggtattgagtggccatgtgatgctattaataggaaaaaattcaggaggaaaagcctagtttaaagtaaagacaaaatatcccatcttggttatgatgttttaagatgtctgagagaagccaggcacggtgtggctcacgcctctaatcccagcactttatgaggccgaggtgggtggatcacttgaggtcaggagttcaagacagcctggctaactggtgaaaccccttctctactaaaaatacaaaaattagccaggggccgtggcgcgtgcctgtaattccagctacttgggaggctgacataggagaattgcttgaaccagggagatggaggttgcagtgaccactgtactccagcctgggcaacagagcaatattccatctcaaaaaaaaaaatcttttaatttttataattaacttttatcatgcagcccaacatgtcatcttttcataaaatcttagtagaggtgcactccagggatgattgggccctcagtcaagggctgacttttcctgtagctatgctgaccacagcaggttactaaaagctgatggttaacggaggaaacagtggatgcttgtatcctaggtcttctgatagaagcagaagtccacagtcactacagttttgtccacatgcactcagcacatgggcct

SEQ ID NO: 694902 - DNA, 545 bp, Homo sapiens
aggagttgtctatctcgccaggtcctggcagccaaggagaggcactgtgagagagctcaaggggtaggctgggcctctccaccctaggggatgctgaaacagacgctgtccaggagctggcatgacgtgcaggtctctagcgcctatgtgagaacttctgagaaacttggagagtggaatgagaaagtgacccaggtcatacctctacaagaagactcaggaaactctattcacaggcaggacagaatgacttcggcttgccctgtcacactgtgggctctgccatcagcaggaagcttggagacatgagggctcatccattttcacactccgtttaacagctactccatccgccactcaataagtatgccagccatgaggaactctgctgatacttcaagtcgtttgaggaccgagttgggaccataaagtctaaggttgtgggtgacagagagaacggtagtgatgatctcccttcctcagtggggagtggtgacaagcccctgtcggattgcgggacctactaaggctgtggttgcttcagc

SEQ ID NO: 694903 - DNA, 652 bp, Homo sapiens
ttttcagctgtccgcgctgctatcgcctccgcctggggatgctgcacctgtccgaacgcaacatgaaagtgctcctagccgccgcccttatcttttggtccgacttgttactgatgttgccgggaccttctgcggccgatgagaagaagaaggggcccaaagtcaccgacaaggtgcattttgacctactaattgcagacgaagatctatgccgtgtgatctttggactcttcggaaagactgctccaaaaacagtggataatcttgtggccttagctacaggatagaaaggatttggctacaaaaacagcaaattccatcgagtaatcaacgacttcatgaaccatggcggagacttcaccaggggatacggcacaggaggaaagagcatgtactgtgagtccttccccgatgagaacctcaaactgaaggactacagacctggctgggtgagccaggccaacgcacgcaaagacaccaacggcgtcccagcccttcatcacgacagccaagacagacctgcatagatgccaagcatgtgaggtttggcttcctagaaggtatggcagctcgtgctcaaggtgcatagcaccatgaccgacagccggatcctctgaaggatgagaccattccaactggtgcaagcgtgtgg

SEQ ID NO: 694904 - DNA, 292 bp, Homo sapiens
atgctatgctattaatttggggaaagaaatattgaggttcaaaaggatccagaagcactggctcgattaatgctgtctgtaccactaaccaatgatggaaagtatgtactgtgattagatcaagcagatgacactggcggaagtccaagtgaaaacagaggttgcagaatctgaagcataactcatttgggcatcgggggtcagagcacgtgggaaggagagccactccttaagcagttttcaacttctctgccgtacaggcacagtgacctgaatttataacaccgacaat

SEQ ID NO: 694905 - DNA, 939 bp, Homo sapiens
cgcacgcgtgcggcggcgcattggcaagtgggagaggcccgagattgtctgcaccaaactccagagcgttcacatctggatgctggtggaacaccacgcagccgaaccatcgcagatcagccacctatcaggcatcaccaccactaatcccggaaggagcgctaaagacacacagaaacactcgcacacgggaggtactggaggaaacaggagcggacatgggaatttctgcctgaagaagcagatcagaagaaagcagcaacgatcattatcccatgccgtcctctgggagccttcgcctgggtgagcacgagaacccgagaggagatatactaggagagtccataagttcctgaatgccgagtacgacgatcctcgcctatgacacatagatctctttgtggcaatgctcctcttatcccttattatatcttaggcaagatcctcttgacaggtggcagccgggtgtctgacaatagtcctttctcgatctggctgaactctgggagtgtgtcccagacatgagggaagcacaagtagcaaagctcgattggtctggtctcttgttgccaggctgattgaagcaggccttgatgagggtgcatgagtgtatgtttgcattcacgatgaaggaattgctttcacaccagaaattcagacttagtcaatgtaggctgaacttcctagatccaggaacgaggcctggacgtagggtcatcagctttgggactggacggctacaccgaagcaccctgtctttgaactttgacagcagctcttcctttacctgggactacaggccaagttccgtcttaggccttgggggataaacaacggctgtgaggatccggccattctggattacggatgttaggcacctcatcgtgcctccagtcgacgggatgaccacaagtgggtcggggatgttgactaagtacc

SEQ ID NO: 694906 - DNA, 870 bp, Homo sapiens
  misc_feature (616)..(616): n is a, c, g, or t
tggcgtccttgcctttcttttattataggggtggtggttttaccttttatagggggaagtatgctttatggagtgtcttttgggaacgcttttgtatttttgagcgtggcaaatcttggggggcccttttactcgccgcgcacctgtgtttgtccccctcacccgttttatttggcgtgtcgccccctatcatataccattggctcgggttaatcaggactgcttatttggcggtccacccggccgtttccaaccgtccttttacgtggttcttcctccttttgcccgcgaagtttttttcctccgcggggattgtttcgggcccttgttcacctcggtccttgggctggttccccgcctatttggtggtgcattggtgcccccacatggtgtcctcccttggtattcccctttgggtccctcggcgtaccacatcgctccttttttgtgcccccggggtttctaattcccgctgggtgccccccaatgggtttattgggcccgcccggcgccccattctgttagcccgcgccgtctcacacatcttatgggggctttatttttccctctcctccagcctcctagcggttcgtttgagtgtcccctcccccattcnggagggcattattcagggccaaacaattgttgtaaagccccacgggcttttcccgggagctttcacgcgtccacatttggggtccaagcttcaccacctcaatcggggtttatccccgccgcacctcatatgttctctcctaccacaccccagcacaactacactcgggttgaaaccccccccttacatgctttttttaaaaggcttcataattttcataacttcccttttttacaagggggccccacaaaaaa

SEQ ID NO: 694907 - DNA, 138 bp, Homo sapiens
ctattacatctatggtccaggtgtccactcccttaaagatgattagagacttcaggcagaaatccaaggaggtaacaaagtgttcatgcgcattgagggtcttcatgcatcgcttgttcttgtaatccccattcatta

SEQ ID NO: 694908 - DNA, 165 bp, Homo sapiens
cggtaattaactagaaataactttgcaaggagagcaaagctaagacccccgaaattcagacgagctagctaagaacagctaaaagagcacacccgtctatgtagcacaatagtgggaagatttataggtagaggcgacaaaactaccgagcccggtacatgcaag

SEQ ID NO: 694909 - DNA, 245 bp, Homo sapiens
gtccatggcggcgcttgacctgcgagcggagtgggattcgctggtcctgcagctgctttgggacctggaggagctggaggggaaacgaacggttttgaacgcccgggtggaggagggctggcttttggtcggcaaggctcgcatacgcgaatgggcgccaagtcggtagggcccttcagtattcttccacatagagccccaggtcttctctcacgccacacagggccccgagggactccacaagt

SEQ ID NO: 694910 - DNA, 717 bp, Homo sapiens
  misc_feature (2)..(2): n is a, c, g, or t
  misc_feature (13)..(13): n is a, c, g, or t
  misc_feature (33)..(33): n is a, c, g, or t
  misc_feature (162)..(162): n is a, c, g, or t
  misc_feature (186)..(186): n is a, c, g, or t
  misc_feature (202)..(202): n is a, c, g, or t
  misc_feature (210)..(210): n is a, c, g, or t
  misc_feature (215)..(215): n is a, c, g, or t
  misc_feature (221)..(221): n is a, c, g, or t
  misc_feature (228)..(228): n is a, c, g, or t
  misc_feature (234)..(234): n is a, c, g, or t
  misc_feature (254)..(254): n is a, c, g, or t
  misc_feature (314)..(314): n is a, c, g, or t
  misc_feature (326)..(326): n is a, c, g, or t
  misc_feature (345)..(345): n is a, c, g, or t
  misc_feature (378)..(378): n is a, c, g, or t
  misc_feature (393)..(393): n is a, c, g, or t
  misc_feature (404)..(404): n is a, c, g, or t
  misc_feature (483)..(483): n is a, c, g, or t
  misc_feature (501)..(501): n is a, c, g, or t
  misc_feature (531)..(531): n is a, c, g, or t
  misc_feature (544)..(544): n is a, c, g, or t
  misc_feature (548)..(551): n is a, c, g, or t
  misc_feature (565)..(565): n is a, c, g, or t
  misc_feature (586)..(588): n is a, c, g, or t
  misc_feature (601)..(601): n is a, c, g, or t
  misc_feature (614)..(614): n is a, c, g, or t
  misc_feature (617)..(617): n is a, c, g, or t
  misc_feature (634)..(634): n is a, c, g, or t
  misc_feature (651)..(651): n is a, c, g, or t
  misc_feature (702)..(702): n is a, c, g, or t
anattactgcctnaaaaaacaacactttcagcnatttatattcaaacaaaaccacacggcattgactggttgtgttttcagtgtttccttggggctggcttcctcgccatcgtgccacggcacagctgcggtcggccacagtttgtcatgctggatggcggnggctcactcagcttcacattatcngggggccctggatggnagactcgngggtnttgaantcccaanttgtcntggctccatcgttgccagtngtgcaaaatttgcgacaatcttgcttgtccacctcataaatagagacttgagtgttgctnttctggtgcggngtctccaaggccgtgttgnggtcctcagttgtggctctcttgtccatgttgnggaaggttccttggnttttttgttgngttggttgttctgttttggattatctaacttggggacgaggtcaggcagccgcggtcatcgtagttaaagagcattggncagcagtcatggccagcngccacgacgctgttctctgagacaaatganacacttaggagcngtannnnctctgtcttcagantcgagacctgcacactttttnnngcatcagcaacanacacggtgctgtngtngctgacccaggccaggnggctcccactggcaganaagcttaccccgtggacccagccaccagtgccactgccaccaaactctganatcagcagcccaaaa

SEQ ID NO: 694911 - DNA, 886 bp, Homo sapiens
aattctaccgtgatttatttatatcttaagagaagagcttatctgtagagactctcttaattttccaacgctacacaactgcttcttgctgccgccatatgaagaaggacttgttcgcttccccttcctccatgattgtaagtttcctgagacctcgccagccatgctgaactagtgaacaggaaacctacagaataggagaaaatttttgcaatctactcatctgacataaggctaatatccagaatctacaaagaactcaaacaaatttactttcacataacgaacaaccccatcaacaaggtgggctgaaggacatgaacagacacttctcaatataatacaattttgcagctcacagacacatgataaaatgctcatgatttactgcccaagctaaatctttgacctttatagaagaagtgaatgatggatctctgttgccaatccatcagtaaatggagactcaacaggagctttttgggaattttataggtatgaatacactcgtgcttcaaaaaccctgtataatatgatattcgattacaaaatgaaatccagcttttcatatggtcatattattccaatataccttctcagcttacagtatacctagtgtaacgcatccatataaatggacacatgtcctatggcagaacttgttttcatttaataactcccaaccaccttcgtcgcccaccttcataattcaaaacacgcctcttcctattccttatcctaattggatagaataatttgctatcttgctttgtcgattaggatatctcacctattttacatattttattgttcttagccattgtctttcctcatctagtatgtaacctttgatcaggcgatctttaccgtttctcaataactatca

SEQ ID NO: 694912 - DNA, 108 bp, Homo sapiens
cgagcgggttgggccaggggattaatccttctaatagctatcctcttcaacaatatactctccggacaatgaaccataaccaataccaccagatcgcccaccagatcg

SEQ ID NO: 694913 - DNA, 274 bp, Homo sapiens
tttaaggttatagtaagctatggtcatgccactgcacttcagcatggatgacagagcgagaccggtctctaaaaaaaaataagtagatcaaaataaaaattacatggtagttgtaaatttattcagattacaaaagcatatgtactggctataaagaagaccagaaaatggaaatatataaagttaataaatttctcctatctcccttaaataataacccttggaagtaatcaatattatcaattcctgaactttctccttgcttgttccggtg

SEQ ID NO: 694914 - DNA, 485 bp, Homo sapiens
ctgtcgggcggcacgctcggcggcctgctcgcgttccgcagccagacgctcgatccggccgaagcgcagctcggcgcgatcgcgaccagcttcgccgcgcaggtcaacgcgcagaacgcgctcggcgtcgacctgtcgggcaagcccggcggcaacctgttcacgaccggctcgccgattacctacgcgaaccagggcaataccggcaacgcggcgctgtccgtgtcgttcacgaacgcatcgcagccgaccacgggcgactacacgctcgcgtacgacggcgcgaaatacacgctgaccgaccgcgcgagcggcacggtggtcggcacgtcgacgtcgatgccgggatcgatcggcgggctgaacttctcgttctcgtccggcgcgatgaacgccggcgacaagttcaccgtgcagccgacccgcggcgcgctgaacggcttcggcctcacgacgtcgagcggctccgcgatcgcggcggccgc

SEQ ID NO: 694915 - DNA, 197 bp, Homo sapiens
ctaagtctctgggaagaaacacagccctgcaggaacctgattacaatcccgtgagacccacgtcagacttctgatggacagactcaaaaggacacatttgtgtggttcaaggttctaaatttatggcaatttgttattggcggcattcaaagtttgccggggcctgaattgaggttggttgaggaaaaccagggtgg

SEQ ID NO: 694916 - DNA, 548 bp, Homo sapiens
  misc_feature (1)..(1): n is a, c, g, or t
  misc_feature (177)..(177): n is a, c, g, or t
  misc_feature (245)..(245): n is a, c, g, or t
  misc_feature (249)..(249): n is a, c, g, or t
  misc_feature (301)..(301): n is a, c, g, or t
  misc_feature (307)..(307): n is a, c, g, or t
  misc_feature (339)..(339): n is a, c, g, or t
  misc_feature (354)..(354): n is a, c, g, or t
  misc_feature (378)..(378): n is a, c, g, or t
  misc_feature (384)..(385): n is a, c, g, or t
  misc_feature (421)..(421): n is a, c, g, or t
  misc_feature (435)..(435): n is a, c, g, or t
  misc_feature (439)..(440): n is a, c, g, or t
  misc_feature (442)..(442): n is a, c, g, or t
  misc_feature (502)..(502): n is a, c, g, or t
naacagtatcaaatgaagtgatcattttcagtgaaagggaaggtagaacacaatacaaagaaaacccagagatatcatttagtttacaattacacaatataagatgaagaaactttttccaaaatactatgttttattaacccctcagtggtaaacaataacatcattatgattaantttttaggccactatatgtcacatacccaaggtctcagttgaatcacatgtggtcttttcccattagntgtntgctaatctttttcaagcggtcaaacttcaaaataccctgttttatttcctntcagtnctgggtttctatggcggactgatgggggcgcngctggtgcgggcggntttgggcccttggtcttttgggcngggggnnggacaaccctcccccccttgccttggtccttcctgncctttttttttcangccnntntttgtttcggttagcagttctggcggtttcacggctaccgtctgcccgggccctgccccngggccctcccccccctccaccctgtgtggcacccgcctgccctgct

SEQ ID NO: 694917 - DNA, 519 bp, Homo sapiens
  misc_feature (487)..(487): n is a, c, g, or t
tgttgagatcttcaggctagggtttaagccatacctcttcggtctacatgctcatctatggcaggggctttaaataccattaattggctgactctccaaggggtatatctccaacactgagctcttctgagttctagacaccgtaccctcctccctccttgacagcactccgggagggatgtctcatgttcagggaggaactctggattggcttccaggtcccatctaccccatccggcctcggcgctcggtgtcttcaccatctcagtaaagggtaccaccatccttccaatttacaaagtcagaaaccggtatatcatcctgggtttctcttctatggtccttcctctccccccagtacttctaccttcaaaaggatttggagtatcttctcggtctccactactatcatcttaggccagcttcgtcaccgggacttcaacattagtctaaggactgggtctgtcgtttccactcctggcacagnctcccaagtagctgggattacagatgcacgcc

SEQ ID NO: 694918 - DNA, 903 bp, Homo sapiens
gcgtggacctgtgtacactgcggatcacagtggaccgtgcgcttgagatactgatcctcaaatctctgccgacgcgtagcgtatgggttctactggaaagatcacaagaggatatgtctcaggatctcaagatataaacggactcctataaaccgagaagtcagtctgagcaggccgtcctgaacttccctggcgacagactgcacggggaatgggcactctatctgtgtgtcacttgccagaaggcgagaacgtaagactccaggggcagtacagagacatcgatgatgtctcggtcattggtgtcgtaacgacgcctctcattgtagaaatttccgagcctatagaagtcatgagtcagcagtactgcgcctggtaggtgacgttatcatcgcgccgagtgaaggtggtgccctgaagtcgtccgtcaacgaagcgttgtaagtcgaaaccttttacggagcgtatagttcgaatgcactcgagacgagaatccgaagaggtggcgcgatacagacgtcctacttaactggtactgtagctggtggggccaacgcgacatgtctgctccatcaaacctcgagaccattagatattgctcgatcgagatggatggtcccctgaccttgtgggtgaaacagagccctctcttggaatctggtacccatgaggatgcgatgggggaaaacatcgcttatctaatgttttagtttcgcatcgaaagtcctctttattcgtcgcaatccgggaagtgtatccccatgagagtggggtgaggcctacgcttgtaaattctgatcaggtgttgtgcacatgggcactggagtccggaggactgtcctctcaggcatgtaatccaagacgatcctttcttggggtgtacagaatctgttgctcaggaac

SEQ ID NO: 694919 - DNA, 265 bp, Homo sapiens
tatagagatccagccactgacgtagccacctagtctcccgtacgaggacaaactgtcatgctcatggaggaatcaggggccattccagaggtcataagaaggcaccgatggtaggcatctggagctctggggtacgaagtggttggcccctttccacggtcatcttgatggtagctgggtacataacccctgtcatcaaggtgccgtcctatccccacctactcctgggtcaggaggaaaagactaacaggcaggtgcgtacagt

SEQ ID NO: 694920 - DNA, 166 bp, Homo sapiens
acgtgcactccagcatcctcagaaactaagaggatactagagtacacagaatggcaaagaattatgcagattgtagaggacaccgtacattcctaggaggtcaagtccctgtgggtgatgttttcggtatggttggtctaaatggagcggctagaagtgtcttgtc

SEQ ID NO: 694921 - DNA, 935 bp, Homo sapiens
gagttgcttggcggaatcaccatggcggtctggagaccctgtagccaacgtatcctgaaaactggatgggccttcaaggtctcatcgctgctcagtacaggggcctcagcgtccggtgctctccgaaccaccccattccatttggccaaaccaaaccgcaccccatgagattgtctccgcaaaatatcctgccgggtacggatcccagcatgtttgagggtgatgatggatcctgtggtgtgatgagagcaacgccaatgtgcatactatgtgagcacatgaggagctgcgggccaaagttcatccagaggcagcagcccagggtggtgcatcgtggagtgacagcttctgcaggagtgaccgatatagtgcccccagcccagtacactggggtgtaccccacacctgggccagtcaatggcggccaacaaacaaaaaaagggccaacttgacgacatgcacatcggcaggcaagtcaaggcgactacagggggcctgcgggaatgctcacctcgcaagacagccaggactcacgggagggccgaacgagctgacctggggtgacactcaccagggaggcaccgcaccacgtcagagggcttctaataagcaggagacaagacgccctcttaccgcacaggccttaccagtaccaacggggtctcactgataaacagccagtacggcgtgctagggcagaagaacggtgcgagagacgggcagtgcgacaaacgtgacggaccactaaaggacccggaagaaagtccgagaaaaaccagccaggtcacgagagggaacagacggccgaccagaaaagggaggacaacgagggaacggcaagacagaagagcaacacgaggaagaaagcaacagatcgagcgagaaagaagcggcagaacacaaaagcaggaacagacccgactgcggacacgtgc

SEQ ID NO: 694922 - DNA, 1675 bp, Homo sapiens
  misc_feature (137)..(137): n is a, c, g, or t
  misc_feature (192)..(192): n is a, c, g, or t
aaagactgcggatgccacgtgggtggtcctgggtgcactcagacgagaaggcatgtctattgaggtgacgtcagatgcagctgattagtggcagaatatgttggcgccatgactctaggcaagtaggtgacttcgcnacgttaatcgcctagcaataaggtggcagaaagctagatgcacaagggacagctnggtgtctactgagaaggttagtattgctgagcaggaaccaatcggtccatacgtcgaggactaaactgtggaacggaccttgtgatgcaaatggattcgcttctcattgggcgcttagtagagtccttggtgtaggagaccattggggggtacttgggcaaggagctgcaaagcaaacccacaaacagggcccgcatggtgagatgtacagccgattgaaaacgcatcgcgagacgcgaattgcggcttgataagttcgaaatcgggtcctccttgaatagccaggtggaggcctcaagaagggcagccccgaggtaattcataattgatatggtgaccgtgggatcctcgttatgaacggttgggagcgctaaaaaccctatcggctaaaagcgggaagctttaagcgtccgaacgccaaatcgtctcgatggatatcgattcggggcctttgaggttttcacctttgatgttatgcgccgttgggtggtggcttttcgcccatctaagagcggcctcggagaaatctttccgcgtcgggatcggttttcgaactccacacatttgggccccataaaaaccaaaactttggaagacacacaccgccaaagtttcaactaatttccgtatatcacgtctgtgagccaacggcattatatcaccgtaggttcccaacaagggcacctaatggggggcaaccgtaaaaggacctaaaggctccaccaaggtaagagggctccgggaaggttaataacctatggccgcctcctttatttacccgccgtggtgccaaatttaatatgccgatttcccgttcggaattggcggtgtggtacaaaatccttatggagttccgccattcttcccccgtgggatggaaggacccatatcaaattacccaaaagagactgttatacctcgtgtctataaacgctggctgtgtgcaaatacattccatttatccaaccgcccgctgattaaacttgcggatatgggggggaaccgcaatgggggcccaaaaattcgcccgatttagttcccagacgttttgtaacagtatattcacactgtgggatatggggaaaacacttatacaaagacgggtacaccccaaaagagtagggagcatcataggccatccccgttatgtggggtttgaaggcagcacattgagcgaaatgggccggtttggttgaggagcacacatatgggcatcccagtgggggagtttcaccccgttaagtgaccgcattaaatgtaagggctcgtcagatgaagaagaagcagatgacgatgtttcgccctctttttatacccagcgggagagggcaaaagaataatcccatcttagaagagggctagcaaaatagttgtgccctcatcccctgttgtgtaccaggacaccctctattgtatggtgctgttgttgtacagccgccgctttgtatgtggcatcacactgcgtcgcgtcactacataccaa

SEQ ID NO: 694923 - DNA, 916 bp, Homo sapiens
acgtccttgacctcacacgggttattatatcttctgaaaaagcttaatttcagacgccctgtcccccgtgatttctaccggcctctcttacggataatgtttttaacccctaccttgtctacacaaattctctgggacccaaatatttaaccaaggcccattctggtagtaaattctctctgcttaccaaccgcaatagtgtttctccctctactttgtaaggccgcaacgttcttcattaacaagcccccaggtaatgttctaacagcaccagtcccaccaaacagaggctattgagaaattttattccaaaagcgctcacgacggaacattttaaacaagaaccccttcttatccgccagtgtttggcaccgcatgtcaccctgcccaaaattataagttgtataaaaaccccatgcctgcaaaacatgtgtcacacccacataggccaacggggaacaattattctcgtaggtatttaattgcattatggaaaactttccccttccgcgcgtccctctctcccctctccaagagggacccagcgccccttctccttctccattccggtggaagccactcagagatatatttaccaccaaaagcgggaaccttcaaatattttttggcgtaattttccccgaggattaaattttcctggcaattcacccccgcactaatctttcttaacgaggacacaccacagcccacaatggattaaccaacactccccaaccctttctgtcctggtgaaaaacaactgttcagccaccctctaatactaccgacgtcactaccccccacgttcttgtctccacacaccggtcattatatgcccccgctcatgccgatgatacaaatgtccgggaaacccccgcattttctcgggtagcaaaaattaggtgaaataatcaca

SEQ ID NO: 694924 - DNA, 340 bp, Homo sapiens
  misc_feature (12)..(12): n is a, c, g, or t
gggcttttttantaattaaattgtgtacttttaaaaaaaccttttaattcatgataaagtaaatccagtctactgagtggctgtgctatatctttaacagctattttatctttatttccttcagtgttacagcttccctacatagtacagattatgttacctaattaaatagttgagctatgtcccattctagttaagaaaactgtcctgttgcctattttcatctgattaaaattttctgactttctttcaatatctgtttttttgtaaaccagcctattcagttttatgtcccaacgtcctgttctcttgcttgcccactgatttttttctccatcat

SEQ ID NO: 694925 - DNA, 207 bp, Homo sapiens
tgtagattattcagctagagaataatccagagtaatccagagctgcgcagttcatacacgaagctagacgtagctagagaataatccagagtattccagagctgcgcgttcatacacgaggctagacgtagctagagaataatccaggttaatccagagctgcgcgtgcatacacgacgcttgacgtagctagctgaataatctcaa

SEQ ID NO: 694926 - DNA, 121 bp, Homo sapiens
caggcataacaccttcacctgcgcagatagacaaaattaaaagcaagcaggatagcctgaaccacaacagctaggcattctagtaggctctgcggctagtaggatgagccaaaacctaaag

SEQ ID NO: 694927 - DNA, 176 bp, Homo sapiens
gaataatttattgtgaaaaaattccttttataaagggaaaattatttttataaattttattgttggaaatcaaaaattagtagattttttcccctgttaaattaaagggagattaaaggattactaaactgggatgcaatgtttgtttccctaaactttttaaataaaaactgaga

SEQ ID NO: 694928 - DNA, 106 bp, Homo sapiens
gagctcggtacctttcaaagcggagatctgccaacgtcttgatgtttgtcaccagatcccctattgttaagttttgtaagtggacccagcatttccggtttggaaa

SEQ ID NO: 694929 - DNA, 938 bp, Homo sapiens
taagaaccctcatcaatagatggagacatacagaaatagtcaaaccacttctacaaaaggccagtatcaggccgggggcttcgaacccaaagggatgttgggatgtaaagtgaaatattagtggggggatgaagcagataggtgaggaaaggttgacccaattaatgtgacgttgaagctccgtgggaaacccgtggtggctacaaaaaatgtggttgacccgataaagtgccgctcgggaactgtgggttgagagggagcacctcgaagttacctcgtgaggctggataggagggtaaaaatagagcacccagttaaacatgggtaataagcaaggtgctgtggacattatagtgtggggttcacgggtgggtttctcttattataaaaccatatgtgggtgacgcctcgaggtgtgaattggaatcactctcctgtgaatttgcggagtataacatacggggaagtggtgatacacaaggaagtgggggacctctctataggggggaaattaaagcggggggtgaagtgcccgtgttgtggggcgcccaagtggcccctccacatatggggggggggaaaggggcgcagagtgccgggagcacgtggtggtaaacaggggcctcagaaaaaacctcctgcgccgaaagaaaaaaaactctctcctggaggtgtaactaaacactaggggagttaactccccggaaactcagacaaggcccttgtctggggaccactgttgggcgtgctcgtctgggggggcctgtgggaatatgtagcttcccctccgttgttaacaatcgcggggccaacccattgggtaatatctgggtcagctgttggaggggacaagcacgggccaaaatatgaaggagccgcatagaggaaggtggaagtagacaacccaatgagcaaggccggaaggacaaaagaagggg

SEQ ID NO: 694930 - DNA, 155 bp, Homo sapiens
gcccaaattacagcaactctattctatcagcagcaatgatgtcatcggctgtcatgaaatacttgctgtgccttccatcttctatctcctgtgcccagactccctgcatcccataggaaggggcctctcatacctccatgatgctgaagtgggag

SEQ ID NO: 694931 - DNA, 365 bp, Homo sapiens
catgagtacaacttgctggcggcacctcatcagtctctttacaactgtgacattccggcatcgctggcgggcaagggaatgcaggcagccagagacggtagtcattctgtcacggcttccgcgctctgatgggaaatgccgtctccagcagcttcacccgggtctccctgtctcagcacctcctcccccaattcccaggtctcacatcccacccctgctgccctccaacccttctgccttgaaagctggctgtacggactcacatcctttatgctaatgacacttacatatttctcgccataacttttctcttgcagaaaaactgacatgactttaggatttaaaaacaagagcaacacgccctt

SEQ ID NO: 694932 - DNA, 437 bp, Homo sapiens
ctactttcctttgaaagctgttcttcttgtgtactcaacccagaaaattccaggcctattgtcctcagccctcactagagtcctagatacgcaccgttttattttctttgggtggtgtaaagattcagttaaggaatatcttccttcagacatctgctgactacaggaaatgattgtcatagcccatgtgaaggtcatagtgagactaagatgacgttttggaactcctgaacgctgtagggaggagcaagtagaagcgagtatgggtactcgctggtaagagactggggatagctccaggagtgagagcggcgaggcccggaggagagactgggtgttctccctgtggcgcaggcgtacaggccaccagagtgagggacaactgtccgaggaggtcgggtacacatactgccgcgaaagggtcagcataatgtaga

SEQ ID NO: 694933 - DNA, 154 bp, Homo sapiens
  misc_feature (19)..(19): n is a, c, g, or t
acccactaagcagctatcnagatatagcgatgtacagactgaatcgatggggatgcagaagtggacttctattactgcagaccaattgggttgctccaatagagttcatgggtgagcaaggtcgaaggtgtgcggttcttcggcttcggccaat

SEQ ID NO: 694934 - DNA, 119 bp, Homo sapiens
gcgaaccagactcccatgctaaggtattacactttgatatagacaatgggatgaccccaatattaaccctttatcttccccctcaaaaatgccaggagtctcccaaactgccccaacaa

SEQ ID NO: 694935 - DNA, 136 bp, Homo sapiens
caacacatcatatgttgttgtttacattgaaattatatgagaatacagagaatgctctgaggatcctgttctaaatacatatgggcttctattctataggtctgaaaaaagcaatgtcagttaatgtcaccaaaga

SEQ ID NO: 694936 - DNA, 615 bp, Homo sapiens
actaatgaagcaatagttggatttccatcaacaaagcacagatgcttgcccacttttgggcaatgacttacattaatttctgaaggcgtctgaaaaggattcacatttctctgttcaggagacatacaaaatcttatgctgctgggtactgtccacgacatcaatccgtgtagtgtataggtagaagctaactgagaagggcatagttattgtgacagcagagttcctcactttctctctggcatcattaaaactatcatgtcacgtaatgcactggctggaactccgtgacagcgtaatttcgaacggctgtcttctcaagctccatcgggagaagctatggcttctctgataagcagaggtgtagcacaccatagcatgacataagcccagctccataggccttaatggagactcagtgtctgcagagagttcactccacagtgaatcagtacagtgtgtcgagcttttcaatgtattcacaaggtgaatccacaaaggcaagtgcaatttcctggcagaaatgggcaaaactgagatctgaaagcaagggtagatgagccaagtgctcatggcagctctcaggtcaggggtatacgtggacctgtatccagg

SEQ ID NO: 694937 - DNA, 590 bp, Homo sapiens
tggagatcgcagtgtgccccatcggggtgtgaaaacaaactttcgcttggagaacaaaggcaaaccaggagaggcccaaaagcctaaaggttcctccccccccccctttcccgcccccgggtgggattgtgggcaaagggggccctggtggcaaccggggaaaaaaaaggggccccatggattgtggtggtcccggtggaaatttcaaaggtggccctggtggaaacaaaagtggcttccctggtggccggggcaaggaccaagggggctttggggaagaaaaaaaagggggccctggggggccccccggcccttttatggaacaaatgggaggaaaaaaaggggggcgtggggggcctggaaaaatggaaaaaggggggccccctcaggagggcaaagatgggcccctttaaaatcaagaacccccccaaaagggctttggccccccaattttttttttaaacccaaaaaagtttttaatttaaaatcccaaatttaaaaagggggccccaccaatataattattcccggggggggcctaaggatttttccccctttgggaaaaaaccttaaaacaagttaaaggggga

SEQ ID NO: 694938 - DNA, 454 bp, Homo sapiens
ttgaagatactcatgtcctaattcccagaacatgtgaatatgctacttcaacagcaaaagggacgttgcagatgtaaattatggacctcgagaccgggagattattctggattgtctggtggacccattgtaatcacaaggttcatataagggaaatagggaagcaggagagtcggagaaggagatgggatgatggaggcagaggttggagtgatgcaattgctagctttgaaggtagaggaagagaccttaagccaaggaatgtgggtggcttctagaagctaaaaaaaggcaaacaaacaaacaaacaacaaccctgcaacagattcttccctagaccctccagaaggaacactgccttgctaacaccttgattttagcccagtaaaattcattttgaacttctaacctgcagaaccataagataataaatgtttgtcattataaactaaaa

SEQ ID NO: 694939 - DNA, 797 bp, Homo sapiens
  misc_feature (29)..(29): n is a, c, g, or t
  misc_feature (143)..(143): n is a, c, g, or t
  misc_feature (145)..(147): n is a, c, g, or t
  misc_feature (227)..(227): n is a, c, g, or t
  misc_feature (237)..(238): n is a, c, g, or t
  misc_feature (274)..(274): n is a, c, g, or t
  misc_feature (280)..(281): n is a, c, g, or t
  misc_feature (283)..(283): n is a, c, g, or t
  misc_feature (291)..(291): n is a, c, g, or t
  misc_feature (294)..(295): n is a, c, g, or t
  misc_feature (300)..(300): n is a, c, g, or t
  misc_feature (312)..(313): n is a, c, g, or t
  misc_feature (317)..(317): n is a, c, g, or t
  misc_feature (326)..(327): n is a, c, g, or t
  misc_feature (335)..(335): n is a, c, g, or t
  misc_feature (337)..(337): n is a, c, g, or t
  misc_feature (342)..(342): n is a, c, g, or t
  misc_feature (350)..(350): n is a, c, g, or t
  misc_feature (384)..(384): n is a, c, g, or t
  misc_feature (412)..(413): n is a, c, g, or t
  misc_feature (419)..(419): n is a, c, g, or t
  misc_feature (478)..(478): n is a, c, g, or t
  misc_feature (481)..(481): n is a, c, g, or t
  misc_feature (500)..(500): n is a, c, g, or t
  misc_feature (535)..(535): n is a, c, g, or t
  misc_feature (539)..(539): n is a, c, g, or t
  misc_feature (560)..(560): n is a, c, g, or t
  misc_feature (563)..(563): n is a, c, g, or t
  misc_feature (565)..(565): n is a, c, g, or t
  misc_feature (567)..(567): n is a, c, g, or t
  misc_feature (571)..(571): n is a, c, g, or t
  misc_feature (575)..(575): n is a, c, g, or t
  misc_feature (577)..(578): n is a, c, g, or t
  misc_feature (586)..(586): n is a, c, g, or t
  misc_feature (589)..(590): n is a, c, g, or t
  misc_feature (592)..(592): n is a, c, g, or t
  misc_feature (597)..(598): n is a, c, g, or t
  misc_feature (604)..(605): n is a, c, g, or t
  misc_feature (607)..(607): n is a, c, g, or t
  misc_feature (613)..(613): n is a, c, g, or t
  misc_feature (615)..(616): n is a, c, g, or t
  misc_feature (626)..(626): n is a, c, g, or t
  misc_feature (637)..(638): n is a, c, g, or t
  misc_feature (678)..(678): n is a, c, g, or t
  misc_feature (684)..(684): n is a, c, g, or t
  misc_feature (705)..(705): n is a, c, g, or t
  misc_feature (717)..(717): n is a, c, g, or t
  misc_feature (735)..(736): n is a, c, g, or t
  misc_feature (748)..(748): n is a, c, g, or t
  misc_feature (751)..(751): n is a, c, g, or t
  misc_feature (786)..(787): n is a, c, g, or t
  misc_feature (791)..(791): n is a, c, g, or t
tttttttttctcagtatgtgcccttgtangattccaaaatgttggagtttctgattctcctgggatcaaaggtaaaagcattgtatggaaacactcaaccttggctcattaccctcctgaggagctaagtctggaggcctcanannnagggagctgacattcacaacttattccaagatgggtaacacagtgaacaaagaattagtaaaacatagactcagtctgtngagggcttcnnatatacatattctatatatttaaacctgttatatangatttnnanttattggnttnnttgtnttttgtattttnngtanaattttttnngttgttgnanactgntgttttcnccttctcagcccccctccctccccaacataaatnactttacataggtcaggtgatcctaagnntttttnttgttgttttttttttgtttttttattcatattccccttcctcccctgcaaactacctntgngagtttgtaacacagcagnatggaatggacaagactggggacagcatgggggtntaanggagggagcgcagaacgttgnttntnantgangggnannagatgggnttnngnatttnnattgannanagaggntnngacagggggnagagaatgtgnnatgcggcttaataataataaaaagagaaggatagatgggnaaatgngaaaagaaataaaggaattgnggtttttggggnaggagaaaagataaaggnntgtattggatangtnttttaaaaatatattggggatgaaatttaattttnnggantgtgtg

SEQ ID NO: 694940 - DNA, 182 bp, Homo sapiens
aaaatagttagccaggcgtgtgtggtgcacacctgggactacagtgtgcctgccaccatgcccggctaattgtgactacactatttttaaggaaaattagttaaacagtaatatgtaaaggtgaattgtaatgtcgaaagatggaaagtaaggaaaccaatcaggcctttaaactggggtac

SEQ ID NO: 694941 - DNA, 166 bp, Homo sapiens
ggggttcagttatgggttgcttgtcttgtttccgcggttgagggggaaacgttggttgggtagggagggagccaggttggagatggcaaggagtttacagagaagcagacagagccaacgtcgaagccgaatacctggtctggggcaccaaccaagttaccgatca

SEQ ID NO: 694942 - DNA, 106 bp, Homo sapiens
gttgtcttagaggatcttcggaggtaatggtgatgaacctgaagaattatgtgggtgaggaggaggagaggaatggtgaagttaaggaggaagggtaccagatgct

SEQ ID NO: 694943 - DNA, 569 bp, Homo sapiens
gcgtcgacagggcttccagggctggctggagaccagtgtgagttcggagagaatggagacccggggattcctgggaatccaggaaaagtcggccccaagggcccatggctagagacggtggcgcaggggccgctggagccccaggccccaaaggtgaatcgggagactacgaggccacccagaaaatcgccttctctgccacaagaaccatcagtggccccctgcgccgggacgcagacaatccgcttcgaccacgtgatcaccaacatgaacaacaattatgagccccgcagtggagagttcacctgcaagtgcccggtctctactacttcaggtaccacgccagctctcgagggaacctgtgcgtgaacctcatgggtggccgggagcgtgacacaggaggtggtcaccttctgtgattatgccgagaacactgtcggggtcagcagcggtggcatgggtctacagcttgagcagggggagaacgtgctcctacagtccacgacaagaactcctatctggcaggagggtgcgacagagtttttaccggttccgggctttcagattgg

SEQ ID NO: 694944 - DNA, 182 bp, Homo sapiens
tgcgatgcttctcacgtagatgctctttcctcctgtgccatctcccctggtgaagtctccgccctggatcatgaagtcctaccaacactgaccaataaaaaaaaatgtgggttttttttttttttttttttttttttttttttttttttttttttttttgttttttttaaaaaatttttaaa

SEQ ID NO: 694945 - DNA, 288 bp, Homo sapiens
  misc_feature (84)..(84): n is a, c, g, or t
atcgccctcatccatgtcacattctccccagagacaaccatctttgcagtttattgtgtttaaatctagcgacattttgtacantaacaagcacaccctcttccaacattttttttttttttggaaatggagtctcgctctgttgcccaggctggaaagcagcggcacaatctcggctcggcgtgatcttggctcaccattacctccgcctccggggtttcaagttgattctccgtgcctcagcctcccaagttagctgggatttacagggcaccttgccaccaaggt

SEQ ID NO: 694946 - DNA, 360 bp, Homo sapiens
atcacagcggacataaggtcaatatcgatctccaggcaccacctgcggctaacgttacgcaacagaggcgatatcattcttatccatgtcgtcctccacaatcgggtttgggttggggaagtcgtatctgtccttccccatgctcaagcactgctgggagacattgtggttgaggtaggtcgcctccatggccaggtagcggggtgaacttgatggaactgaccttcatcttgagggggctcatgggcagactcactcacagtcaggaggtcaaagtctaaagttgtttctgtggtcaaagaagagttaggacccaactctctggacgacaatatcccaggaatacactaagcgggtaca

SEQ ID NO: 694947 - DNA, 194 bp, Homo sapiens
gggcacaagggtgatttttttttgttgaactaaagtttgtgagagtagttttcctttgttacttgaaaaccaataaaagggtgttaactttttgattgatgaaaaaagtccaaaaagcctttacccttggggggccttttgaaattaaccaaatttcatccatatatccttttttataaacttatagaaggtca

SEQ ID NO: 694948 - DNA, 167 bp, Homo sapiens
agaaggtgaatataaggcatatatgcatatcttatatgcggactgtaccctacctctcccccctagacctagcctctagggtagttgtgctgctttccccctacacctgcctccttcaagataaaaccaacttaactatagaaatgtagcatagtaaggggaaagca

SEQ ID NO: 694949 - DNA, 169 bp, Homo sapiens
gctgatcgctagtctaaaatatcatttataaatatactttctaatcagatataattgttctgtctgatttaagccctacactggctcttatttgttctcttcaactaccagcaactcctgtctccctccccaccagtataaaacttcagttaatcctttgcctatcatt

SEQ ID NO: 694950 - DNA, 689 bp, Homo sapiens
atctgttcccttgggtttccgttctttcttaggatggttgccaacccacaatctcattgatcagcagccaatatgggttcgtttgtttcttttaattcttaaaaacatcctctagaggaatagaaacaaactttcttatgagcataaccctatatcaacgacaacaatgaatttctgaccttaccatatataccattaggccttgccatggctttaatgtagactcatagttgcaaattagtgcacgcaaagaactcagatgtactagatttccatcgttcatggcatatgctcagtatgctgccacataacgcatgaatttaattatattcaaccaaagcaatatactcttacactgatttctaggccccatgacccagtgtctagagacattaattctaacgacgtcgtcggcttcttaaatgagtgattccatcctcgggaaacaggtttcaacactgactatatatacatggcgtaaaattactctgtgctacgcgtagtcttactacagacacgtccatggtcccactcgctctctgcccctcgcggcccgccctgccccccgcctcctgtatctatcccgccagctccaccgcatggccaccagcatccctccacacccacactctccacaaccccggtcaaccctcttcccaaaccctctgcaccccaacaaccccccccac

SEQ ID NO: 694951 - DNA, 317 bp, Homo sapiens
tggaaaaaaagtttgcctttgtccccaatggttggggggcggggccacaatttggtttaattgaaccctcaacttccgggtttaagccatttttcttccctaaaaaccgggcaaaaccaaaaaaccaaccccaatttcccccttcccttttgacccttgacccacccccaaccttgatttaaaatccttccacacacccaaacagttttttttcaaacaggcggggccacccaacactttcccgggggtattcccccgccccacggtaccccggcaaaaccccaaaaggggggttcttttagagtgaacctgcggcc

SEQ ID NO: 694952 - DNA, 273 bp, Homo sapiens
gggcaccaaaatacacatcagaggagactggcttccatgagacgcttcgactgtctcatcggggcacttgtaataagcatcttgatgccactgaatgcaatgctgtattcaaataatagctttcatcttcactataaaacaatacaaacgtaaactttgaagccctttgaaggacctaaccaaacaacacaaggatgaaaatagatcagtacaactttgagacacattattaggtcaaatctgcaaagcatattcggattttaccgtaaggaa

SEQ ID NO: 694953 - DNA, 269 bp, Homo sapiens
gcatatttcatagtcccaagtatatcacaggcaaagctgatgttcagagtcagtcgtttgaaagagaccaatactactacatatagatcgcaaagacaattaatccaagaatcggttcagcacctgaaagatgtagaaataattttacacgcaatgagctaacggtatctagtactggactgtgtgccagaggacaggcgtatgctgattgtggcatatgttgattacctggatcgccggggtccacccccaactcctacatgcatcgt

SEQ ID NO: 694954 - DNA, 268 bp, Homo sapiens
  misc_feature (107)..(107): n is a, c, g, or t
  misc_feature (151)..(151): n is a, c, g, or t
ctagcggagcttatgatacaccaacaatagtagaggggtatcattgagaggtgattaggggactctgccctcatgaatgaggtggcaccctgtggaaaaaggctcangggtggccaggcgcggtggctcacgcctgtaatcccagcagttnggggggccaaggcgggaggatcacctgaggtcagcagttttgagaccaacctggctaacatggtgaaatcccttttctactaaaaatacaaaaaattagccagacgtggtggtatag

SEQ ID NO: 694955 - DNA, 101 bp, Homo sapiens
ttcagactgtcacgtaatcatcaaagtattgtacaatatcttttattctgcaatattcgaagtataatttagttttctttttcttttttttctttcgagga

SEQ ID NO: 694956 - DNA, 901 bp, Homo sapiens
aatatgttgtggcttcatggttccgtatcactgatactgctcgcgtgaccccttgtcgcgcctgttatccctatatgggtctctcctccgcacgccactttgcgggcccccgattgctggtccaacctatatgtttcctttccgcccgaaatgccggcttgccttttctccggccaaagggttggggccacatttatgccggtataactggtgggaaaaccacggatcctccttgggggcatcccgcgcttccccggaatccttcaaagcgggggttgcccgcgttgccccctctccccggctccccggttttccctcgctcccccccgtagatgtcgggaacaattaaaacgcccgtgcggctccttgcgaaactcctgtgaggagaaataaaagcgcccccggcgaacacggaactcacatggaaggcgctgggatgtgccccacggaagcaccaagaaccattcttcccaccaagggggaaagagcaccgagcaggtgctcaccaaaagaggaaacagcgtgctagcggacacaggaccacccaaaaaccaacataggggccccccgcctcagttggcgccaaccccccgtggagatgccaccgccacctccggggaacaaggcaagctgggcgagacaccccgaggggtcagatagtcagaaaccccccacggggcaaaacaggggaaaccacccgtccgtctgggtggaagaatacaccaattataaccggcgctctggtgggcaacgcacgaatcgaccccactctcgacaggagcgatgccacacggcaagcaggtttagaaccccgcggaggagggggccatgccctgcggacccagacgcagccgacccgcacccaccccccggggcccaaaacacccccctccaacaaaac

SEQ ID NO: 694957 - DNA, 106 bp, Homo sapiens
gctagagtacacattgcaagcattccctgcttccacgtgagctcgcacctctaagtcaccacgatcacaagggtacaggcatcatgcacgcagcaattcatgcgtc

SEQ ID NO: 694958 - DNA, 268 bp, Homo sapiens
tgccattctccttagagagaattggggtggcttttaggatggcaaggtgactatcctgtaacaactgcatctcatattatggaatgactattagcaaaaacaacaactgtgcaactcaaatgtcctctggacacatttgtgaactattgggtggatgctctgctccaacctgacttgctgtcaccattcacctgttccatgtttttaaactccttgagtcaatgccaaaccaaaataaaaaatacccaaagacaacaacaaataaaaa

SEQ ID NO: 694959 - DNA, 180 bp, Homo sapiens
gggcaggccacgatcagtatacgtgtatcttgtgctctcacaagtatatgatacagtccagtgataaaagatggaggaacaggtgggtcatgccttatattccagcacttagggaggccaagtagggaggactgtttgcggcctggagttcaagaccagtcctgggctacagtggtgaaa

SEQ ID NO: 694960 - DNA, 476 bp, Homo sapiens
agttccttgaaaatacaagtcatgcctgaggaccctccagagccgcctccctccgaagtcattaacggaattacatcaattattcggtaatttttataaatatccattgtctgctaattttttaaattaaaatgtaaacccagctatctacaaattccagaaaaaaacttttctttcttttctttctttcttttttaaatgaacttacttttgagacaaaaactaatgaaaataaccaactcgccatccctggatctttaccattctgggctgcatgctataaatcaatccaaaactaggagcacagatgggggcggacaccttaagataaaaagccaaggtgccccccaaaatgggcagcctgggcagcgaggctcggggtgacaatgctaacccgggcagaggctcgctaggcagccagagagccgcattttccttaccttcgatcgcctgccccccagctgcttctgcggccc

SEQ ID NO: 694961 - DNA, 602 bp, Homo sapiens
tattttccaacatagctagacttgtgaaaatatttttcggaaaattctccaggttactaagaataggatgatgataaaccagtgtgaaaaaatagaaaagggttggataaaggggagtgagagggggagaatgagagagaaggggctctcactaaattcatagaagtgccgcattgattaacattttatgtttatgtttcttttttattttccagctttattgatatatgattgacaagtaactatatatatttaaggtgtacaatgtgatattttgacatacatatacattgtgaagtgattacaacaatcaagccatttaaaataatcttacatggttaccttttttgtgtgtgtagtgagaagagttgagatcctctcagcgagtttcaagtatacaatactgtattattactatttttgagactggtgctctctctctctgtcacccaggctggagtacagtgatgtgatcacagcttgctccaaccttgaactcctgggctcaggagagtcgcttggatctgggtgttagaggttgcagtgaaccaagataatgctacagcattccagcctgggtgacagaacgagactccatctca

SEQ ID NO: 694962 - DNA, 186 bp, Homo sapiens
cctcctgctcttcttctcctcctccccagcatgtgtgtcggggctccccctcctccccggcgcttggagtaagaacccaagaaccccgaagccgggcccgagtgcaagcgtgcgggaggctggcgggcgcggccagctctccagtaactgagcgcggcgcgcagtcccaactaaagtgtgaaagaa

SEQ ID NO: 694963 - DNA, 162 bp, Homo sapiens
caaggagggagctcgtgccgtaaagcttgtggagagctctttcccctaagagcacacgctataacgtctcactgtgcaggtaaggaaactgacacccacaaggcttggggcagcccagaaggcacacatgtggtgtaacgcagcagagtctgagactttcct

SEQ ID NO: 694964 - DNA, 403 bp, Homo sapiens
  misc_feature (164)..(164): n is a, c, g, or t
  misc_feature (187)..(187): n is a, c, g, or t
gaatatattatggatttcttaatgtcggactgtctttgcattcttggaattaactatcttaatcatgatttcttcattaaatttgctactgtatttgatttataaatattttaaattttttcttctttttaaataagtgttattggctctcggctgtattttantgtgctaaaccagggttttgatngttttgtaaaatcaattctgaagtctttcatctttttgtatgctttgaaacagttttgttttgttttttcgtttgttttttgtttggtttggttttttttttttttttcagatggagtctcgctctgtcgcccaggctgggttgcagtgagctgagatcgcccaattacactccagcctgagcaacacagcgagactcttgtctcaaaaaaaaaaa

SEQ ID NO: 694965 - DNA, 106 bp, Homo sapiens
tggccttcaaccaaatcgcggtctgataggtgggtggtgctggaggcaacggttgcgatcagttggtctcaacttttggtggattttaggttcgtgaccgcgaatt

SEQ ID NO: 694966 - DNA, 127 bp, Homo sapiens
aaatcaagtactcagaacaccagactagaagccagaaatggaggctcaagtcctaggttcaatagaacttgatttcaggtcaataacggtcccccctcactccacactggcacgtttgtgagaagaa

SEQ ID NO: 694967 - DNA, 914 bp, Homo sapiens
ggtgcttcgtccgctcggcggtggcccagccaggcccgctgggactcagaccagcggggagcgcggtctccgcccttggggccctcccgccgggccggagacccaagcccccaacgccaggccctgccctggaagcgctcgcgtggccggcgcctggacgggggagttgctgctctttggcgtaaattgcaatcgattagggatcgtttctcagaatcaatgttagaatgtgagagttcatgataagtgaggcctgccattgctgctttgtacacctcataaggggagaatggatttatcaggagtgaaagaagagcgagcttgctaggagtccaggagcgatacactaaaaagtccagcactagggctccttcagcctaccaaagcgcaaagaccgctcagatgagaagtccaaggatcgctcaagatagattatacggggccaccaaggagtcgagctgacgcacatgtgcatcgcgtggcggagacaaaagccgactagaggctcagcgcttccagtggtagcagcagtaccaggtctcggtccagctcgacttccagctcaggctccagagcagcactggctcaagcagtggctccagtgtcttcctcagcatccagccgctcaggaagctccagcactcccgcagctccagctctagcagctcttctggctctccaagtccttctcggcgcagacagctgacaacaggaggcgctcccgttccaaatccaaaaccaacttaaaaggagacttgcaaccgggagacggcaaatggcgggcgcccattctcctaagcccacgcaagtgccatttgcgagactccaccggactgtgccgcaaggatctcgttgtggagaatatttccacctatgggagacttcaatgatggctgcccggaaaggttggtccc

SEQ ID NO: 694968 - DNA, 298 bp, Homo sapiens
ctctgcagttcctttattgaaagaggtgtgctgctgccacggtgcttacacctgtaacccagcactttggagccgagcgagcagatcacgagtcagagaccgagaccatcctggctaacatgtgaaaccctgtctctactaaaaatacaaaaaattagccgggtgtggtggtgggcgcctgtagtcccagctacttgggagctgaggcaggagaatggtatgaaccagggaggcggagcttgcagtgagccgaagatcacgctactgcactccagcctgggtgacagcacgagatgcc

SEQ ID NO: 694969 - DNA, 992 bp, Homo sapiens
  misc_feature (657)..(657): n is a, c, g, or t
cgcggtggctcacgcctgtaatcccagcgctttgggaggctgaggcaggcggatcacgagctcaggagatcgagaccatcctggctaacacggtgaaaccccaactctactaaaaatataaaaaattagccgggcgtggtggcaggcgcctgtagtcccagttacacaggaggctgaggcaggagaatggcgtgaatccgggaggcggaggttgcagtgagccgagatcgcaccactgcactccagcctgggcgacagagcgagactctgtctcaaaaaaaaaaggaatgaaatacctgatacatgcgacaacatggatgaaccttgaaaacatgctaagtgaaagaagccaagcatgtatggtacaattccatttatatgaaatacccagaatagtcaaacggatagagacagaaagctgattagtggtggcctaggtttggcgggaaggaggcaagggggagtgactgctaatagtggggggatttcctttcagggtaatgacaacatgttccgggaaccagatagtgatgatgcttatacaacgcttgtgactggcctaagggccactgaatggtccactttcacacacggttcacactgccacaatttacggtcatgctgtctttccaccaaaagctctgtgacaattctagngaacctttacgtaactacggcattggacctggggagaccacaccaggaagctccctcaagagaggccccaagattacaacttccaaaagaacagcgttttaacctaaaaaagcgcccttacatgacgttaattccttcccccctcttctacattcaaaatccttggatagaatcttgggaaccacactcaagcaaggattcccacctcaggggccgtgggcctcctggaggtactccttatacctgtgacggttaaggtcacacccatctggtcaataccaattataccttacatatgggctggccaattagactccaagggggcccaaggcccc

SEQ ID NO: 694970 - DNA, 865 bp, Homo sapiens
tcccatttggacccaagcgtttatggtcctttaacaacatgtcatttttgggtttataaaaacgtgcttgggtgattagttttctccaacattataactctcaaaagcatgtgttaaaaataaatctcaacctatactctcttcttatattaaacatctccaaccccagggccctccaggaacttttccaaaaaaaaaaaaaaaaaaaaaaaaaaaaaaaaaaaaaaaaaaaaaaaaaaaaaaaaagagagagaggggcgggcgcgcgccaaaatatatttctccccgcggggggcgcccacaacgtcttccagcgcgcgcacccccgcgtgttttgtgtgtgtgaaaagagaggggcgccctcttatagagagagagaggtgtttatatttatatatccgcaacagcacggcgcgacgcggcgcgccgcgcgcttcttacaacacacacagcgcagcaaaaaaaagaggagagaaaacacacgcgggcacacccgcgcgggcgccctcttgtgagagagagaagagagccctctcttttctctgcgggggggggggaggacaatctgtgtgggggagacaaacctcctctctcaagaaattatttataaacctcttcgggcggaaaattatataaactttcttacaggagcggcggtataagggggggggtgcacacccctccgccgcgtgctctatgctgtcgtgcgccgtgcagagaaccaaatttttggcgtgccccacctcgcgcgggatcttattagtatagtcttatcatgaggacgaaaagaaaaacatattttcctattatactcccccccaggggggggcatcacattcagcaaaaccagagccaaagagggggt

SEQ ID NO: 694971 - DNA, 888 bp, Homo sapiens
  misc_feature (697)..(697): n is a, c, g, or t
aacaagtgcgcccccacctggaaggctgcggcaacgacatcgtcagtgcgcgccctgacgagtggctaggtcgctgcgattctcgatgccaccggggtggtctgcactggtgaccacgagggggtgcactataaccatctggagctgagccctggggagtcagtgcaggagggggaccctcatttccgaagtgccctgacagcccagccatgtgcgtgaccctgtgcacatgtaccagcttgcacaaagctttcgcccggagctgaactggaagcgcactgtactcaaggagatccgaggagttacagtgggagatccagtaataccagccatctggccgttgatggggaccgggcgagctgctgtggtcctgtgtggtattccatgcacctatcccgcccgtgactccctgcttatgaggtgctgcgctgggactatcttcgcgggagctgcatgctttctcctgcgccgttggtcaccccgctgtcccactgcgtgtgggctgacctgggctgatgtgggcgatgttctgggtgacagctctagaggagctgaaccgcctgtactcacccggacttgtcggttccagaagcagcagctggtgaatgggtaccgacgctttgatccgtgccggggttatggaactacacgctggacttgcagctggaggctctgagcccccagggaggccgtcggnccctcactcgccgagtgcagtgctccggcggctgaggcgtgtggcagatcttgcctgtgcctatgttactggtggcccacgttcagtgtgcggtgctctagcttggctgagtgactgtgcccgggttctgggggccttggcgctgggctgcctgggtgtttggggccttcccttttttttttccggcggcc

SEQ ID NO: 694972 - DNA, 701 bp, Homo sapiens
gcatcctttctggccttcaagaacaacttagtacacatctccattccgtgtattccacttggagtcctccttatcaccgaaacgagaatgcatacatgttgtgtgtgaagtcatcggtgtatagtctctgcacactgcagcggttggagagaacagtcattcctctggatttgtgtttgtcgtggtcgtgcctggtgtgcgggactgcgtgtgaggaggattaatgagctgtgatgttgcagtagtgatacatagagtagactcccgagagcagtgtatgtagaggactaacaaatgtatctggtatttaagtaatctgaaccagttctggaaggtgactgtgtattgtattactggtgaagagtaagaagaatgtagttaattacaactttaaagagtattccacataacttcttaatttctacagttccctcccttactcttcgggggtttcctgttgcagtaagcaacttttccatgctcttaatgtattcctgtgtagtaggaatccggaagtattagattgactggcaccagcacttgccatctctgtctaggggtcacaaattgaaatggtcctgtatcacatacggaggtcttgtgtatctgtggacaacaggagtttcccttattcactctttatgggctgttgtataaagttgccaaactccctcccaattaaaattcacttacacctctgg

SEQ ID NO: 694973 - DNA, 133 bp, Homo sapiens
accatgtaactgcccaagcctgctagatagaccccgtgggattacataacaacttcatgagtggctgtgtcttgtaattttggggacaggtttctctctttccctctctttttttgtcaaaagcccagagact

SEQ ID NO: 694974 - DNA, 2130 bp, Homo sapiens
ttccggctatctgtggaattacctgaagaaaaaacgcctaacggtggcaaccattaagcgctaggtataaatcagataaaaaacaatttataccataattttagcaagaaaaacggagaatagcaaatgactaacgaggtcacggtaattaacgagtggggctgaagcatacacactagatatgttgcgggataaaaagacggtcgaaaagatgtctgctgagtcgctgcatgatctggcgtatgcgattaagtctttgaaagcaccgatgaaaaatgttgaagacgctgtaaaagcaaagctagatgatggcgtggagattaaaggcatcagttacacggaggctacacgtaaatcattagccgccgatgatgaaaagttgaaaatggcttttgtcaaaaaatatggttgggacgctgtgcaagttaaaacaccaacgcaactagaaaagcaatacggcgaagctatcaaagaagacttggaaaaagttgtcatttatgacacgcagaagagggttaaatatgactgattttaatagtttgtatgaggcgctggccgaaacacaaaataacatcgaacaaccaaaaaaagatgcgagcaacccaatgttcaaatctagctacgtgacattagacgcggttatcaatgcaatcgtcaaagcacgtaaggcgtctggagctaagttctttttcacaaacattgtacaagacggcgtgatgttcacgcgaattatcggttatggggaaacgttggacttggcaggttcaaaagtagcagacgacctaggaaaccgcgggacgaactcggcgcaagcagaggggtcggcgctaacgtatgcacgtcgttatagcctgtctatggcgtttgggatagcaagtgatgtagatgatgacggaaacagtgcaggtggctcaaaacgcaaaccagaggcgcctaagactatatcacaagaaaagttggtcttgttggaaaagttgatcacagacacatcgcaacttagcggacaagacatgatggcgttcacgttaaaagcagcaaatgtcgcagcattgaaatttgttacagaagacaattacaagccgctattagcaaaagtaactgaaaccttgctacctacacacacaaagggtcacaagtcggattagcggcgagtgccagacgcgaactatgaaacacagcgggcaacgtgttacgtgaacgagctaaatgcaccaagttttgatttgcttgatccacgaggcgcaacgcaaccacaaagcaacttagatagcgttgatccgtttgcggcagcgggtaaaaaacaaatcgacatttcagacgatgcgctgcccttctaactggtgacgccatgagagagtttcaggcgtacccaacacaaaaagccggtaacgaaatcatattcaggtttaaagacgaggaaagcgcgaaccagtttttatcaacatttcaactatttaagcaaactttggttgaaattcaagtgagggacgaccgagagattagtgctaagcaaaggcggtttatctacgccatgtttaacgacatcgcaaagtggtctggggacgcaccggaatacgtcaagcagtggtttaaattagcttatgagtattggcaagagttggacacaatttcactgcgagacgttgaaaagtcggtagcggctggtctcataacgttcatgttggacttcgtagccgatcacaacgtgcctttgagttttaaaccactagacgcattagaacctgaagacgttgcacattgggaatatcgggcgctcattgagggatttgacgtgctagatggctcaagaccggttgagttggcccacggcgaacacgcagtcggcatggggcgtgaccgtgacaagatcagcaacatcggcaacacggtatttagcctaagccacacgcatcacatggagcttcacaaaattggattaaacgcatttaaagcaaagtatcacattaacggcgtgcgagtgacggcagagattatcaatgaattagaaaaccgaggcaggcgctttggtggaaatggagagtaactatggatttagtatcttttaagtctggaggactggaatactttgaagcaaagtaggctttgagcgacaaagcgattaagtgcttc

SEQ ID NO: 694975 - DNA, 121 bp, Homo sapiens
gtaacacacccctagatccaggggcaattatgaacgtcattaatgacgagtcatattaacaatattatgggttgcttgatgtggcccaacgtgaaatacatacataatattacctaaaatg

SEQ ID NO: 694976 - DNA, 375 bp, Homo sapiens
agaggatgcgtgaaatagccgacggcactgagttgtacggttcctgctgtttttctggatgactcataccaattgtttatatcatggttaattaagagtagtcaaggccaccggatcaatactgtcacgagacactcttttggcgtaggggagaggagacctgaccttgtgtgatttcccactaggttccaggcactgtgtcacataggcacacacgctaacatatttaattcccacatggaccctgagccaggtaccctcgtcttcctttcacacatgaatgatctcgtactacgagatgtaacagacacatagccactcaaacaaactcaggacccaaactcacattttcctcatccaaaagtcggctaattt

SEQ ID NO: 694977 - DNA, 198 bp, Homo sapiens
tcctagcctctccagtgtcctagcctcgccctgtgtcctagcctcggcggtggtcctaccctcgccggtgtggttgccaagcctgagcctgcctgctaccttcatcaccgaatttgcactcgctcattcctggaatccttttgcctatcttcagcaccaaatcgtgagcgcaccttcgttcgtgcctagattccttca

SEQ ID NO: 694978 - DNA, 746 bp, Homo sapiens
acctgggatggtggagaattcccaagccacagccctttgtctcggggaactcccttcttcacagagaaggaggtgggggctgtgaatggttgttagtttctgaattttaccaaataaagtagaatctaagaagaaaaaaaaaaaaaaaaaaaaaaaaaaaaaaaaaaaaaaaaaaaaaaaaaaaaaaaaaaaaaaaacaaaaaaagaaaaaaaaaaagaaagaaaaaaaaaaaaaaaaaaagaaaaaaacaaaaaaaaaaaaaaaaaaaaaaaaaaaaaaaaaacaggaagacagaggcggggcgcgggccccatatccacccaccgcgggcacaccataccccccctttagaaggagcgacgccgtacgaaggagtggtggttattaaaataaagacgggagggagggcgaggacgactaaaaacaaaaaaaagcggtgcgggaggaaaaaagagaaagaaaaggagagaacagaagcgagagtacttaagcgagagaggaagagaccaaacaccacaatacagaggggggagagagcgaaaagacaaagaaagcgcgagcagaagaccacacaagccgcaaagaaagaataaagttagcgcagcggggcggcggcaacacaaaacacaacagcagagagaggacaatggagcaggaggaaagcaaacaaagaaagcagcgacaaccgcgggaaacaggagaaaagaatgcccgcgagagagaaggaaagaagaacacaaacgcg

SEQ ID NO: 694979 - DNA, 351 bp, Homo sapiens
tcgcggaccctatccagcatagtttttttctctttgaaagatagagattaatacaactactttccaaatatgtcataggttactaagatattgcttagcgttaagtctttaacgtccttttaatagcttcagatttcaagagaatatatgaagacttataacagtagcatgaggaagcgaaaagactcaaggtttctagaacatgacggacgttgagatgaagctgcttcatgcagtataaaatgtatttgacagcaaaattgtgagaatggactacagagccccgaattaataccaatcgaagggcaatgcttttcgatcaaaatgaaggtcacttaccctgcttagagt

SEQ ID NO: 694980 - DNA, 587 bp, Homo sapiens
  misc_feature (312)..(312): n is a, c, g, or t
gcagatatttcggcttcaggaggtggctctttgtgcccgatctctcccggagctagctgggcttcgggcggaccagaggcccacagcgatgacttgatccgtgcgtgagtcgggtcccaggggtttcctcgcgctggcctgtgtttgtctctccgcctcggttcgtcccccttgcaggcgtgtcagcggctggactgagcggtgacctggcgggtcgcgcctgcgctctgccctgtttcctgtctggctggtggtcggcggacattttgttcatcctcctcctcctcctgctcctcctggttggagcgcagngtccggagcgggctggggggagagagcccgagagcagggttcggtgccttttcctctgtccccagccggtgcccagaggccccctccccttcctccccaccctcttcccttcccaaccctgcccttccccttgtcccgtgatcgctccgtcgcacccaccatgatggaagacgacgggcagacccggactctatacctatgtaatctttccagagatgtgacagaagtccttatacttcagatgttcagtcacgattgtaccctgtaaaagctgt

SEQ ID NO: 694981 - DNA, 122 bp, Homo sapiens
tctgatgtctcccgggaccttaacaagactcaggaatcagctgagccttgaaatggtcagagctaacagcgtcgaatctcccaccttgagatcgtccgacagaagaaggacagtgaggctgt

SEQ ID NO: 694982 - DNA, 113 bp, Homo sapiens
acgaggcagaacaacggacggaagaaaaggtctggccggagatgggtctcacttctgtcacccagactggcagtgcagtgagtggtgcagatcatgcttactgcagcctgaaa

SEQ ID NO: 694983 - DNA, 129 bp, Homo sapiens
agagcacactgaattgtgactcagtctcgagagctagctgctgccgggtgacctgatccaacctgataaggtgccatcttcagactaccacatgcaaagaccctgagggcaacagcagcaccaccagga

SEQ ID NO: 694984 - DNA, 190 bp, Homo sapiens
tgttacaggatcttagactaaccaccctacacacagctactacaacgcaggatcgagccgcgttgcaacctacaccacagctcacggcaacgccagatccttaacccactgagcaaggccaggatcgaacctgcaacctcatggttcccagtcggattcgttcaccactgccccagtggggttaggtctg

SEQ ID NO: 694985 - DNA, 170 bp, Homo sapiens
  misc_feature (15)..(15): n is a, c, g, or t
cttgagaattctagntgtcttctaaatgattttcatctcctcctcatggactgaccagattgccagttcctgctgtgagatgttaccccactcttccgccaaggcacctgaaagttcccagacatttctagggggaatggccctagccctcagactccgatccaacaggt

SEQ ID NO: 694986 - DNA, 239 bp, Homo sapiens
catgcggctatcagggagatagaaatccacgctcctccgtggtgtaccacataggttatgttattcagacttgggacccatgtcgtaccaaagttaacaattcaaaatgagaaaaagagaggatgtactaaataatcagtggtccatgtgttgtgtgccgctgtagtggagatgttgatatcgagattaaatctcttggatgaacagagtgtgggtggcaaaatgttcaagcactggga

SEQ ID NO: 694987 - DNA, 178 bp, Homo sapiens
actaaaacatctataatctaggggcacaatgttccgtctcgtttttatgagatagggttgcctataatggagtgcagtagcttgaccatagctcactgtagcctcaacctcccagggacaagcaatcctcctgtctcagcctccaagtagctgggagaatcactggagcccgtgagta

SEQ ID NO: 694988 - DNA, 541 bp, Homo sapiens
  misc_feature (137)..(139): n is a, c, g, or t
  misc_feature (198)..(200): n is a, c, g, or t
  misc_feature (518)..(518): n is a, c, g, or t
  misc_feature (527)..(527): n is a, c, g, or t
  misc_feature (536)..(536): n is a, c, g, or t
caaaatattttttttttttggggggggggggggggccccacaaacccgcgggggggggggttctcctttcttttttttttccccctttttttttttaataaaaaaaaaacaacgttttttttttcccccccaggggnnnctccccccccggggggagaagaaaaaacccttttcctcccaaaagaaaaaaaaaaaaannnttatttatttttttgggggggggggccccaaaaaagagaaaaaaaccccccccccccgggggggggggggaaccacctctttttttttaaaaaaaagtttttccctcacccaacaccccccctgtgaaaattcctcccccgcgctgggggccccaaaaaaaaaacccggggggttttccaacgaagggggggcgaaaaaccccaagggccgaaaaattttttttttgggggattcagagtacccaattgcccccccccctgaatcctttctttttctggggtaagcacagccctccggactttgggatttaggatagnctctggttncctgctccncagct

SEQ ID NO: 694989 - DNA, 216 bp, Homo sapiens
  misc_feature (28)..(28): n is a, c, g, or t
ccgcaacgtgggattcactgggtactcnatgaatataaaaacacaacaatagacactggggactattagagggtgaagacaggctgaagtacaagggttgaaacttacctgttaggtactatgttcactacccgtgtgaggggattattcacatctcaaatgtcagaatcatgcaacatacccatgtaacaaacctacacatgtacccccacgttt

SEQ ID NO: 694990 - DNA, 264 bp, Homo sapiens
tcttaagaggcattaagagttgggaggccgaggcgggcggatcacgaggtcaagagatcgagaccatcccggctaaaacgaattgaagacatgatgcctggaaggagataaacttcaggagttcacctttaagcctaaaaagtaccagcaaaatgcaatgacaggataaaaagtttgtcataaatattttcacaagatggaagacaagaaagcaaagagcagcatagaaagaatgaaggaataaataaaaataagtgaaaatgc

SEQ ID NO: 694991 - DNA, 143 bp, Homo sapiens
aaaaaaagtgagcagactgtgacagaccattcccatcggacaagtggtcgaacccgacatccaagacccagagagcatcacaatgtctcagcgcacaactccgggctcctcgaactgaatccagaagggtgagcacgtcgccc

SEQ ID NO: 694992 - DNA, 223 bp, Homo sapiens
  misc_feature (19)..(19): n is a, c, g, or t
  misc_feature (64)..(64): n is a, c, g, or t
  misc_feature (117)..(117): n is a, c, g, or t
  misc_feature (133)..(133): n is a, c, g, or t
  misc_feature (142)..(142): n is a, c, g, or t
  misc_feature (146)..(146): n is a, c, g, or t
  misc_feature (194)..(194): n is a, c, g, or t
gagagagagagagagaganagagagagagagagagagagagagagagagagagagagagagagnggggtgagaaaggtcctggtccgcgccagagcccagcgcgcctcgtcgcatgnctcggaaaattgaggnaatcaaggncttnctgctcacagcccggcgaaggatgccaaatctgtcaagatcaagaaanataaggacaacgtggaagtttaaagttcg

SEQ ID NO: 694993 - DNA, 258 bp, Homo sapiens
  misc_feature (219)..(219): n is a, c, g, or t
tggactcagtcctcctcctccatctctcccttgatccagtccacgtagttgagcactttgacgtagaagccatagcccctgctgcacccgatgccccaggacacaatgcccgtgacacccagcgatcagtgctcaagtcccttactgcaaaaacacccccactatccccctggcaagcatcttgcttcagagatgggtgtccagcacagaatacgcccnaaaagcacacgttcacaaaaccaaaacaaagcggccaat

SEQ ID NO: 694994 - DNA, 245 bp, Homo sapiens
gctactttcacatgtgcttatgattttggtatagtaaaagagttagaggtttatataagagcctgataaggtatattgaggggctatgagaccttactctacatttgtaatatataggagccttgacattgtgagagttacgctcctagattttgataaatctctaaataaactatgagagatacaccatgaatccccaattgcggttgacatgatagcatatagttcctcccactaaaataact

SEQ ID NO: 694995 - DNA, 133 bp, Homo sapiens
gagtagaggaagcacccgatctaggccagctgaaggtgcgggaggtcgcgtgccccgctgcgctccgtgacctgggtcatggtgcggaatgtccttcttcatgtgaaacgtgacgtggtcggtaaggcggccg

SEQ ID NO: 694996 - DNA, 105 bp, Homo sapiens
atcagaccaggctttggtcgatggacttgcactcaggtaggagacaggccatccttcaaggtccatccagttcactgatttcatcctcagtttccgcacagtgcc

SEQ ID NO: 694997 - DNA, 113 bp, Homo sapiens
catgagatcaagtgcaaggctgcagttgcttgggaggctggaaagctcttctctcatagaggatgatagaggtcgcacccccaaaggctcatgaagttcgatcaagatcattg

SEQ ID NO: 694998 - DNA, 379 bp, Homo sapiens
  misc_feature (6)..(6): n is a, c, g, or t
tcggcnccatgacagcagtcgtctttgtcacccgaaagaaccgccaagtgtgtgccaacccagagaagaaatgggttcgggagtacatcaaatctttggagatgagctaggatggcagggtccttggaacctgaacttacacaaatttgcctgtttctgctttgatcatggtcatagcttgggaggcttcccctcactatcctaaccaacccgctccttgaagggcccagattctaccaagagagaagcagttacgaaaaaccttcacccaggctggaacgtggtgggtcaggctggtaatcccaagaaattggggaggccaaggtgggtggatcaattgagggtaaggagttcgagaccagactgggcaaaatgatga

SEQ ID NO: 694999 - DNA, 226 bp, Homo sapiens
atctagaggacccgttcgacggaacagcagcttcattggctgcaacgcctctctcaggtgagtaaaggagacacgacgggaacccaggggcctaggtgaggatgtcatgggcctggtgctccaccagcatctccatgctcttcacattcgtgcaccagaactccagggcgtcccttcattcccttgatctgttgccaatcccacactcggggctgcacccaggggt

SEQ ID NO: 695000 - DNA, 225 bp, Homo sapiens
gcgattaatactgggtggtggatgggccagtagctaagaagtgggcttttaaagagtgatcaagatggaaagggttttttctttcttttttaaaaaagaaaaacaaactatggatggtagataatgaaaagctagggttggccctcttcaggtctactctccttccaaatagtggtatccaaacacggtttttcccatctcccctacctggagtcccgctggagt

SEQ ID NO: 695001 - DNA, 344 bp, Homo sapiens
cctttcccccaaatttaattatgtttttccgctaaaatgatgatacaagttgaagacccatccctttgaaattggaagacctccccccttaagggtccccagtggcttaatcaactgaaattttgggttaatactctttactttgttccccccttggggggggcagttttttttaaatgttgggagatggcccttttaactactgttgaatgtttttgttttgggaagggataacaaaaaataaaaaaaaatatatattaagggaaaggctggttatctcctcccatatgggtggggttatccttttatgggtttcaaatgaatatttggaggtttgctttcca

SEQ ID NO: 695002 - DNA, 1068 bp, Homo sapiens
aggaccatggttgtcacctgttctcccacagcaatttccacccaatcggttgtctagaatcttctttcattagcacattccctacccctctgccactaggttctagaaatggagctccctgggctcaagttgggccttttcaggaactcgtgggaaccaagacgcgaaggtgagagcttcaagacagtatagcgcccagggaacatggcaaggccaaagtctcagctgagagccttaacgcaaaactcacgtaataggactgctggtttaacaaacgatccagagactgtgcaccgcatgtcgtatcagcactgaagcggcaaagtccatgttccttcgtcgccagctgcgctatcgtacgacgtacgcacatagcttctatggtagccggggtagcatgcgtacgaacggctgagcgcccaggccaagagccaggacatgcgcaggcactcagccaggagcaattgcccacttcgtcgcaatcctggagtgcatccacggaacccctgaagataagtacaagagcaggtacggatgagagccatggtgacatgctcggagcctacagctctgcacctttcagtgactgctggctccctaggctgcctcctggggcagcctaggccacaggtagcgtatgcgattccatctggggatgagacacagttgtaatgtcgtcaccagatggcgtcttaacgtccgctgagtctgtcgttgttagccatatattcttgttcgagtctaagacgacagtggtcttcagctactggtcacaccagggcgtggaatgcagatggcgcaagtctacaactcgaacgcagatcgtagactccatgggctcaagcaatcctcccaccttagcctccagagtagctgggacgatgggcatgcaccaccatacccagctaacttatatgatttttagtagagatggggcctcactgtgttgcccaggctggtatcaaagtcccgggatcaggcgatcctcccagcctggcctcccaaagtgctagggattacagatgtgagccacaacgcccagcccttaaagccatagcactgctcata

SEQ ID NO: 695003 - DNA, 284 bp, Homo sapiens
aaaggggcctggggccctggttccggctgtgtttggtggtttggctccggggaaggggcaaaaaggggggcgggccttttttgcagcattgggcctcaaatccgttttggggcatgagggtggatacagtggtggtggggccgccccccgcctcctcccgaggaagccagggttttttttgggttttcctgtcccaaaaggggcacaattggtttttaagttttttttttccagatcctaatttatgcctatgcaaaaaataaatgaggcccaaaaggtgtgga

SEQ ID NO: 695004 - DNA, 1163 bp, Homo sapiens
acccccccccaatcacacaagagaaataataaatatagtgaagcactagacaatacacatttgcgtatatcttcgtttctagtgtgttttttaccctactatgttcttctctctttaggtgtattcttaatcttactgcttgtgtatataatttcccctgttatcatgttccagtcccttatatggtggtgtttcttttctgctccccctggggttgctggccaccgtgtacctgatggcgaggagcatctggggcacatatgaggtgaatcctgtgcaccaagactggccgatctagcaattctttccctgggggactttcacaactgggttttttttatctccacgactgacatgcggtgtcaccgtggacagccgcgtttgttaaaggaccccggagcatatccattcacagttgtccacagagcaacttccgcgccttttggatcctggatccagcgttaacaatctgtccttcagacgaggcatttaaccccactggttaatggactggtcacccagtttttattttatcttttatgaatctacctttcccttgattgatttaagcttcagccccacttttctgtcttttatttggttactcgttgttatcttgtctttctaagattaggatagctttttaaacagcctttgagaagccgcctgctgaaattgatactgggggaaagggttcccctgtcctttctagagcacgaaaagggagacgaggtgttgtattcctcgtttggtaaccccacgttctcctgtaagaccctcctaccaccactgggcgagtataccccccatcacggagagggtatcctgcctgcatatggagcctcgcttccgacttattcccttccccataattattcactccacgagcttatgccaccacgtgcacccaaacgcacaacctgctagaagagggcacgtgaacacccaccacgcttctccccacgtctaggtgccttttacactccgggtttcgttctccttccactggtgtgttgctgaacacttgtcacctgagtcccactgtgaaggtgctggtgagtattacctttcaatctgtgccatgctctagaaccttgaccttgatagttcaccccctctgatggatccctgttttaaataaaaacgattcactttaaagccta

SEQ ID NO: 695005 - DNA, 877 bp, Homo sapiens
  misc_feature (549)..(549): n is a, c, g, or t
ccctttgtccgctttttgggcaccccatagtagcgaacggtcggtgccaccaacgacgcccgcggggtgtcccgcgtccccggactttcccccggagttttgtccgccaccacagcggtgcccgggcggccatctctcttcccgctgtcacccccgccgctgtggtgtgccctgctgtcaggaagagggggtccccccccccccaattctgctgcccaggggtatcgtgcggcgcgctatatcgcgcacacggcccgcctcttggcgttgttggagcgcccatgtgcgctcgcccttcccccgttcgtgcgccgcgcgcccatgatcatcactgaccgcgcggccctcctcgttggccccccgctcgttggtggccgcgccgttgtgggcgagactgttcccctcactttttgctgttgtgccatcttcggccatagattagctgctctccccgttggtgatgatattcccctctcgcccgccccctcatcatccactaacatgtcgccccgcgcagagccgcatctccccaccccccgcctcctgtgngagggatagatcggcccttcttcttggggagacttttgtcgtccccacgcccgcctacttcacacctcctccgggtggggccgaccacctaatagttggttgccactagggctcctcccttgttgccgccgatcccctatggggacgcccccgttgttgttttggtcacatgcgccccccctatgtcccatcagatgaaggggattgggggagttatatttcttcagagctccggcgcctattggtggggccccccccccaaattttcccccgggtgggggggggttttttaagaggggaaaaaaaaaaaaaaccccttttttaaata

SEQ ID NO: 695006 - DNA, 1349 bp, Homo sapiens
  misc_feature (981)..(981): n is a, c, g, or t
  misc_feature (1059)..(1060): n is a, c, g, or t
  misc_feature (1081)..(1081): n is a, c, g, or t
  misc_feature (1096)..(1096): n is a, c, g, or t
  misc_feature (1287)..(1287): n is a, c, g, or t
  misc_feature (1322)..(1322): n is a, c, g, or t
ggtgggttggtggtgtgtgtgtgtggttgtgcggaggctcggcgcgcaggcggggaggagcagcagaacggagcttaggcgtgtgggatgtatgggtgagcatgttccgacggggtgggcgtgccgtgggggtaggggttgcgggctttctctgggggtggtgggcccgcagcgtggtgtgtcacaaggggcgcccgggtcgcgtgttgggacggttgagggtgtccccggcctggggggacctcgccgggtcgcgtggtgcgggcgagagagagagttggggcgcccggggggtggtcaagggacgcgtgccacgggggggagtgcggtcgccgcgtcctgtggcacatgtggtcgcccgatctcgcagggaggtgttgcggggccagtgtcagccctggtgggggaaagggagcctgttgtcccacctcgtggggggaccccttgcccccctgggtgacaggcgatccgcacccgtggaggggtacaccactttgcccggagccaaggccaactccgattcccggataatgaggagcgtcccaaggggagaaaatcgccaggggaggagccaagggccgatggtatgcgcacatgtgaccgtagggttgcgagatgtggccccacagagacccacaaaccggggtgacccccacaagggatttggtggacactcggcgcccccccagggaccaggggagggaaaggtttggcccaggtggagccctcggattggaggctgggctggccctgctgataggaaggttatattgggttaattgagctggggcacccacccgcgaaagcttgtggagaaatgcgcgagcacccaaagatttctggtgcctgtgtgttgtgccggtgcccatgtggaccagcgcgcttatttaggcacccagatgccagaggaatagtgacccagagaatagccggatttacccctggatcgtttgcccaaaactgggtgtgtttccggattgnaagagagaggtgttggaacaccagaagcgcctctttaccggatcccctggagctgcccattagaatccagaatctttnncccagaactagaagcccaagnttttatgaagggacnttttaattgggaaaatgtccaaaccagccatgatgccccccagcctgctgaagctctttccattcgggagttgcccccagcccctgctccaatgtggagtatcttccaagccctttccaggctgtcccagaatctttccccacccagaacccagccaactaccggctttgaaccttcttgtcatcctcctncctgatgccaaccgggacaccactgaaggcccttnttgaatttctcccaagagtaatagata

SEQ ID NO: 695007 - DNA, 588 bp, Homo sapiens
gttttgattttctttttgtttttctttcttcttcttatttttttcatttgagtcttagctcccatttaagttatgcttctgaccttgtatggtctgtaagcttgcccagaaataagaccactgttttgaactaccacaaaagtataaatgaatattttaatgccacaatctttcctgttgcctgtggagtctctgctgaaatgaatcaggattcgagctctaggatgagacagaaaatgaaagcatgttgtttgccaggacactgtgggtttatattgatgtgtaacaagttgatttggaacactggactctcaattctgtattctggttttgtttattttgtttgttttttttcttttgtaaaggcaatgagcttatcccagaaaggatccttcagttacatacaatttgtttaatgaaaattcatgggctctgtccataatttaggcttgtttttccaaacggtttattacaactttcaaagcccttttgttttttgtaaggttggaatggccccaaacttttgaatagaagcctgggtttcactggtttttggtttagaatattttttgtttttgatattttatc

SEQ ID NO: 695008 - DNA, 115 bp, Homo sapiens
gtaagtagacgggtgactgtttgatcatcataattacctcgtgctctgaactggatacattaaaatggttacaggccattgtgcggcggctcacacctgtaatcccatcccagca

SEQ ID NO: 695009 - DNA, 524 bp, Homo sapiens
cgagtaaaacacagcacgccaacatgcagtatccgctgctttacggatacgcatcagcgcacgcttcttccctggcagggccttgctgactatcttctctctacttcatggccatgtaggagtcctccatacctggctttcttcaggaagcccagaaccttccctaaccagagtactcgttagcaccgtaatactctggagatctgcccccaaagacaattttttacattatggtaagtccagaaattcaaaattttatgtacctagcataacaatattttgtattttttttttttgcatatccaaaagcccaacgtgtttttcctagaacagaaaaaaattatgccacttctctgctaggccttgctagttattccctcctcacatcattactccttggcacaagcaataatcccaggtcactattatcctttgcctcaatcccaaactctgaaacaagagttgtcaggagggtttaagaaaataatgtggccaggcagggtagctcatgcctgtaatcccag

SEQ ID NO: 695010 - DNA, 213 bp, Homo sapiens
cttaaaatctcctcatattcttctggctgtagtggtggctcattgtgaatccattttgttcaacaccgacaattagttgtttcatagcccagtgtgtaagccagaagggcatgctctctgggtctgcccatttcttggaagatacctagcttcaaactatcaccaatcaccagacagcgacaattcagcacagcacagttcagtgacttagga

SEQ ID NO: 695011 - DNA, 259 bp, Homo sapiens
gccccctggggttaaatcatcccaaaactttttaaaaagggccagaattttattttaacccgatgttgagcccctttaaaacgtttgtatgtggggtgccctaattttaaactttggaggcatttttctgtgtgaggccgatcccccccgtaaaggtcctaaaggtgcccgtttgtttttggagatggaattaaacccaataaaaagcttcccctggaggcttgtattggccctggaaatatatgttaatttcgggtta

SEQ ID NO: 695012 - DNA, 114 bp, Homo sapiens
gtactgtaggactaactaactcatctcatatctattgtagctgtatgaactaactaactctctcatatctattgtagctgatagtaccataactaactctctcatttctattgt

SEQ ID NO: 695013 - DNA, 215 bp, Homo sapiens
  misc_feature (6)..(6): n is a, c, g, or t
ctcggnacccctgtaaggctctgtaaccgcatagatggtgagtgggtagaataagcgggaagtagtaatgcgtgaccaacggttacttatgcgcataggtgttacgttgcggtggggtgatgcgtccgcctagcaggtaacaggtacctcgaagggagagcgtatgcgcatcctcatgttaagccatgagacggacaatgcctccgtcataccag

SEQ ID NO: 695014 - DNA, 339 bp, Homo sapiens
aaagccaataattctcggcggtgggtattataacgcatggggctctgaaagtgttgcaaggaacctgctgtgtgaattttgatcaggtcctgggttctcatttaagtgttccaatcactgatatatttgttaccctttgccataagatttaacatgtgttgtatttccagcggttcaaacctatttgtgtcgaatatcaaggattggagcaagagtttctgcctttcagcgctcttactaaaagcttgagatatagtctgccggccattggaccctagtaggaatagcagtctgtgaagagcgaatgggtggaagcagccccagaataccctgtgtaaa

SEQ ID NO: 695015 - DNA, 406 bp, Homo sapiens
gggagagagaaaactttacagaaatttttagacactgctgggaaaagctgagttcatttttttccctgatgaacttagtagtttttaaatcctgatttaaggatgtgatcctagggggtctaatgccacatcttccatttctatctgttctccctgcctgctggtataatgctgtgcatatgtcagatgctgaacaagtacctattatttcagtagattgcactgtgttttttgaaaaaacattttataagccatagcaaaaagaaggtaacttggccaggtatggtgctcaagcctgtagtcccagcactttgggaagctgaggcaggaggatcacttgaggccaggagttcgagaccagcctaggcaacatagcgagaccctgtcttcaaaataaaaaataaaa

SEQ ID NO: 695016 - DNA, 131 bp, Homo sapiens
agcggagatcccagaagtggttgtttccttgcattgggacgaaagcttggtccaagcatccaggctcagggaaaacatggcctgctattgcagaatacccagcgtgcatatgcaggagaacgtcggagtac

SEQ ID NO: 695017 - DNA, 156 bp, Homo sapiens
tcggcaactgcttcggatgtcggcaactgcttcggatgtcggcaactgcttcggatgtcggcaactgcttcggatgcggcaactgcttcggatgcggcaactgcttcggatgccgcaactgcttccgatgccgcaactgcttccgatgccggaact

SEQ ID NO: 695018 - DNA, 175 bp, Homo sapiens
ccagtcggggtgacagtaagaccatgtctcaaggaaacaagaaaagacaagaaaaaaaaaaaaaattgggcctaacctaggggtccacaattattgttccttaatactttattctaaaaagtctataaagtttatagctttgggttttggggtgtcaggggtccatttgggagta

SEQ ID NO: 695019 - DNA, 280 bp, Homo sapiens
ttaatccagcagcatggcttaacggggctcttacccccatgccgaaaacttgctgtagggtaaataaaaaaggaaactccttcatggagcccttggactatctatgtaaaggctttgggccttaaaaaaagtggtaattatgatcttaataagtttaagagatgatgcttggctgaagatcccaaaacattaaagtctggctcttgggcaacttctggtcttccttggaggctatcatggtgtcctgatggtttcacacatgtctgattcacagccttct

SEQ ID NO: 695020 - DNA, 209 bp, Homo sapiens
atcacagcactcgtgagtgtaccaggccggtggatcataacggcaggatgtagatagaaacagattgctcagtattatgaggccctgggtcaaataaaaatgcacgaaattatccgggcacagtggcatgttgcctgtgatctcagatactcgggaggctgaggcaggagaatcgctggaacctgggtggcagaggttgcagtgagccg

SEQ ID NO: 695021 - DNA, 462 bp, Homo sapiens
tccctctatgtatgcaggcgtcttctataatagcgttagaactgtagacacatatccttacgaatcattcatggtgtttgatctttctatgcgacatgactttaagtcagttaacaaaacatgtctctgtagacagtaatagttagataaaatatgaacagttttaaaatggcactgaatttacatctttaatcattttagataggccatccacagcctctcttgtgtctctaattctcaatctccgattcttaaaggctgtaaaggctcacaaagtgccagctcatgtgggtctctgtaagtgtctatgtcttcatagacgtacatatgtgctgtatacacacacatacatacatacataaatatactttacaatcaacagatgtgcattgtcagatccaatgttgattctggcatctggataaccaagaaagctgcttttaggtgtctggacaactttgt

SEQ ID NO: 695022 - DNA, 257 bp, Homo sapiens
cataaacacctgaggagcaagatctaaccagagacaattacttcaactaactctagagattaccagatggcgaaaggcagatgtaagaatcctactaacagaaatcaagaccactcaccatcatcagaatgcaacactcccaccccacctagtcctgggcaccacaacacacccagaaagcaaaggggaggaaggatagagtgaagcacttagggtgggagaaccgagaaggggggggcaacatttggagtcgacgc

SEQ ID NO: 695023 - DNA, 124 bp, Homo sapiens
  misc_feature (39)..(39): n is a, c, g, or t
  misc_feature (43)..(43): n is a, c, g, or t
  misc_feature (45)..(45): n is a, c, g, or t
  misc_feature (48)..(48): n is a, c, g, or t
  misc_feature (75)..(75): n is a, c, g, or t
  misc_feature (94)..(94): n is a, c, g, or t
gcacgaggtttaaataaactatatagtaacaatgaaaanacananaanagactgaggtggcagctgcccagaatntttgtggattaccatagtntggtttaaataaactatatagtaacaatga

SEQ ID NO: 695024 - DNA, 280 bp, Homo sapiens
ctctgcacgcaggcttgagcaccagggctaggaacacccccaaccgagaacgagcacgaggatcctctgcaaccaggcagatgactgccaaggctgtagagggcatcacaggggccatgcacacgagagcatcgagaagcacagagaccaaatcggaaccacactgccgagccccactagaaagacagagcctcaccagtaagctacagagacgaaaccgatgatcacagagcagacaacagaagaaacaaaacacaccagtaaaaatatagaacataca

SEQ ID NO: 695025 - DNA, 1566 bp, Homo sapiens
  misc_feature (1530)..(1530): n is a, c, g, or t
tgggaatctacggcgagccccagcaggtcagcaacaagtttatttggcagctagcaaggtaccagggtagggcagtgggttacatgtgtgttcaggttcaacttctcctttgggtcggtgggtggaatggggttgtggtcttatagtggggggggggttaggggaaagcaaagcaaaagtataacagtggagtgtgggtgtgcagccctcccgtgtgtaaaacccggtggtgttccagaaacgcttgtggggacagatccacccggtggctcgtggagaccggctcattttctcttggaacatctcacggtgtgttatttaagaatgtctcaaggatatattattttaaagaggaggtctccacgtgtgtgttcgctggagaaggggagagatatcagggggatatcttgtgtggccaaagatctccacacagacacaaaatctccacgcgtgtagaaaacacacgtcgtgtgagatagtagatagtgacagcgagataccacagagatatataatccccagagggggggcgcatatagatgtctctctcatatagcgcgcgcggggggccccgagggaaatctccgagatctcagcgggggcccccgcaagagggcccatatataacaccgaggagagacacaacactatataatactctctccacaggcgcgagtgtgggcagagagcaccctcgcggggagagagacggtgctatacacacgtggcgggagggggatgaggaggcgatctccacaccctactcatccagagatgatagaagagtactacaccaagaagtgctcaccccgcgcgccgcggagagacgaaaaacacccgcgggtgtggtacaccaaaatatatagccgccccacgtgggggggatcaaaaacacgccccaacgcgggggggagtccccttactcgacgaaacacatattttgtagccgcagtcgcatccaaaactacatagaggcagaaatgaccccccccttttttgtgtatgcgccaccaggagaggatctcctcctctataattgtagaggcaccaattgtttatatcagccacagaaaaccaaaaatgggttgctccccacacataaaaacaaaccagcgggctaatgcgacacacaatatctttacccaccgggtgagcggtccgtagaaaagccccacatcggtgagggaaaagcaacaaaacacaggacggaactactcagaggcgacccaccaccaccaacagaggggcggagacccccacagatgcgctgtattacaacaccacaacaacaaaacaacataaaattcaccccagagaggaagagtacaccatcagggcgtgacacacaggagggggcaggggggagcaccctattctccaaacagaagcgccgacaataatatgcagcggcccatcgagatggtggcgcacaaacagcgccccccactctctctacgtgcggcagggcacgaccaaacactttgtcggcacgcatacatcgaggcacaactctcgcccaactcccccctnaacaagagccacacaaaacgggacaggcaccccgga

SEQ ID NO: 695026 - DNA, 213 bp, Homo sapiens
gagcctggccagtccattcacctgctacagtgatggaatctaagttacttttgacaacaaatcgtccttgcatacactttttatttgctcccaaaaaggcgttatttccatactaagatctactattaagacgataaattgcgttaagagcgattatgggatattccttctaaactgtcaagtatgttttggtgagcgggggatccgtctagt

SEQ ID NO: 695027 - DNA, 1244 bp, Homo sapiens
  misc_feature (449)..(449): n is a, c, g, or t
  misc_feature (465)..(465): n is a, c, g, or t
  misc_feature (783)..(783): n is a, c, g, or t
gacaggagtcgtgaataactagcccgtaaaagccaagagatgggagaaggaaagagattcatatcaacatagtcgtcatcggacacgatagaattcggggcaagttccatccatgtacttgggccatctgactctattaacatgcggttcggcattcgacagagaacgaaccaattcgacaatagattgtgacgaagggacggctggctgacgagtgggaaacgggcgtccgtgtcgaaggtagtgcgcatgggtcgttgagatatagactggagaatgctgacggcgtgacatcgtggtcagtcacccagttgactatctcctgtgctggatagatgtagtagaaccagcagagatactagtgtggagctgaatcatttggatggacctcacaggcagcatcagacgcagctattatgcaagagacaacatgcacttggagcagcggnaccggtcgtacatggnactgagcgtgagtgcctgctgcgctgaactatggttgcactggctggatggttggctggaagtcttgaaagactggatagtctcgcaagaagtggcgcagaacccggaggagcgatgcgcctgtcatggactctacatcgacgtgggatgatgaagagcaacacttcagtagggtcggatggttgaactgaagaatggagatttccactctggagccaagccgtacagtgccaggaagagcatactgcaggaacatcggttaacggcacaggtcaagcagcgttaacagtgttagcgatacacatttggcgtaacaancccctggatgacagataagcactcttggtgccaagttatctgggttcggcaatggttgaaccaagcatggctgggcagaccaaagtgctaaacatggcctttggaatcaaggggcatggacacagtccacccgggaagggattggcaatggccagtggaaccaccgcttgcttgacggctcctgggacgtggaatcctacaacagcgcaactcggtccaacaggaaaaagacccgggagcccttggcaacctcccaaggaccggtctaccacaaaactgggagggaactgaggaacggggtcctgggtgggcccagtggagcaacagggcgtacacaaaaccaggtaagcgagacaacgattgaccacagacaacggaaagaccaaaagacacacaacagaaagacagcaaaaaactatgagagagacaccagagaaaacgagaggtcactcaaaacgacg

SEQ ID NO: 695028 - DNA, 285 bp, Homo sapiens
  misc_feature (73)..(73): n is a, c, g, or t
  misc_feature (77)..(78): n is a, c, g, or t
  misc_feature (89)..(89): n is a, c, g, or t
  misc_feature (106)..(106): n is a, c, g, or t
  misc_feature (144)..(144): n is a, c, g, or t
  misc_feature (171)..(171): n is a, c, g, or t
acgttgacgaacaagtaagtgaacacattagttgtatgaaccacttattacgatactcgctgatcataaacancctnntgtgtaatatntttttctcaaaaaacgnagcacccttcagcaggaccctataaaactttcctccancccttgcctctttgcaggtagcccctnctctgctgagctgcccactgcaacatattttcacaatttctctaataaatctgcccttctttacctacaactatcttggtaaatggctttaccacctgcaaaactgaccctagg

SEQ ID NO: 695029 - DNA, 212 bp, Homo sapiens
ctctagcaggatctcttacacgggagcagatgttgcagggttctgtgagcaagattgcacactgcactccagcctgggtgacagagcaagtctcctgctcagctccccagtagctgggattacaggcatgccgcacacacccggctactgtttttgtatttttaatagagatggatttttgccatgttggccagggtggggataccaggggg

SEQ ID NO: 695030 - DNA, 125 bp, Homo sapiens
tatttattaattatctattaataatattaatatatattaatatatttttatataatatataatataaaatatataataaataagtagcctagtaataaaagaataccagcctgggtagtcacaga

SEQ ID NO: 695031 - DNA, 492 bp, Homo sapiens
gcgtttatgtctattaataggagaacgaccatgggcgcgctatcgcacctgcgggtactggatttgtcgcgagtgctggctgtggcccttgggcccgggcagatactggctggacctcggcgctgaagtgatcaaggttgagcggcccggcaatggcgacgacacccgtgcctgggggccgcccttccttaaggatgcctatggtgagaacaccactagaggcggcgtattacctatcggccaatcgtaacaaggagtcggtgacgatcgacttcacacggccggaggatcagaaactggtgcgtgacttggcggcgaagtccgacattactgatcgagaacttcaaggttgggggctatgagcaggcctaacgggctgaactatgagtcgctcaaggagatcaatccggagtaagatctactgtactattaccgggtacggtcagactgggccctatgcgacaagggcgagctacgaattcatgatccagg

SEQ ID NO: 695032 - DNA, 541 bp, Homo sapiens
  misc_feature (166)..(166): n is a, c, g, or t
  misc_feature (214)..(214): n is a, c, g, or t
aatggtgccaggtggattattcggctgcggaagggctggccctcccgttgctgggagatctcattttggccatgctgggggcacagtttcatggttggggagaagatctgtggggctgtggtgtctgtcccctttcaggaagacattatttcaatatggaataagnctgccagtgaccaagcaaccacagcccgaatccgggacacacttcggngagtgcttaacctacctcccaaccccattatggaatacaaaactccccccgccagcatcaaaatgccaggcaggttgggcccccaaaggctcctttttcaaaacctttggaagccgcggttgaatgtgccatgaccctctccctttttggatggccccatcattgaagctggggtcatcggagtttcttgttttgttggcgtgcaacctggaaaatccttctgtcctggccaaaaggaattggaagagcattttttgttttaagaacaggctgccccccagcagctccaccaacagctgagatcccttaataaatggtgttaaacta

SEQ ID NO: 695033 - DNA, 1268 bp, Homo sapiens
  misc_feature (953)..(953): n is a, c, g, or t
  misc_feature (961)..(961): n is a, c, g, or t
  misc_feature (1010)..(1010): n is a, c, g, or t
  misc_feature (1016)..(1016): n is a, c, g, or t
  misc_feature (1018)..(1018): n is a, c, g, or t
  misc_feature (1055)..(1055): n is a, c, g, or t
  misc_feature (1077)..(1077): n is a, c, g, or t
  misc_feature (1102)..(1102): n is a, c, g, or t
  misc_feature (1104)..(1104): n is a, c, g, or t
  misc_feature (1106)..(1106): n is a, c, g, or t
  misc_feature (1131)..(1131): n is a, c, g, or t
  misc_feature (1149)..(1149): n is a, c, g, or t
  misc_feature (1153)..(1153): n is a, c, g, or t
  misc_feature (1161)..(1161): n is a, c, g, or t
  misc_feature (1169)..(1169): n is a, c, g, or t
  misc_feature (1173)..(1173): n is a, c, g, or t
  misc_feature (1177)..(1177): n is a, c, g, or t
  misc_feature (1182)..(1182): n is a, c, g, or t
  misc_feature (1184)..(1185): n is a, c, g, or t
  misc_feature (1187)..(1187): n is a, c, g, or t
  misc_feature (1190)..(1190): n is a, c, g, or t
  misc_feature (1192)..(1192): n is a, c, g, or t
  misc_feature (1194)..(1194): n is a, c, g, or t
  misc_feature (1198)..(1198): n is a, c, g, or t
  misc_feature (1201)..(1201): n is a, c, g, or t
  misc_feature (1204)..(1204): n is a, c, g, or t
  misc_feature (1255)..(1257): n is a, c, g, or t
tttctttctttcagacacgacggaagaaaaagagaagagaggacagcggggagagagggacagagacgtgtgatttctgatgtgtgtttttcatgtggtcgtgttattctctgctcttcattttgtggcctttcgtttatgcagtctccctctctgtgttcaatcggctctattttctagtttctacttattctttgcacatgttatgtgctctgtccttcctggtcctcggtgatatcttttcgagcgcgtgtgttatgcatgggcgtggattcttttcttatttcggtcctgtgctcacatttccagatggtgtgtgccctgttcgtggtttacccagttggcaaggccttcctagagattttctaagtgttcttggaattgttttataccctggtacccacctgtcgttaaaagcccatgtgatcaggatgctgtttctgccttagctttgtgtgagaaccctgtcaccttgctcctaggctcaatgacgtcgtagctcggtgcaatattgaccttagttcttatagcatactatgcatccctgaacatgctatcatagtccattgtagcaatgattgccttcgatttctctttctcaattctgtgtgctgctgtgtgtaagactgccaattaagtacactggtttcattccatgtaacgcattaaacagtgtatcgtaggtttcaagagattgtgatgattcttaaattcttgaactaccttcacttaatacgcttgaaactgtcgccttaactatgttaagcatctagactaaaagccaacaatcataattattgctgcctttctaaaacaccctaaatgtagttctctattaacctgaaatgtacactagcccagaacagtttaatggtacttactgagctatagcatagctgcttagttgtttttgagattttttagtcaacacataatggaaacttctttcttcnaaaagttnccagtgccacttttagaagtgaatcactatatgtgatgtaaaagttatnacactnancaggataaacttttgactccccttttgttcattgtgngattaagtggtatatacttaantttggcatttgactcttaagattangnancctagctactttggatggtcttagnatatttttctgatactgntccntttcctgnctcctccntgcnaacnaaatnanngntgncncnttanccngantttttttcttctgtcttgacaccgtctactctaagtacatattacctagtnnncccccctccca

SEQ ID NO: 695034 - DNA, 243 bp, Homo sapiens
cggcatgcggactgtaggagggagcatggatacaaactgagtgctgaattcgggcggtaacgggggtagctcatcagctgcgttgaagtcttctgacggtggaggaaaatcactctcgatgtcgaagcctacagggtaatagtccgtatcgacggcgtttgcatatgctgagtacaggggtgtctgctcatcaatcacctcatagctggtgaactcttgtatgcccgtgagaggaacgctagg

SEQ ID NO: 695035 - DNA, 1270 bp, Homo sapiens
  misc_feature (953)..(953): n is a, c, g, or t
  misc_feature (961)..(961): n is a, c, g, or t
  misc_feature (1010)..(1010): n is a, c, g, or t
  misc_feature (1016)..(1016): n is a, c, g, or t
  misc_feature (1018)..(1018): n is a, c, g, or t
  misc_feature (1055)..(1055): n is a, c, g, or t
  misc_feature (1077)..(1077): n is a, c, g, or t
  misc_feature (1102)..(1102): n is a, c, g, or t
  misc_feature (1104)..(1104): n is a, c, g, or t
  misc_feature (1106)..(1106): n is a, c, g, or t
  misc_feature (1131)..(1131): n is a, c, g, or t
  misc_feature (1149)..(1149): n is a, c, g, or t
  misc_feature (1153)..(1153): n is a, c, g, or t
  misc_feature (1161)..(1161): n is a, c, g, or t
  misc_feature (1169)..(1169): n is a, c, g, or t
  misc_feature (1173)..(1173): n is a, c, g, or t
  misc_feature (1177)..(1177): n is a, c, g, or t
  misc_feature (1182)..(1182): n is a, c, g, or t
  misc_feature (1184)..(1185): n is a, c, g, or t
  misc_feature (1187)..(1187): n is a, c, g, or t
  misc_feature (1190)..(1190): n is a, c, g, or t
  misc_feature (1192)..(1192): n is a, c, g, or t
  misc_feature (1194)..(1194): n is a, c, g, or t
  misc_feature (1198)..(1198): n is a, c, g, or t
  misc_feature (1201)..(1201): n is a, c, g, or t
  misc_feature (1204)..(1204): n is a, c, g, or t
tttctttctttcagacacgacggaagaaaaagagaagagaggacagcggggagagagggacagagacgtgtgatttctgatgtgtgtttttcatgtggtcgtgttattctctgctcttcattttgtggcctttcgtttatgcagtctccctctctgtgttcaatcggctctattttctagtttctacttattctttgcacatgttatgtgctctgtccttcctggtcctcggtgatatcttttcgagcgcgtgtgttatgcatgggcgtggattcttttcttatttcggtcctgtgctcacatttccagatggtgtgtgccctgttcgtggtttacccagttggcaaggccttcctagagattttctaagtgttcttggaattgttttataccctggtacccacctgtcgttaaaagcccatgtgatcaggatgctgtttctgccttagctttgtgtgagaaccctgtcaccttgctcctaggctcaatgacgtcgtagctcggtgcaatattgaccttagttcttatagcatactatgcatccctgaacatgctatcatagtccattgtagcaatgattgccttcgatttctctttctcaattctgtgtgctgctgtgtgtaagactgccaattaagtacactggtttcattccatgtaacgcattaaacagtgtatcgtaggtttcaagagattgtgatgattcttaaattcttgaactaccttcacttaatacgcttgaaactgtcgccttaactatgttaagcatctagactaaaagccaacaatcataattattgctgcctttctaaaacaccctaaatgtagttctctattaacctgaaatgtacactagcccagaacagtttaatggtacttactgagctatagcatagctgcttagttgtttttgagattttttagtcaacacataatggaaacttctttcttcnaaaagttnccagtgccacttttagaagtgaatcactatatgtgatgtaaaagttatnacactnancaggataaacttttgactccccttttgttcattgtgngattaagtggtatatacttaantttggcatttgactcttaagattangnancctagctactttggatggtcttagnatatttttctgatactgntccntttcctgnctcctccntgcnaacnaaatnanngntgncncnttanccngantttttttcttcttttgggttaaggccaatcctaataaaaaaggaataaaaaaggtcccttttagct

SEQ ID NO: 695036 - DNA, 387 bp, Homo sapiens
  misc_feature (23)..(23): n is a, c, g, or t
tgagctctcacatggcaccactnttgactcttctgcttccctcttctacactgaaaacttatggccaggagcagtggctcgcacctgcaattcccagcactttgggaggccgaggaaggcagatcgcttggccccaggagttcaaaaccgtcctgggcaacgtggcgaaaccccatctagaaagaaaagaagagaaggggaggggggaggggaggaggagttacatatatacacatacacacacacacacacgtacgtacatacatacatacacgctagctggacgtggtggtgcgtgcctgtagtcttagctttccaggagactgaggtgggaggaccacttgagcctgagatcgcgccagcctgggtgacagtcagaccatgtct

SEQ ID NO: 695037 - DNA, 202 bp, Homo sapiens
cccctttaatacagtatcgtaaaattgaattttatagtaagcaagcgcgtctaattaatgcaaagccgcttaatcgcgaagggcgtattatgctatatgcctcgataagccaatgcgcaagtttaagagaaaatccctctgcaaacagccgccacgatctgaccttaattatccgcggatacacgacctcgtcataaatgat

SEQ ID NO: 695038 - DNA, 298 bp, Homo sapiens
  misc_feature (183)..(183): n is a, c, g, or t
gcaaggtgaaggagcaagagctcacatagaagctgcagcaagttatccagagatctagctaagatcactggtaaaggcggctgcactcaacaagagattttcaatgtagatgaaaaagctttgtattggaagaagatgccatgtaggactttcatagctagagaggagaagtcaatgcctggnttcaaaacttcaaagaacaggctgactctcttgttaggggctaatgcagctggtgaccacaagtttgaagccattttgtcattctgaaagtcctaggaccctttaagattttatg

SEQ ID NO: 695039 - DNA, 1530 bp, Homo sapiens
cgcttggctgcgcccccccccacttgttggtggtggtggcgtatggtgggtccgtcgcgggctgtgtttgttgctaggctggttgttttttcttgttgtcgttgggcttcccacgcgctgtcggtggggtctgcactcctatgttcgtgtttgttgggttgtcgtcccgtcccctcgctcgtcttggtgcgtcttctggcttgtgttgtcgtcggtgtggggcgtacccgttctcgccccccaccgtcgtggcggtgagcgtacgtcgttttgggtgggggggttggcggtggcacgtctgcccctcggtctggcgtgtaggtggtgtagtatagtagatggccgcctaccgcgtgtcgcatcttgttttgcgtccacttcgtcggggttcggtcgcgcgtctgttcaccctcctctttagtgtttggttcactacgtctacgtctggtgttgtggtggtcatcatcatcaccagctctcctccactctgcgggggtggtgttctcttaagtatcttcctccagctcgtgttgttgtcacctcttcgttgttttattatgcgtgttgttcccctccgcctcggggaggagagccgcttcgtggtcttgttgtttgatcttgttgtcgtttcctcgcgtcttgtctattagtcgttcttattggtgtcttctttcgcccccgcttgtggtgttccacacatctcttcgcgccccactccgcccccgtgttgttgagttcttccttctgtcgtggtacgactccacccacctcactcgctcgtctccacactactcctcactcaccacccacagcgtgtggttagaccgcgtggtgtgtgttagttttgtctgtagtacacatcataaatggagataacaacatcatcacctcgtttcccacagtctatgttagtattatatagaataagaggagcaatatatatattctcttgtgtatacattgtggtgcgcattatgcacatcagatcgccaatagtgcgttttgttagtatacgatgttctcgtgtgtgggtttagctcaacacagattggatatcgcctgggtgggcagttcacacagagattgatatagagacacctcatgggagcacacagattgtggacccacaagacactcgttagtgtatagacaccacgtgtgtgtgttcccacaagagtgagagaggattccaccctgtggtggtgattaccgccttgtgggtagaaaggcgggtcctgatccctcgcttgttgtgccacccacacacgatgtgtgtcgtttttgttggtggtaaaataatattataatgccttggtgttattatcccttaaaggataaaataaataagaaagttaaaacttcgtaggcagttaaacgctcgggggcgtagtatatagtatgatgggtggcccgtgggtgaatggtgtctggtgtgtgttggtgattagggtgaggtgatggttgatggttatagatggtaattgttgcagggagtgagatgtgatgagggtggatgtggtagtgttggtg

SEQ ID NO: 695040 - DNA, 116 bp, Homo sapiens
  misc_feature (75)..(76): n is a, c, g, or t
ggggccgcctactactactactactgctcgaattcaagcttctaacgatgtacggggacatggtacgtattctcnngcacagtctgagcaattaaatagattcataagcaaaaaaa

SEQ ID NO: 695041 - DNA, 498 bp, Homo sapiens
  misc_feature (246)..(246): n is a, c, g, or t
tgtatgagaagaaaaagacctctttaaagcaacgtaaggaacgcaagaacagaatgaaggaagtcagggggactgcaaaggccaatgttggtgctggcaaaaagccgaaggagtaaaggggctgcaatgatgttagctggggccacttgggatttttcgcaagaacattaataaactaaaaactccatgtgaaaaaaaaaaaataccagactacatatattctaaacaaaaaaaaattaaaaaaancaatttcagggactttaacctgtgaacatcccagcggcaggacacggggggtcctgtttattcctcaggaatactgaattgccctggtttaagctgccatctttttgtacaatgttatcaacaatgctctaaactccagcccctggatatgcattttgcccccttttaacctcttcgtttttaaacccctggggaatacccatctttggccccttgaaaaaaacccccctttcccgcaccgggtgatattaa

SEQ ID NO: 695042 - DNA, 667 bp, Homo sapiens
tcaggtggcctggtcataggcgactggcaaggccccctgtcgagacatctgctgttctctcatccgcatggagagaggccctcggctcacgtgttctccgacggagtgcatgggagcgcgagcggctggcactgccccgcagcacgacccacggcctcgcaagccgggatcggcaatcgcgccgctggagcccaggccgacggacaaaagcctgacacggccggacacccacctagccccacgctgcaccgaccgccacgcacccccttctcccaccctcaggccacggactcccacccctgcaatcccgccctcgcgcccgccggcccccctggacaccagactgaccccggcagcggagctgacaaccaggtcccgtccaccacaacaataatacttcccccccaacttcaccatttcccttctgcacagatgcccactacccaactacggccgcaaaaccggtcctatcgtgacatttctccctcagcacaacaattccattattgacgacagtcttgacgaccctgtcattacagctcctcaccatctggtcaagcgccaacaccattacaacactacacatacctgacgcaaatcgatcctactcacactgcccaccaacaagaaaccatgacacctcactgcccacaccctacatcgccgc

SEQ ID NO: 695043 - DNA, 597 bp, Homo sapiens
cgggttcaggcgattctcctgcctcagcctccggagtagctgggattgcaggtgtgcgccaccacgcctggctgatttttgtatttttcgtggagaccgagtttcaccatgttggccaggctggtctcgaactcctgacctcaggtgatcctcccgcctcggcctcccaaagtgttgggattacgggcgtgagccactgcgcccggcgtaattttgtttttagtagagatggggtttcatcatgttggccaggctggtcttgaactcctgacctcaggtgatccatcttcctcagcctcccaaagtgctgggattacaggcgtgagccgccacgtccggctaacaagtacttttttatttttattttattttttggatggagtctcactctgtcgcccaggctggaacacagtgagctgacatcgtgccactgcactctagtctgggtgacagagcaagactccatctcaaaaaaaaaacaaaaggaaattttggtaaacctaggtggtttttaaccaacagaaatcagttccagtttgggaggctggaaaccccaagttgaaagccccggttagattgcaacctctttggtaaggg

SEQ ID NO: 695044 - DNA, 245 bp, Homo sapiens
gtagtattctcactgaggctggggttatggtgtcgtcaggtagagtgtggtttcagtgtcgcctgggctgctgtggaaggttgtagattgttgaccaagggatgaggctgtggtactgccaggggacaatgttgtgtctgtggggcctgggctgctgtgggaagctgtagattcctgactgaggcctggcatggtggtactgccggggaatgctgttgtgtgtgttgagccgtcgtaggcagtga

SEQ ID NO: 695045 - DNA, 127 bp, Homo sapiens
tctgggggtttctgcccaccagtaagagcagagaaagggtcggagcatggaaataagggattggggtgcagacataagaggttggggcatggaagtaagggattggggcacagagataacaggttgg

SEQ ID NO: 695046 - DNA, 871 bp, Homo sapiens
cattgaatttggaagatttctgaactacgataggaaatattaataagaagaattaggacacgcttcagataagtgtacaaactacgctttagaacatcttcttagaaagagatgactacaaacaaacaggagacaatttataccagcatgtacgctcagaagatcataaatctgactaatgtagaagtgaaaaatacttaatcttttaagacatgaacgcgtgattcgaaaatggaggtcccatatccaagaactttcttgtatgtttcacgagtgaacagagcttagaaaccaagattgccaagtggaaacctgccaatcagggaatgaatatagacatgatggctatagtgatgaaagaagcacgttggcaatagaacatctgtagctttaaccatacacaggacctcttaaggtttacagaacaaaggcttgaccattttacaggagctatttgaaaagcttacttcccaaatgagagatcaggaagccaagttgtctgaaacaatttcagcttcctgagtgcctgataagtcattatgagacaattgtatagataaaagcgaattggaagtactgattgaaacaatgagaaagcagtcattaatcttttggacgatcctgaagaggatgggccgatcgtggggaaaaaattctggtgaagaaattgcttgaaaagttcactcagtgattgaaatgagactctgaatcttgggaattcgcgattaagactacacttgcttggttgaaggtggagtggtccgcgggaataactcccgatgccgagtgaaaaagaaccttgagtgttaccggtccatgcaagcgttaataacgctcatgcttcaagcctaaccaaaaaaaaatgggcccc

SEQ ID NO: 695047 - DNA, 765 bp, Homo sapiens
aggaggtggcgctcgcagccgccgtctcagtccccgtcgccgccggctgccaagacccaggtaggaggcggcgcatgcccggtgcgctcgtggctccgcgctgccggcgccccgccaccccgacgcagcgccccgatccggcgcctcccgtcctcacgcccctctcccagtcttctgcatcccctctacctctgcccacaagacggcgcgtccctctcctggtgcccctctccacagactccgcgttgccctcccggtgccctctccccgagccactctcccgagcaaactgggtaacaagcgggcgagagaagagagcaaccagaccagaaaaaaatagagaaaaaagaaaaacaaaaggaaaacagaaagagacaccaaaggaagaggaggcaaagcgacaaaaaacacaacaaaaaagaaaaagacaacacaacacagaaaaaaaaaaaaaaacaaaaaaacaaacagaacagcgccccaacaagaaaaacaaagaagagaagaaaaaaaccacaggagagaagaacaaagaaaaaaacgagaaaaaaaaagcaaaacaaccgcacagcaggaaaaaacaaaaccagaaaggaacaaaaaaaaaacaaaaaaaaaaaccagggacaaagaaaaccaaaacgactaagaaaacaacgcagaagaagagagcaaagatccacaaagagggagagaaacacaaaaaggaaaaacaaaacaaaaacaaatcaaacagagaaaaggacgaccatagaaggcagcagc

SEQ ID NO: 695048 - DNA, 279 bp, Homo sapiens
accctcgttgataatctcacatgttggaggaaagttgaagagacgatgtgaactatggtgtagccatgggcatccaagaatgagatatgtatgttaggttgcatgtcaatgacagtgaagtccacgtagagttgaactcccgcaacctttaccttgagggtaatggtacccatgatctccctcttagagttgtcaaagcctttgacaaagaggtcggatggagtgatcatgtcgcgagtcactccaatgcgtacagcggtacgcataacaccacacaat

SEQ ID NO: 695049 - DNA, 227 bp, Homo sapiens
tgagtttcttcagcaaagcctaaaaaggaacaatagtaagcacaatcataacacataaaccacgttaggtcaaggtgtagcttatgggtggaaagaaatgggctacattttctacataagaatacccaccatacgaaagttttatgaaactaaaaaccataggaggatttcgcagtaaatcaagattagagtgcttgattgtataaggccatgaagcacgcacacac

SEQ ID NO: 695050 - DNA, 1224 bp, Homo sapiens
  misc_feature (69)..(69): n is a, c, g, or t
agcgcgctctgagctgcccccagtgtccctcccccgccgccagcagcccatttggagggaggaagtaangggaagaggagaggaaggggagcctggaccgactacccagacagagccggtgaatgtgtgtttgtgtgtgaccctctgaccacgaaatattataaaaatcaaaggtcgagaacaagatcagtgcgcatcacaaccgggcacgcatacgaacgagagcacacatgcaacctggaacagagcaacaacagaacaaaacaggcctaccacgcgcccccacgaaccaacggcccaaccaagcgacacaagaaaaggccaccaccaagagaaacacaaaaaagagaaacaagagagcacacacaaagaaagaataacctaaacgaccaaagacacacaaccagcaaagaacaaacaaacaaacagaaggaagaaagaaaggacaaacgaacaacaccagagagacgaaccaaacacaacacagaacacaaaacacaaaacagacaaacaaccaaaaccgaaaacgagacagcaacgagaaaaaaaaaaacaagaacacacacaaacagaaaaaaacaagaaacgaacccaaacaaaaacgcacacagacaagacaccaccaaaaggaaccagcaaaaacacagaaaacaccaacaacaggacaaacagcaaaactaacaagacctacgacaaccaagcccatagagagacagacaacaaaatcacaacctaacaggccaagacactagacaaacagaatagtgagaaaacagaaacaccaaaaagacaacaaaaaacactcagcgcagcaacaggggaacaacccagacacaacaaaacacaagcgacccgcaacccaagcgacaacaccaagcgaaaacaggcacccacacatcgacacaggaaagcgagacaaaataggagaacgacaacacacggagaacaaggaacaacacacagacagaacagaacgcaggaaaacagcagacaaaacaaaacaaccacaagaacaacaagaaagagacagagaggaggagaaacagaaagagaacaagcggaaacaaagaaaaaaaaaaagagaagaaaagcacaaaaaaagcaaaaagcgctaacaagcgcaaagaaagaaaagaggagaagagaaagagagacgaaccaacaagaagacaacaaaaagaaagaagagaagacagccaccgaagagaggagaagcgagacaag

SEQ ID NO: 695051 - DNA, 246 bp, Homo sapiens
acccagcctttatcacacagcgaatttgcgcaatgactatcaacatgagttttgagattgggcatatgcctttatcctgtctgctataattacataattacttttactgctgttctttctttttgtgggcactgcacgtatcctgtagggtcacttactgtcagcctgaagaactttctttagtatgtcttgtaagacaagttggctaggaacaaattgtctcagtttttcttttgaaggagaaat

SEQ ID NO: 695052 - DNA, 243 bp, Homo sapiens
ggggggggggtttttcccttttttccggggggggggggtctttaacccattccccttgaaggggtttcccaagctaggggggggggtgggtccccggggtggttgggggttcctcgcccccccaatttactccccaatttaaacccggggggggggggcaaccccccaccgggtttcccttttttttcgggggattggggggttttccagggggtttttttttttagggggggattttcccca

SEQ ID NO: 695053 - DNA, 682 bp, Homo sapiens
gcagccaccagcagccagccccctccgatacacctcccgtcctctcctacagacctgcacccctcccccagattagaacgacacactcctacgcaggacggaggacagcccatcattagctcccgaaatcacacctacatcgaacgagccgcctactcatcgaacaacagcagagacagacagaaggccagaaatgacacacagcaaaccccaaaaaatccccacggagcagctacgggcacagcacactcacgactaggagaccacaccacaagaacgacgcaacaatagcacaactgcatcaagacccaaacagaggggctggaaacccaagaacaatccacaaacaaaaaagaccagaaagccgcaacaaaaagggcaccagcgcaacgctgatacaaccagcaacacactgaagcacagaacaaacaagcaaccagaatacacaaaccacacgcgatatgacaccagcaacccagcaccccacaacaaagcccagaacagcaaaagcccgcaagaacgcaacaagcacgcacacaacgcaaaacagcgcaacgcgccacgggacacacacaagccaaaccacccgaccagcagccacacagaagacacaagcaccctcaccacacaaatagcagagagaccaaaaaacacatacacaacccggaacaacaccacaaca

SEQ ID NO: 695054 - DNA, 126 bp, Homo sapiens
gctcccatgatgagatggatttgatgctgaggtggctatttgaaaatcatgatgagaaggatccagagttaatgctagtaagactgctgacaaaaagctcaagcttgggaaggaagatgacagttc

SEQ ID NO: 695055 - DNA, 624 bp, Homo sapiens
  misc_feature (2)..(2): n is a, c, g, or t
  misc_feature (85)..(85): n is a, c, g, or t
  misc_feature (95)..(95): n is a, c, g, or t
  misc_feature (98)..(98): n is a, c, g, or t
  misc_feature (100)..(100): n is a, c, g, or t
  misc_feature (102)..(102): n is a, c, g, or t
  misc_feature (105)..(105): n is a, c, g, or t
  misc_feature (108)..(109): n is a, c, g, or t
  misc_feature (111)..(112): n is a, c, g, or t
  misc_feature (121)..(121): n is a, c, g, or t
  misc_feature (125)..(125): n is a, c, g, or t
  misc_feature (142)..(142): n is a, c, g, or t
  misc_feature (165)..(165): n is a, c, g, or t
  misc_feature (186)..(186): n is a, c, g, or t
  misc_feature (254)..(254): n is a, c, g, or t
  misc_feature (262)..(262): n is a, c, g, or t
  misc_feature (283)..(283): n is a, c, g, or t
  misc_feature (319)..(319): n is a, c, g, or t
  misc_feature (322)..(322): n is a, c, g, or t
  misc_feature (337)..(337): n is a, c, g, or t
  misc_feature (345)..(345): n is a, c, g, or t
  misc_feature (355)..(355): n is a, c, g, or t
  misc_feature (372)..(372): n is a, c, g, or t
  misc_feature (403)..(403): n is a, c, g, or t
  misc_feature (407)..(407): n is a, c, g, or t
  misc_feature (412)..(412): n is a, c, g, or t
  misc_feature (440)..(440): n is a, c, g, or t
  misc_feature (447)..(447): n is a, c, g, or t
  misc_feature (463)..(463): n is a, c, g, or t
  misc_feature (471)..(471): n is a, c, g, or t
  misc_feature (489)..(489): n is a, c, g, or t
  misc_feature (500)..(500): n is a, c, g, or t
  misc_feature (503)..(503): n is a, c, g, or t
  misc_feature (518)..(518): n is a, c, g, or t
  misc_feature (520)..(520): n is a, c, g, or t
  misc_feature (522)..(522): n is a, c, g, or t
  misc_feature (525)..(525): n is a, c, g, or t
  misc_feature (531)..(531): n is a, c, g, or t
  misc_feature (544)..(544): n is a, c, g, or t
  misc_feature (547)..(547): n is a, c, g, or t
  misc_feature (550)..(550): n is a, c, g, or t
  misc_feature (553)..(553): n is a, c, g, or t
  misc_feature (573)..(573): n is a, c, g, or t
cnccacccccccagccccctgcaggcagaaaggaatcaggtgctcctgggctattgaatcactttaggcttctctggactgtagntaattttttntantntnttnttnntnntgcgtgtantacntgtttgatactttttanttttaggctgcgagggtgcgccnttttgaattggcttctctttncgcttttgctgctgcgacggtttaatttacttattttatagctgctacgcgcgagagagcgacgcgcngccgcctngcgcgcaaatgctttttgcanttttgcagcgcagcaagcaaataatttttttgcganatngcgcggcgcagctantgcgcacngcagtaattnggttgtttgcaaagcgngcagcatgcaggcattggcaaattgcgcatnaatngcatnggcaccctttattagcgcaaatgcattngctctgnttatgcgtgcgctcgncatgcagncgcttttttcgcaattangctgcgctttntgngcagcgcgcttttantntntgnttaatnggcattttaaagngcntgngcntttcatttgcaagcacatgncattgggcattttgcttgctaatgcaagcacctgcattttatgcgcctcag

SEQ ID NO: 695056 - DNA, 563 bp, Homo sapiens
  misc_feature (6)..(6): n is a, c, g, or t
  misc_feature (15)..(15): n is a, c, g, or t
  misc_feature (563)..(563): n is a, c, g, or t
tttttnatgttaaantatttttttagggtaaaacccctaagggtttattactaaaaccaataaaaatttcccatttataccgatttgcttttcaaaaaggggtttacttatttattcagggaacatttcctgaatatttaccaaccaagcctttagtcaacatctgctgcattataaatgtccctaaagggtttcccaaaacagacttgataattaattggaaaatgatactggaagttatggggattaggtgcaaagttttattaccttatacagccgtgtttatgattaccataaaacatacaaaaatgtttttatattaatataatactaaagaagttcaatgcttggaactattttaatgggcttctgacttaaagaaaatttacttaggtacaataacaaagttgtaattggaatcataggttactaaaatagaaaataaacttcatagggtacgatttatattaagcccacataattcattctaaaggacaggcttgggggttacatttagccctatatggctctttatgagttctttggaaagcatatatgaaagn

SEQ ID NO: 695057 - DNA, 127 bp, Homo sapiens
tgtggccctatgggcgttcttacattttgaatgaatgtgttatgagtacttgggactccactgaaaaaaattagaagaggccaagagagtaggatgaagggcctctccatacagggggaatagactg

SEQ ID NO: 695058 - DNA, 820 bp, Homo sapiens
  misc_feature (218)..(218): n is a, c, g, or t
tgtcacagaagtccttgtgatactccagccataatatacatcgagcttctgggattgtgcttgccatatatgcatcaagctctgaacaaaggaagtatcgaagatgcagggctataatcatcatggtatagtttgcatgccatgcacatacatacgttcatcgaaaatctgtcattgttactaggtagccaattatgatctatttgaaacgcgtgacnattaaaaatatcttggcatgatctagtacgtgatatcaataaagaaacatccaatctaagtaaatcttagtcaaagcattgatgtagtctaggtagcatcaacacgaagcgctatatttgctaacatactctttttggcactctctgcagtttcttctctgctactcaaggccccatctcaaagtatccacctctattaccaacttgctcctactaccaagtcagtttacgctgttcctagaaatctatcattttatcaaatctacatgctctcttattgaatagcatatttttaattccacctcgcagttgagatagccctgcataaaaactatgcacttggaaacacaataatagtattaactaactagatctattgaatttcagagaagagccttctaacttgtttacacaagaaacgagtatgatttagcattcatactagttgaaattttaatagaatcaaggcacaaaaagtcttaaaaccatgtggaaaaattaggtacttattgcagatttgatgtctctcaatcccatgtattgcgcttatgttacaagttgttgtcacagtttgagatttaatttctcctaattctttgccc

SEQ ID NO: 695059 - DNA, 164 bp, Homo sapiens
  misc_feature (136)..(136): n is a, c, g, or t
agagaaaaaaaaaaaaaaaaaaaaaaaaaaaaaaaaaaaaaaaaaaaaaaaaaaaaaaaaaaaactaataaatcctatcgatcccgttgaccttgatgttgaccaggtaatcccggaaattcccgtccgggccttncaggctttccaattttccgtatagtgag

SEQ ID NO: 695060 - DNA, 309 bp, Homo sapiens
tggagagttcttcaagataatatgaaaaatagaactaccatatgatccagcaaccccactgctaggtatataccaaaagaaaggaaatcaggccaggtgtgatggctcatgcctgaggcctgaggtcaggaattcgatatcagcctgggcaacatggttacaccctgtctctaataaaatacaaaaattagctgggtgtggcggcgggcacctgtcctcccagctattctcagaaggctgaggcaggagaatcacttgaacccgggaggcagaggttgcggtgaactgagatcatgccattgcattgtt

SEQ ID NO: 695061 - DNA, 191 bp, Homo sapiens
aggctcatatactactatcatactaccaagctctggagtcaagacctgtgaactatactatattcacctgctgtctgtgatgtaataaaaccagagataactcttttcaatgactaatatttattatagaattactcaatatagcaaagaagtatccaacataaaagtattggtaggtatgatgaaggacg

SEQ ID NO: 695062 - DNA, 218 bp, Homo sapiens
ctgttctagaggatcccgagaggtgggacatgggctgtgtgtgtgtgggtcaggtgggctgttgggctgtgtgtcgggtcaggtgggctgtgggctgtgtgggtcgggagggctgtgggctgtgtgtgtgtcgggtcaggtgggctgctcagaggctgccatcattctgattgctaatagcatcaattggttttgcctgttactgaacttccttgttt

SEQ ID NO: 695063 - DNA, 431 bp, Homo sapiens
taactgggattacaagcatgtgccaccacatctggctaatttttgtatttttggcagacagtgtttcgccatgttgcccaggctggtctcaaactcctggcctcaagtgatctgcctgcctcggccttcctaaatgctgggattacaggcgtcagccactgcacccagcctaaattaacttttatcgtaggcatctagggaagtactatttatgtaccaaacttgggaaaattgagaaaacagtcactaattttttctattttgtggttcaaatcaggaacccagttgaaaaaggctggtttagagtaattggctggttgtcgtggctcacacctgtaatcccatcactttcgggggctgaggtgggaggactgcttgagctcaggagttcaagaccagcctgggtaacatggtgaaaccctgtctctacc

SEQ ID NO: 695064 - DNA, 115 bp, Homo sapiens
accttctagtcccctggggtggctgtaagtagctcctcatttcaaccttccttcttctcctgcagaatatatggattttagagaggcacaagaaggaactgatgtcatttattga

SEQ ID NO: 695065 - DNA, 252 bp, Homo sapiens
  misc_feature (24)..(24): n is a, c, g, or t
  misc_feature (58)..(58): n is a, c, g, or t
  misc_feature (197)..(197): n is a, c, g, or t
  misc_feature (212)..(212): n is a, c, g, or t
  misc_feature (251)..(251): n is a, c, g, or t
ggtccattcagttccccaagctanccactgccccatccccaggggatgtgcagcaatncctggagacatttctgcttgtcgcaactgtcagggggatgctattagtatttagtcggtagaggccagagatgctgctaaacatcctgcattgcacaggatagcccccaaacagcaaagaattattcaagctcacaatngttgacaagctttcnagggtgagaagccctgcattaaaagctggcgttgtttant

SEQ ID NO: 695066 - DNA, 135 bp, Homo sapiens
  misc_feature (3)..(4): n is a, c, g, or t
tannagactgaggcctggtcgggcacgtgaggcctgctttccacccagtgtaagtgaggaaatggcttccaagccatgcgacaccaaggtgaaccttgtgacatctggagtcgggcgggagtgatgacgtggtgg

SEQ ID NO: 695067 - DNA, 791 bp, Homo sapiens
gctgagaggctctactatgctatgaaaggtgctggcacagatgactccaccctggtccggattgtggtcactcgaagtgagattgaccttgtacaaataaaacagatgttcgctcagatgtatcagaagactctgggcacaatgattgcaggtgacacgagtggagattaccgaagacttcttctggctattgtgggccagtaggagggattttttttttttataattgaaaaaaaatttctattcatagcttatccttcaaagcaatgacctgcttgcagcaattttcaaacttcagctaaccgaaagagctttctggcagggaccgtatcaggggtaatggtggctgggttggcacttgttggttattggccttaattctaatttaattggggtctctacttacattcaaggtaaagccatttcacaaggatccggtaatatggcaaggttggtaaaccttcattcttactagttgcattctaatcaaggaggtcaacttggctttaaattcacagcaatctccgaaaaaaccacaacgacaaaacaaacaaaaccttgggggcggcggttgggctccggaaagcttttcaagccattccgggtggcgagcgggggcccagtagttactgacaacgggccacacacgcgtcccagaggacacccgggaccagcccggggccggtgttctcccaaataaaagggcgggggacccggcgtctttaaaacccggaggcccggaagccggggccttccccgggcccggggccataccgccccggcgccggcgg

SEQ ID NO: 695068 - DNA, 110 bp, Homo sapiens
taatgagctggtaccgattagctcgtagacgggcaggatgatcatttgagcaggagttaacggttacagtgagggtaataatgactgtgtggtgattgtagatattgggt

SEQ ID NO: 695069 - DNA, 481 bp, Homo sapiens
gcaagcaagagagaacatcgccatgtctcacttattgtgagatctaaaaatcaaaacaaatgaaatcatgggcagagagtagaaggaaggtaccagaggctgggaaggggtagtcagggttgggaatagttaatgggtaaaaaaaaattagaataagatctactattgattgcacaacagggtgactatagtcagtaataatagcatatttttaaataaagaacgtaaaaattagccaggtgtggtggcacacctgtagtcccagctacttgagaggctgagacatgagaatcgctagaacctgggaggtggaggttgcagtgagctgagactgcaccactgcactccagcctgggtgacagagcaagactccgtttaaaaaaataaataaaataaaaaataaaataaaagtgtaattggattgtttgtaacttagaggataaatgcttaaggggatggatatctcattctccataatgtg

SEQ ID NO: 695070 - DNA, 141 bp, Homo sapiens
tctcttgaggatccgcaacaccctgctatgtgggccgtcccctgctgctttgggggggcaggcagaaatggactccttttgtgtcccgatgtggggtccctcccagccctgcatctccgtgcctgtagcggggtgtttcct

SEQ ID NO: 695071 - DNA, 831 bp, Homo sapiens
  misc_feature (4)..(4): n is a, c, g, or t
  misc_feature (112)..(112): n is a, c, g, or t
  misc_feature (155)..(155): n is a, c, g, or t
  misc_feature (178)..(178): n is a, c, g, or t
  misc_feature (200)..(200): n is a, c, g, or t
  misc_feature (203)..(203): n is a, c, g, or t
  misc_feature (261)..(261): n is a, c, g, or t
  misc_feature (264)..(264): n is a, c, g, or t
  misc_feature (270)..(270): n is a, c, g, or t
  misc_feature (308)..(308): n is a, c, g, or t
  misc_feature (312)..(312): n is a, c, g, or t
  misc_feature (316)..(316): n is a, c, g, or t
  misc_feature (346)..(346): n is a, c, g, or t
  misc_feature (691)..(691): n is a, c, g, or t
agtnacgtactcttgcaattgcccgcaacctaactcagcagctccagaccacgtgctacaccctcctgtccaacatccaaggtgtaccacagaacatccaagatcaagccangcacatggggtgatggcaggcgacatctactcagtgttcccgnaatgctgcctcctttaaagaaanaaaaaaaaaaaaaaaaaaaacnagnaaggagcagctgcagaaaatgaaggaatctttagatgacgtgatggattctcttgttnacnacacanaaaaaaaatggctggtaggtccattttatcctcagctnactnagtntcagaatgctcaggaccaaggtgcagagantggacaagtagcagccaggagacccagtcgatctggagcataaaactcattaaagcctgcccctatcactagtgcatgctgtggccagacagatgacaccttttgttatgttgaaattaacttgctaggcaaccctaaattgggaagcaagtagctagtataaaggccctcaattgtagttgtttccagctgaattaagagctttaaagtttctggcattagcagatgatttctgttcacctggtaagaaaagaatgataggcttgtcagagcctatagccagaactcagaaaaaattcaaatgcacttatgttctcattctatggccattgtgttgcctctgtnactgtttgtattgaataaaaacatcttcatgtgggactggggtagaaatctcggtgtctgctctggtgtgatctgacaaggcgtcttcactgctttatctcatgatgcttgcttgtaatacttcctggagtttgtcattt

SEQ ID NO: 695072 - DNA, 299 bp, Homo sapiens
gcggatcacttgagttcaggagttcaagaccaacctgggcaacacagtgagaccccttctctacaaataaaaaaattagctggacgtggccaggcgcagtggcctgtaatcccaggactttgggaggttgaggtgtgagccactgcacccggctattgctggcaagattttaaaagaaatttacagtctttataaaatagtcaaaatgttatgttacaagaactattaacattctcaatgcacaggccctcaatattaacacatttagggttgaaatcttggccaataccaaaaactgc

SEQ ID NO: 695073 - DNA, 114 bp, Homo sapiens
gaactgggcagatctcgcgcgccgccctctatctggaccaggaccagtcggtgctgagccgccgcatcaacgcgctggaacgcgagtgcaacgcgcggctgttcaaccgcaccg

SEQ ID NO: 695074 - DNA, 209 bp, Homo sapiens
gcagtatcgtgtccttatggtctagactgtccgagatctcatggttgcattttggccacatagaatatcacgacatattcgatcttgcgtttttaagcattgaaattcatgtatgcttatatagtaaaaatgaaaacatttcaaccatctaagtcaaacacaaaaataataaaataagaaacataccagccttgggtccggggatcctc

SEQ ID NO: 695075 - DNA, 355 bp, Homo sapiens
agccccaaaaaaggggagggaagaaaaagctgccaaaaccagtagagatagcagagggcgctcccctagaaaaaacgctagtgaaaaagaagaagaagaaagattcccaatggatccttcccagccggggcctttcggcccctcagctgtcagggccctgcgggggcagacacctttggcctgaagtcccaacaaagttccccccagagggcctgggggcattttgtggcatgcccatggggtgccgagtcctgccctctcgccccctttccccccagttacattcccaggagggcccttttaatgttttccatcgtgggtttcagacccaaataaatttttttgttaactctga

SEQ ID NO: 695076 - DNA, 276 bp, Homo sapiens
ctacctatcactatcatcttgccttcattattgcagccctagcagcactccgagcgtccatattcttgcacagaaaacgggatcaaacaaccccctagagaatcacctcccattccgaataaaatcaccattccaccctatactacacaactcgaaagacgccctcagacttaacttctcttccgttctctccttgagtgacagttcacacgtattctcaccagcacctcctagagcgacccagtacacattataccctacgcctctagtattcag

SEQ ID NO: 695077 - DNA, 122 bp, Homo sapiens
tggccgtggtccaacttctgtaatggctctcagtgcagatggctactatgcccgttccgaggactacgtggacattgtgcaggcgcggcgtgttggtgtctggaatgtgccctatatttcaa

SEQ ID NO: 695078 - DNA, 190 bp, Homo sapiens
tatacatgatacaaccatagcattcaggaagaggtgaacagctgtctctcttcctgattattccaagtcagatatcacttaagaggtatttccacctttactgaattggatccaggaaataaagataagcatacatagatttttaactcttaatatattgagatgactgttctaccctgtctaattcaat

SEQ ID NO: 695079 - DNA, 432 bp, Homo sapiens
  misc_feature (83)..(83): n is a, c, g, or t
  misc_feature (127)..(127): n is a, c, g, or t
  misc_feature (395)..(395): n is a, c, g, or t
tggcagtacgtccacttgtacagcgcatgattcggcgcagtataccaggcggtacaactaggtaaaatgttaactatagcggntaaccgggctgaaactgggtggactacgcgctttagggcacagncacgcccactgcgcgtttacgcagggtgtatgccactggttagtggccctgtggcacgtcagcaggcaacatgtggctagtattgtaccaccagcacttggtgcgggcgggttgccgtggttgggcaacaatcctggtggtggccctgtgtaacgccactcgcggtggtgttgtgtactcccaagtaaaaaatactaggggtgggggcatttgggcctcccagtctagccacgcaacagccaaactgtgcgaaggtatttttagtcgnccccgggtttttgaacccccctcctcccacccaaccg

SEQ ID NO: 695080 - DNA, 166 bp, Homo sapiens
acaaaccacacaagtagcagtcatatcacaaacacggggacacatatgcctacacatgcacagacatgcatgctaacgccttccaatatggcagccaatggggctcttgctgtggtcagtgagaatgggttggtcggcatgacagattctgagagggtaccgcagc

SEQ ID NO: 695081 - DNA, 627 bp, Homo sapiens
gcttgaacttgggaagcggaggttgcagtgagctgagatgtgccattgcgctccagcctgggtgacagagcaagactctgtctcaggaaaaaataaaaaataaaaataaaaaattaaaaaaacagttgctaagagctgtgttagatgcttccaaggccacacaagggaacaccccagtcacctcttcgacttcatccctttccattccctctcatctctgcctcaattgcattggcctcccttttgatcttccagtaagacactgggtgcactcctgacccacagctctcacgctggccctggcctccccaggctgctctttctgctctgtgtgccttgtcccctcccccactcctttggtcaaatatcaccttctcagtgaggccttccctggagtccttcttaaagttgtaacactcctggctctggctatcacatccccttttcctgatgtatctcttttcctgatgtatctctttctctctctctctctttttttttttgtaaatagatgaggtcttgctacattgcccaggcgggctttgaacttgaactccgtgggctctagcgatgttcctgccttggcctcccaatgtgctgggattacagcaggagacaccaacccag

SEQ ID NO: 695082 - DNA, 358 bp, Homo sapiens
gctaatccacttagcccctagacctcttagccactagcctcttatcccctatcccccaactcattctctcctaaccccttagcccctagtccctaacctcttagcccctatctcccaactccttcgctcctaaccccttagcacaacggtctcttttcaccctctaggctttattaacgccccatcactgtactgtgagtctggccctgtggtctgcaatttttgcctgcagtaacagcggctccctaagccctagccactacagcctgcagcaacactggcctcgtccagaaacaacccttgacccctaatccactcagatgtccactcagatctacataagtgtcgaggggctaag

SEQ ID NO: 695083 - DNA, 734 bp, Homo sapiens
cacagtggctcatgcctgtaatcccaacactttaggaagccaagccggcagatcatttgaggtcaggagtttgagaccagcctggccaacatggtgaaaccctgtctctactaaaagtacaaaaaaattagccaaacgcggtggcacctgcctataatcccagctattcaggaggctgaggcaggagaattgcttgaacccaggaggaggaggttgcagtgagctgagatcacgccagtgcactccagcctgggtgacagagcaagactccatctcaaaagaaaatcaaatgaaatagaaagcagaaaaacaatagagagaaaaactggtcctttgagaagatcaaaaaaaaaaaaactcggtaacctaaatggatcaggaaaaagggcaaagggcacaatttaccatgggtcgggaatgaggaagatgacttcattacatattctacagattttaaaaggataagaggtcactattttgaaaacttttatgccagtaaattggatgacttaagtcaactgtgcaattcctttaaagggcacaaagtggtgaaaatcttatttaagaggagataaatagacaaaatagattatatctgctacagaaatggaatctgtcggtgcgacaactttcccacaaagaaaactccaggccaagaggcttcactaagggaattctgcaaatatttcaggagggatattccaaattctaaggaaggtcttccggaatggcga

SEQ ID NO: 695084 - DNA, 534 bp, Homo sapiens
  misc_feature (407)..(407): n is a, c, g, or t
aagaggacatcttcaaagacttctatgagcgggagcctcataagtaccagaataagaccatgggtatcacccctcggggcgggctggtgctgtgtaagccggggcgggcagaggtcatggctgagcgcatcggggaggacttcatctctgacctggaccagctgcgcaaacggctctccttgggggatgatgaagcttgcgattcgggatgtggccaaagtgaggcaggaaaacaagtggaagttggctgcctacctagagagggactacaaagtcgcacagtgaaccccaaatcactcttcgacatccaggtgacgcggattcacgaatagtaagcgacagtgcctcaagggcctccaggtcatcacccggtacagccgcatcaagagggagcccaataagtttantgtgcctcggacggtgatgatgggagggaaggctgcactcggggtaccacatgggcaagaggatcatcagagctcgtcacagccatcggggatgtggtcaagcatgacccgggagggggtgagccgc

SEQ ID NO: 695085 - DNA, 104 bp, Homo sapiens
agtctagaggatcgcaaatctctcattgcgaccgtactccccaggcggaatgctcaaagcgttagctgcgctactgagatgcaagcatcccaacagctggcatt

SEQ ID NO: 695086 - DNA, 206 bp, Homo sapiens
caggacactccctcttccagctcctggtgactccagtgcttccttggctctgcgagaagtttcacatgcgcttttcagctcttactatttggtctctaacaagaacacctgtcattgcatttagggcccatcttatgttcaggatgatcccacctcaagacccttaattacatctgaaaaaacactttttccaaataacctgtcag

SEQ ID NO: 695087 - DNA, 1053 bp, Homo sapiens
aattgaactaacaaaggctgcatttggctgctttggtaactggcttgcaacagtggaacagcggcaacgaaacaggaaactgagcttgaattgcaaactgaacactgctggactgtataataagagaaacacaagggctttacttcttaacacctaacacacttaacatgccacacgaagactgcattacagctctctgctttctgctaactgcagacaaaactctgaacagcccaccttggttacagctagcacacagactggttacttcaacagtactggactattaacagactgactctgacactatacaacaaacacgcctgctcgcgctgcgacctgctgactcttgctctgcgcctacgctcactcacacagtactcaagcaacctaacatgctctgtttctcccgaacgatggcttcctcctacctacgacagctctacgctcctctgagcgacaaataagctcacgacagtactgaggcattcctgctacccactgcgcgacaccttcacacactgcttacacttctctgcccaaccggagcttggcgaacaaattcaacggacaccctatcagcatctacgcgcgacgactcgaacgctattcaacacgctattcctacctctgagctgcctcactcgcacacccactgcgcactttcctattgcctcgctcgggacagttcctggcactgtcagccctgactcgcaacttggcgcacgctgccacactggcacacacacgtccacacactgctctacgcacgctcacctgcggaaacccccggagtcaccttaacgttccacgaaccaaagtacttcggaattcgcacaatccgtcgtccagcctcgtcttctccaatccttggggcgcttccccgcaaccgttctgactcgcggcccaacttctccaccgagcaccctcgccttgcaggcccctcaggagtcccacttggattatctcctctcccccgcaaggggcccaactacctcccccctccgcccgccccgcctcccccctgcggagccccctcggtctctgatcacc

SEQ ID NO: 695088 - DNA, 355 bp, Homo sapiens
cttttaagggcttctcagccttgcaccaaaagatccccctggaaattaggtgggaaaaaccttaacttttgtggggccttgtgtttgtcttaaaagttcatgcccatagccaggtgtggtggctcccacctgttatcctttcctggatcccttgagtcaaggagtttgagaccaacctgggcaatatagtgagaccccatttttacaaaaaataaaatattagccaggggtggttgtgggcatctgtagtcccagctactactgtggctgaggcgggaggagcccttgatcctgccctgagctctgatctccccagtgtattccagcctgggccccagagcaagaccgtgactca

SEQ ID NO: 695089 - DNA, 369 bp, Homo sapiens
tctgtcaggatcataaatctcaaacactatattttgtaccacagagcataatgtgtcagagaaagttgtgcttattcttggatagccgacatatgattgtgatgattgggatatggtacagagtctaatgattgcagcatggttgtatacagatccgagggggtatgagcaactgtatattctcagtttgtgcggagcagcattagatgataataaataggtcatattaaagtgggctgatgagagttgcaaaagagtacttctaatgtgcatatggaaccaaacaggagcccgtattgcctagacgatcctcagcccaaagaaccaagctggaggcatgatgctatctgagttcgaactatactacaa

SEQ ID NO: 695090 - DNA, 343 bp, Homo sapiens
ccatccttctcctggcaaccagaggaggcgtgagactcctgaagccagaggaccggaccagggcgtggtgggagccgtagacccgagtttttatccttctctggcccagcacccggctgcggaatcaagtttgagctcggtgtagctgaagtttaaattgtagctgtttcagaggtagacccccacctcacccccagcccctggaccaagacctctggaagcgtcctgccttgaagccgcttgtgggagggctctcctaggtctccagctcccgtgagcacgcctggagatgccttggagtctaggaaccccagattcagcacccctgcttaacctgctttta

SEQ ID NO: 695091 - DNA, 1080 bp, Homo sapiens
  misc_feature (613)..(613): n is a, c, g, or t
  misc_feature (671)..(671): n is a, c, g, or t
cgcgacgccagccagcccgtcgagcgcgccaaccctgagggcctctgctacggcctcgtgcggggacctggccttcgccgccaaggagagcctcgtggctgccgagtcggggcgcaagccctacactggcgaccggcgccaccccatcttctttaagcgcaagctggaccctgccgagcccttcgcaggcctcgcctccagtgccctcagtgtctttgagacggagccaggtggcggcggcatgcgctggtttgtggacacagctgagcgttatgcgctggctggccggccactggccgagctctgtgaccacaacgcaaaggtggctcgagagcttggccgcaaccaggtaggtaggtgctgagcctgggggtccctgggccacgacctcagggcaggggctggttcctccgtcagctgcgctcaccccacctcaagctccgcaatggactccagccagtcgcaccaacaggccttgccttggtagctgagggtgtcaggatcacacagggccagggctccagggtgggccagggctccagggtgggccagacccaggactgtcctctgaggggcgggggtctcgggagtcgtgtggctcaagctctctgtncttccccccttgcttctggagctctccaggcaccagcagcggtggagccgggagctgncattcccatgcccatctctagctgcccgcaagtcccactgcccattctgttttcctctgtgctgctgtagggcggggaccggggttttttgtctttcccatgagcctcagctttcctacctggggtgggcctggacattggtgtactgagggcagctgaatgctgagggctttgtgactgtcccaggcagagagggacctgcatggggtgctgggtgtccagggaacgcccagcaagtgaccagtgcccggccctaaggtggcgcacacgtggacccatgcggcggaatcagtctactggagggccggggcctagtggcccaactgcaaaacctcgacacacagggtgggccaagcgggggccccggggagcgacggtcaggaacaggacaccgagaaggaaatggccc

SEQ ID NO: 695092 - DNA, 157 bp, Homo sapiens
cggaagataggacctctcccacattctcaaattattccctctattacttgaacatttccatcatatacagaataagaacaagtatgctgttatatcatccatctaaaatacaaatatttatcattagatcctagcttcaccctaccaaactctgacc

SEQ ID NO: 695093 - DNA, 356 bp, Homo sapiens
aaggactcggcaatgttacccgtctgttaccaaaacatcactctagcatcaccagtattaggggcaccccgtgcccagtgcaaatgtttaacggccggggtaccctaaccgttgcaaaggtaggataatcatttgttccttaatagggacctgttttattggtccacgggggttcaacgtgtttttaatttttaccaagtaaatgccctcccgtgagggcggggatgcaaaggaagcgggagccgttttggcgtttaatttttaatcgaactagtccttacaaccccaagtccttaactcctaacctcgatgaaaattcgttgggcggcctcggggaggccgacctcgaggatcca

SEQ ID NO: 695094 - DNA, 679 bp, Homo sapiens
gaaaggagggaaaagtgcatttatttgatacagagttacttaattacctccaaaacacatatgtggaaatcgctttgctggtgcaaagtatattaatgagcaggaatacatacatgaggttatgaatagagagctcaattggtacctttgcgtgtcttgctcaagcttggtatggcatgaaaactcgactttattccaaaagtaacttcaaaatttaaaatactagaacgtttgctgcgataaatctcttggattttgtgttttctaatgagaatactgtttttcattacctaaagaacaattggctaaacatgagaaatcactcacttgattatgtatagattacataggaagaacaatcacatcagtaagttatagtctctattcaccaggtacttttctgtggctcataacaaatataccagcattcatgatagcatttcagcatttccaaggtaccaagtgtacttatttggtcggtagtagtagtagtaggtattttagagggaattcagtctgatgtttttaaagaaaagcagcatctctgatgttgcaaatacgtgtaaatgggtgtacatcttatcctgcatttaaacccaagtttataagtggtgaaataatagtagtctggatggtgctgactggtaatactgttaagtcataaagataggttcatagg

SEQ ID NO: 695095 - DNA, 1428 bp, Homo sapiens
  misc_feature (633)..(634): n is a, c, g, or t
  misc_feature (637)..(637): n is a, c, g, or t
ggccggagagcgttggatcacgccttgtaatcccagctctcaggaagcgctaagaggcgggaggatacgcttgagcccaggagtccgagacgtgctcgtggggcaaatattacgcggagaccccccggatttcttcccagaaaactggtgatcataataatacacagccgcaaaataataaaatttatctatcactcatcctccacaacccatatgcgagacagcctctccatcctctcttgaggaagaaacgcttagacagaagacaacaatggcgctgggcagagcggacgcgacggacacacaacgagcagggacaaagacagcgcacccttgcgagaaatcagaacgagggtggacacacacaagagagagaacacactcgcggacatccgagaccacaagggggtgccgaggggagactattctactccgcctcagaccagtagagtaaaacaagaggcggtcctggggggagaggctcacactacagcctcctctgcagtgctttagtggagtcaagagataaatatacttcacaagaggatggtggtttagttttttcagagggcgaggtgtcatgaatgacagagggggggtagaaattatcttcaagcaaaagggggggtggcnngtnccaacaaccacacacgtcagcgcaacgccacgaggagaagaagcaagcaagatataggagcgccccagcagacagccagtctggtggggcaagaaaacaacagccagcagcaagtagaaagaagagagcaacagagaagccagacaaggtgaagagaaagaagataaaagtaaaaacacagctgagagacacaaacaagaagaggcaaaagaacgaagacgagcaagagagggagagagaggggtagcaggtagcaagttggtgacgaggggaagaagagtagaggtaaagagaggaagggatagaggaaagtaagggagtaggtgtatagaggataggagaagaaagggcatagaggtatagagaaaggaagaagagaggaagaagaaaggacgtagagaagggaagaagaagtgaaagaataaaacgatagagagagagaggagaggagggggaggaggggggagaaaggaggaaggagagaggagaggagaaagagggggagagggaagaggagaagagagaaacagggaaaaaggacagaggggagagggaagggggggagtggaggagggaggagaatagtcagtcaagcatggaatctgagagaggaggaagggtagggggaggagaggggcgaggagagaagaagagagaagagagagataggaggagaaggagacgagattgaggggaatggaggtgaaggggagaatagagaggggggaaagaaaaagaagagggaagtgaggtaaggagagaggagaggagaggatgaggaggggatcggg

SEQ ID NO: 695096 - DNA, 1159 bp, Homo sapiens
  misc_feature (435)..(435): n is a, c, g, or t
tggggcagcggggtgggcgcggcatcgggctgggggtgtccgccgccggttgtgggtccctggtagaggcggcggctggtgttcgcgcgtccgggtgttggttgtgagcggcgcgctgtgggtgtttgttattttgcgcgcgcgtggcgtcgatggtgcgtaccgtcgtggtcgctctgttgtgtgggggtccctgcttgcacgagcgtggtgtttgtttgtttgtagcgggcagcgtgtggggggcgggccctgccctgctgtgtggtgtcgcctgggttgtgtcggcgcgggggtggtgtccgccccgtcggcggtgttgtgtgtggtggtgtgggggtgtggtgggtggtgtgtgggtgtggggggtgctgggcgtttttttgggtggaaaaagagtagtagtatgagaagtacgaatatgtccgcgaaatntagcgcacggctgggagactccccgttttagatggatgccccagtgtttgtgtggcaaacagtccgcaagcgatctgtaatccacggagccacgtctgaacactatgccttcgtgtctcgtccactcacggccgaaatcacgggtggttgaccctatgaaggggccaaaaggggaaccgcgaagaatatagggtcctgagatcacgagatcacgtggtcttcccgccacggtgaaaggtggaacaaatgtttgagaaaattatggtctgaaattcccaagagagaagtatcggcaagtccctgtaactatttatattccacggacagagcacctaaggggcgaactaaccacgaaagggcctgtctgtaacctgttgttggtggagaatgagctgaagcccgaacccggcctgagcgtccacgaaaatggtgctcacaccacatgcttccacgctaaacacggtttatgaaaaccacgcttgcgaaataaccacgtccccgtggccacatccctgtgaagggtgaacgttatgcacttatcccccacacctcacttttagttgcctaagcacttgcctggccttcctgttctagtctctcctgtaagccacaagaaatgaacacttccaaggagttggaaagtgaagttctatgaatgtgaaaacacctttgcctcctgtgtactgtgtcataaacagatgaataacccgaatttgtaccttta

SEQ ID NO: 695097 - DNA, 463 bp, Homo sapiens
aagcttttaccgcctgtataattaacgtaattcttagctttcttggattaggctgcaatgtattcctgcatctcaatgatcttcgttccttccacattctgaattatatttctgtcatttcagccacctcagcccagttcagaacccttgctggagaggtagtgtcatcatttggaagaatgaaggcactctggcttttgtgttgtcagggttcttgtgcttgttttttctcatctttaggagctgatgttccttcagtctttaaagtggctgccctttggattttttggtatcttttattcaatttatgctcttgagggtttgactgtggtataaggtgggttcagtcaactggcttaacatctctaagattttagagagttaaggctccactcccaactcttggactgcatgttctaactctggggaacttgtatcaggccttgaatttgttttctggctc

SEQ ID NO: 695098 - DNA, 708 bp, Homo sapiens
  misc_feature (115)..(115): n is a, c, g, or t
  misc_feature (172)..(172): n is a, c, g, or t
ggaacaacggagggacaagtgttagtaaaaaagaaaggccaaaaaaagagagaggcggtattaaaaaaaaaaaacgcccccccaacacgaccaaaaaagaaagaggggagagggnaggagggaacgagcggacgatacacaggcaaacgcgaaaaagggaacagagacaacngaggaggaaagaaaaggggacaacaaaaaaaggcaacgcgaacacagaaaaacacgaaaaggggagcgggggaaaccgaaaacggcgcgaacaaaaaagaaagggggaaaaccaagcggcggcaaaaggagggggcaagaaaaaaccaaaaggcgccaaagcaaagcagggcggggaaaacgaaacacagaaagagaaacggcaaaaaaacacaagggagaagacaaaaagaagagcgaagaccaagaaacgggggagaaacaaaaaccaaggaacgcgcggcaggaaaaaggagaaacgacaagaccgagaagcagaggggcgcgaaaacaaaaagagaaaaacgggggaaaaagggacagggaacaaaaggacaacagaggaacgcgagaaaaggcgacaaaggaaacagaaacgcagacgagaggagggacaacggagacagagcagagcaacagagaaggcgagaagaaagcaaaacgaggggagggagacggagacggagagaccggcgcacacgacaaggagaaccaccg

SEQ ID NO: 695099 - DNA, 659 bp, Homo sapiens
gtacatcttgtccgctcgcctcgactcagctgcatcgattagagaatgagcccggacctctaatcgagaccgaacgacctgctggagaatcactgggaatcgacgatcagtgcgacgaggtgtgcatcgaaccatcgcagagccttgtcgcgtagttccactgtacatcgcgtgaggcattctatcgacctttctagaatctagagcatgcccgtacgtgacaagtcgcaagccacgagatcccgatttcgtcatccatatgcctcgcaaggagaggatgagagatggctgtacttcgctcacatgcacgccacacatgcatggtgtaccttggttgaataacagcaggtgtcctacttctatgacacaatagtcatgattacgtagcctttgaagcacgtacggcacgtacactgactttcgtacacatatgccgcaagtcctcgaaggggccctatgggctcacgctcttaggacaaggcaccccaaggcatgcagacgacatactaaggcgtattcgaaaggcgacaggaattacgcggcacggaccagtggctacgggctaccgacgttgcgaccactccgtaacgtgggacggatcgttaaaccgagttagggcggtcggacgccgtgcaccttttggactcaaaactgggctc

SEQ ID NO: 695100 - DNA, 493 bp, Homo sapiens
  misc_feature (452)..(452): n is a, c, g, or t
ggagaccgggttcactggtgtaacccgaggcgggtctcaaacttcggggcctgagcgatcctcccaccttggcctctcaaagtgctgggattacaggagtgagccatcatgcccagccggcctatcctattttattctgaggctactactactccttaggggtagatccaaggatctgacatcattttcatacatccggtgcagggtgtgagtatagaatggaggtaggctgacaacacaaaagggggcagaggtttcccactcatccccgacagggattctctgtgggcataggtgggctcgggtccaactccgggccgacatgagcatggacaatgtggcacagtggtggctctgcatctggtgtgtgactgcggcccggttttggtttagcaagcggtggtgccaatttactatgcatgtggttacatattcggctctaattggactgncattttgcttcagcgagacgatgatggtttatggcagggct

SEQ ID NO: 695101 - DNA, 232 bp, Homo sapiens
aactatggtgagcacatttctggcgctcaggcgtgtcgggctcagtcatctccacacacaggtacagcagcgcttctggtagtcggccttaggtgtcttgctggatataatagtaccgggacttgcggtactttctcttgaattcagacctaaattttcaacattgtccacttcacttgcgggaaggaaccatgaattctggatcagggacctttatctcggcgtacccctt

SEQ ID NO: 695102 - DNA, 1377 bp, Homo sapiens
  misc_feature (955)..(955): n is a, c, g, or t
  misc_feature (1003)..(1003): n is a, c, g, or t
  misc_feature (1093)..(1093): n is a, c, g, or t
  misc_feature (1108)..(1108): n is a, c, g, or t
  misc_feature (1157)..(1157): n is a, c, g, or t
  misc_feature (1161)..(1161): n is a, c, g, or t
  misc_feature (1167)..(1168): n is a, c, g, or t
  misc_feature (1188)..(1188): n is a, c, g, or t
  misc_feature (1190)..(1190): n is a, c, g, or t
  misc_feature (1193)..(1193): n is a, c, g, or t
  misc_feature (1196)..(1196): n is a, c, g, or t
  misc_feature (1205)..(1205): n is a, c, g, or t
agcggggctgtcctcccttctggtgtactgggtgggaggtggaactagtcggacaaagccctcgcgtcggacccttgccagaactcaattaatggatgcctcgaagttgacgtacatatatattcagaaatgttttgccacctgagacctatgaggaggttatgtctagagaagatatttccacactggtttcccttttcaagagctttatcgggagctgaagcagtcaatgccttgaggcctttctattttgcagtacatccagatttctttggacagcaccccgtagaaagggatgatacatggaagagttttcaatgccctagtgatttttccttatgatgcatgctgctggaccactcccctacaacatcagttaatgtgtgctccaggaatacaaactgatatgaaaaatgacttatggtagatgtagttaagacagtcaatatattttaacattagaaaatacagtcagtccttcatatccatgggttttacatccatggattcaaccaacctcagactgaaaatattaggggaaaaaaatacatctgtactacacatgaacaaacttctctttcttgtcattattccctgaacaacacaggataacaactacttacatagcacttacattatattagatattataagtaatctagaaatgacttaaagtatatgggaggatacacataggttatttgcaaatactacactattttatatgagagacttgagcattcgcagatttcggtatccacgggaggtcctggaaccaatcccctatggataccaagggactgctatgtattacaaagccacatgctttggaattacttcagtgttccttctattttcattaacactgatatctagtttaatatgaaaaggaacttgaaatcttgaaaattagaacatcgttatttttttctacttgcaatggaaaatctatttngcttttttgcttctaggaaaatattctgattatgatatgtgatatgtnggtactcaaagtcagaacttttcaaagtaatcagtaaattgaatcaacagaaaaatattcattaactcggggatgcattaataaagtttntaaattcaaaatgtntagaaaaatcaggcttagtaatactttaatattattctacaatgtattntttnaattannacttctgtatgcagcagagntnggnggnacacctgtnagtcccaggctaataaggagggtgaaggcagaaggataccttgaacccaggaattcaagccgggccaacataaggagtcccaagcatacctaattacaaaacgacacaaaaactttaacgtggggtaaagggtaacacacagagatgggagataaacctggacatcccagaa

SEQ ID NO: 695103 - DNA, 849 bp, Homo sapiens
  misc_feature (704)..(704): n is a, c, g, or t
  misc_feature (778)..(778): n is a, c, g, or t
  misc_feature (801)..(801): n is a, c, g, or t
agcggggctgtcctcccttctggtgtactgggtgggaggtggaactagtcggacaaagccctcgcgtcggacccttgccagaactcaattaatggatgcctcgaagttgacgtacatatatattcagaaatgttttgccacctgagacctatgaggaggttatgtctagagaagatatttccacactggtttcccttttcaagagctttatcgggagctgaagcagtcaatgccttgaggcctttctattttgcagtacatccagatttctttggacagcaccccgtagaaagggaaatcaatgaaaattctcttaaaaggttaagtgtctacctagaaaacctccagaaaccaggcttcaagtctttgaaaccaactcagcttacattttatgtaagagaaacagaccagagttcctccgatggccaggaaccttttagtacttccggatttcgagcagtcaaatttactttgcacaccagagatctgctaagcacagtgttatatattctcaactcctgcagtttatctgttgaacatatccaaagcttgaatactaatatgcatacccagcctctcaaagaagctaaaaggatgcctgacaggcccatcaaatgggacaagtcttattactcctttactggattcaaggaccctgatgaagaccttgaacaagtctcgagagtggaaacaactctcacatnctggttagataacaatgggaaaagtgctgttaaaaagctaaagaacagtttgccacttagaaaagaactagatngtttaaaagatgaactgtctcancaattgcaactctcagatatcatgtggcaaaggagctggggcatcgcc

SEQ ID NO: 695104 - DNA, 122 bp, Homo sapiens
actgaagtcacaatgcttctgaccatactttgtctagcagagcaaaaactggccgactccgaccacatcgaaccagcagtgtccccaacgccctgaggaccaacacccatctgtgaacaagg

SEQ ID NO: 695105 - DNA, 773 bp, Homo sapiens
  misc_feature (628)..(628): n is a, c, g, or t
  misc_feature (702)..(702): n is a, c, g, or t
  misc_feature (725)..(725): n is a, c, g, or t
agcggggctgtcctcccttctggtgtactgggtgggaggtggaactagtcggacaaagccctcgcgtcggacccttgccagaactcaattaatggatgcctcgaagttgacgtacatatatattcagaaatgttttgccacctgagacctatgaggaggttatgtctagagaagatatttccacactggtttcccttttcaagagctttatcgggagctgaagcagtcaatgccttgaggcctttctattttgcagtacatccagatttctttggacagcaccccgtagaaagggaaatcaatgaaaattctcttaaaaggttaagtgtctacctagaaaacctccagaaaccaggcttcaagtctttgaaaccaactcagcttacattttatgtaagagaaacagaccagagttcctccgatggccaggaaccttttagtacttccgtttatctgttgaacatatccaaagcttgaatactaatatgcatacccagcctctcaaagaagctaaaaggatgcctgacaggcccatcaaatgggacaagtcttattactcctttactggattcaaggaccctgatgaagaccttgaacaagtctcgagagtggaaacaactctcacatnctggttagataacaatgggaaaagtgctgttaaaaagctaaagaacagtttgccacttagaaaagaactagatngtttaaaagatgaactgtctcancaattgcaactctcagatatcatgtggcaaaggagctggggcatcgcc

SEQ ID NO: 695106 - DNA, 1169 bp, Homo sapiens
ggaggagagagagaactagtcgcgagttatattatttttctatttggttaagcacgggtacttaatggatgtgccccttgacaagtgtgcggttccctaggcccctccccttcttacaagggttctacatggcaactgtaagtgagggagaaatccagtgtggggggtgggcactgagtttgtggcagggactcccgcagcgagtgagggtctctctcttcgctcgttgtgctcattgactggggctggttggctccaggggttcatacatccttggaggccattgtgggccatgaggtccaccacccgtgttgctgtagccaaatttcggtggtcactaccaggaaaatgagtttgacaaagtggtcgtgtgagggcaatgccagccccaggcgtcaaaggttggaggagtgggttctccctgtagaagtcagaggagaccaccgtgggagctcaggtgtaccccaggatgcccttaagagggagcccttcagaacagccctagataagacgcaacactttgttgaagtatcatcaatattggagacagggtatctctaaacaggaggaaagcgtcaggttcacagccaatgtgacacccgcttgagataggtggggtagcaacacggaaaaggcgccatgccaagttaaggctacccccggtatcaaacgcaaccagggagaatataacacttttgcgccaaaagaggacttttggggtcagcgccgagagatacaacggcccaggacaactagaatagtctcttgaggaagaatcccccggaggaggcaacatatagaggcccacgaagattcccacgaggagggggggcacaacacaaaagagcatttaggggggagtggagagaacaacatggcacaatgcaatttgctgcgcaactagaggagtactcccttcacaaggaaaccccaaaaggatggtacaacgaaataaggacccctttccgccaaggggcattgaaaaaacaccacattggtgatgtgttatacggaaaaggtatattcgcgataaaagaaacttaaggaggagagtggggcaacaaaatgttccttaatgggtctacaagcccatatgcacaaacacattgggggtgtataaacaacatgggaggcacgaaactgaatacccctttcgtgctcccccacag

SEQ ID NO: 695107 - DNA, 105 bp, Homo sapiens
acaatccaatattacactgcaaatgaagcatgtagaaaatagctgaccgggtgcggtggctcacgcctgtaatcccagcactttgggaggccaaggtgggcagat

SEQ ID NO: 695108 - DNA, 188 bp, Homo sapiens
cttaaaagttacagcaagtgaaggtggtgtctcccgtcgataatcccagcactctggaggctgaggtggatggatgacctgaggtcaggagtttgagaccagcctgaccaacatgatgaaaccccatctctactaaagatacaaaaattagctgggtgtggtggtacgtgccttagtcccagctaatt

SEQ ID NO: 695109 - DNA, 313 bp, Homo sapiens
aatgcttaaagcttctgtagaccgaattccaccagaagcggaaaacatccgttcatagaaatgttcacgcggcggcaagttgccatacaaaacagggtcgccagcaatatcggtataagtcaaagcacctttagcgttaaggtactgaatctctttagtcgcagtaggcggaaaacgaacaagcgcaagagtaaacatagtgccatgctcaggaacaaagaaacgcggcacagaatgtttataggtctgttgaacacgaccagaaaactgggtcgacgcggccgcgaatttagtagtagtagttggcggccgc

SEQ ID NO: 695110 - DNA, 1076 bp, Homo sapiens
agcggatgttgtactatgcttccacggcttggatgtgggtgttaactccaggtctccccggagcaagggggcttccgtctgcgtctttggatccgcgtaggtgaatcggagcgttgtccgacgccttgtggaggccgacatactcagccggacccgagaggcctaaccgcggtaaccaaccaagctcaatggagataaagaccaatgtcatccaggagttggatagcagagttgctagagtgcccgactaactcgcattaggatcggtctaaagaccgtgtcgagatataaggaatgcgcacccggcgtctcgtgattggcacagaatcagcatcgttcctgctgcttcagcccttgatcactagcggcggcgagtgagggcggcctacttagccaacaggcctgaacagccggacccaaccgccggtctcgagcagttgacaatggttactgagaccaccatcgggctacgtgcgcgaccggtctcgcgaaaaagaaggaattagcgacctttgttcacttgggtcgcttgttgccaaggggtcaaggccgtaaactcgaagactacgatgacgtctgagatcacgcaggtctgcgaagcagtcagtaggctgagtcgcggatgggatccttcacatctttcgggatacgaatcaattggggacatcatcggccccctaaggataaatgtctaggactaatccgcattgccacagtatgtagttcatgacgacgcgtgaagacctaggtcttgaggaggaccaattcgaggtgcccctacgcgaaaggtttggaagcgtagttccccttgtatggattgcgaggaaaaacgatccgaattaaagggggcttgcctacccagtatcatatctttacgtgcaattcatgatgggagcacccgaaaaagcgatggcgtgaccaattgggttggtttgttcgaattcctaaatgtgggtaaccaatggtacacgggacactttgcttcgggtaagagggacctcccctaaggattcttgcttaggtttttccagggccccttgatggtttgggggaaacagctaaaggcccaaacccca

SEQ ID NO: 695111 - DNA, 116 bp, Homo sapiens
gtgtggtttttctttctttgtttgttttatgtgttttgtgcttacctcaatgttgatggctgctgactgatcagggtggcagttgccgaaggcagaggtggctgtggcaattgcca

SEQ ID NO: 695112 - DNA, 837 bp, Homo sapiens
ggtgtggcccagacagggcactgtctgtggccccaggggttgaggacccctggctttaacaacagaaagaccccagttactggattgggatccaccctcactcaatatggcctcagcttaatgaaagacatctgcagagaccctatttctactaaaagccacattctgagacttctcgtgggcgtgagtttttgagagacactgttctgctccatgcagggagggaattgggatctgaagacgttgcattcgaggtctcggggctcctgatgagcagcctcggcctgacctggggcaggtgtgatgtctgcggctcaccatctccaccctgcctgctgtggaatctccacaacgacaggtgctttggaggccagagtgcatgcgtacgggccctgcacacgctgaatgtcactgggaacaaggacacaccccgcttccaggagaagatagaacatgtcgaccccttttagccatccccagtgcaggacatgctattgacttccatgagacaaacacctacttggaaatcaggttttttctgtaccttttgaaggagcaggaatttcccagcatttcctggacaaagacggaggccacattcgctgcatcctttccagcaagatgtaattctgagatttttgtcattcctgggcgttatgaggactgccaagggacacaattccatgggaggaaagttttcttctaagctgcaagccagctctggcttctggagtttctccttaggattgcaagacagtagttccctgtcctttaggtcttctccagaaataccttaaaatagcaaataaaataagatataagcaaacaaaaaaaaaa

SEQ ID NO: 695113 - DNA, 117 bp, Homo sapiens
tcggtccgaaacccatgctgcgttactctggcacggcaaggccataagacccagctcagccatctcgcccaggcctccttggagtagccaccttccttgatgatgccgcgcgggtct

SEQ ID NO: 695114 - DNA, 955 bp, Homo sapiens
ggtgtggcccagacagggcactgtctgtggccccaggggttgaggacccctggctttaacaacagaaagaccccagttactggattgggatccaccctcactcaatatggcctcagcttaatgaaagacatctgcagagaccctatttctactaaaagccacattctgagacttctcgtgggcgtgagtttttgagagacactgttctgctccatgcagggagggaattgggatctgaagacgttgcattcgaggtctcggggctcctgatgagcagcctcggcctgacctggggcaggtgtgatgtctgcggctcaccatctccaccctgcctgctgtggaatctccacaacgacaggtgctttggaggccagagtgcatgcgtacgggccctgcacacgctgaatgtcactgggaacaaggacacaccccgcttccaggagaagatagaacatgtcgaccccttttgctctcgttctgttgcccaggctggagttcagtggcatgatcttggctcactgcagcctcgaactcacaggcttaggtgatcctcccacctcagcctcctcagtagctgggactacagagccatccccagtgcaggacatgctattgacttccatgagacaaacacctacttggaaatcaggttttttctgtaccttttgaaggagcaggaatttcccagcatttcctggacaaagacggaggccacattcgctgcatcctttccagcaagatgtaattctgagatttttgtcattcctgggcgttatgaggactgccaagggacacaattccatgggaggaaagttttcttctaagctgcaagccagctctggcttctggagtttctccttaggattgcaagacagtagttccctgtcctttaggtcttctccagaaataccttaaaatagcaaataaaataagatataagcaaacaaaaaaaaaa

SEQ ID NO: 695115 - DNA, 349 bp, Homo sapiens
ctccattgcttggggatatgcttcctcaaaataaacccccctggcatcaagggttccggatcagaaacaggcagctaatcaaaggttcatcaagaatggctgggaagccagggatccaagcggaatcaagcccagctttgtcatcttagcactatctttgtctgtggtgagttacagttccctgtgtagaccaaagacaggaccccaaagagaagtaacccagaaaaactacctttgcttggatgtgaaaatatgaaaaacataaaggttggggtatttttcaaaaatagaaggagcccttctccatcctatatttttttaaaaataaatatttttttttaaagtttaa

SEQ ID NO: 695116 - DNA, 480 bp, Homo sapiens
agattctcaaatggatcgagccacctcggtgattaagtataaagcatacctatcacatatgtaaacgcgagtaatcctctccaatataggggaggcatataggaaacagggaaaagtagcagtatgaccaagagtaaaccaggtagtaaaaaacaccagcatagggatgaaaccctggcaaacaaagaataccaaatttaaggggtaaaattttggcaaggggaagatacctcaattcctacattttccagctcctggtataaaccatttttccatcggtacctagatatgggttttcctcctccatagtaggatcaccggattattggatatttcaggcctttaataacaactggtttaatgatcccaccatttatgtccacttcctcagggcttaatttccaagaaaaaataaggtcgtagtagcacaaggtgataagctccatctcccacccaattttcactggtctcatgggtagg

SEQ ID NO: 695117 - DNA, 510 bp, Homo sapiens
tggggtctttgctggcgagtgtggcttcctgccatggcaccaaagaagagggctggcggattagtcctgttgtctctcatagctttgtagggacacagcgggccatgtggactgacagctggagccttcataaagatggcctagaaaattaggacactgtcctgttgacaaagcccctaggcctgcccccatcaggcctcatgggtccttttcaggcctaagccagggttctgaaatcatctgtaatgtgaatttatatttctaggccacattcgctgcatcctttccagcaagatgtaattctgagatttttgtcattcctgggcgttatgaggactgccaagggacacaattccatgggaggaaagttttcttctaagctgcaagccagctctggcttctggagtttctccttaggattgcaagacagtagttccctgtcctttaggtcttctccagaaataccttaaaatagcaaataaaataagatataagcaaacaaaaaaaaaa

SEQ ID NO: 695118 - DNA, 985 bp, Homo sapiens
gccctttcctcaggtgccgacgacttgctcggtacttccgatgaagctaaggatgtgtcgcgtgtgaggtcctcactacagtccggagaataacaccgcgtccggccgcgctcgggccttacccaactcgccctgcgccctatgcgcactctgttccccgcagacttccgcctgcaattcttatcctcggtactcttctacttctgtcgcgtcgcatcgagcgtgcacggttcaacggaccgtagttaatgtcgatgccctccttgtagcagccggtgttgacttgttggagcccttgtataggggctcgtggcttgtttgcctaagtgcgctctgggccctaccgttcggtcggtatagttcacgctctgcaattcatcgcacttggttacaggaggccagtgtggatccttgtcgacactccgtaagacataggggagcgtcgctctccagaagaggaagtttcctgtgcgttaccagtggttgagctcgaatcaatcttgaggataaggaacctgtagttaagccctagtgacaaagggaactagttgcccggagagtagttctgactgatagatcgtagcgtcctttctgcgctctcagtagaactaaaggtcgctcgtgttgggatgagcatgtctacggggatagtgagtgtgtacccggttgccaaccatggtatgggttaacaatcaggtggttatatgggtgccgcacgccagaaccgcatttaaagctagtcatggactaacttccaatatttgtgtgggcgacgcacgcttttttgaaagaacaaaacacactggagcaatgatccagacttttcatgaaattcgagacgccggcttcatgtgcgtttgtagaccttgggggaaacaaatgcgcgcacgatcttgactccaagcttttagagcttaaggtccatgttgtccccgaggagttgcgggtttgttcaacaggtaaacacgtattctaaaaaggaagc

SEQ ID NO: 695119 - DNA, 799 bp, Homo sapiens
gcaaacgaaggacacgctctttgctacttgtgcaggaagaaatgggcttagattaaatacttggtcgacaagcagataatctgaatatcaataacagaattctttattctaaccaccagacttacggtgagccctggggttaaaagattccattggtaataaggcctggttgcttgggtgaatcctgtattctattcaagaaagcagcaaaatcagtgatctcagtgcaggtgaagattgtgatcgttcttaacagctgggtgattacctgtaagagaagataagctacattgacggagcagaaaaaaaaagccgtgaagcattttattgcagaatgtcttccctattattagaatataagagtatagtagtaattactgttcattgaacagaaaatagcacgacttacatttagtttccagtggtcaagttgtagattcggaactgtggtgaaatctgttgaaccagacgattttcacttaactaaactctagttcatgttggaatcaatctgggtacaaccgtactcatggttcatgggaagcagagacttcacgtcacaaatcactcattgtcatgctatccatgttcaagtcacgacttacatgatttttgaacccagagcaacatccacttgtagcaaagtaggtttgcacagtgctaactattaaatcttctagtagagtttctaaagcaacaagttcgggtctaaatagagttagattactgcttatttccctagttaagctctggatggaagtggtaatgaagcttagttaggataagggggaaaggcaga

SEQ ID NO: 695120 - DNA, 506 bp, Homo sapiens
acggcagtactcctacggtttaagtggctagtctggatcggtagcgggagcggagagcggaccccagagagccctgagcagccccaccgccgccgccggcctagttaccatcacaccccgggaggagccgcagctgccgcagccggccccagtcaccatcaccgcaaccatgagcagcgaggccgagacccagcagccgcccgcgcccccccggcgcccccgacctcagcgccgccgacaccaagcgccggcactacgggcagcggcgcagggagcggtggcccgggcggcctcacatcggcggcgcctgccgggcggggacaagaaggtcatcgcaacgaaggtttggggaacagtaaaactggttcaatgtaaggaacggatatggtttcatcaacaggaatgacaccaaggaacgatgtatttgtaccaccagactgccataaagaagaataaccccaggaagtaccttcgacagtgtacggagatggagagactgtggagtt

SEQ ID NO: 695121 - DNA, 368 bp, Homo sapiens
tgagtgtactgtatacgtatgatacataacacacagacaaaaaaactaatcgtgtagattgtgaacatgatactgcatcctaccctccagtgggatctattttaaggacaagaggagtggcaagaaaatcctgcgctctacttggtagattggttgtctacaatggtcttgggggagtaattccaaaactatttggtactaaaaagacgttgctatcacgtgggaaacagagtttcaccatgggagaaagaaaacacaaataaggaatgggagatggagagaaagtaccctcagatgtgagactggaatggaatgtattagcatgacattgtgatttaaatgaataaacatttgtaaaatacactcaa

SEQ ID NO: 695122 - DNA, 147 bp, Homo sapiens
agaggacaaacagtattaatgggggatgtgggatatggcgttgtattagtttgctagggctgccctaagcaaacaccacagactgggaggctataaatagacagaaggatattctcttatagttatacgaggctggagggggccgcg

SEQ ID NO: 695123 - DNA, 476 bp, Homo sapiens
acggcagtactcctacggtttaagtggctagtctggatcggtagcgggagcggagagcggaccccagagagccctgagcagccccaccgccgccgccggcctagttaccatcacaccccgggaggagccgcagctgccgcagccggccccagtcaccatcaccgcaaccatgagcagcgaggccgagacccagcagccgcccgcgcccccccggcgcccccgacctcagcgccgccgacaccaagcgccggcactacgggcctcacatcggcggcgcctgccgggcggggacaagaaggtcatcgcaacgaaggtttggggaacagtaaaactggttcaatgtaaggaacggatatggtttcatcaacaggaatgacaccaaggaacgatgtatttgtaccaccagactgccataaagaagaataaccccaggaagtaccttcgacagtgtacggagatggagagactgtggagtt

SEQ ID NO: 695124 - DNA, 238 bp, Homo sapiens
ggcgtgttatcccataactttaaaatcattctatcatcttggagcactttctcttagcggggagatgatggaattctgtgatcataagaagtatcgtgtggttcttgcgctggtggagcatgtgctaggacaagacagcatcctcaatcaatccaacagcatattcgggtgcatcttctacacactacagctattgctaggatgcctgcggacacgctgggcctctgtcctgatgctg

SEQ ID NO: 695125 - DNA, 801 bp, Homo sapiens
  misc_feature (18)..(18): n is a, c, g, or t
  misc_feature (88)..(88): n is a, c, g, or t
  misc_feature (101)..(101): n is a, c, g, or t
  misc_feature (118)..(118): n is a, c, g, or t
  misc_feature (156)..(156): n is a, c, g, or t
  misc_feature (208)..(208): n is a, c, g, or t
  misc_feature (232)..(232): n is a, c, g, or t
  misc_feature (235)..(235): n is a, c, g, or t
  misc_feature (268)..(268): n is a, c, g, or t
  misc_feature (274)..(274): n is a, c, g, or t
  misc_feature (295)..(295): n is a, c, g, or t
  misc_feature (331)..(331): n is a, c, g, or t
  misc_feature (352)..(352): n is a, c, g, or t
  misc_feature (365)..(365): n is a, c, g, or t
  misc_feature (372)..(372): n is a, c, g, or t
  misc_feature (379)..(379): n is a, c, g, or t
  misc_feature (393)..(393): n is a, c, g, or t
  misc_feature (427)..(427): n is a, c, g, or t
  misc_feature (436)..(436): n is a, c, g, or t
  misc_feature (454)..(454): n is a, c, g, or t
  misc_feature (459)..(459): n is a, c, g, or t
  misc_feature (465)..(465): n is a, c, g, or t
  misc_feature (493)..(493): n is a, c, g, or t
  misc_feature (495)..(495): n is a, c, g, or t
  misc_feature (506)..(506): n is a, c, g, or t
  misc_feature (566)..(566): n is a, c, g, or t
  misc_feature (569)..(569): n is a, c, g, or t
  misc_feature (586)..(586): n is a, c, g, or t
  misc_feature (593)..(593): n is a, c, g, or t
  misc_feature (655)..(655): n is a, c, g, or t
  misc_feature (687)..(687): n is a, c, g, or t
  misc_feature (728)..(729): n is a, c, g, or t
  misc_feature (735)..(735): n is a, c, g, or t
  misc_feature (768)..(768): n is a, c, g, or t
ttcctgtagacacaggtntggctgcccggactcctgctgttgagggtatgacagaggctgaggaggaagagctcagggctgagcttancaaggtggaagangaaattgtcactctgcnacaggtcctggcagacaaggagaggcactgtggagagntcaagaggaggctgggcctctccaccctgggggagctgaaacagaacctgtncaggagatggcatgacgtgcaggnctntagcgcctaaaagaagactcaggaaactctttnacaggnaggaaagaagacttcagctgncctatccacagatgggctctaccatcagcaggaagnttggagacatgaggaactctnagaccttcaaatngtttgangaccganttgggaccataaantctaaagttgtgggtgacagagagaacggaaatnccaacctcncttcctcagcggggagtngtganaagccnctgtcggatcccgcacctttctaagccnanggttgcttcanccgctgcagagcacacgcaacccagcctcagcatcacagccgcagctctgttcagcgganagncagccagggcggatgancagagcnggccctgaggacagtcctgcccatccacgcggagatgtggctgccgcgtttgcatgaatttnaagaacacaggcttgtacacagatgttttacnctcacgtttgtagatgaaacagatcactgtgctgtccttcnnaggggngcagaagtggacagggcggagggtttgaaaaanattgaacaaaacccaggctccctttgggaatca

SEQ ID NO: 695126 - DNA, 327 bp, Homo sapiens
acggcagtactcctacggtttaagtggctagtctggatcggtagcgggagcggagagcggaccccagagagccctgagcagccccaccgccgccgccggcctagttaccatcacaccccgggaggagccgcagctgccgcagccggccccagtcaccatcaccgcaaccatgagcagcgaggccgagacccagcagccgcccgcgcccccccggcgcccccgacctcagcgccgccgacaccaagcgccggcactacgggcagcgggcggagggtggccggcggctactgggggctgcgggggaaaaagtatgagaagttggaaaac

SEQ ID NO: 695127 - DNA, 389 bp, Homo sapiens
atttaatgactacagcatgaatgacatccactctggggaaagactcagctgtgcacgagtgactagcaaggaaagcagggctcaccaagagatccttgacacttgttaaggcatttgaacttcctcctggggataagggggagctactgaaagccttagagcacatgaatgacctggacagacttccagtttgcaaaagatcttctgtgaccatgagtgagcccgtagaagtgaaccaggctgggagcaggttgaagtcaagaccagttgaagtcattcttccctgagagtgaaccttcttggctgagacatctgtcactccatgaacaatactgaacacttgctgtgatccagggaatgttctagaagctgctggcagtagaaaaagg

SEQ ID NO: 695128 - DNA, 293 bp, Homo sapiens
tactactaataaattcgcggctgtgtcgacggcagctgttgcagcatccagttcctaactgcacctcctgctgtgcagcccggttcctaacagaccacaaactggtagggttggggacccctgccccagaggtattctgaccacagagcactgaagatgaaatgaatttggcaacagctagtatatattcccaaactgggcttcccctattgccataagacacaagtgaattcaagtcttctggacttaaaaatagaaataagtagtcgacgcggccgcgaatttagtagtag

SEQ ID NO: 695129 - DNA, 162 bp, Homo sapiens
  misc_feature (71)..(71): n is a, c, g, or t
gtggcagagaaagtcctcactcagaggcagagactgagttaaggcataggtggccttaggcatctgcatgnttgcaggggttaagttttccttccagtgagggctggagggaatgaaataagctggtacctggagcccgcttaagctctgcactctggcaac

SEQ ID NO: 695130 - DNA, 203 bp, Homo sapiens
cctcctttaattccaagcagtcgactccaggccctactgagcgggtgacgagtactccacagcgtcgggcgcatctggctgtccgtggtgtcgtcttccgggtgcgtaggtatacgtgtgtgtctgcagagcgcgtgtggggggatgagcagaacgactttgtactgccacaccaagcagcccgactgcttggatcacaagga

SEQ ID NO: 695131 - DNA, 1302 bp, Homo sapiens
cggcgggggcgggtcaggatcttcggcgtgatcttccattctcagtgctgggatgccggaatgtcctgggcgccctgggatctgggcgtgggcccgcgcccatggcaatgctgcggcctgccctgggccctggggaccctgccatgtgaggcagtgcccgggctgggtgtgcccgtgccatggcctggtggaacgtgtccccactgcgagtggccctgttgcccggtgcctggagagtgtgcctggggggatgtgtggcccccagtgggcctggggtggcactgggctggagtgccctgtggcctgtgtggcctgccctcctcctaccggtgctctccgcagctgcctgtgtctatgccgtggcagcgtgtgtgacggattttcactgcgcctggagaagatctgtgggcctggcttcttctctgagggtcatacaagggttccggcaccgaccatgtcaggtggccaagtcagtggttgcttgaagcgatgaacgaagctcccccagtaaaccggagggcaacacactactgggaagtgcatgctgatgaaaccaggctcaggggcacccccaacatcctaaggttcattgggagtcgtgtgtgcaaccagggacacgcctgcatcgctcttacagagtatatgaatcgggtgtggaccatagggacacagcttgctcaggctatccacctgaaaccccagtgtaccatggcccgggtacaagagctccaccatgggcaccttcggacatttgccccgagggccctgacgagttaccttgaaagatccaaagagggatgataatttcacccggcgatacttcacagtccaaggaagctggccgatagtccctgaacgggggaaagcaatctgaggggcattcaaccgggcgttgtacagaggggttgacattacgaagagcatggggccgcacaaaagaattaccgcttggtggatactaagggagaagcggggcggcaaacggcaaaagtgaaaccccagattaagtgccaccaggatcgaatagagagaattacccacaaaaataagtagagaaagtggagcaccaaagaagtagttggtataacaggggcggttgaagcgcaatgaatttaaactcaagaaaataggcctcgattagtcaattaacacaccttacagagaaaataaggaccacacatatgaagacagcacatatgaacacagaaaagaaacgttgtagaagagccacaagacagtagcagtaaaacaacagcgacatgaacgacaccaatagagcgagaagaagttcgcaaccagatg

SEQ ID NO: 695132 - DNA, 889 bp, Homo sapiens
  misc_feature (373)..(373): n is a, c, g, or t
tatagtagctcaccctggtaatatcaatgcttgggaggccgaggtgggaggattctctgagcccaggagtttgagaccagcctgggcaacacagcaagaccccagctctatgaaaaaattttcaaaaaatcagccaggcacggtgacatgtgcctgcagtcccagccactcgcgaggctgaggcagaagcaccgttgagctcaggagttcaaagctgcagtgaaccgtgaccgtgccactgcacccggcctgggtggcagaacaagacctcatctccctttttttttttttttttaaaaggatggggtcttgccttggcccaggccggagtgaaagcggcacgatctcgactcagtgaaactccaccccaagnggttcaagcgagatctccggacgtcaagggaaaggagcagagacctccatcctcgtgacacaaaacaaaaacacacacacgacaacaacaactatgtggcgggcgcgcagcgccccaggagaaagttttaaaacacaccggttggggcggcaggggacccaagaggaacgagaaccacctgctgcccaacaggcgagtgcccaaagagagcgacctcgcgtcctcagcaccaatggtcgctggcgggtcccccccccaaaaaaaaaaacgcgcggggggagacacccccggccgttcgtgaacaacaccccagagggggcgtcggagggcaaagggggctcacaccaggggccacacggaggccgaaaaaaacccacgccgccggcgtgacaggaaaacatacaccacgctagcaagcaacacacgcaacgctagaagcctcaagactgataactacatgacacgcaccacgagcagagctgacaacacaacaagcacgaacaagcacactactaa

SEQ ID NO: 695133 - DNA, 308 bp, Homo sapiens
gtaaagctagtaccaaggaagatgaccggagaacatctgccatcaaggcccttaatgctacaggacaagcaaacctcagcctggaggcacttttccagtgaaagcaggccaggtgcggtggctcacgcctgtaatcccagccctttgggaggccaaggcgggtggaacacttgaggtcaggagttcaagaccagcctggccaacatggtgaaacctcgtctctactaaaaatacaaaaatcaaccaggcatgacggtgcacgcctgttatcacagctacttgggtactacgctttggcagtgtaccga

SEQ ID NO: 695134 - DNA, 993 bp, Homo sapiens
atcgatgtatgtcggcctctttttaattttctcccgctttgtttctcctcccggggggcattttacctcttgtttcgcgctttttcgccccctttgttgtcccgggctccccccctttcccggtttgtgaccccgcgctccatttgttctccggggtctttgtaccaaaccgccctttcgcctgggtaccgcaggtgccacgtggtggctcctccccggccgcgcactgtgtcgttcgacaatcgccaccccgttctttttcagtgccctgggctgcgccccattgtggcgcccccaaacataaaactggcgtggaagaccaattgtgggcaccgccgggcttctttaacaccctgaaggtgcgggcacacaaccccctttcccattactgttcgcggtggaacccacaacagtcttcccctcattggcggccattccagtgtcaccccccacggatctattgggagagggccctggtggcgacaacccgccagggtggttattccactcctggtgcccccccctgttgtccactcatgtaatgtcgccacgccgccctactaacggtttcctgcacctcacagggcgccattctggtattgtcacgcctcgcttccactagggcgctccagttctacacatttctccccgaccgcaccagggaatctcaatatcatctccacacaacaatcggggcttatccccaagatcttttaagatgcggatgcatttgcaatacacacatatggtggtccgagacaagagaccgacgattccccgagtagcgtgcttggagtgcttcaccaatatgtctgcccactctctgtcgacgctcctcttcgagaccacattgcgcgcggggtatcaccacgccacccctaacagagacggttgtggtcccgaaaagtcttttcatcctctgctgctcactcaatttgtgctgcattgtgagcctttaaaaaaatttcttctcttttctgcccccacataaca

SEQ ID NO: 695135 - DNA, 1297 bp, Homo sapiens
  misc_feature (484)..(484): n is a, c, g, or t
  misc_feature (1142)..(1142): n is a, c, g, or t
tcgaagccgcgcccgactggggactgctgaggcgcgcacagggtcgacgctcgcacgcggaacctgtcgattccgcggtccgtgcatgaggtctcggcggcgggcgtgtgcagccatgtctgatgactgagacctgccaagacaacaggttcatacaacggcagagacaattcgatcgagatagacaatgagtcggaagcgcagccagaggggcaccagagcctggacttatgaccttcatatgacgagtggagacaagacagcgtgcgatttcactcagctatagtggcgtgtgtaaccgtaatcctgctgaggcacagcggatccatcaggagatacacttgacagagcccatactcacaatccactcttacgcgagcttatacgccctgaagcccgagttgacgtacacaccagcggtttggtcgcgaattcagtcacggagggcacagcagtgcagacgagagaactcgctttgcgcatnacgcgctgatccgctctgttgatgcgtgcgctttcttcgcgagccatagttgcacattgatctcgggcgcaatacggacgtccagaggcagccattgtgatgcccgccgcagcgaggtacccacacactttcttcgcgtttgcacggtcctcattggacttgagtattttcacgagtcggaaacttcccaagtagcacaggacctgtcgctagtgaccatggacgaggcttgcagaccccgtaccttttcgcccctttggctacggaagtccgcatggtgtccacatccgacgcaaattcttcccaatattgtagatcaccctcgttcctacgaatacaacgttgttggccgtacggaagacatgaacccttcggagacgtcaaggattctcaacgacagcactttccccttgtaaacttagcaacgcttggaagagagcaccgacccagtccatgagatctttcagatgcgtatctgatcgatattgaaacgccgggtatgaggtgacaggaggtcccctcgcagatgaagggaccacttacctgtcccacttggcgttcctgttgaggaaaaaggaacctggatcagacaatttctccaaaagggaagcgttccgcataccacacaagaacattccaattggcaccatagaccgtntccatgttgtacgaaccttgaaccaattcgggccccccatgggtagattctcccaagcctctatcaagaccactttgtgtaagtacttcaggctacgtcttaggatcttaccccaagcctggtccaagctcactagtagccacacataccttggg

SEQ ID NO: 695136 - DNA, 406 bp, Homo sapiens
gatgcgatactcctagaactgataacacttcagtaagttgaggatacaaatcatctataaaacagtagcattctatatcccaataacatccaggtggaaagccacttcgaaaaggcaatccccggaccaaaacttaaccacacacacccagagagagagagagaacggagaagagaaagagaagtcacctaagaacatttctaaccaaggaggtggaaaggccctacaaggagaactacaaaacacagatgatacaaaccagatgggaaaacattccatgctcagattgggagaatccatatcattaaagtagccatactggccaaagcaatctacagattcaatgctattcttaccaaattacccatgtcatttttcacagaactagaaaaaagctattctgaaa

SEQ ID NO: 695137 - DNA, 134 bp, Homo sapiens
cctccccccatcacagccgaacgatatttcctattcgcctacacaattctccgatccgtgccgaacaaactaggaggcgtccttgcccgattactatccatcctcatcctagcaataatcgccggtcacgagat

SEQ ID NO: 695138 - DNA, 274 bp, Homo sapiens
gggggcccccccccccccccgggtttgggggcccctttccccccccccaatgggggttatatgggggggggggggggccctttttccccctttgggggggccccctttcccccggggggaaaaaggggtttccccggggggggtttttttaatttttttccccgggggtttttttttttttttttttttgtgccccccccgggggggggggggggagaaaaagttttttttggcccccccccaaaaaaaataaaagggggttttttttttttta

SEQ ID NO: 695139 - DNA, 167 bp, Homo sapiens
  misc_feature (77)..(77): n is a, c, g, or t
  misc_feature (93)..(93): n is a, c, g, or t
  misc_feature (114)..(114): n is a, c, g, or t
  misc_feature (124)..(124): n is a, c, g, or t
tgggtgtttgcgggggtctcgcggggcggctgcggtgtttcaccggggaaaggctcgaggagagcgcggctcacganagataacccagctttnctccctggaaccttcaatttnaaggcctccntgcctctactaggcgccttagctcactatggggaaccacttga

SEQ ID NO: 695140 - DNA, 700 bp, Homo sapiens
gctttagttttggaggaaatattgtgtgtcattctaaaggctaaagtagggtgatgggtgcagatactagtaagtggatttgaaacaatcagacgtcaggcaatgcaaggggttgcctcatgaggtggcaatggggggtatttatgcagaccacctgtggagatgctgttcaagccgtaaattgttggggacactggatgagaggacctctgaggtcctggtgttctttaattctcggactaaggccattgaaaggagcaagctgggctacttgaagaaaattagaagtgaacaaaagtatagggctcttgaaatccattttcgccatttgaaaatggtgggattgtttctgatgcagcggagatgttgaggcagttgagactgaagctgtccttctggaagagatggttgggttgtgctggaaaacagtggattggaaaccgttgagagtcttaccgcagctagggcaaagggcagggaaacagaatgctctggttgcttaaaagttcgttttctatccgaacatactgaagttatggatcataccttgatttgaatctgtaatttctagaagttgtgtttctagcccagttcttggaccatcaagccagctcattgaccaaatacttcaaaacaggagaaccaagcagctctcatttcgaaagccttctgtatgtaataggaacagcagctttccagt

SEQ ID NO: 695141 - DNA, 264 bp, Homo sapiens
  misc_feature (1)..(1): n is a, c, g, or t
  misc_feature (44)..(44): n is a, c, g, or t
  misc_feature (106)..(106): n is a, c, g, or t
  misc_feature (115)..(115): n is a, c, g, or t
  misc_feature (140)..(140): n is a, c, g, or t
nctgcattcctgaccggtgtgactgagccgctggaattcctgtncatgttccttgctccgctgctgtacctcctgcacgcactgctgaccggtatcagcctgtttntggcaacgntgctgggtatccacgcgggcttctntttctctgcgggggctatcgactacgcgttgatgtataacctgccggccgccagccagaacgtctggatgctgctggtgatgggcgttatcttcttcgctatctacttcgtggtgttcagtttg

SEQ ID NO: 695142 - DNA, 399 bp, Homo sapiens
cttataatgcaatctatcgtcctttttgctacaatgagacccgactcgtgtgctacacgaagaggctcccagtctgttcccacctatacgtggttggtaacctccttgcctgctactttactcatgctcttccaccaggaagaattaataatgtattttctgataccatttctgttgcatatatgcacataattcttacatacattgggttcaagtttcacaagtaaagagtgcaattgtttcaattatttattgaccatatatttgttgtatgactctgtgaggagaagaaacaaaccatttttcctccgctctcataccacaacagtcacagaaagactactgtgagcaaatgtgtttccccacacacaaggcaagcaatcagttctgcagtgcaca

SEQ ID NO: 695143 - DNA, 550 bp, Homo sapiens
tattactatttcctttttttaggcacatgacagtgttggtattggaggaccttccaaggaagagggatgctgtaccagtggtgcctgggtgcctggcctccagtgtcccacctccttcaccaccccactgtggctccttgtgccatctgtgatgctgaggtatcctgttgggtgaaatcaggttgtttggtggtaacaaaggaaaggaaagggcttctggatggctttgccacaagcttacctgtgggttcacagtcctgagaaggccaccaccagttcccatcagcactgtctccatgcagccaagttgcatgggtcccatgtccagctgcctctatgggcttcaggggttattctgcttccgtgaccccacaccccactatgtgcaatcctcaaagattggtcctgattctatattcctggacacctccactgcctgttcctgggggatatctacttactccctgtgatggaaagccctataagcctgttgagtctaacagcgtacaagaacatgaccctgtgacctattgactggggcccccagaaa

SEQ ID NO: 695144 - DNA, 808 bp, Homo sapiens
  misc_feature (450)..(450): n is a, c, g, or t
ggcacactggtgactacgcagcttttggcgatactgctgcgtcaatccgcgggcaaggatgggcaatgtgtgtcaccaaaggaggacactcgactgagatcagggacatgttgcaggccaataaggtgccagcggcagcccgtgctggagccagtgccccaagtgaagtcactgtgccagcccaggacacgtggtctcgggcccagagaagacctcctttttccaggcctttaggtatcaccaggtccaatctccagggagcaccattgacaatcctgaggctgatagtgcagctggatcaagatctggagacaaagtgggatgcctagcgaagccactgctgctgaacatgcgtcaatacatctcccccttgctcctttgggactggtgcatccagcaggtgttcgacaatggcatgcatctacaaccgctgaagtgcttagatatcancagatggaaactctgcaattctcgcttcctggagggtgtccgcaatgttagccagtgtctgtctgcagaattggctacccaactgttgcatcagtaccccattctatcatcaacggggacaaacgagtcctggccttgtctgtggagacggattacacctgtcgcacagcttgactgaaaaggtcaaggccttcttggctgatccatctgcctttgtggctgctgcccctgtggctgctgccaccacagctgctccattgctgctgctgcagccccagctaaggttgataaccaaggaagagtcggaggagtcggacgagatatgggatttgtgctctttatttactcaccataagca

SEQ ID NO: 695145 - DNA, 1604 bp, Homo sapiens
  misc_feature (1371)..(1371): n is a, c, g, or t
gcaagtgtgctagaataccctgatctccagggtctaaagagacacagctgagacccagaaaatgatcttcgagtggtacctcattgtgcggagaaccagagaccctttcgagccccttagaaatgcttatttatccgcgtgctgtacctctcacgcgtccagtcattgctcacactgcacctcacgccatactcactgggtctcgcattctcccagaataccttggaaggaatcttcctaggaggaatggcgagttcaacgacggaatagacctgtatgactcaatgtgttcttgccagaagtcgtgcgctgtacttggaaagggtctgagcggctcctctgtaatagcactgccattcaataatccagcctacgtagacccaggcacggacaggcctatcttgcgccttccggagggatccatgtctgggtatagcgccccttggcccaaggctttcactccagactagtgtagcttgaatgttctctatgcctggggggtcaacatggcggcgaatcctcacttcatacaacgtgctccgagacgtgacaagggtccgactagcgaggcgtgacaagacataattgttagagtataaagcttttgacaagtaagggactcgggggtagtataaaaccattaggtacgttggacataaaccccacgaatctcacattacgaaaaatctaaggctgaccacacgtgccttccatacctaggtcggccccatttgcccccccaaggatatcaaacgcacgcctttctaggttctcgcgaatggtacagggtcactcttcctaattactcaggatcccttgcggctatattttccccttgtggagaatggaacgaaccctgggtgggcaattaacccataagacgatctcaatagcgtctgtggacgattttgctctaatcgcaacggtaatttcctgggaaggcgaagactgaatagcggataggagcccagtggcggttctatctgtggcgaacttccaacccgtttttgtgaggttcctacccataccaaatggagatgtttattacccatagactgaaggtcaaagggtataccctttctcaaccccaaaatttgcctaaggtaggtaactctaaacgcgtaccatacgtggcgccgtccttttacaagaatgactcctatggaaccatagggaaaacccgcaaattataggattccatgaagggccgcaaccgtaacgtgttacttcggttggttattccaagtacgttaaacccaaaggcgaagaaaggcgctcccttttgaagcggcatacagcatgctgctgaatgagcataagacgcatctcgcgatgtacaacaaccgtccggtggagccagaatttccaatncccgggttcaccgaaggaactaaaatgtacgtgtttcattgtccccccattgtttgggacggccatttatcctccggaattgtaaaacgggtgagaacacgagcatgcgaattttgggcgccatgcgcggtgtcacatttctttcctccttgtggatagttgcggcccccacaaccgtgtagtggtcatcttccggacttatttgtgggccactcctagacaccaatagaatt

SEQ ID NO: 695146 - DNA, 195 bp, Homo sapiens
gtcgtatctccctgagtccattgatggccatctacagcctctggccccatccagactatccctttacctggagcaggactacttcctcccccagacagttcttccctggacacatctattcattgcccgtatagattctagggttcaataagcttctccgtctcaaacactctcacattactccgtctgaatcta

SEQ ID NO: 695147 - DNA, 108 bp, Homo sapiens
tataggagcattactcccacataggaaggcagagccctcatggccctttggcttcccaaaattctcatattctaataccaccagggtgggaaccaaatttcaagcagg

SEQ ID NO: 695148 - DNA, 351 bp, Homo sapiens
atctcactacacaatgcgcatgacgccgcggggctctgtgagtatgtcaacgttctcatagctgtacgccatgatcactatgcctgagtaattgatagatgactatgtgattacatacatgcgagagaaagaaagaactcgagggagaatagtgaagcgatacttgtggaagatggaaatggaagttcttgtagtgcattatgtgttctatagtctagggaggatgtatattgtggaatctaccgatatgcaacatgtgtgactgatttgccatgaactaagacttatggtcgggatgactttggcattggttttgtccttcaagaagctgagaacgaacagttccccctg

SEQ ID NO: 695149 - DNA, 368 bp, Homo sapiens
  misc_feature (261)..(261): n is a, c, g, or t
  misc_feature (275)..(275): n is a, c, g, or t
  misc_feature (334)..(334): n is a, c, g, or t
tgagatggagtctcactctgttgcctaggctggagtgcaatggcataatctcggctcactgcaacctccacctcccgggttgaagcaattctcctacttcagcctcccgagtagctgggactaccggcatgtgcaccacgcctggctaatttttgtatttttagtagggacggagtttcaccacattggccatgactgctctcgaactcctgacctcaagtgatctgcccatcttggcctcccaaaatgctgggattacanggcacgagccaccngcgcccggtcaagaaccatgtaaaagcccctctaagtcatgttggcataaactcttaanttcattcttttttaaattgactattttcattagt

SEQ ID NO: 695150 - DNA, 115 bp, Homo sapiens
gcaaacccaccccaccctaccaccagacaaccctagccaaaccactttatcccaaaaaaagtataggcgatagaaattttacaccctgcgcattatataatagtgaccgcaaggg

SEQ ID NO: 695151 - DNA, 676 bp, Homo sapiens
ccccgagggttaagataagcttgattggggatggcggggagatcgcttgaacccagcagttcgaggccagcctgggcaacatagcaagacctcatctctacaaaaacatgcaaaaaattagctactcaggaggctgaggtgggaggatcacttgagcccaggaggtcaaggccatgatcggctgcactgtactccagcctgggtgacagagcgagaccctgtcaaaaaaaaataattccttgcttttacataactgggtaagaaggtggacgtgctagtaaggtccaaacactcttgtcctttttttcttatttttttttttggcccccctctggggggcttcaaccccctgtggaacctttaaggaggctttggtggtggtggtggtggtgacattctttttaatttaggcccttttttggcctctctagagagctttggtgttttaacaggccttcccaaatcgattccttgcggccgggggtacccatattttatagggggcccgccccgggtgaccccccagttttggccctttaaagggggaaaatggccctgggaaaccaggcaaagtggcctgggaaacctaaaaaaaaaagggtcgcaacatacacaaactcacacccactcacctaactacccagcccaacaacgtttacagcgagtaaccaacaca

SEQ ID NO: 695152 - DNA, 494 bp, Homo sapiens
ctagctgggtgatggagtgacgagactattgcatgatcagtctgtacttggaaatcgtttctccatctgtttgagatgtgtgcagatctgtgcttacccattgaattttattttcaatggcaagcacagatagaattgcataaagagtcctagtaatccatcatagatatgagaatttttgctgcacgtctatgtggttttttttttcatggtggatggaggggatttggtaagcatgtgttaatgttccagttccatgggctgtcagaatgataaactttggagtgtctctctggtgagagtgatcatctaaccaaatccctcttctgttatggcactgtgtgtctaaggtgttgtatttatgttgccaccagctacccattatcactccattctttctgggcttatatggttgaaggagaatggtcctgtatcacagtttctttgagccctttctccatccctggccaaaagcaatcttaagttatttgcca

SEQ ID NO: 695153 - DNA, 1006 bp, Homo sapiens
agcacaggagcagtcacctgctgccactgctactgccgctactgctgccggcgcgtctgcacctctcgtgcctgccagtgtacctgccggcgccttcggttcgaccgtcccctcgctccccgtctcctcgctttgcgctctctgtatctccttgtttcgttggctcgctgacgctctctcgtccccggccgcgcccgtagcacacacaccaaccccagacaaccccacacccagccgcaccaaccaacccggacccacacctgcccaccgcatcacgccaccccatagcagcgaccacaccaacaacctcccactacactcactccacctcacctccgacgcgacacaacacgccacctacacataacgagataccaacactccctaacgtctccactaaacaatagcaaataccatacaattaacacaacaaagaaacaaaacacaccgcacacaaagcccacatgtggaacctgccacatccagcatacgtacacaccccactcatatacctactcgacagacccccgccacggatatcgtgagcctttaccttattagaacatcaacagataattatttgatccaaacctacagactacactctagaccaccaacaaaataagacataataaaacatactaatatatatatttatctactagaacactacacaaccttacaataataaaaatacagtcgaccacaacatacaaaaaacgaaaacggacagaacctcacacataacaacacactcctcgcaccacaacgagaacaacgcccaccccacgccacacgcgaacgagccagcacccactagccaccgcaccaggctctcgtctacacttaccccgctcacccaacaaaagagaacgcctactagccacactctagcagctaaccacaaacacgatgctgaccacacactacagactcagaactcacccgcactcacacaaacggcgccacaggaacaacgtagcaccaaccatgcgcgtacacagag

SEQ ID NO: 695154 - DNA, 332 bp, Homo sapiens
gctcgactgactcttaatattaaccatcacatcggtaaacccaaaggaatataaaccgttcgaagatacatgcattcatatgttaatcacagcactattcacaatagcaaggatgtggaatcaacttagatgcccatcaaccatggactggataaaaaaattgtggtatatatacagcatagaacacgacacaggcataaaaaaagaatgagatcatgtcctttgtagcagcatggatggtgctggaggccattatcctaagcaaactaatgcagaaacagaaaaccaaataccacatgttctcacttataagtgggagctaaacactgagt

SEQ ID NO: 695155 - DNA, 513 bp, Homo sapiens
  misc_feature (28)..(28): n is a, c, g, or t
  misc_feature (36)..(36): n is a, c, g, or t
  misc_feature (154)..(154): n is a, c, g, or t
gttaagtgaaataagcccagttccaaangaaaaatnctatatgattctactaatatggggtccataaatagaaccagtagaatggtggttgcttgtgggaaggcagaaatgggagctgtctaatgggtacagagtttgttttgccagatgaaancattgggagatctttttcacaacaatgcgaatatacctagcactactgaatgtgcacttaaaaatggctaaaatgggccgggcgtggtggctcatgcctgtaatcccagcactttgggaggccagggcgggtggatcacctgaagtcaggagtttgagactagtctgaccaacatggtgaaaccctgtctctactaaaaatacaaagaattagctgggcatggtggcgggcgcctgtaatcccagctactggggaggctgagtcaggagaattgcttgaacccaggaggcggaggctgccgtgagccaagatcgtgccattgcacttcagcctgggcaacaagagtgaaaatcagtctc

SEQ ID NO: 695156 - DNA, 527 bp, Homo sapiens
gaactactctttagagagaattatccccattgtgctggtgtgggctcagctactttgggaggctaaagcaggaggattgcttgagcccaggaattcaagaccagcttggtcaacataacaagactccaattccaagaaaaaaaaaaacccaaaggacaaacaaaagaagaatttaggctgggtgtgctgcctcatggccttaatttcaatactttgggaggccaaggcaagaggagtacttgagggcagaagttcaaaaccagcccgggtaacagtgagactgtctctacaaaaatttttttaaattgtagggcgcagacactttgggaggcgaaggcggccagatcacttgagctcaggagtttgagaccaacctgggcaacatggtaagaccctgtcaccactaaaaatacaaaaaattaaccaggcatgatggcacacacatgtgtgcccaagctactcgggaggctgaggctggaggatcgcttgagtccaggagttttggcctgtagtgcgctttgccgatc

SEQ ID NO: 695157 - DNA, 1003 bp, Homo sapiens
  misc_feature (1003)..(1003): n is a, c, g, or t
taatagtggtgctttttggaatcagcattacaggtggcttgttttacacgattttcaaagaacttttttcttcatccagtcctagcaagatatatgggagagccttagaaaaatgcagatcacatcctgaggtgatcggtgtctttggtgagtctgttaaaggctatggggaggtgacaaggcggggtcgccggcagcatgtcaggttcactgaatatgtaaaagatgggctgaaacacacgtgtgtgaaattctacattgagggctctgagccagggaagcaaggaacggtgtatgcgcaagtgaaagagaacccaggaagtggtgaatatgattttcgatatatatttgtagaaattgaatcttatcctagaagaactattatcattgaagataatcgatcccaagatgattaaaatagggtttctgatggatgttgaatggcgtggactcgctactccgttcttcacagctgccttccagaatgtgttcaaaagaaagacaagaaggagtgtatggcttataaagtgaatctaatacagtatttgttgcatttaaacaaactagacattttcttacggaaaaattatgaaatacagcatattttatgttctcccattgactcaatcatgacaatatttctgctttaacaccatctttcatgattagaaatgtttgttattggaaatgttacaccatgtaaataaaggaaatagattttagtattgtattcattttatattatagaactccataagtctggcggaataaaatttaaaactaaccaactaaaaaagaacaagaaacaaacagaaggagaaaatggagagagaggcaaggagaaccgaggaaggaggaggaagggacggaggagggcggaaaaaggcagaacgtgagagcgaaaggcggacgaaataggagaggagagggaggaggaggagagcggagagaggaggagctaagaggggaaacaaagaagaagaagacggagttggggcgcagn

SEQ ID NO: 695158 - DNA, 949 bp, Homo sapiens
  misc_feature (949)..(949): n is a, c, g, or t
taatagtggtgctttttggaatcagcattacaggtggcttgttttacacgattttcaaagaacttttttcttcatccagtcctagcaagatatatgggagagccttagaaaaatgcagatcacatcctgaggtgatcggtgtctttggtgagtctgttaaaggctatggggaggtgacaaggcggggtcgccggcagcatgtcaggttcactgaatatgtaaaagatgggctgaaacacacgtgtgtgaaattctacattgagggctctgagccagggaagcaaggaacggtgtatgcgcaagtgaaagagaacccaggaagtggtgaatatgattttcgatatatatttgtagaaattgaatcttatcctagaagaactattatcattgaagataatcgatcccaagatgattaaaatagggtttctgatggatgttgaatggcgtggactcgctactccgttcttcacagctgccttccagaatgtgttcaaaagaaagacaagaaggagtgtatggcttataaagtgaatctaatacagtatttgttgcatttaaacaaactagacattttcttacggatatttctgctttaacaccatctttcatgattagaaatgtttgttattggaaatgttacaccatgtaaataaaggaaatagattttagtattgtattcattttatattatagaactccataagtctggcggaataaaatttaaaactaaccaactaaaaaagaacaagaaacaaacagaaggagaaaatggagagagaggcaaggagaaccgaggaaggaggaggaagggacggaggagggcggaaaaaggcagaacgtgagagcgaaaggcggacgaaataggagaggagagggaggaggaggagagcggagagaggaggagctaagaggggaaacaaagaagaagaagacggagttggggcgcagn

SEQ ID NO: 695159 - DNA, 766 bp, Homo sapiens
  misc_feature (697)..(697): n is a, c, g, or t
  misc_feature (715)..(715): n is a, c, g, or t
  misc_feature (734)..(734): n is a, c, g, or t
  misc_feature (762)..(762): n is a, c, g, or t
agaaaaaagagtaaacagaaatgaacaaagtctccaagaaatatgggactatgtgaaaagaacaaatctacatttgattggtgtacctgaaaaagatggggagaatggaaccaagttagaaaacacccttcaggatattatccaggagaacttccccaacctagcaaggcaggccaacattcaaattcaggaaatacagagaacaccaccaagatactccccgagaagagcaaccccaagacacataattgtcagcttcaccaaggttgaaatgaaggaaaaagtgttaagggcagccagagagaaaggtcgagttacccacaaagggaagcccatcagactaacagcagatctcttggcagaaactccacaagccagaagagagttggggccaatattcaacattcttaaagaaaagaattttcaacccagaatttcatatccagccaaacgaagcttcataagtgaaggagaaataaaatcctttacagacaagcaaatgctgagagattttgtcactaccaggcctgccctacaagagctcctgaaggaagcactaaacgtggaaaggaacaaccagtaccagccacggcaaaaacatgccaaattgtaaagaccatcgatgctatgaagaactgctcaactaacaggcaaaataccagcttacatcatatgacggatccgttccacatacaanttaccttaatgtaatagntagtgccattaagcagagntgcaatgataaagcagacatatggtgtnggac

SEQ ID NO: 695160 - DNA, 1102 bp, Homo sapiens
  misc_feature (1102)..(1102): n is a, c, g, or t
taatagtggtgctttttggaatcagcattacaggtggcttgttttacacgattttcaaagaacttttttcttcatccagtcctagcaagatatatgggagagccttagaaaaatgcagatcacatcctgaggtgatcggtgtctttggtgagtctgttaaaggctatggggaggtgacaaggcggggtcgccggcagcatgtcaggttcactgaatatgtaaaagatgggctgaaacacacgtgtgtgaaattctacattgagggctctgagccagggaagcaaggaacggtgtatgcgcaagtgaaagaggtgtgggaatcatgggatgtggggtcagaggttctgagcgcggtgttatttaagttctggaaaggaaaataatacctggaaacactacatttttttcagaacccaggaagtggtgaatatgattttcgatatatatttgtagaaattgaatcttatcctagaagaactattatcattgaagataatcgatcccaagatgattaaaatagggtttctgatggatgttgaatggcgtggactcgctactccgttcttcacagctgccttccagaatgtgttcaaaagaaagacaagaaggagtgtatggcttataaagtgaatctaatacagtatttgttgcatttaaacaaactagacattttcttacggaaaaattatgaaatacagcatattttatgttctcccattgactcaatcatgacaatatttctgctttaacaccatctttcatgattagaaatgtttgttattggaaatgttacaccatgtaaataaaggaaatagattttagtattgtattcattttatattatagaactccataagtctggcggaataaaatttaaaactaaccaactaaaaaagaacaagaaacaaacagaaggagaaaatggagagagaggcaaggagaaccgaggaaggaggaggaagggacggaggagggcggaaaaaggcagaacgtgagagcgaaaggcggacgaaataggagaggagagggaggaggaggagagcggagagaggaggagctaagaggggaaacaaagaagaagaagacggagttggggcgcagn

SEQ ID NO: 695161 - DNA, 1316 bp, Homo sapiens
cgtcctgttcactaactgcgccgctccttctgctgggtatgcattcttctcttctatctcggtcgctctctgtgtgcttcgtatcttgcttcacgatcacggtgtgtgcgctcgtcatgcttttccgtcggtaatgtgtgcacgccgccggcgctgtgtagcgccgcgtgtatgcccctctttttttttcctcgtggctcttcatcaagctgcgtctgccgcgggccaggcattttgttgtgggctgtagtatagtcgacgatcgtccgccagggcgcccgccaacggtgttggggggccccctctcgcgggggttgtgcctagccgccgcttttcgtgattcgccatttattgtgtgttgtgcctccgatatggtcgccccctttgttcgctcccggatcagtttgttgtcgttggattcccgtttgtacatttcaccctggcccgtggcctttgggtttcgtcgacacatggcgtcgtgttgtacgtggtggatctcccgccgttgcccagttgccgaagcccccccggggtcaagcccgtcagccctttaggccctcctgatttatttcttaccccaccttttagcctagcccgtgtgtactcaaatcctcgtgatacagggttgagccatctcaactcctaatttacccccctgatacggcgccactgcggagcagtagccccccacaccaatctcaaaatgaagtccaccccttagccatcagttgctactattccaccacttatctaataaggtggctccctttaaacctttcccgcccttatgtcacccacaccaaggaacacccttctgattaactcctgccactcatgaccccttggccataaatattgatttaatctccaccacctagcacgaggactccatccgagacccccttcgacccttgccgaaaggggaagtccgaaactagtctcacggcttcaaacacttgagatatccccgccacggccccttcgccctatttcttcaatagcccgagaatatcacccacaccacttatttaataaatataacacccctcacccacctaccacattcttcctatgggaccacaacacatattgaacgcacactttcccctgaacttctacacaacatattttgtcaccccagaccctactttctaacctccctgtttcttatgaattcgaacagcatacccccgattccgctacgacccaactcaaacaccctcctatggaaaaacttcctaccactcaccctagcattacttatatgataatgtctccatacccattacaatctccagcattccccctcaaaccta

SEQ ID NO: 695162 - DNA, 1180 bp, Homo sapiens
  misc_feature (833)..(833): n is a, c, g, or t
  misc_feature (878)..(878): n is a, c, g, or t
ggcatgtgttgcgccggcgttgtcctgtctgcttgggggctccctgaagaaatccccaggcccgctccattgcttctgcacatgtctgatctcacatgggtgcccaggagattcaagagaaatagatttcatgacatctttagtcgctcaactgaggacgaggtattttatttctgataaggtggtagatcagggagatcatgggaccatcttctgtccctgtgctttagtgctcggtccggtgcgactgtgtttggcatctccagacatggttccagttaactgcgttgcttggcttggagacgcgtttggattcatactgcgatgtgtgactcatttgcggtgcgtatcgtcttccgttgcttttcacttgagttggatgagatagctgtagtttgctggcgtcagcgtcctggaaatgcgtcgggcgcgtgaagatgcctagccgccgccgacgcagactcatctgtctccttcccagctcttgttccgactttaggtctattcatgcgcgacaagcacgttggacacccctggggctcgagagatgggtcacaaagactacgtagtagaggagatagtagcggaaacatgtctcgcatcttgaccctaggatggcattcattagtcagacaggcagtgacgcttaggttggcaccaagtagatgggtgcaggttcaccaaaggcttcgatgtcaagggtggactcaagaatgtccttggctaatttgtacaaggacgctctgtgatcggacaaatcccaaggagggcctgaaacacaaagacgacgagatggagttttggagaaaacgcgaagaaagcgccatcatcgntactaataacaagtcttcgcatggtcgtgtctataagagttgcgncgttgtttagctactagtccacccttgttgagaaggtgtcttatactaacgaaatgcattcttgtggaagacagacctatgcacacatattggaatcccacgcatgatgttcgatggcaacgggtgctttcacagcgggcttccttgatgtaccttcccattggccattagcaattgggaaaattcttgagactaaactttcggtggtttgtaccttttttttcccatgtaaagcgcctctccttgttctgagtgcgccccaaagtgggacacttttgggaaggagaccagcccataacttg

SEQ ID NO: 695163 - DNA, 348 bp, Homo sapiens
gcagactggtactaaagtgactctgggggactggtcccttgggaatcagagggcctgaagcatggaccaagatgacctgggctacctgcatggaaacctctctctcctaccaggagagccctggaactaagcctggctctggtaaatagctccaatgtgcgagccatgatgcaagagctgcaggcctttctggagtcctgccctcctgacctacgggctgacctgtgcctcaggcatcctgctggctgcagagaggtttgctccaaccaaacgctggcacatagacaccatcctgcatgtgctgacaacggcgggcacccatgtgcgggatgatgcagtggaccgtag

SEQ ID NO: 695164 - DNA, 1039 bp, Homo sapiens
gctcgcgtattccctgggagatgaggccgggacgttctccctgactgctggtggctggtgctctgtgaagctggtgcaccttcgtgaccgctcacagctatgaccaacccggagataacaacagaaggtctcaaatcaagtgaagacatgtcgcctgagacagccttcagagaagcataacagcggtcgaacaagcccggcggggactttgcagggtcgtccaggggcctcattcgatcccaggtcctaacatccagatcactacagcggtttgcatgtgcatcgggctgttcgtggtgacgtatatcccctagtaacgacctgttgaggatctaacatgacgtagcttggtggataccctgtattgatgtcgcgcgtcggtaattgcaatctgttcttaactgtacttgcatctatattcccagttgggctacagagggcggacgagggctgtgactcggtcactcacacatggtcagtcgagtcatattcgggtggactgctaggatgggaaaacacgcgaggcgtcagaagagtatttgagacttgtttgacctagtattaatccatctaattttctgaattcatattacgatgctatagacctggcattatgcgtttattaatccagaagtacctgatgaaaagaattttgatacattgatgaaaacatctgatggtcttacattgaatgctgaatcatatgtttccgtttacaaccaaaaatggaatattgctactggcttgctaaattattgagtatgggggttctcttgctaaaacttgatattcggtatatgagattacttcgataccgtgataatcatcgctgtgcagtgataaataacctgaaagtcgttcttgatgaaccaggctgtaagttgggccggaaaaataatttagagcacgtgtattaatttaagcctagaggggggttaaaaggggccgaaattgaggtccttgttagaaaagtccttatgtaggaatggataagttaattaatctaccgaggggatatttttacaattttaatggatta

SEQ ID NO: 695165 - DNA, 406 bp, Homo sapiens
agttcgctcattagatacatgcgaatctttgtgttatatactgttcattgtgtgcctaatcccctgttaggggtctaaatttttactttcttctttgttttttctttgtctgtactgtttttgtttagagacagggttctcactccttgctctgtcatccaggctggaatgcggtggtgcaatcttacctcactgcaggctctgcctccggggttcaagtgattctagtgcgtcagactcccatgtcgctgggattgcaggaccctgacatcatgccttgcctaatatgttgtatttttcagtgcagatcgggttccaccatgttggccaggcttgtctcgaaattctgacctcaaggtatccgtgcagctcggtcctctcaaagtgctgtgattacaggtgtgag

SEQ ID NO: 695166 - DNA, 99 bp, Homo sapiens
gcaggtcaaaaagaacctctattactttttatgattgccacttatgctttcttcccagatgcctttgcaccaggtgctttctgggctggagctttttga

SEQ ID NO: 695167 - DNA, 518 bp, Homo sapiens
cgcgctctcctcgccggcgcgcgccagcctgcgcccgccgttgcccccagtgcctgggcacctgttggaggcagagccagggtgctgcatgatgggccgcaggggcgatcgcatgaccatcaacatccagtgagcacatggtccatcaactgtgtgccccgggcccatcctggcccatcctgctcagcatctctgactgacttcccactcggtgggacctaggacctggaaagggggctggcggtggtgcttgctgcgtggcaggcgccccctgcccatccttggtcccctcattggcctgctggtctgcctctcctgttcggggaccccttctcttttggggcgacttgaatctaggcttccacatgcagcgccattgcgtggccagggcacggcttgcgtaccgagcgcttatggaacgttcccgctttggattgctcgcgcccgacgctttaggtccagctgcctgggtagcctgttggaacccatttcttcctatggactcggggcccttcctg

SEQ ID NO: 695168 - DNA, 103 bp, Homo sapiens
ctctagagtgatccctaagagtgagctacagcatgatctattgcaaagagtgaaagaacaaaacttctacagtgctggaacgcgggacccaagtggtgttgcc

SEQ ID NO: 695169 - DNA, 262 bp, Homo sapiens
gagctccgtacctaaagcgaaggtcaaaggaggacccaagatgagaggaggaaggaggaggaggaaagaggaggggtagtaagcaggaagaataatagaaaggaaagaagaggtagatcaagaaggtagggagtagcaggacgctatgctggcatagtagtagggcagggaaataagtagtagtaggaggaaagtagtagtaggcaaacgcagaagtaaggtggccagagtagcagtaaatacacgtcctagcacataccca

SEQ ID NO: 695170 - DNA, 397 bp, Homo sapiens
atggagtataacttgacttctatgtgttatttgattgaatcttgtgacattcgggaatgattcagcttataacacgtattatttatcaaaatgttatcaaagtaatatcatgtgataatctaggatgacataagaatatctgtgacttggacagaattatagtctgtgaaggaacagcttaaatacccaagattgtacttatatttcaagagggctgtagtaataacgtttgatttaatgatataaatgcagtaggtaatccaggtatagtaaatatgttttacagtgtgcatagtctatgttaataatttattaaaatactgagacatttaatattgtatttttatttatagcaatttaacttcaattatgtgacaagctttaggtgatagatgag

SEQ ID NO: 695171 - DNA, 930 bp, Homo sapiens
ggagagagagagagagagagagagagagagagagagagagagagagagagagagagagagagagagagagagagagagagagagagagagagagagagagagagagggggggggcgggggggagcgggcgagagagagagagagagagagagagagagagaggatcgggtgtgtgtgtttattatagagagagagaagagagagatatagaatagagagagtgagtgagtttattagtagagtgatgatgagagatgagatgatgtgaggtctgagttgtgtgtctcatttttgttgtgatgatgatctgctgtgtgtgtgagtagtagtagtagtagtagtagttgtgaaggatgagagtactagtaatagtaatagatataagagtggtagtagtaggagtagtagtagtagtggtggtggtggtgactgactactagcagagtagtagtagtagtgagagcgtcgagcgacgccggcccggaagcaggcacgagtggtgttgttgtttgtcgtcgttgtagctgggacgactgctagcactagttgatgttgtgtgcttcttcgctgcgtcatgcggcgaggcggaggaagggacagagcgcgcctcgttccttgttgttgttcaggaaggaggagccggcgctagtagtagttctagtcggtagacgacgtccgtggtgggaggagggaggcggaagacgaacaagaatagtatgaagaatggagaatgggcgaacggagctaagtcgcttgttagtttgtaggttgttagtgagagtgttgtggatgactggggagggggtgatagtcgtaagcagtcgttgtacttattagtaatgcggaggaagtgggaagagtcgatgattaataggtaggaggaagggaggagagaggtaggtgttttagggaggatgacgacggaagagg

SEQ ID NO: 695172 - DNA, 484 bp, Homo sapiens
  misc_feature (218)..(218): n is a, c, g, or t
  misc_feature (220)..(220): n is a, c, g, or t
  misc_feature (266)..(266): n is a, c, g, or t
  misc_feature (276)..(276): n is a, c, g, or t
  misc_feature (329)..(329): n is a, c, g, or t
  misc_feature (348)..(348): n is a, c, g, or t
  misc_feature (382)..(382): n is a, c, g, or t
  misc_feature (406)..(406): n is a, c, g, or t
  misc_feature (413)..(413): n is a, c, g, or t
  misc_feature (417)..(417): n is a, c, g, or t
  misc_feature (477)..(477): n is a, c, g, or t
  misc_feature (479)..(479): n is a, c, g, or t
gggggggaggggggaaagagggggggggggggggggggggggagaggaggggaggggggaagagaaaggggggggagaggaaggggggaagggggggagggggggggggggggggaggggggggggggggggggggggagaagggggggggggggggggggggggggggggggggggggggaggggggggggggggggggggggcgcggggggcgggngnggcggggaggggggggagggggggggagccccaggtggggggaccngggggggagngggcccccccggcaagcccgcgccgaccgcaggtaaaaggtgctcctttgccngggtttggaggccagcgcngccacacccacggggcaccgccgggcgagtttgngcgaggccccacgtttaaagcganggcaccnccgncccaggggggtgtgaggattacccagtgtggtaggtgctcaataaatgttggtcaatgtnancactg

SEQ ID NO: 695173 - DNA, 545 bp, Homo sapiens
tcggtgaccgccgccgccgctgcctcgagctgatcacgcgccttcgtcgcagccttctccgcgcgagcacgttctgtcgacgccttctcgacggttgccagtgcctcacgaaccgcgcgtacgtcaccgtcccgctcctcggcgtgcccgcgaagagcggtactgatctgatcactgcgagccgtgcctggcagcggtgtccacacgatgcccgcatcctcggctgcagtctgcagctcttcctccgcgcgcgtcacgccggcaacggagtcacggagtgcggagtccgcccgagcggcctcgacggtgcgctgttccagttctgcttgcgctttccgtgcccggtcggcctgctgtgccgtcgacacttcgagcttggcagcagattcggcgaggtcgtccagttgctgcttgccctcgtacgcgctcgagcgctggagagtctcgcggtctgcgacggcctgatccaatgcgcgttcggcctcgtcgaaccgggtttctgccgccgctcgttccagcagccgccgatccttcagcgcggccgc

SEQ ID NO: 695174 - DNA, 491 bp, Homo sapiens
cgcgtacggcactatgggtctacgtgcaccagcacaggtagtccagcctgaaataacagactcactggatacgagcgtcaccaaacaatgcatggttctgtatgaagctctattgaagggcgagtgggatttgaatatttggacccctgccgctgaggtacagaagaagacgtatgccttcaactgtcacagactaaaacgcaaataactatcgagcacgatccacccagtcaatgccatttcttctcacaatatccacaatacatatgccacaggctggttctgatggctttgtaaataatatgggatccatttcacaaaacgcgactgtgccaattccatcgataacccacgaacatcgcatcacttgccttcagtaatgatgggactacgcttgcaatagcgtcatcatctatgtctgaaatggatgacacagaacatcctgaagatggtatcttcattcgccacgtgacagatgcagaaacaaaacc

SEQ ID NO: 695175 - DNA, 560 bp, Homo sapiens
ccctagagttcccagtgtcttcaagacaagataggctaccttccttgtttgtttcattagtggctacatccccaggcttagaacagtgccttgttcctgccaggcgcggtggctcatgcctgtaatttcagcactttgggaggccgaggtggtggattgcctgaggtcaggagtccaagaccagccctgaccaacatggtgaaaccccgtctctactaaaaatacaaaaattaactgggcatggtggcggacgcctgtaatccaagctactccggaggcagaggaaggaaaatcgcttgtacctgggaggcggaggttgtagtgagccaatatcttgccattgaactccagcctgagctacagagtgagactgtgtcttcaaaagaaaaaacaaaacaatgaatacatatcaccgaaagaggacaccaaactgggtatagtaccaaacgggttcagagggtagattagtaggattgagtattcactggattgctgaagtgtgtgccataggtcacacatccagttctgggcttgagagacgacaggatccctgcttcttg

SEQ ID NO: 695176 - DNA, 198 bp, Homo sapiens
tatgaggatgtccagcatccaggcatcaatgtcatcagcatctgactggaactggtgcagcagggaggccacctaccaggcgcttcttccgaatggccagagagctgctctaggtacggcccactgctcccgagatgtaaatgatcctctacacggatctatctccgacccgcaagtgctcctccgacgctcatgtct

SEQ ID NO: 695177 - DNA, 427 bp, Homo sapiens
tctgaccgttgacgtcgtagaccgtggcaccgtgagccagctcgagcagctccgagccgttctccttgaggtaggcattgcagtcgacgagcagctggtcgtcgatggcgtgagcggccgcccacttgtagatgctctcgttctcgctcttgtcgggcttggtcaccggccggaaggtgagctggtcgacaccgttggcggtggcgaagtcgatcatcttcttcatctcgtcgacgctgtcgagatagcccttgaccagcaccgttgccagacgcacggtgaagttgaacttcttcagcttggcaatcagagccggcaagtcttggtactcgcggtgaggcgtgtaaatcgacttgttcttgctgcgctcgcagtgcaccaccgaaatggcgatggtggtgaggccgaggtcataccacttttgcag

SEQ ID NO: 695178 - DNA, 468 bp, Homo sapiens
gacctctactcccctgacacaaaatcattcaagaagaaatagatacagcctgagcaacatggcagaatcccatctctacaaaacatcaaaaaaaaaaaaattagtcggggcatgggggtgcacaccctgtaatcccaggtagctgccactacaggtgctgcaccaccacgccgggctaattttggtatttttagtagagacagggtttcaccataataagccaggtgggtctggaactcctgacctggtgatccacccgcctcggcctcccaaagtgcggggattacaggcgtgagccacctggcctgggccaaaaatctcagaatcctttaagacggttttaatggctccatcagtaatttggaagcactttcctttttttttttcccccttttgggccctttccccaaggccacaatggggtggaataattgtgggcggggaaaaagaagtgtaggaagattcctg

SEQ ID NO: 695179 - DNA, 333 bp, Homo sapiens
  misc_feature (140)..(140): n is a, c, g, or t
  misc_feature (260)..(260): n is a, c, g, or t
tcaacttctacagtcaggatatcatccaggagagcttccccaacctagcaagacagaccaacattcaaattagggaaattcagagaaccccagtaagatactccacaatgaagatcaacccctaaggtgcataatcatcnagattctccaagagttgaaacggtgtacgaaattgacacgttcatatttctacacacaaaagttatacgccacatgtgccgtgtatagcgatatatacgggtactactccacatgtttgnacgcatccacagtggaggtcttataaagcgcatccctatgcacgataagcgggaggactactcaaagaaagga

SEQ ID NO: 695180 - DNA, 547 bp, Homo sapiens
gtgcggaggattatcctggcggctcatttctgattctcctctgctggtccaggtatgctctgagttgcgaatctcagtggtttcacgtcgaggttgccgtgctttagatgccatgtgtcggtctgtaatcacgtgtttctgggggtgcgggaaggtctgtggaaacctgacccctgtacagtcgtgctgcaggtatagtgccttgctccaggtgtctatgcaaagctagacagtcatgatatcctctgttgttttgatcctccttatacaacccaaagccaacagaggatttcaacttccccaaatttctgccctgagcattaaacaactttttcctatgctaaatttggttttagttttgaagtgcctgagatgcacaattcaaaggggtcaagttcctggcctcttatgttgatgaaaccatccccaatcctcagcttacatggcttgcccctatgcctaccacctcttatagctcttccatccatcattcaagaggttccatgaagaaagctcagggttaatgtttggggtagtacaagctaaa

SEQ ID NO: 695181 - DNA, 1096 bp, Homo sapiens
gatggccgaggcagccccttaggcggcttaggcctgccctgtggagcatccgtgaggggaactccggccagcctgagtgacgtgatccaaagagcgctcccgggtaggcaattgccccaatggaacgcctcgccagagcagcgtgtagcaggcccccacggaagattaacacagtggctgaacaccaggaaggaactggcacttggagtccggacatctacaacttggcccaaccaccgagaccacccttaaacatcagtagactgggagctgtacgtggatgggagcagctttgccaacccttgcaaagtgactctgaagaagacgacaagccttgttccggtcacacccggaagctgactggttcacgcatggccgaagcatgaggaaactcatcgcgggaataattttccttaaaatttggacttgtacagtaaggacttcaactgaccttatgctaagctgcctgatcagtggacaggtagctgtgtaattggacaggtagctgtgtaattggcaccattaagccatctttcttcttactgccaataaaaacaggtgaacttctaggcttcctagtctatgcttcccgtgacacatgaagcatagccataggtgattagaaaataatgaatggcccctgaaagaatcatacaatactatagaaccacacttaggcacaagatgggtcatgcggatatcgaacccccatctaaatgcttcaacgaattcttacggtaccaagcggtttacgacaatcttcactaattaaaacccagtcaagcttggacggtctggcccggacagacgaccccgctgacgaaattattctatcagaatttcttatcgccttggacaactggcagccagccgaatacgggactattggaaccaacttaccagtgaagcagagtctgactagccctatacgactaacgggacagcactacatacgttaagcgatccacaagcctggcctgcgcagtgatccgatggggcctaacggctcttttgatgtgtgccagtaagcacttagtgaggaacatagcagagcagcccgagcatactgagaagaaccatacgcgaattacgggcg

SEQ ID NO: 695182 - DNA, 536 bp, Homo sapiens
  misc_feature (10)..(10): n is a, c, g, or t
  misc_feature (62)..(62): n is a, c, g, or t
  misc_feature (125)..(126): n is a, c, g, or t
  misc_feature (141)..(141): n is a, c, g, or t
  misc_feature (208)..(209): n is a, c, g, or t
  misc_feature (216)..(216): n is a, c, g, or t
  misc_feature (222)..(222): n is a, c, g, or t
  misc_feature (275)..(275): n is a, c, g, or t
  misc_feature (277)..(277): n is a, c, g, or t
  misc_feature (418)..(418): n is a, c, g, or t
  misc_feature (448)..(448): n is a, c, g, or t
  misc_feature (524)..(524): n is a, c, g, or t
cagagcaaantcataaaaaaaaatgctttttttttagcactgtcattacaaaaccccaaggngcacatggcaacaaatccacccactatgaccaaaaaaaaaaagccaactctactattggatannccctgaaatataaanaaaaaaattcatccttcttttaaagaaatatttttacccatgccctcactcaatcacagccctgggnnagtgtgngcattntcaaaatggtgcctaaaccctaacttctaactcctatgggggggggggggggngncagggggaaatggggtcaggggtccttggcaactgaacaactaaggatactaaaagggggggaaaaattcaaacatctctcacctgcctcataaggccatggtgaagcaatagattggaatgaagcacaatccctgtgtcngggcctcccagatccctcatgcctgtgggngggcaaacaaggggctggggcaatcatttttctgcagcccaccccgggctgagtcttcagtctcccagcctattanggtgaggcaaaa

SEQ ID NO: 695183 - DNA, 831 bp, Homo sapiens
gtagggaggggggacgatggcgtgacgggtgggccggggtgccagtcctgggcctgatctggagcaccgggaccctgtcgctgaccccactacgaacaatggaccgcgcagggccgatgtgacctgggatcgaccgtcattgcgcgcacgctgtgaggtgccatgggccgagcaggcggacggagagtgtggcacggaaggcgcgcacggccgagggagccgggtactctgagggatgcataggaggggagaacgcacggagtccggtccagtagagccgcgtcgtgggcgcgtggacgagggtatcccgcgaagactgtgcgtgaggcatggggtggaacacgaggtcgagtcactaggacggtcacagggtctgaacactctacattctgcaggatgtggtgagggccacaatttttgcctagggatgcttggggctctggttaagaagagcactccagcgaccagatgatcgtatccccttcctgatccactggagttggtccttcaaggggagcgtcctttgggccccctaggggcttttatacgccagcacggaaggctcggagataagcgcgcccccatccgggaggcatggacgggtgttcccagcggctctgggaatgaaagctatacagggcacgcggaaaccgtggctgagtggtcagccggctgccagggaggagcgcaagttggccacagccgtgctagaacgggccagttgaccgggaaccgggaaagaccctgatgagcatcgccacccggggaggccggggaacgccacaggcgggccccagggctgttacacttaccgaaccgggggcgtgggaa

SEQ ID NO: 695184 - DNA, 101 bp, Homo sapiens
aattcaagcttctaacgatgtacggggacatgtccttgctacttttaaaaacttgcatttattcctcagattttaaaaataaataaataattcatttagga

SEQ ID NO: 695185 - DNA, 534 bp, Homo sapiens
gccttttcacaagatggcgccgaaagcgacagaaggaagctcctgcccctcctaaagctgaagacaaagcgaaggctttaaaggccaagaaggccagtgttgaaaaggtgtccacagccctatctaaaagacagaagatccagcaacggtcacccaccttcctgggctggaccgaaagactgctgcgactcctggagacagcccaaatatcctcggaaagccagcgtcccaggagaaaacaaagcttgaccaatatgctatcatcaagtctcccgtgacctgatgaagttctgccaatgaaagaacagaataggacaagaacaacacaacagaacaactatggatgtacacaattaggatgggaatcatcacaacacgcccaacccaaggcacccagacacttacacacacggcttcgagacagaaaagccttggacattgcacctttgacatgctggccaagggtaccaaaaagccccgttcattacgggccttgccctcacgacagcacgaaggactaatgtacacgacatg

SEQ ID NO: 695186 - DNA, 959 bp, Homo sapiens
aacacccaaccttactaccagacaagcttagccaaaccatttaaccaaatagagtataggcgatagaagttgaaagctggcgcaatagatatagtacccggctagagggaaagatgaaaaattcataaaccaagacataacgatagcaaggactaacccctataccttctgcataatgaattaactagaaataactttggcaaggagagccgaaaagctgaagacccccgtaaatcagacgagctacctaagaacagctaagaagagcacagccgtctatgtagcaaaatagtgggaagatctataggtagaggcgacaaacctaccgtagtcctggtgatagctggttgtccaagagataggaatcttagttcaactttaaattgggccacgagaaccctcgtaaatcccctgtgaattgaactgttagtccaagagcagggaaccagggtctttggagcactagggagaacaaagcattgtgagagagagtaagacaacatttagcatccatagtaggcctaagagcagccagccaagttatgaaagcgttcaggctcaacagccacatacctaaagaatcccaaacgatataaactgaactcctcagacccaatgggaccaaatctatcagcctagtagaaggaactaagagttaggtataagtaacatgaaaaacattctcctctgcataaggcggggtcagattaaaaccactgacctgactaatgtaacagcgcaatatctacaagtcaaccaatccagtcagttattacccgtcactgtcaacccaacaaagggtggtcctaaggaaggttacaagacaggtcaggactcggcaattttacccggggtaccaaaaattactttagcatacacagattgaaggccgcctgccaggccaggttaggcgggacacgaacggcaaaggcatacactggtcctaaaggacggataaa

SEQ ID NO: 695187 - DNA, 338 bp, Homo sapiens
tgctttttgagacagagtcttaggctctgtctcccaggctggtgtgcagtggcacgatctcggctcactgcaacctctgcctccaggttcaagtgattctcctgcttcagcctccccaagtagctgggattacaggtgcacgctaccacgcccggctaatttttgtatatttagtagagacagggttttgccgtgttggtcaggctggtctcgaactcctgacctcaggtgatccacccacctcggcctcccaaagtgccgggattacaggggtgagccaccacacctggcctgtgccattcctttttaccccatctggccccatccctctgctgtca

SEQ ID NO: 695188 - DNA, 799 bp, Homo sapiens
gtagtgggatcgcgcctgtgaatagccactgcactccagccgagattgcgccactgcactccagcctgggtgacggagggagactgtttcttaaaaaaaaaaaaaaaagaaaaaagaaaaaaagcctggttgccagttttaaaattaacctaaaacttttgggttacattcagaaagtacatacaagtttcatgtttatcctatgaacaaaatggttttggaggcacacggtctggtcaaaggctggccaggattcagaagtctaccaggaagtgtcaagcattcggcgtggaacatcactggtaagggtccattcggtcacttagtgtaaagatgggaggttacactcttggttgcccagggcgtggagagtttgcaacaggggcacgaatcttggggattacaacggagaacacctcatgagcataccaaggggttcaaaagacgagatcatcacttaggattcaggcccacgagattgagaataagctgggggaatatacaaggagcatgtgttgcacatttaaacaacacgaaagacatacaatcagcgggaacctagtagaacaaggacaaaacaacgaattgcacgagtactacgccacacaaggggtgaggcacacaaagggcaagggcggctcactccagaacaggctcccattggacacacccatacgagaggatagaaacccagcagcccgacgctctcaagagcagtccccccacaaagagagcctgggaggaatacaaccagaggcaggtgaacgcccacctgggaacacccgcaaggcacacgtgg

SEQ ID NO: 695189 - DNA, 206 bp, Homo sapiens
aatgaaagggaaagtgtgtggcaaagagataaaggggtacggggaaaagtaacaaggaagagatgaggtgacagtttgggccaaggaaaataccaagggaagacttcacactacctttttttgttctggttgtgccattcttttattcatgttgtaacactcagtataggatagtttattaaaatcgttatgtctgtagacgttca

SEQ ID NO: 695190 - DNA, 535 bp, Homo sapiens
ggcatctcttttatttaccattaactgtatttcagaaagaccaggtactttcttaaaaagtcagcaaggccagacgtggtggctcacacctgtaatcccagcacttcaggaggccaaggcgggtggatcacgaggtcaggaggtcgagaccatcctggctagcatggtgaaacctcgtccctattacaaatacaaaaaattagctgggattacaggcacgtcccagcacgcccagctaatttttctcgtattttttagtagaggcaggttttcaccatgctggccaggctggtcttgaactcctgacctccgcctgccttggcctcccaaagtgctgtgattacaggcgtgagccacgtgtgcctggcctgattttcctcttcaacttttagcaaaatatcggaaaacacagtaacatataagaagttaatcgaatattacttcttatattccacctggactggtactggaacatactaagaagttaatcgaaatatacgaagtcctccgacgtacatgacttctcccagataac

SEQ ID NO: 695191 - DNA, 103 bp, Homo sapiens
  misc_feature (61)..(61): n is a, c, g, or t
  misc_feature (77)..(77): n is a, c, g, or t
  misc_feature (101)..(101): n is a, c, g, or t
agtaaagacatctttgatatagacattaatgaatttctaaatgggcttctatgctaacctnataatactctctgggnagaaggtcatgctttccttttcanct

SEQ ID NO: 695192 - DNA, 888 bp, Homo sapiens
  misc_feature (34)..(34): n is a, c, g, or t
ggtttcattgagtggctgcgcgaacgtgcggtcntgctgaccggtgaaccacagccgattgaattcacagaccgcgtcgttgccgttgtgcgttaccgcgatggctcggtgatcgatgttgtgcatcaggtgaaggaataagccatgcacctgcttcctgaactcgccagccaccatgcggtatcaattcccgagctgctcgtcagccgggatgaaaggcaagcacggcaacacgtctggctcaagcgccatcctgttccactggtctcctttaccgtggttgcgcctgggccgattaaagacagcgaggtcacacgccgaatttttaatcatggcgtgacagccttgcgtgcctcttagccgcaaaacagggctggcaaattcaggagcaggctgcactggtttccgccagcgggccggagggcatgttgagcattgccgccccggctcgcgactcaagctcgccaccattgagcttgaacatagtcatcctctcgggcggttatgggatatcgatgtcctgacgcccgaaggcgaaattctctcccgccggactattcactgccgcctcgccgctgctgttgtgcgaacaaagcgcagcgtctgcgcgcgtggaaaaaccatcaactgaccgatttactcaaccgcatggaggcactgctgaaacgaatgtcggagtgcctggaaacgatcaataaagaacacaaaagcttgcgacgtacatttcaatcgatgagtacgccctggtgggactgggcggcgccagcagactggaagcaacctgtcccgagaaccaggctcgggatcgcattaactgcgcggcgcacaagatcatggcgtggaagattcaacgagggcgcggacatcacggggataaccggcacggat

SEQ ID NO: 695193 - DNA, 140 bp, Homo sapiens
ccgactagccgacaggttcctgcctaactctctctgacagtctctgcctgattctccctgactggtcctcctgcctaactcctccctgactgtctccagccctaatcctcctgacagtcctcctgtcgggctagtcgggg

SEQ ID NO: 695194 - DNA, 185 bp, Homo sapiens
tggtgagcgtgtcagggaaatagagtgttttctccgtaagatctcaggataacttaaagaactacagtaggcaatgcatgtcacagaagactggcccgatggtggacaacagtaagggtagcttaaagaataaatactgtaataatgacttttttttttttttaagagggattcttgctctgtgg

SEQ ID NO: 695195 - DNA, 161 bp, Homo sapiens
tagcctgatcgtactgcatgagatattccttcttcctccaaacgtcagcgagaacccacaacactgccgaggagggggcgtgtaggataaaactctattatcctttcttcaggcccttttgaacatctttaattctgcttgatccccatacttggaatcct

SEQ ID NO: 695196 - DNA, 334 bp, Homo sapiens
  misc_feature (28)..(29): n is a, c, g, or t
agggggggcccggggggggggtttgttnnttggttggtaaactggggccccccccccggcccaacaaaggggggggcccccggggccccatttttccaccttccggggggggtcaaaaggcggccccgcctttttaaccccaaaaccctttttttttggtaaaagcccccggggcctgggaagtacccgggcctgccaagggttttttttttggcccttaaattttccaaaaattggggggccccgggcccgggccccccccccgggccccggttggggtttccctaaggggaatggttttaccaaagaaaataaaaagtttttttttttggga

SEQ ID NO: 695197 - DNA, 611 bp, Homo sapiens
  misc_feature (35)..(35): n is a, c, g, or t
cgtacgggggggagtacggaatcactagaacccangtttttagcagaaagaatggcacagagttggaaccccagagagcaagaccacgtatttaaaacaagatctgcctaacagacttggcttacaattcaacaattgttagctttgctttctcattaaatctcattctttctttgccatgtttgtgggggtttttgtttgtttgtttgttgttgttgttgttgagatggagtctcgctctgttgccaggctgaagtgcagtggcgcgatgttggctcactgcaacctccgcctcccgggttcaagcgattctcctgcctcagcctcaccagcagctgggactacagacatgcaccaccacgcccagctaatcttttgtattttagtagagacggggtttcaccatgttggccaggctggtctcgaactcctgacctcaggtgatccacccgcctcagcttcccaaagtgctgggattacaggcatgagcccatctttaccatttttaactgtgcattcgtagcattcacattgttgtgcaagcaagctccagaacccttcgtcttgcagaactgaaattctatacccgttaaacatcatgtcccaattcc

SEQ ID NO: 695198 - DNA, 979 bp, Homo sapiens
atcacccaccaagttcacatgcctatcatatagtaaaaccgcagcaccatgacccctaacagggtgccgtctcagccctcctaatgacctccggcctatccatgtgatcacactaccactccataacgctcctcatacataggcctactaatccaacagactagccatataccatattgatggcgcgatgtacactacgaggaaagctacggtaccatacggcacatcacaacatccacgctggtccaacaaagggccttcgatgaccgggagtaatgccttatggtacagacctgcagaagttaacagcattccgcgcgcatgtattgctgagcactattgccactctccacgcactagtcacctaactgcgcattatggagggccactggaacccccagaccaagggtttcacaccgcggatactgacctcgaatatggagatgtcgaccactgcctaactttcgttcgcggtatctataatcgacagtcagagtagtctcttgcatctgagacacgtgttgggactagataggtaactatactgtaaacccaaagtgggtcagtgcacaggtctatagacgatcattacctgggtactctatctttacccttcatatttaagagtcgcaaggggcatgccagtcggccctcacgtcagagccgctggattttctggtgcaccttgtctcgtgagccggcgtctgtctcggacacggggattttgggcgcaggcttacctcatgttctggtttctccggcactttgttgccagttttcggccatgctcactttgcgtcgcacggcgctgatttggccaccgtcttggggagcttatggacctcgcatgcggtgtcgggcaaaagtgtgtgagcctgttgctctgcctggttccccccgtgggggtccacggtgccttgggggcccttttggtggtcaagcggcctcaaagagggggtagcgctcccgcgggtgcgcc

SEQ ID NO: 695199 - DNA, 230 bp, Homo sapiens
gatggacggagctgaggaggctggagttagtgttgatctggatgcaccgggtgcagcaggggctgccgttggtgcggactctggtagaggctgggtgttgggcgccctggaccgcctatcctcttgccccggtgatgatgaacttcctcttgaacatgggacaggaaccttggggttctcctgctgctgcgtcaatgcgataccaaccatccagacttcccagtgggaac

SEQ ID NO: 695200 - DNA, 212 bp, Homo sapiens
tggtagagatggggctccaccatgtggcttaggtggctctcgaactctggggctcaagcgatctactcacctcggcctcccaaagtgcggggattacaggcgtgaaccaccaggcttagtagggggggccaccttttggatccaggtttcagccaaccaaacaaagactcagaggccttcctaaacttctaccagttggcaactatggaatt

SEQ ID NO: 695201 - DNA, 233 bp, Homo sapiens
ccattgtgccaggctggtcctgaactcctgggctccagcaattccccccgtgcttggctccgcaaagggctgggataacgaggtgtgagctcctgcaatctggcccgaatgctgctttgattaccagtctgttgaagtgtggggggaaccagccttttgttaatgtgagcttccagtgttgcttggtctttggtattctaaattaataacagagtgatgtgtctggggtatag

SEQ ID NO: 695202 - DNA, 193 bp, Homo sapiens
ataaacaagataaacactaggtgcttttgaatttttttcacttccctttatagttttgggaaaggagtgggatctttgatttcagggtgaaaacagagtacccctttaaacacacacacacacacatgcacatacacacacacacacacacacacacacagtgtgcaactagccccagttttgacagaataat

SEQ ID NO: 695203 - DNA, 687 bp, Homo sapiens
gggagatagaactgcccactacctcatgccagtgcgccgcgcccaagctttatgataaagcagaagggagtgagagatggaaattcgaggcatgtgcgcacgactctgagacaagagagcttcgtggtcctgtcaaagaaatgcgagttcaggaggctcgcgcagtcttgaggtacgagagggcaataacactgagactcggacggcgaggaatactacgcgcccagttcatctcgtaagtcttaagttagaggagtattgaactgtatatccttaaacgagttccacggaaaatcgatcggagcttatgcccgacggcctgactaccatcaaatgtgcattcaaattggggctcgtcgcgtgagggagcggggatacctactgcaacacagctggaggctcaactggcagcaagagaccgttacgttctaaacgtggacagtctttttcccatgttcaccctaggctcgacaggggacagcgctggaccgtacagacactgcctaacatgcaaagcgcagccaacgcttcactctatgatcctcgggcatttactctggggagatcaggcctgaggcccagctcgggagccaagcagactccaaaccactacaaccttgccagacacagcccactccatttcagaccgccttcctgaggagaaaatacgcctggggtttccagtac

SEQ ID NO: 695204 - DNA, 465 bp, Homo sapiens
ttaggactatttaaaaaccgggaaaatcttaattatctaatactgatacacgaagaaaggattccacccaagaaatcctgccctgaaacaatcatgaatctcggcagaacgcagtgggtacagggtaacctacacacactgatgaacaggcaatgactcctactttgtcacgcgccgtgatacagacgaccccactatctatagggcacggggctatgtccaacgggtcaacgtgaggcttgaacccaaaatgctgcaaaatggcacacaacaaatgaaacagctctcttgcaggcacgccttatccaggacacactcattgtactgaggaaaatggcttgaaacactccctgttctagaactttccattgtcatatcaggaagagtgctagcttcaacggtgctggatcaggaaattcttgttgtcatacaaaacagcgtacagatggtgcactacgactgatc

SEQ ID NO: 695205 - DNA, 1087 bp, Homo sapiens
ccgacgccctaacccttaggctaggtacgaggctgggtggtgccgagccggggctatttctggcgctggcgcggctccaatgaatggcatctgcatttgctaccagcggcgtgccgcgtgcggagcctgtgccggtcctcagcgcccagcaccgccgctcccggcaacccggagcgcgcaccgcaggccggcggccggagctcgcgcattcccagccatcactcttccaccttgctcctttagcagaagggcacagactgacgtgagtcgagctcgaagtccagccagccctttggccttccaagcaggaaacaggacggcactgacgaagcggggccgggccaggccgcgcaagcagcctccggtgagtcccgggacagcgctggtagggagtcagaaggagcccagcgaagttgccaacacccttaagagacctcggggccggaccaaagggaacgccacaaaccacagggcttgctgccaagacccggaaaaccaccagcaacatccaggaaaggcaaaaccaagggcggcagacccaaaacaaacctggagacgcgagcgacgccacggagggcattctcgccaggaagctcctcgccaccgcacggacccaggtgaccccattgcgttgccggcgtgttctttcactggcacgcgaccagctccctttctgggcgactgcgacagcttttgctccgttcccactccggctccatgaccctatcacccacaagcctccaaccaactcacaacccgtccaatttggcccgtccaccccatgcattatcactgcactgttcccaccacatcacccacatccaattacacgtcacccactcgtttagggggttcgcagtggctgttgattttgggggtctgtgtttccccgctgggtcgtcgtttcacgaggtttccgcctgggcccccacctccctccactacccgaccaacgtacctccctacccgacgccaccacggccctacactacctcaccgtactcccgccctcgcggcgccctactacgtctccactacccctcgctcgctccaccccctcgcccccactcggcaccatacacaccga

SEQ ID NO: 695206 - DNA, 376 bp, Homo sapiens
gctgtacttgtggaatatggaagttcctgggctagtggactgaatctcagccatagctgtgacctaaatcacgagctgcagcaaagccagatcctttaacccactgtgccaggccagggattgaacatgcacctctacagtgacctaagctgctgcagttggattcttaacaaactatgccacaacaggaactcctgagactgtgttcttataagcaggaaaatttggatgcagagagaacactgtgtgaagagaagggtgagatctacgagccaaggaataccagaaattttcagcaaaccggcagaagatcggggagaagaatcatataaattctcccccagcaccctccaaggggtatcttgtacaaattaat

SEQ ID NO: 695207 - DNA, 994 bp, Homo sapiens
cctctgtgctgacgtgctcttgttgtcgttgttgtgtgtgttgttgcatgagcgtgttgcgattgctttcgggtgcgcggtgttgtctgctgtgtcggacctttgcctccggggtgtgctgcggacgtattcagtttgatcgcggtgctgtcctcgtcgggggtgctttctcgtctttgccctcgtgtgtgttgcgccatgcttgcccgcttctggttcccgctgttgggttagtgtcccttgtcagcccatttccgtcgccttttagatcttcaccagtgcgagcccccttgggcaggaccacctgcgtctggcaccccgggaggtggggcagactcctggtttagtgataaggggctgaaccggctttggggagaccgagggggttcagacttgggaagaatctttcagtgttgtcatggagatgaatggtgatgtgtgttgtggatggatgtggcacgtgtggcacgacggttttttcttgtgctgccgtgaggaccgtgtgaaattttggggcatgtgtttctaccagagagcacttcagccttctctcccccaataaggactggctgtgaaccttaagcccatcaagttacttccagcctgtgagagaacctcacccaacatgctggtgtggcctagagggtgggccatggtgggaaatgggcatgagaatacatacctcccccaattcaatctgagccccgcatggagagggatggtaggcgttgccacgggctcagaagtgccagctcgattactcaccccaccctgcctcccgcacctttcctttgtttccttgggtgaatgcaggaccagcagtggctgcccatcccacctggacaatggtgtgtgtagaaaaccacctggatgtctgtgcgtggggcctcatggtgcctaggacggagattaagatgaggagctttttccttatccgtataaatgaatatttgtatgattccaagtaacacaccacacccgaaagacaatagta

SEQ ID NO: 695208 - DNA, 1445 bp, Homo sapiens
  misc_feature (1122)..(1122): n is a, c, g, or t
  misc_feature (1445)..(1445): n is a, c, g, or t
gccgcaagtacagatggcagtggtcctgatccgtggcccgttggcggcgtcactgacacttggtgtccggtcctcgagatcccgagcgcggggaggcagaccggtgacgtgacgggtgccctgggactggactgcctagtggagtctgctgcgcggccatgtgctgcgcccggtcggcggactggatgagggcgggtcttggatgggccgtcgccgagctcccgccttgaggctgcgggcttctgtccgtttcgctctggccttgagccctggcagagagcgtccgccgactggccgcggggctcaccggggggacaagtgactacggccgatcgcatcgactggaccgtccgcccgttgcgtacgtggacgtgtctggttactacctaactggctgcaagagaactatcgaaagtgtgcatgcgggaagagtggatgggcccaatggtggtcttggtttggactcagcagtttatctggcagagtgcggaccttggacaaggcttgcctcctgctttccctgtcgccttgcgcttcctgcttcttgaaccggtgtggaaccctcatccccgaacttgtgaggctggctttgtacccctataccttgcgggcagtccctgggggacacatgaagccctacctgtagaatgagccgggggatttgggatttggagcccagggaccttcacttacttccatactagagccgttgacccatgtagacacctaaacccaagaaactaggtcccaaaaacaccttggcaagaactcgccctattggggccaggcgccccttgggattgacgccaatctggctgtccactcgacgtgaggctccgacgcttcatatatgggaccataggaacacagtaagctatgcactattaggcatcactatgagcggggacaaaccaatacttagcattggacacgcaccttctcgtgcacatgggctgcgacaaacaatatcatatgcacaatcatagagatatgaacattaacaaaactcgcgctgctaatcatcatgaacatacgaccacacagcaaaatgagtgcacactactattgttcatcagcgaccacataacactaacgcaagtgacacacatacatataatctanaaaacaatatcacacaatagtcgcacaccaactacacacaccatatcgacaccactacatacgctccactcacataccaacacaccatacacgcacatacaacaacaggacctaacacacaaaccacacatcgacacaacaacacctaaacataacacatacgcacagatccataggactaacactcatccataaccgctctatcgctttctgtttttcttctgtttccttctcactgacaattcgactaaaacaccaccacctatacacaagaaacgacccacccaacccaaatacactaaaccaacagaccacccccagan

SEQ ID NO: 695209 - DNA, 124 bp, Homo sapiens
tcccccagctcctgtcacagattgctcccagggctctactctacctcactctcctgtgttcccctctaccgcgccagaagctctcattactttctgctccccaactgatttgtggctttctcca

SEQ ID NO: 695210 - DNA, 566 bp, Homo sapiens
ggagagagaactagtctcgaagtttgttttgttttttttggaaactttaaaatccctcaaaaacggtttattatccaagtgagtttggagtcacaaggggcttatcggaaggattccgggtaccgagcgcgggcaccagggcctccaaacttttgggactcgcaggcgacgagggtcagctaccagcgagggctccggtcataccgggatgaggatgctcattgagatctccttctcgtgggaaagcctcaatccacaatattctcgggataatgaggcccaccgagggctttgggcagacagtggcaccgtgacggcatacgcataaaactcgggggcccacgttgtacccaccaacgccctgtgtaacgggcgggaccagcggcatgttctaaccccgagcaaaaaatgcgtctcctgtgctcgtagaaaaagtccagaaatgggggtctcccagccagcgtctggtcttacctggttcagcgcggtgtgcggcgggtttccaaattcacattatcttccgaggggtggccggccccgtttcaacctgtgtattggagaaccca

SEQ ID NO: 695211 - DNA, 493 bp, Homo sapiens
ttacctctatgctgttctcatgatagttagtgagttttcaaaagatctgatggttttataaggtgtttttccccaccttcactctgcacttctccttgctgtcaccatgtgaagaaggatgtgtctactttcccttccaccatgattgtaagtttcctgaggcctccccagcgctcagatctgtgagtcaattaaacccctttcctttataaattatccaatcttggatatgtcttattagcagaatgagaatggactaatacccagaaagtacggagaattattacatactcatgcccaatttttctgtgtgttctcatttttaatctggtgttttcttcacaatttttcagtggtaaataattgtcttagagttttacatgtagagttagaagaaaaatgaaagagtcagtcatctggataattccagatcagaaaacaatttagtgtgaaagctatagataatcgagacagaatttttgtgtgtgtgtgt

SEQ ID NO: 695212 - DNA, 816 bp, Homo sapiens
ccacgcgtcgcccacgcgtcggaagagtgcgggtgcccaggagtgcacttgaccaccgctacttcataccctgagaagagtaaatggtctggaaggtgtctctgagaggtaatgccgcacaccaccctcccgtgggggcagggtcaggctacacctgccgttaggtcagggggctgcagcagccatgagagctcatcagtagggcctcagtagcctgggagggagcaaggggcagtggggcagggaaagaggcgtagtggggctgtcgcagaagggcctgggaaatctggtccctgaggcctgggcacagcgtacaatcacttcggatatatggctgtggggccagtggactgggaaggaaagaagcatataagagtgaccaacgtgcagaaggctgtcaggtcccaggtcgacactgccttagtgcagatgactgcctcagtcattttctggggtgatgggctgtcgttggtacacaccattttagcatgatgaggagcaccgaggcccagaaagagttaagttacatgtcctaagtcacagcagtgttgtaagtgccagaactgagatcaagaagcaagtctctttgactttaaagtctgtagtctgaccccaaagagatcctgtttggtcacttataggaggtccctagagctgcagactccccttgccggtacccacatatagagacattaatcctttcgcctgcgagggtcagctcaaatagtcttttagctgggcgttctcctgcagttccatctaatgcatcccctgggtgttgccaaacctgaactggggcagtggggtgagaggagg

SEQ ID NO: 695213 - DNA, 533 bp, Homo sapiens
  misc_feature (28)..(29): n is a, c, g, or t
  misc_feature (32)..(32): n is a, c, g, or t
  misc_feature (38)..(38): n is a, c, g, or t
  misc_feature (45)..(45): n is a, c, g, or t
  misc_feature (49)..(49): n is a, c, g, or t
  misc_feature (53)..(54): n is a, c, g, or t
  misc_feature (60)..(60): n is a, c, g, or t
  misc_feature (65)..(67): n is a, c, g, or t
  misc_feature (69)..(69): n is a, c, g, or t
  misc_feature (82)..(82): n is a, c, g, or t
  misc_feature (102)..(102): n is a, c, g, or t
  misc_feature (108)..(110): n is a, c, g, or t
  misc_feature (116)..(116): n is a, c, g, or t
  misc_feature (118)..(118): n is a, c, g, or t
  misc_feature (121)..(121): n is a, c, g, or t
  misc_feature (124)..(124): n is a, c, g, or t
  misc_feature (127)..(127): n is a, c, g, or t
  misc_feature (129)..(129): n is a, c, g, or t
  misc_feature (136)..(137): n is a, c, g, or t
  misc_feature (140)..(140): n is a, c, g, or t
  misc_feature (150)..(151): n is a, c, g, or t
  misc_feature (153)..(153): n is a, c, g, or t
  misc_feature (156)..(156): n is a, c, g, or t
  misc_feature (158)..(158): n is a, c, g, or t
  misc_feature (173)..(173): n is a, c, g, or t
  misc_feature (176)..(176): n is a, c, g, or t
  misc_feature (181)..(182): n is a, c, g, or t
  misc_feature (186)..(186): n is a, c, g, or t
  misc_feature (191)..(191): n is a, c, g, or t
  misc_feature (194)..(194): n is a, c, g, or t
  misc_feature (196)..(196): n is a, c, g, or t
  misc_feature (198)..(198): n is a, c, g, or t
  misc_feature (200)..(200): n is a, c, g, or t
  misc_feature (215)..(215): n is a, c, g, or t
  misc_feature (237)..(237): n is a, c, g, or t
  misc_feature (239)..(239): n is a, c, g, or t
  misc_feature (242)..(243): n is a, c, g, or t
  misc_feature (249)..(249): n is a, c, g, or t
  misc_feature (252)..(252): n is a, c, g, or t
  misc_feature (254)..(254): n is a, c, g, or t
  misc_feature (270)..(270): n is a, c, g, or t
  misc_feature (279)..(279): n is a, c, g, or t
  misc_feature (292)..(292): n is a, c, g, or t
  misc_feature (296)..(296): n is a, c, g, or t
  misc_feature (310)..(310): n is a, c, g, or t
  misc_feature (327)..(327): n is a, c, g, or t
  misc_feature (335)..(335): n is a, c, g, or t
  misc_feature (346)..(346): n is a, c, g, or t
  misc_feature (363)..(363): n is a, c, g, or t
  misc_feature (387)..(387): n is a, c, g, or t
  misc_feature (424)..(424): n is a, c, g, or t
  misc_feature (443)..(443): n is a, c, g, or t
  misc_feature (456)..(456): n is a, c, g, or t
  misc_feature (463)..(463): n is a, c, g, or t
  misc_feature (477)..(477): n is a, c, g, or t
  misc_feature (479)..(479): n is a, c, g, or t
  misc_feature (517)..(517): n is a, c, g, or t
ttgcgcggggtgggttcccccccccccnnctnctttgngaccatngaangttnngggacnaaaannngnttcccctgagccncaggggagaatgtttccccngccctnnnaacaanancanaanggncnattcccnnggnccccctcctnntnctnangggggtcccgggatnaanagganngagnttcanttnanananacccttgggcagttncagtccccccagaaggggtccntnttnnccagcnggncnttcagagccagggganggtgaaccngcagccccctttnagtnatgcctccctcagnggtatgcctgccaaaanacgcaagntccggtttganatacaaaaagggttgcnggaagaccccaattacagtccccngggtttccccaatgcccagggggcctttgttgatganccttagctttttgctttanggcccttcctcancaggggnccgtttcccccctntnccttcccagtatttaaaaaataaaagtgggattttttnggcggctttctctcta

SEQ ID NO: 695214 - DNA, 153 bp, Homo sapiens
aggatccccctgatgatctctcacagcttgtaaggtgtgagacagctgccttgtgtgggactgagaggcaagagttgctcctgctcgccacctgacttgctcccttcaactccctatttttacctaatctatcttcctgccttcatgccctac

SEQ ID NO: 695215 - DNA, 155 bp, Homo sapiens
gctgagcggctggtcctcctcctcatccgcggtctgggcatctgcaccttcaatgtagtgggagagctttccatttagtaccggttctgaagcatcactggataggtgtcatttccacatctgtgctggtgcagttaggaagctcaaaaaaaacc

SEQ ID NO: 695216 - DNA, 420 bp, Homo sapiens
ctagatgaaaccagaaacctcagcgctcacaagatctcaggaaattttctgatggaatttcaagtgaaaaatgttccttcagaaagaattgcaactcagaagatcctgtctgtgttaggagagtgccttgaccactttggccctggctgtgtgggtgtgcaaaaaatattaaatgcccggtgtccgctcgtgagggtctcaccccaggccttcggatttcaatgggatttgacttccaaccattggattggcttgaccaggtcccaacttctttattatatatggtgccctaaactcaagagtgagagccttggggttcagggtccggggctgggctcgagcacattcactaacaggtagttttcctgggccatggatcacaaatttctcctttccaatgatgggcatcttttttctcca

SEQ ID NO: 695217 - DNA, 412 bp, Homo sapiens
gagccccttatcgcccaacactatacttacctatctgctcaatcttagaagaacagtatgtagtttcagaattgctaacccctatcactgtgaaaaacaaacctactaggccaggcaccagtggctcacacctgtaatcccaacactttgggcaggaggctcacttcagcccaggagacagagactaccctgggcaacagagcaagattgtctcaaaaaaaaaaaaaagggaaggaaaggaaaaggaaaaggaatttcccttttttttgatatgcagagccccgtttttcctggccagggggaagttcccagaaaaatacagcccagggccctttgtttgacattgccactgaaaaaagcataccccaaaagcggggggggtcttttttttttttacccgggcattgggggg

SEQ ID NO: 695218 - DNA, 697 bp, Homo sapiens
catggtggtgtgagcctgtagtcccagctactcaggaggctgagacaggagaattgcttggattcgggaggtgggggttttagtgggccgagatcacgccattgcactccagactgtgcgacagagcgagactctgtcaaaaaaaaaaaaaaaattttatcctgggaaattttggaaagggaaaaaaaaaaaaaaaaaaaaaaaaaaaattgtgtgggggcggcccgggggcccaggaaaagaatttcaacaacacactatccggtggggggcgcgggggccccagggagtgagaaggagaaaaaggtggccaaagcggtggtgccccagaggagaaaaccgggggacagaagaaagagaggcgggggagaatctccacacaccaaataaaaagaagcggcgcgcggggggggagacaaacaacgagggagcgcgcttcgagcgaaaaccaaaaaccgagaaagaggagaaaaaccgacgagagagactcaaaaacggggggggatccatatatcaacaaaaaagggaggggacgtcccacaagagacgggagacgccgcaaaaatacataacaaagataaacgccccccgcgagctcgtggggtgggtataaagacaaaaaagcaaagaaaagcacaaagaagaagaagaagacgcagacagaagcagagagaacaagaagaaagaaacaaaagca

SEQ ID NO: 695219 - DNA, 150 bp, Homo sapiens
agatggacctctcacagagctatgctaaaggatcattctgcctcaaagcaaacaaatacaggtcagttgcctctcacttcattagcaccaagatgaatcacccttttagccattttagcctaaaggagacatcctaacagtcactcctag

SEQ ID NO: 695220 - DNA, 201 bp, Homo sapiens
cgtgtaccagtgaactccttttcaacagaattgcctagaaagtctcgggaaagtgacagtctcttcaataaatgctgctgggaaagctggatatccatatgcagaagaatgaaactagacccttacctcttgccatatacaaaagcaaatcaaaatgaattaaagacttaaatctgagacctcaaactatgaaactactag

SEQ ID NO: 695221 - DNA, 429 bp, Homo sapiens
  misc_feature (1)..(1): n is a, c, g, or t
ntgagaagaaggtgagatgatcatttttcttcacttttcaactgaagaaattgagtcttgaaggtccacagctaaaaggagtagcagagtccagactcagtcccaggtctcctgaccccaaatccactgtactgtctgtttccttgtctgtcaaatgagggtttcttccagatctgaggtcctgggtcacctgccttttaacacagcgagttagttaggagtctttgggaattaacaggaactggtaacttgagcagaatagaaattggcaggatcgtacagaggctcagaggattggtgagaaggtggaccccaggctggtaaatgggcatgattcaggctaactcctggggtttcagaagcaggggcctgaaaagcactgccattgaagggccaaactccactgttttgcattctctactcaagatg

SEQ ID NO: 695222 - DNA, 321 bp, Homo sapiens
gctggtaccaggttgatcacacaatgctcgtaagtactgctttgtgggtaacagttcaacagttccctccttaggcttcatgtttcaaacagcctttctgctgcctaggatagaatttcccgtacaagatctgtggcttctcactccatgggccataataatcccttacatatgagcgatgctttacatttttcacaagtgctgacaaattacctcccctccaaacataaatcttgaaaatgattctgttaggtaagtagaacaagtgtagtgaagcctgtttcacagatgcagatctttactcagagaggggcggagcag

SEQ ID NO: 695223 - DNA, 309 bp, Homo sapiens
aagtggttctccatcttcacctcccagtttcaagcgtctcctacctcagcctcctgagtagctgggagtacaggtgcccaccaccgtgctgggctagcttttgtatttttagtaaagacggggtttcaccacattggctaggcgggtcttgtactcctgatgtcaggtgatccacccgctttggcctcctaaagtgttgggattacaggcatgagccactgcacctgaccagatttcagatttttggattagggatgttcaacctgtattaggtaaatggattgtagtaatgacatggtagaaccgact

SEQ ID NO: 695224 - DNA, 773 bp, Homo sapiens
attttctgtctctatgaattggagttctctaggtatttcatgtaagtggaatcagtatttgttctttgcgactggcttatttcacttagcataatatcttcaaggcttatccatgttgtagtgtgtgtcagaatttcctccatttttgaggctgaataatattccattgcatatgtataccactcactttgtttattcactcatcttttgatgtacattaggcttgtttctaccttctggctcttgtgaataacggtgcaatgaatgtgggtgtacagatgtctgtcagagtccctgttttaaattagtttggtccctcttttaaattagtttggttatacccagaagtcgaattgataaatcatatggtaattctatttttaatttgggagtggggggggaattgctatagtgtttccattgtggctgcactatgttacattccccccaacagtgcacaaggattccagttgctccacatcctctctaatacttgttattttctggtttttggtaataaccattctattgaatgtgaagtgatgtttcattgtggttttgatttggttcgttttttaatgattagtgatgttgagcctcttttcatgtgcttattggtcatttatatttcttctttggagaaatgtctaatttgattcctttgcccatttacaaaatttctttttctttttagttattacattctaggaagttctttatgtattctgatatggattccttatcagatatttgattctcaaatattttctcca

SEQ ID NO: 695225 - DNA, 101 bp, Homo sapiens
cgtatcttccagaagttcctaaaagccacatgaaattagttgagcatttctacgatcagcttttgctaacgccccataccaccaaaccattaagaactttt

SEQ ID NO: 695226 - DNA, 170 bp, Homo sapiens
ctaaatgtgatctcctgtggatttccacatgcattaaaaaattttttaagctgggcctagtggctcacacctgctatcccaacactttgggaggccaagagaggaagattgcttgagcccaggagtttgagaccaatctaggcaatgtagtgagaccctgtctctaattt

SEQ ID NO: 695227 - DNA, 130 bp, Homo sapiens
  misc_feature (28)..(28): n is a, c, g, or t
  misc_feature (36)..(36): n is a, c, g, or t
  misc_feature (115)..(115): n is a, c, g, or t
tgattctgggcgtgtgcagtagtgttgntatgtagntgttatgattttttttttggctgtcagtgcctttggtgtctgtgatttcttccttggctttggatgtgatggttagtgnagggtatggtggttt

SEQ ID NO: 695228 - DNA, 402 bp, Homo sapiens
cttttgtcctttttttttttaaaaaaaccaatggggggattaatgtgggccaggtgccctttgtttaaaaaactaagtttaacccccttatttggttttggcccaggccccccctatataagggaaatgccccccccgtggtacccccccggcccccggccataccggccaatagccggggaaaaacccaagggaaagggttccaaaacccccgtggttggtaaccgggtttttaaaggttccccttgggcccccaaaaaggctgggggggggaaccaaggaaatctggttcccccccccccccccttaaaccaaagtgggggttctttgggcctttaaattggtcccctcccccctttttttttttttttttatccaaaaaaccaggggttttccccggga

SEQ ID NO: 695229 - DNA, 969 bp, Homo sapiens
gagaacctagctaagttgtcaaaaacggctttttacgaaggcagtactattacggcctaggtacgaggctgggtggcgagagagagagagagagagagagagagagagagagagagagagagagaggcggcacagggtgtgggtctgggccgttcggcggcgcccccgggctgaggcggcccggcaaatctggcgctgcggggaagaagtgctgacaccgaggatatggatctgtacgatctggcgcaggcggcgggcggcgctatcgaccccgatgtgttcaatatcctggtggacctgctgaatctgaatgtgccccccctcgcctgtcttacagtatgctcaatgttctgtgtgtgccgggcagaggctagcgagcgagccccaagactctgcggtctgtgtctctgcccactgtcgagccgtgcccgagacccgagggagaaacaaaggcagcgctgccctcgggggagcattggccctggcggaacgcagcaggcgagaaggatccagcagaggatgcacgccagcccagcgctaacaggctgcccaaggggggcggctctgggaagagccctacgcggggcagcatctaggatggggcagagacttgttgtatcttttgtccccagcaaaggctacgtgttccctccttcgagtgataataccctctttgtgagatgcaagagggtccagtgtcaaaaaaaaacttacagacaacctcatctaagaacacaaaacacccgcgggcgacactttatgcggggcgcgagcaaaaccgcgtcttacaacggcgccacggggtcacattattggattcaaaggccccacctttttctcaaagggtagtactcatcggggcgaccccaaaatagagggagtcttacactcaacacaccgagcgtcacgcctggcttttaacaagcggaacgcggctcactaccaccaagcaggcgggctacccatgaa

SEQ ID NO: 695230 - DNA, 382 bp, Homo sapiens
  misc_feature (370)..(371): n is a, c, g, or t
gctgcactcccacacctacatcctgaggcgtggccacctgctgtccatcacccccaacaccccagatccccggatccttctgatggcgacggctctgccggtctgttctggctcatgtgctgtgtgccctggcccgctggcactcagcttacatttgaacctcgtctttagagttaaggtcccacctgtgctgtggaccggacgtgggcctcccagtgagtggggggcatctgataggtgaggctgcttaggaagcctggcacaccctgtccctcagcagggtgggcctgggtaagtctgcccgccgcatgggagggagtgtggagagatgaagagatgagggagcccgagaaccgcatgcctcactggnnatgagggacac

SEQ ID NO: 695231 - DNA, 357 bp, Homo sapiens
ctccacggctggctaaaggaaaccaaatacttaaagaaaatcagattctctcaataagattaacaggagttttctcaggagaaaacatggaggttaagaaaccagccctgggcagatagacggatggactgactgaccaattttttttttttttttttggagacggagtctaattttgttgcccaagctggggggagcaaaaaaccgaagccttttttttttggaaaagacaaacaaaaaacctaagtggcctttgtggtttgttatgggaaaaacatataaaaagatgggaagccggggagtgctggggtgtgaaaagattgtctggaagatcataattgtcttggagcagagttt

SEQ ID NO: 695232 - DNA, 951 bp, Homo sapiens
ctgagatatgtacctcgcgggtgtgtaagcagaagtaaatcctttttctcgcggaaccaggtgtagtagtatctcgtatgatccctcgcacacgtgtggaaaaaatgttgggtgtaattagagcatctcctctcaaggaacatcaattcttgctgccgggtatacgccccatgttgtcctctaagtcccgggtgttccgcctggtgcttttccagaaagggaagctcttgtggggttatatataaaagggttgtttcgtgctggcctctatattgtgcagttcggaccgactcttcttattagggggcttgcccccaccccgctgcatgtgcttcttgcggctccccgtcgtcatcgcccacagaacacttgtgtgaatttcaaaggagcaaataattccccccccgttggagtgtataaaaacatggttgtgcggggacgctccgcctcccccatgtataactactctcgcggtggttctattaagcgtctttcttcggcccccgcgtgctttttcaggcagtcactatctcttgcgttggcatacactcacataaatcgggcgtgctatgtgcaccgatctgggtcgtttcggtaacaaaaaagtcgataactaaagaaacaaaacaagcaagttgggggcggtgacctcggggaacatgtccctccggttatctgcggcaccttttgcacgttcttcaaacccgaagagcccaggaagaaacactgagattatctagaattttccccgagattacacggataaggaaacagaatgggtgctcactcacctgatgaccccatgctaaaaaatccgcttataaggatctgctcagcgtaatacttttattatgtttatctttctgtgcggaacaaatcaatcccgccgttgccccccctgggaaaaaaaatagatcttggaaaaaaaaaacctttaaaccccacaaaaca

SEQ ID NO: 695233 - DNA, 265 bp, Homo sapiens
aacaccatggtgttctaatggtatacccaaacttaggggcatcatgactttttttttttggagacgggagtcttgccttggtctgcccaggctgggagttcaatgggcgcaatctccaacttactggcaacctctggcttccctgggttcacagcgattctccttggcctcagccttcccaaggtagctggggattcacaagcacccaaccaccaacgccctgtgctaatttttggtatttcccaatcagactatggggttttgg

SEQ ID NO: 695234 - DNA, 1238 bp, Homo sapiens
cggttttttttgtgggacccacctggtgctgcagcggtgttctgcgggtgctcttgtgggcaccaaacggtgttgtgccccctcgcggtgaggtgtccccccccttcttttgcacccgtctttgttgtgcgccgcatttctacccgcgtttgtttgcgccccgtggtggcccccccctgtggtcgtcgcgcgcgcaaatgtcccttgggcttgttggggtagcatacgcttgtactagtagcacccgctggctattccgtgggcgggcctcttacaaaccgcggggggtgtcttgtgcccctctgattgattatcacgggtcggccaaggaaatcttgtgcgcacaccctcgggtgagaaggcctctgtgggggaacattacttagagacccctttcagaaaaaggggaggaaatatctttaagagtgctgttatggccgccggggagtgatttttgggaacacaccgtttacatggtgtccccactggactttgtgcccggctggtggggtgtgcccacacactgcatactgaatggagtaggatgtggccctctttacaccgccgggttttatactgacgcgcgggtgtccgcgagtataattcacgctctcttgtggggctttctcgtggccctggtgatccccccgtttatcttcactgggcaccacatgaatttatctcgcacgagactggccacagaaaatatgtgtgagaaaaccacacacgcacccgagaggaggcgccacatgtcgtgaagatgtgtcacagagagggagatattcccacgtggggaacccttgggggattatccccgtgccttaacaccaggtgagaaccaaaggtgataggccccaagggcgacccccgtttagaaatgtcccaggaaccacaacgggtgtgccttaaagggctttggagcgccacatggggcacctttatttggatgtcaaagagaaacctctttttgcggtgtgacaacaccgaggtttgcctcttcggagctcacgggaggcttaacctttacgcgaacgctgttttgaagcggtctcattcattaaggggggaagcgctggggcaaaatcgccacaccttggcctttcctttaggccctggtgcgccccacataaccccaacttcgaggggggccacccctggggagaaacgggaagcgctcggtcccttttccccaataagggtttttttgcctggattcccgcagaaattattaaaaggga

SEQ ID NO: 695235 - DNA, 289 bp, Homo sapiens
atgggaaaggtacgctgaacaagggcggccagcgccagcgctggggtgccactgtacacggtgatggggaggcccttctatctggagagggcggcatgatcctagtgggccaacgtcaaccgcctgggtcaaacgggacacaacccactctcatgaagacatccctaacacacatccagggactatgtttcttaaccttaaaattggaaacacttcttgctaccaaggatagtgggtggggctcagcgtttggggaacctgactgagagtcttttgctgaacagacttt

SEQ ID NO: 695236 - DNA, 224 bp, Homo sapiens
cgatgcttatatacagccgctataccaagtaccactctagtacttcccagtatcgggatacatctatctcagctgcattatatagactaatacagatgcttgaagcaagccttgtacacataaggtatttaatagcacttagggactaattagatgtcccatattcgctatactcttccaatactctaatctcttctcaacccagtgtaacggacatcgctaca

SEQ ID NO: 695237 - DNA, 344 bp, Homo sapiens
tctagaggatccctgcagaggcgttagccttcatttcaactttggtgaatctgacagttatgtgtcttggagttgctctatcttggggagtatctttgtggtgtctctgtatttcctggaatcttgaatgttggcctgccttgctaagatttgggcgaagttcctccctgggataatatcctgcagagtgtttttccaacttggttcccgttctccccatcactttcaggtacaccagggcagacattagatttggtcttttcacatagtccccataatttcctttgggagggggtttttggtaccatttcttcttatatctttttctctaaaacgcctctgca

SEQ ID NO: 695238 - DNA, 882 bp, Homo sapiens
acccacgcgtccgctgaagtctttctccagcccctccctctgcagctctgggaacatgaggccgaccaagagtaggctgcgagacctcttttgcatgggggctgcagttcccgggccccagagaactgacagtcacaggactgaagtctttctccagaccctccctctgcagcttgaacactatgctatcagtgaacctcgtcgctctagccatcatgcctcgagtcacagggcaaacttggcctcctctgtgagaagttgcggcatctcggagaccaggcctggaagcctccatcagggctattccccacacagccctactccactgggaaaagagagtgccgtaagactaggctggttggctcaaggtgagatacagtcatatgtcccgtgtgtgcctactttgatgcgtgctcacgcagccggcgccagggaggctctgcgatagaatgaagatactatgagacagtcattcaacccctctatccacggtatatgatgcccaccgagaggttccaggtgtcccactctatattacacgtacaatggctggtacatgaacctgctcttgccccacccgtatggtagcgctcactggaatgagtctagtgatgccatttctaccagttctatatggctcggtcgttgtgtcctccacaagtgtatgccattttgcagtgaccgtattggaaccaaaattgcctagtgtggatgggggtccagcagtaagccctaggatgctaccaccctttaagccctgttgacctttagagccaattttacttacccttcttcccttcattaatgccgtggttttactcaacaacttttaatagtctgtatactagtgtttgccactggtctgattgtgtggtttcccct

SEQ ID NO: 695239 - DNA, 411 bp, Homo sapiens
  misc_feature (87)..(87): n is a, c, g, or t
  misc_feature (149)..(149): n is a, c, g, or t
ttggcccccttccccctcaaggagcctagtcctagtagggggtccagaaataccagatgggccctgaaccataatgatggtttgacntcccagtttttcaactttaggattgtgcaaaagcctatacacattcggtagaaacagtaccntcaagtatcccatacaatcagtacagtattcaataaattacatgagacattcaacactttattataaaataggctttgtgttagatgagtttgcccaactgtaagctaatgtaagtgatctgagtaggtttaaggtagcctaggtgtattaaatgcatttttcacttaacggtattttcaacttttgttgggtttattgggatgtagccccattataagctgaaaagcatctgtagtataataaatgtggggagtgctgtga

SEQ ID NO: 695240 - DNA, 318 bp, Homo sapiens
catgtgggcatcactggtctccaactctgactcaagtgatccacccacttgggcctcccaaagtgctgggattacaggtgtgaagcactgggccaggccgggtgatacatttaaagatattcttataatgtagcaaaaccttaaaagacgggaatatttggacaaaggaatgactgggttattttatggaaacagggtctcactttgtggcccaagctggaatgcatgggcacgatctgggctcattgcaaccttggcctctcaggttcaagcaattctcgtgccgcagcctcccgagtagctgggattataggcatg

SEQ ID NO: 695241 - DNA, 195 bp, Homo sapiens
tcgaccttcagccttcgtttgcaagaagagttccagttgatgtggtgtttggttccatggaggggtgaggatgggtgcaggatgcacagtgacaagggacatggggtgcgggcccacagcacaggctgaagttagctgacgcatgcctttggcttttatccacgggcgggtagtggcggaccctggctgtggctg

SEQ ID NO: 695242 - DNA, 756 bp, Homo sapiens
cggctggttgcaggtttctctcgccctggtccctgctgcggcccgccgaggcggcgaccaaggtgggtgctggggccccgtggccgggcccagtgacaccgcggggactctcgggagccgtgggccaggcggcttagcctggcacctcgggccctgtccaggcccaggcgttccattggctgctctgcgggcctggtgtgagagggactctcggtgagtgcccctgtgtggtgctgcctgcacccactccttcccacttgggagactccctgcggggctgccctgggtctcctgttcctacttggccagctgtggtgcctcccagggccccctctgcggtctctccagaagcaggagccccaccttgggcctgccctctcacacctgcctgtgtggtcttggtacggcgcctctgtgtccggactccggtgcccgccctgcgtgggaggaagccaggactcccgggctgacctgggccattcctggtgggtaatgtgtcagttccacagcatgcactgtgtgtgcacttaaacaaacgtcatgcaaaaatggtcaagccctggggcaactccttgacaagtgtccacttggacctctcccatgtggcacgggcgacaggtttggtgcaaaaccttgtgcggccaagaacccggcgtgcatgtctcactgagcaaagtgcccaatcgaccaactgttgaccgggcggcccaaaaatgcaaatgcgcagagaactgaaggagagcttagagtgacaca

SEQ ID NO: 695243 - DNA, 639 bp, Homo sapiens
tataaaaatggattttcgccatggttgcccagggtggtcttgaaactcctgagcttcagtgatccgcccgccttcggcctttccgaagttgccgatcacagggtgttgagttcacgtgcgcccgcggtctccagcgtgctttcataatttccagggagatgcgactctgttatagagcctaatcgtgggtgactctaactccttatgaccagaatgtgcagggatttctgacgtgctctcacacagcgtgttggcacatgtgttacacagcctttataccctgtgggccccagaaaaggtcttttattctcattctcgctgtgtgttctttctccgtaaaacgcagcccaaacttctcagcgaaccctgtgactgtggacctcccggcgtgagaagagaaattagaaacgccccatgtcgcctcctatagggggacctcttcttttaaacaacaaaataacgtgtgagcatgtattaagaattttgaaagtgagaaggggcttgtgcacgctgggagaaaagcactcctctgttgaagcgctaaagacacaaattctcctcggtgtatacagagagacagatcataagaacggcccaaaaaaggtgggagaaaagcgggaaaagacaaactccatattt

SEQ ID NO: 695244 - DNA, 1076 bp, Homo sapiens
  misc_feature (585)..(585): n is a, c, g, or t
ctgaccctaaggtactatgagtcctcagtgcgtcgagttcaagaaatggcccagcacagacctaaacaccacatcgctcacaaagtggatggcacacaacgacaagaactctccggtgcgggacctccgactctattcccacccttgagtggagcccgcttactggcgggtgggggtccttgcgagttccagcgacatcgcgtaggccaggccaggacgtccttgctccctgcgaccctcactgttctgtgcagttgattctactctacataaacacgacgtcattccacctcaaaaaaagaagaagaagaagtatacataacataatgggatgctgcattgcagacaacgtactgtcgtccactgcacaaggaggcgcgccaattcttcttcctctgagtagccatgcacagtctattggtgtgtgacgcaacagaggaggcgcccgcgtataaccgagagagagtgcaactattcacatagcgtggcagagcgtaccccgagtgccggacaagtgattctcacaaaagaggggagctggaggcattcgggggaagagaccagattgggggggtagagcacatnggggagggcattcgctttcgggaggaaaataaggcgctagcctgtattaaaaacttggtttgagtgggtagagaagggccggtgggaccagacaaatagacgtcgtgtgggtgggacgcatagaggatcatataacctgttaagaacacaggaagggataattgtttaattagcacggtcctaataagaaaggcggggccacaggatatgtggagcaaacaaggtctgtgttgaatgaccgaagtgtggtgtgatgtcagaatagaagtagcgtagtgaacgatagaaactagacggagttgaatgaacttaacgtagagtgttgaggaggcggaaatggagggactgaatagatatggcaggggatgaactcacggagggagagaaaatgaagaaagaagatatatatagtagaagagaaagcaatttttggtgataacatcgcctaaggaagaattggcaatagtgtggagataaataaaaggagtgga

SEQ ID NO: 695245 - DNA, 388 bp, Homo sapiens
tcgtatttaaattctatgtgtaatagtgtttctatggaaaaagaaacttttttatttttgttttttgagatagagtctcactctgttgcccaggctggagtgcagtggtgacatcttggctcgctacatcccctgtctcatgggctaaagtgattctcctgcctcagtctccggaatagctgggatcacaggcatttgccaccatgcccagataattgttctatttttagtagaggcggagtttcaccgtgttggccaggctggcttttctcataggttttcatttaagccctgattgtccctatgaagtcatttctgcattatgggtgacctggttctgatatatgatcctcttctttattggttgtcatgtgttcttatctctatg

SEQ ID NO: 695246 - DNA, 272 bp, Homo sapiens
actccgaggatccccgctgtgcggaccatcctcaacttttcttagtatttttagtagagaccgggtttcaccattttggccaggccgctgcttcttatttttaataggctttttaaaagagcagttttagatttacagaaaaatcgagaagatggcatagagtttctacttgccctgcgcccaactgtccacatctcaccctcgcacggttcctttgttgtcactgatgaacccaacactgatccatcctcattcaccgtgcacccgcacag

SEQ ID NO: 695247 - DNA, 893 bp, Homo sapiens
tactcgcgaagaatggcggacctactgggctccatccgtgagctccatggcgaagaccacccagcctcggtgaccaggaggactcgggcagaggcccggtgtgacatggccagcccgccctgcatagaaactacaaagaagccattgagacgacaccaacgatgacaagttggccgctttccggtaacgaggatgtgatgccatgccggcgctctatgatttccatttcaagccagagtgggtgaatagactcaaggaaaccacaggtttcctacgccaaaggcactgcacgagtccgtgcaggcagcctacatgctatgattgtgctgggaaagttgtgcatgggcgggaagactgttccttcttctctttctcgtggagcacaagacttgactggactgtgtgtgcatattggtccatgcagtccttcacaaagaggtaggttagggctcgcctccagcatggctgatactatgattcgtaaacctgtcaagtgcgcaacgcgacgcttggggactcccacgagaaaggtctgcatgagatgcagcctggaaggacgggctcgccacggcttggccctacaatggcttgtaccggatgaccgggcaagccccccgcgagagaggcctgtggtgggtgcgacttgccactttgctggcgatctaatcgagtggcaacgtcgcctgcaacttcaatctgagcaagtgcatcgcagctcaatgcacgacagcctaaatgctacaggggcaaataagaacctgcccgatgcgttggccaggacccagacaggcgcgaactacggggcacattgagacagcgctcaattggtgatgagcgactgacacgctaagggcaatgtgcccaagtagccgcgagactacacgcgccccacg

SEQ ID NO: 695248 - DNA, 805 bp, Homo sapiens
ggatgatatatgtgaaagttcttagtaggtacagaaattatactagaaaagacaaatacaaatctgacatgctatgatgcagtagtggacatatcattcggtcgagcttactgtgtcaaaggtggtcttgaaactgctcttggtattggtaaatgttggagtagactagaagtcgagagagtacggaatccgacgcttatgtgctctcagagcttaggtttacaactgagctcaagtgtagggattgtgtctgatgattcctggaatcctttacaatttgtaagaattgctgatgcaattcgtgcaagctctggaaaatgtgacctccgaggtgtatgtcttcgtcagatgcaactattagaccatttgatcacgagttgatacatatactatgtaacaatattattattctttccagagacggagtctcgctctttcgcccaggcatggagtgcagtggtgtgatctccggtcgcgttgcaaacctccgactacatggctatcgagcgcattctccatgccttagcctcccgagatggctgggatttgcaggcgcctgtaaagcatgctgggcgtggtatagtgatccaatagagaatggggtatcagcagagataggtcagggcaggtctcggaacattctggatcctcagcgcgaatccgtacggcctcggcctccccaagggggctggggattgcagggcggtgaacctacaatgctaggggcctatcacattatatcctaccgaaagccaatcatccaaaaccttgaagtcaagccccaaaagagcggcccttgataccg

SEQ ID NO: 695249 - DNA, 228 bp, Homo sapiens
  misc_feature (52)..(52): n is a, c, g, or t
  misc_feature (86)..(86): n is a, c, g, or t
  misc_feature (178)..(178): n is a, c, g, or t
aaccgctgcaacatgggtgttcaagcggttcgttgagaggttggccggttgnctattgctctcttttgagctctcatcccggaaanttgtcgcgagtatagagattattattatcatcagcacaggtcttttcgctgtagctcttagctactcatggtgaggcgacacatcatgcttntcaagatgcatgtcgctcactgttatctacagtatgtttccgatactcca

SEQ ID NO: 695250 - DNA, 940 bp, Homo sapiens
gatgatgaccccgtctgtgtctgtctctgcatcgtcctctgaatacataatcactgctgaagagatatgtcaatggatatcctgcgaaatgaggaggatcttgttgcatccgtatcgtgttacttcctaaactatgtattcatagatttactgcacataactcatgcaattttatgcaactaagtgatattgagttttcactcctacaaatgttttcagtcccagcttcgctgttatgctcgaatggttcgtcaattgatagcttttacgaattagttcctatcaaaaaatcgatggagggatccacccatttatgatggaagtactttacttatgcttaaatgtttgtgattacaagatacttcttgctgagatgaaccagatgtcttatagagtccaagcccaatataattggaaaggcataagaattattttatggtaacatttagaacgacgaatcatgagaaaatgaagtatcgagtcagattgtagaagaaagatagttaatagagaccttagtgataaagtggtctgtgtatctttgacattcgttgatgtggttaattcactcttctcaaaagaataaggataaaattcttttttgtgactacagaaatcaaaggaattctggggtaacaagaactatttcccaaggattcattactgtgtgtccatgaaccatagcaaaaatagtcttcgaggttatccgggtacctaaatgttaccaccaatatagcatgggtccgtgaagcgaagattattcgcccgtccttactggggaatgataattccggcttacggaatcattgacctgaaggttataaacgtttgggttggcggttaatcgggaacacgtgattccctttggggggttccgcccccattaccccagttttccggaagcggttcttgagattcccgcgcaattttaagaccagga

SEQ ID NO: 695251 - DNA, 321 bp, Homo sapiens
  misc_feature (159)..(159): n is a, c, g, or t
gaattccggaggtgcaaatataagccaggggaagtgtgtaccagacttgggaggagtagggagcgttcacagtgacaggtgatgatcttagtctgagatttgaaggggccggggagcatgtgagtcagagccgatgaagtagacaaagaagatggttcntgcacagatggaacagcaggatgcaatggctggtgtggagagctacgaggcaatgtgccgcaccggtggacagtcccactagtgatagcagtgtgggggtacggaggaccattgggcttgcagcttgcgtgcggaccgtatgtagggccccagtgagctgag

SEQ ID NO: 695252 - DNA, 99 bp, Homo sapiens
  misc_feature (65)..(66): n is a, c, g, or t
gcggccgcctactactactactgctcgaattcaagcttctaacgatgtacggggacatgctcatnnggaaaggcatcaaaaaaaaaaaagttgtactgc

SEQ ID NO: 695253 - DNA, 104 bp, Homo sapiens
tcctggtccattttaagtggcaggatatggacccagaaaggactctgtcattcctctgataaaacccttatcatccatgttaaccccaagagccacgcaacgag

SEQ ID NO: 695254 - DNA, 581 bp, Homo sapiens
  misc_feature (1)..(1): n is a, c, g, or t
  misc_feature (11)..(11): n is a, c, g, or t
  misc_feature (23)..(23): n is a, c, g, or t
ncctgttgcancggcagatttanttctagaaccccatagacgtcccaaaagctccttgggtgataaaaaaactttaaggaagttcagaatccaaatcacattaaaaaatcttctagcattcctatctaccaacacagtcaagctgagagtcaaaccaggaacacaatcccattcacaattgccacaaaagaataaaatacctagcaatacagctaaccagggaggtgaaagatctttacaatgagaattgcaaaacactgttcaaagaaatcagaggtgacacaaacaaatggaaaactattccatgctcatggaaaggaagaatcagtatcattacaatggccatactgccaaagcaatttacagattcaatgttattcctaccaaactaccaacgacattcttcacaaaactagaaatcaggatcctagaaactaggatcagaacaaataactattgggtaccaggcttagtacctgggtgacaaaatatctgtataacaaacctctgtgacacaagtttacatatataacaaacttgcatttgcaccctgtaacctaaaataaaagtttaaaaaaatt

SEQ ID NO: 695255 - DNA, 271 bp, Homo sapiens
ctgatacaatcgagctcgtaccctcataagggcaagtgatcttcccattagcctcctgagtagctgagactatagacaggtaccccatacccagctaattgtttttttagggtggggggcgtattttttgtgtagacgagttctcaccatgttccccaggctggtctccaactcctgggctcaagccatcctcctgactcggcctcccaaagtgttgagattacaggcgtgagccaccatacccatctacattttttttggccttatcgag

SEQ ID NO: 695256 - DNA, 178 bp, Homo sapiens
acggttttgatgatgatggctcagaatttcatggacatatatttctaggagtaacacctggagagcttttcaaaacaaggaccatcttcgccccttcatggagctggtgacttgtggtctttgcaaaaacccatatcttagagttaaacagaacggtcgaacacatcagagtggcctt

SEQ ID NO: 695257 - DNA, 124 bp, Homo sapiens
gtagcggctaccaatttccccccggcgcggtttacgaccgtggtgcggggggcgggggcgacccctttcccccggcggcgtgttcgcccgagtctcgggcgtcggggggccgccctccacgccg

SEQ ID NO: 695258 - DNA, 243 bp, Homo sapiens
tctagaggatcccatcgtgcgacgatacctcagaatgataccaggagacaaaaaaaaaaagggttctacttttttctgattccctaggatcaggagatgagttgcctttgtccctctctgccagtatgggctatggggcctttcacaaggaaaagaagagccttagcacatttctgtttcccagttgggagagggaatggacctttgacccttgtgcttttaaatcagggaagctttaagttg

SEQ ID NO: 695259 - DNA, 381 bp, Homo sapiens
gctcgacgtctctctctattgcctaggctggagtgcagaggagtgatcacggctcactgcagccttgactgcccgggctcaaccgatcctcccacttcagcctcccaagtaactgggaggtgcatgccacgatgcctggctaatttttttttttaatttgtagagacagggtctcaccatgttgaccaggcatgtctcaatctcctgggctcaagtaattctcccaccttggccacccaaagtgctgtgattataggtgtgaaccactgcacccggcctcttttttaaatagttattatagtgacattccaacttaacatttggaggcaaatttttcttaagaggattatcaagagccagtatctacaagtgtttgataag

SEQ ID NO: 695260 - DNA, 584 bp, Homo sapiens
tcaatggcaacacagatttatggggagaaagacctggcggagaggggttaccagctagtgccagagcccccttcccgctatacaggctggaccagttacagtcccgtggcaggagaggtctgggattgttggtgaaaatgtgggtggtggtagcggtgtgtagtggctggctgcataatgacatggaattatagttgcagccaggggttaggcctgggacctgcctgacaggatgtttctcacagctcagtgccctgtgtggaatttcccactctgaccagttggtaaaatggtagggtgtctgcaaaatacgtgcagttgtgggctaacattcttatttcttacttctagtataaaaagggaaaaagtggcgtcgttggatcatctggctgcttcctgctggatacgcgggcgttgcgtggattagggcctgggttctggagctcccgcaatgggtttccttcgtagcgctcgcggtattcagactgtgggcactcggttgcacttatcttatccacatggttgttggcatgcttgcctggataaaacacttcagccttggggaccttgagctgggctacctg

SEQ ID NO: 695261 - DNA, 963 bp, Homo sapiens
ttccgccgggtgtgttatcgtgtaacttgtaacccgtaatgtccctccggggtatgagaagtgttctctttaaggcgcacgttgtgccccgctatgaccgttgaatccctcaaaaggctgcttccatttggaagagatatcgtacttacgcatgtttgcgaactatgttcaatagtacagcgtcccctgcgatatttgggacaggcgtacgacattcccggcgggttacacatgggaaaatccaatggttgcatttctcctcgcgcaggaggggtcgtaacaacgggggaatgcccccccccattctttgtcgctaatcatgaagtaccgcgtgtatctgtgtagaatgactttggggttaccacccccgaattagtgggagcttcgctttcaaacatccctctggtgcaaaaagggggatccactctatgggtaaaaaattatatcttggcggggtgaaaaaataaggtgcggtttttgaccagcaattaaaaacgtggctccctgtttaataatgtttttggtgaacaagcccccgtacgaaatatatcctcgttgggaagaatcccgcgtgcttttgatattactgcgcgaaagaaataatggttagctggtggttaagtcataaggagccccctgtgtgtgtgccggctgtacacacagcccctcgtctgttgcctcgagggtcgtatataagattattccgccaacatccttttccaagggtggcgctcccgcgaatacttttcccctggccgcgaatgcaggagcgtgcataatcatgtccgccactcactcggggccctcctatcttataatcgtttggtctgctgctgaaggcagaaatacagccagcgttgttagaacagcccggctaggtactaaagacgtatgtctacactacgagggggctccttcccagcaaaaaaccccaaattggggcccccaactcaaacaaaaaca

SEQ ID NO: 695262 - DNA, 115 bp, Homo sapiens
cgtctacggcgttacccgaaaatcgttacatcattaaataagcctcttatgatatccactacagctcctattgcatggcgtcctagtgtaactctgctacataccgtttttacgt

SEQ ID NO: 695263 - DNA, 291 bp, Homo sapiens
gcccaaagtccagtggggttgagccccttgcccccgactgacccccacgtggtcccttttttcatcagtcccaataggaagccaagcccggttcctgttacgccccatggaggctccgagaccatttgcccagcctccttgaggctcaggacccggcccccccaagtgcagccctcgtcctgggtttgccccgggcagctttcccctccctttcctccccctgcccccctgctttttaaaaaaatgggggagaaaacttccaaatgtttataaaaaaagtttgtcccccca

SEQ ID NO: 695264 - DNA, 411 bp, Homo sapiens
acggcttaaagtattaggggttaagactccaacatatcttttttggagggacagaatttaatccataaatgtttaaaagtagtagaatacacaaaatgtgataccattagcataaagtttaaggatacgtacatacataaccgtctaatgaaaaaggaagggaatgataaaggctaggtttggaatgtgactcctctcgggttgagggagggaaaggtgactggggcttcccatgcctgggcattcgtctagttcttttttttttttccccaagacagggtctcactctgtcgcccaggctggagtgcagtggtgcgatctcagctcactgcaagcaccgcctcccgggttcacgccattcttctgcctcagcctcccgggtagctgggactacaggcgcctgccaccacg

SEQ ID NO: 695265 - DNA, 129 bp, Homo sapiens
aaaaagaaaaaaagaaaagaaaaaatagagcctaacattcctcttattaaagttggtacaccttcaagaagaggaatgtgacagaactggccatgtgtgacttctgaggctacatggtaaaaaaaaaaa

SEQ ID NO: 695266 - DNA, 386 bp, Homo sapiens
atacagcgatatatatctgtgaactccacacttgcatagtagtggtctactccagttgagcatttagatagctacaggcgaatcaccttaatgcgttcctaactagactccccatttccaggggaaacttgtgtttcctacaggttctatttcggggaactgcaattcccttttttcagataccaagataaaagaccttggagtccgcaatttcacacatttctttctcttacaccaaaacttattctaacatacacataacttataaatatatagctaaaaatatgtgtccctatatttcatccggcctgtccacgcccttatcatctctcatttagaggcttgttatagctgtcactggactgtcacgttatcaccttgtttta

SEQ ID NO: 695267 - DNA, 730 bp, Homo sapiens
tatgggcttgggtaagggaggtagggggaaattggggttaaatattttaaatggggtggatgaggaatagtggtaaggagtatggagggggtaattatggtggggcaggattagcaaggtcagcctcaggaggctaaaacctttgaccttgctgaagtcttcttaaattgtcaaaagaaacaccaggtgtttccagaggcaagaagcactgggggcttcagacaacaaaatctgtgtgcaaacaagggcttggtacgggcgcctgcgcgtgggtctatgggctatccgccgtgtgggctggctttggcaaattagaccgctggtccggtgttgtgacgctatggccaaacgcggggaaaaccacaagggggcggggcggcaagaacgggctcgtataagcgccaccgcttagtggcccaagtttacaaccgcaagcgcgggttgagcaactgggcaagtgtacgcaaaacagcaatggcaatggggcagcacccacgggagagaaaagaaggcacgcccatgtgacaggggccccacggcggggggcgcgcgacacaaaatgtttgggagaccacggggagacgccatgggagccccaaggggcggtgtgggcacaacggcgcgacgagcaggacggccccctgcaatacggtcccttacatcagcgggcgccaccgtgggggtaacaaaacacattgcccccttagacaccacaaaaaaaacacaattg

SEQ ID NO: 695268 - DNA, 762 bp, Homo sapiens
  misc_feature (392)..(392): n is a, c, g, or t
tggcgaaacaaagcccttaattaaaaaatttttcaaagaccccaccccccctgacccgaggcccaaaaaaggcgagctatcccagctataggcaaaaaatgcccagggagagggtgtctcctcttcaccaaacaatcttccccgggaaccctataaatatagaaataaatatatattccacagagagtgtcccgaggaaaaaagcccagataccactctctttctctccctagtggaagagagggaagtggtgtctgtgtggtgtcccagccctcgtgctccctacctcgatgaggggcgagggacactctctcttagagaaactcgctccacatataaaatctcgagtgatacatctcgagaggggatctcacggggctcattataagccncctataacgaggagagacacccctatagagagagaagaggggcaccccctctcagaggtctctatcaccgggagaacgccccagagctctcacacaggctccaagagacagaggtgagagggagaagagagcgcccccctataaccccccccttacaagcacgacggcggcacacccaaagagagtattcagagagtccccccctctcaaaaatatcccctctctgtgagagacacccccgtgtgagagggacacgcagtgagagagcgggtgggggcgcagaaaaaataagaaaacccccccgagtgaaaactccgcgggggttcacaagtggatataaagcggggtcacgaccacgggggcagagtgg

SEQ ID NO: 695269 - DNA, 964 bp, Homo sapiens
  misc_feature (95)..(95): n is a, c, g, or t
  misc_feature (274)..(274): n is a, c, g, or t
  misc_feature (300)..(300): n is a, c, g, or t
  misc_feature (314)..(314): n is a, c, g, or t
  misc_feature (317)..(317): n is a, c, g, or t
  misc_feature (322)..(322): n is a, c, g, or t
  misc_feature (352)..(352): n is a, c, g, or t
  misc_feature (359)..(359): n is a, c, g, or t
  misc_feature (389)..(389): n is a, c, g, or t
aatcaaacttaaatcattagaatacaagtttatgtattctaatgcatgttagaaaattgaataatataggaaacacaaggctgcatgatgaaaantgcattgttactgtgcagttaaattttggcttctggctttctttagtttgaacaaacgttcttgtctaccccagtagtcacagatgccatctttgcaacagaaagagtggtggtggcaaaatttctagaatgttaaaaaaaaaaaaaaatccacacccatgtgccttctcaaaaccaantgaacttctataaagcatctcgggtnctttcaaagttggngtngtaanggagcaatgtagatgatgctataatacttnatatttngggttataatgacaaccaccagttcttttncacttaagttaggttgagaaattttatttaatgggccactgaagggccattttcaatgggaaaactttatttacatctctggggtaaacttctatttggatgaacaagtggcctagtattttaccaccagatgagaaaaagatgagcagcatttaaaacattacatgtcctttcacaaatacaagtccagagaaagacatgtctataattatcaggcttggttgaatggaatcttttcccccaattcttaatgtaacagatctggtggctataaccttttaaagccatacaaataagagtgctaacctgtggcccttaaacagtagggtgtcgtaacactcatttcttaactcagttatttacctgtgcaaaatacaagtttataagcaaagcctatagaccaatatgcctatttttttttaccactggttcacctatggcggaggtcttttaccatttttttaacgtacacctttcacaattttgacccacacataccaacacaccgaacaaatcaacagcaacacatacaaagtaacaacaacatcacaaacaacacacacaacatagcactg

SEQ ID NO: 695270 - DNA, 400 bp, Homo sapiens
  misc_feature (19)..(19): n is a, c, g, or t
  misc_feature (38)..(39): n is a, c, g, or t
  misc_feature (76)..(76): n is a, c, g, or t
  misc_feature (153)..(153): n is a, c, g, or t
  misc_feature (317)..(317): n is a, c, g, or t
  misc_feature (324)..(324): n is a, c, g, or t
  misc_feature (331)..(331): n is a, c, g, or t
  misc_feature (346)..(346): n is a, c, g, or t
  misc_feature (370)..(370): n is a, c, g, or t
  misc_feature (392)..(392): n is a, c, g, or t
aaacggggagacctggtancaccgggcctgtttcccannacagcacatgcctggctcctgagcagaggtgtacacncagcagtgcaccctgctcccagttcccacccctggacgccacagcactccagtcctttatccttgactaggccccanatgcctttgagattgtggtgccccccaacccccaatctaggcagcaccctgacaggacgtgtgcatggccggaaaggggctggctttctggaggatgtgggtgcaacctctggggcctggatttagtcgccacctggcccggagtgggcattgggcctggtggncgttggnccgggtnactggagtggtgctnggggtgcagcccaagcccccacgncggtgaacccagccccttggtncctttggg

SEQ ID NO: 695271 - DNA, 994 bp, Homo sapiens
  misc_feature (95)..(95): n is a, c, g, or t
  misc_feature (304)..(304): n is a, c, g, or t
  misc_feature (330)..(330): n is a, c, g, or t
  misc_feature (344)..(344): n is a, c, g, or t
  misc_feature (347)..(347): n is a, c, g, or t
  misc_feature (352)..(352): n is a, c, g, or t
  misc_feature (382)..(382): n is a, c, g, or t
  misc_feature (389)..(389): n is a, c, g, or t
  misc_feature (419)..(419): n is a, c, g, or t
aatcaaacttaaatcattagaatacaagtttatgtattctaatgcatgttagaaaattgaataatataggaaacacaaggctgcatgatgaaaantgcacagtaacaatgcacttttcatcatgcagccttgttactgtgcagttaaattttggcttctggctttctttagtttgaacaaacgttcttgtctaccccagtagtcacagatgccatctttgcaacagaaagagtggtggtggcaaaatttctagaatgttaaaaaaaaaaaaaaatccacacccatgtgccttctcaaaaccaantgaacttctataaagcatctcgggtnctttcaaagttggngtngtaanggagcaatgtagatgatgctataatacttnatatttngggttataatgacaaccaccagttcttttncacttaagttaggttgagaaattttatttaatgggccactgaagggccattttcaatgggaaaactttatttacatctctggggtaaacttctatttggatgaacaagtggcctagtattttaccaccagatgagaaaaagatgagcagcatttaaaacattacatgtcctttcacaaatacaagtccagagaaagacatgtctataattatcaggcttggttgaatggaatcttttcccccaattcttaatgtaacagatctggtggctataaccttttaaagccatacaaataagagtgctaacctgtggcccttaaacagtagggtgtcgtaacactcatttcttaactcagttatttacctgtgcaaaatacaagtttataagcaaagcctatagaccaatatgcctatttttttttaccactggttcacctatggcggaggtcttttaccatttttttaacgtacacctttcacaattttgacccacacataccaacacaccgaacaaatcaacagcaacacatacaaagtaacaacaacatcacaaacaacacacacaacatagcactg

SEQ ID NO: 695272 - DNA, 102 bp, Homo sapiens
cattgactaacagaccgcaacctcaacaccaccttcttcgaccccgccggaggaggagacctcattctataccaatttccagtttgacacatcgttcataac

SEQ ID NO: 695273 - DNA, 137 bp, Homo sapiens
  misc_feature (14)..(14): n is a, c, g, or t
  misc_feature (19)..(19): n is a, c, g, or t
  misc_feature (133)..(133): n is a, c, g, or t
tttcgccatgttgnagtgnttggtcttgaactcccgacctcagatgatccacctgcctcggtctcccaaagtgctgggattacgggtgtgagccaccatgcccagccgtgtgtctgtttcttaaagatattanacct

SEQ ID NO: 695274 - DNA, 843 bp, Homo sapiens
agcggagtccgaagaaggaggctgggagagaccacggtatccttccacgctgaatcaacagtctgccacaaagcagactatccagccggctacaattggagtcagagtccccccagacctgggcttgtctagagtgctgtgcaagcatgtctggctagcgggcccccttttgcttccctggtgtccacctggattgtgttccttctggggtggcgactgtactgtggctgtggacatgtaagcccctcactggcacagaaagagcgtaacttgagaccgtattactccaatcaacgtaccaagacgtatggagtatctcatcagatgctgatccatgcgcttccaggtatgtcatctatggaacttgcctctttcttcttcctttatgggtgccctccatgctggctgagggcgttctacgctcaccggcgcaagtccaggcgagatcatttgtgcgacgtacccagaccaccgatcgtgctggcatagggcccttgagcgtcaaccgagttaacagaggcgagccatgacatagggcagggggctacccaggacggcccagaccagtcaagggctcactttctttctcgctacgactgggttggtgttcacttagcttttggagtaagacatgtccttagggaccactcctccgacacagtatctcgtcgtgcgcatcacccttatgccccttgtagcgccgttggtggttgtgcctcccttggggtgcttttggcccgtgcctctttgcctgttgccgctgtgttaccagtgtaagctctcaaactacccttgggacccaccctgaccaggatcctattggccctccccgcagctaggacc

SEQ ID NO: 695275 - DNA, 429 bp, Homo sapiens
ggctgctgttctcctcctcgctggcagctgcgtgtggtggtctcggtggtggtagctcagacacccgtgccgctggacgtttgcgtgcggtggtctctgtggtggtgattgacgccgtgacgctgggaggactgtgtgacctggtttcagtggtggtgatggcagaagtcaagctgggatccctgtgggctgtgctttcagaggtggtgctcggtagcacagtgaagctgggcagtaatgtagtagcgggtgtctccagtggtggccatagcagaagtgtagctgggagatactgcgtgaaatgatctacggtggtggtgatcgacgaagtgatgctggcagtaagtgtgtgcggtggtcctcagtggtggtgattgaaaaaatgacactggtagtactctgtgagctggtctcggtgtagacaatcac

SEQ ID NO: 695276 - DNA, 291 bp, Homo sapiens
tatgtgaaaagccttcccaagaaagatagctacaaataatcccagacagtgaagactacaataaatactcaccttttctctcgctaaattttattttttaaacttctcatatggtgctgcatgcccaagattttaatgtccagacactgaagaacatctactagcatcaacaccatccaggaaaacatgacctcaccaagtgaactaaatatttcactggggacaaatcctggagaaaaagagatatgtgatgtttctgacagagaatttaaaatagctgtatttaaaaaa

SEQ ID NO: 695277 - DNA, 472 bp, Homo sapiens
  misc_feature (196)..(197): n is a, c, g, or t
  misc_feature (314)..(314): n is a, c, g, or t
  misc_feature (350)..(350): n is a, c, g, or t
  misc_feature (419)..(419): n is a, c, g, or t
cacaacctgacatcacagccttaaataactcctgtaatttccatctgtctcttgctttcatgtgtgttagaaaaacagccaatctctttataaaacagccctataatcatacgtactcttcatcttctaagtgtccatgcagcttgaatcattgcacacagtcttctagagttatgaaaataaataaaaccccctnntttccccattttatggttgtgaaactgacacagataacacaaaagggtagattagggaaagccatatcccctctgccacccacctccaatactgatccagctttcctggatcaggcnagtagggcgttgaggcttcttactagaaattattgntaaggccgagggtggtgctcatgcctgtaatcccagtgcttttggaggtcaagatgggaggactacttnaggccaggagttcaagaccagcctgagcaatgtgacaagaccccatctctaca

SEQ ID NO: 695278 - DNA, 587 bp, Homo sapiens
  misc_feature (47)..(47): n is a, c, g, or t
  misc_feature (99)..(99): n is a, c, g, or t
  misc_feature (216)..(216): n is a, c, g, or t
ggtgatctagaggatccttgtggagaggggttcaggtaaaaggcagntgaggtgggggtgatggaaagcctgagggttgcatcagtgtggttgtggttnaggaggggggcattccaaaggcaggtgataaggctggggatggctgaagggaccagagaggccagcgataggcaggcaatccatgggaatgcacaggtcaccagtgtagggtgcagngtacccaggcttcgccttcaaggaggaggggagaataacatatctcaaactgaggtccctggacctcttgcatctgaatctgtcggggggagggggaacttgtggaaatgcagacccctgggcccaacccagccttttggggagaaagtaagcacagtatgggagaactgagcctcaaggagcaagagtgtctatgggatgggggagcatccagcccctccaaggtcaagggagggatgggcatggtggcatctatccaggctagaggtggaccatgggatattcaaagaagagataggctgggcgcggtggctcatgcctgtaatcccagcactttgggagaatgaggcaggctgatcacttgaggtcaa

SEQ ID NO: 695279 - DNA, 613 bp, Homo sapiens
  misc_feature (593)..(593): n is a, c, g, or t
gtggcatcatttacatggggtgatcgaccagtctacccggatagcaggttgatcatagtggaactcttccaccatggaaaaggagagaggttgtcctcattggaacaggcacttactcaggatatgggtttgcctacctgcatgcaatgcttccgacaagactaccatttatggactcaaggaatgccttatccactatcacggtattccacacagcattacctttgaccaagcactcactttacaggtaaagaagtgaggcagtgggctcatgctcacggaattcactggtcttaccatattccccatcttcctgaagcagctggattgatagaatggtgggacggccttttgaggtcgcgattacaacatcaactaggttgcaatactttgccgggccggggcaccatactccagaagaccgtgtgtgctctgaatcagcgcccaacgtatggtattgtttctcccatagccaggattcacagatccaggattcacggggtggatgtgaaagtggcaccactcactatgatgcactagcaaaatgtttgctttctgttcccacgacattaggttctgctttactagtcatncttactccagagggaagaac

SEQ ID NO: 695280 - DNA, 1114 bp, Homo sapiens
  misc_feature (13)..(13): n is a, c, g, or t
  misc_feature (44)..(44): n is a, c, g, or t
  misc_feature (88)..(88): n is a, c, g, or t
  misc_feature (381)..(381): n is a, c, g, or t
taggccgcccaantgcgaagccgccggagcggacttcacggtcnaccttacgagttgagtgtccaaacgagcaagctggacagacatnagaacgagacgcccgacgcggacacccaagaaagctggtgaggaccaacacgaccgcggtgaacgagaggatcaccgtggggcagacacgacacacagcaggcgctgtctgggagcacacacgctaaagtaatacagggggggccccacctctccgcgcgatcagggggcgccccccgctgggcaactggagatcgcaaaacgtcaatagaccgacgaggcggtgcacaaagacgacgacagtgctcggctggcgggaccgtggaccgcccggatacagggaccgcgggcgcncccttttacgggcgaaggatagcgagacgctctgaagactggcaccatcgaataggggaatacgacaacaagcagcggggcgctcagcgtaacaggggccgacccaccgcaagagatgctggcgtatgtaaaggacactgcttaaacagtggtctcctctattctatttcacgggcctccatggccccacgaatgtatgcctaatttcttggagcttgctccaataagagaagtgtcaaaagtccgtacggcttgatagagccccgcccaaattcccggtgcagtaagaggcccacaagattgatatgtgaatccccccccagagatatattcgtggaagttaattcttaacagggattcaatgatacctagtactaatcgcgggggagggtcaccgtgcgacgatcccaccctgcatcgtctgccagaccatgctcacaagaagcgtggcacagacactgacaatttcacccatcgcccatggttgaggcgaaaacatacccgctcttacgaacgccgcatcagggttcaatctattgtcatagtgactggtacgatcgtcattgttctagtgagtttaacccgcgagatcacaaactttgtttccctaatgcaatactcagagccgcccggggggtgaaaaaaaaccccggtatactccttatgtggactgcgaagataatatttggccccatcccggccaatccaaaaatggggggcgccccacaaataa

SEQ ID NO: 695281 - DNA, 368 bp, Homo sapiens
  misc_feature (109)..(109): n is a, c, g, or t
  misc_feature (299)..(299): n is a, c, g, or t
  misc_feature (364)..(364): n is a, c, g, or t
  misc_feature (368)..(368): n is a, c, g, or t
tgtagcctatggaattatccttaggaactcaaagcttcctaaaactatcccatgtagtcaaatcctaggggaaaaagcaaataaaaatagtaaaatttggccgggcacnagtctcacgcctgtaatcccaacactttgggaggccgaggcgggccgatcacgaggtcaggagatcaaggccatcctggctaacacggtgaaaccctgtctctactaaaaatacaaaaattagctggccctgatggcatgtgcctgtaatcccagctacttgggaggtggaggcaggggaatggcttgancctggaaggcagaggttgcagattgtgccactgcattccaccctgggtgacagagactctatctnaccn

SEQ ID NO: 695282 - DNA, 478 bp, Homo sapiens
taagcaggaagagaagccacagcgcttcagaaaagagtgggacagggccaagcctatttaagaggctgaacatgaatccacagatcagaaacccgatgaaggcaatgttttcaggcacattttacttccaatttacctatgggaagccaacgatcggaacgaaacttggctgtgcttcaccggggaaagtataaagcgcccctcaattgtctcctggaagacgggcgtcttccgaaaccaggtggattctgagacccattgtcatgcataccaggtcacctggtacacattttggagcccttgcccaaactgtgcaagggaggtggcccgatttctggccacggacaagaacgtgaattttaccattcttaaccgcccgcctttactactttccagtttccatgttaccaggaggggcttcgcagcctgagtcaagaaagggtccctgtggagatcatgggctattggatttttttgt

SEQ ID NO: 695283 - DNA, 273 bp, Homo sapiens
agagaagagtcggagacaacctgaaattgaagatgttggttctgatgaggagagaaagaaggatggtgacaagaagaagaagaagaagattaaggaaaagtacatcgatcaagaggagctcaacaaaacaaagcccatctggaccagaaatcccgacgatattactaattgaggagtacggagaattctataagagcttcaccactgactgggagacactctgcagtgaagcaattttcagttgaagggcagttggattcagagccctctatt

SEQ ID NO: 695284 - DNA, 368 bp, Homo sapiens
ctaccatgttggcaggctggctcaaactgctgactgcaacggatcacctggctcccaaactgctggaaccaccggcgtgagccaccgtgccgaaccttttattgttccttagaacggagtcttgctctagtcacccggcctgggagtgcagtggtgcaaacacagctcaccgtagcctcaaaatcctgcacgtaaagggctggtcctgcctcagacctcccgagcagctgggactacaggtggtgccaccatattcagctaatattttcttttttttaaaggggagggcatcttagatgttgcccaggcttgtttgaccaccagtgatcctcctgccttgggctcccaaagtgctaggattacaggcc

SEQ ID NO: 695285 - DNA, 475 bp, Homo sapiens
  misc_feature (453)..(453): n is a, c, g, or t
tttttcattagagatcataatgctgtcatgcattgtagaaagagagcaaagagcactcacaattgtgatgggggaggagagacagattgataacattccttttaaagcttagctagcataaagaaaacagtatttactaaatgaaatagattttcaaggttggaaaagtcgtactcaagaatgaatttttggatacaaaaattcagttacacaatcaggagcattcaaaattagctatgagtatttatacaagtacagagagggattcatgttttaacaacgtattgtataagctcagacattttaaaacagggacaatattctaaaggcatatgcattcaccatgggcttttgaatgtcctcacttctcactttacatataaaatctacagaagcggcgcacgatcagagtttagagggctatattttctttcactttactttacttagggntgcacacacattgacagagggc

SEQ ID NO: 695286 - DNA, 315 bp, Homo sapiens
accacttccagagtggaaggtaggggtagctgagatggttgaggaccagaggatagcggggagtagtctggatagacttttctgtctctaaagtcctgttaactccactctcctattgcttttgcatgggtccctccccagctatcaacatcctgaggcctcctctctcggccagagtattgcaagagttgtacaaaccttcctggcgaataccaggtcagcggtcctttgggtgagagaggaggcctcaggatgctgatagctggggagggacccatggaggatccataggagagtggctgtaagaggcctagc

SEQ ID NO: 695287 - DNA, 137 bp, Homo sapiens
  misc_feature (98)..(98): n is a, c, g, or t
tccacacagactagggactggggatagggggagttgttgaatgcatacaaagtttcagttggacgccgggtgtggtggctcacgcctgtatatcccangcactttgggaaaggccgaggcgggtggatcatgacggt

SEQ ID NO: 695288 - DNA, 133 bp, Homo sapiens
cctgctcagaagaggcaggagtcgagaccagcctggtaaaacacgagcagacctcatctctactaaaaatgtaaaaattagctgggcacagtggtatgcacctgtggtcccagctactccagaggctgaggca

SEQ ID NO: 695289 - DNA, 107 bp, Homo sapiens
ttacaaccccacgatcacagaggacagaacgaaacactagtattgtggttgtgttcgaacttcaaatacgaggggtaccgcagcgtcgacattcgctaagtcgatgg

SEQ ID NO: 695290 - DNA, 102 bp, Homo sapiens
ccctgcaagcatgtttttcacaaatcctgcgttggatctctggcttagtgaacattgtaccagtcctatgtgcaaacttaatatattgatggctctgggaat

SEQ ID NO: 695291 - DNA, 164 bp, Homo sapiens
ttagactcatgaaagacagcccaggaaccgcggacggaccattggtcattgagagactcagcagcatggcctacgggcagatttcgcaatgatccaggctctcggtggcttcttctcttcactttgtgatcctgtgcagaaaatggcttcttgccctggcaacc

SEQ ID NO: 695292 - DNA, 231 bp, Homo sapiens
gcgacgacttctgcagcagctcattgatctttgaaaagtgtctacatcctaagaaccctctatacactgacacaggggagggatgagccgtctgtagtacatcgtgccgctccctatcaatggcactgcccttcttctgaacgcaccagagccccccctagccatgagtacaatggcctattcgagttctgattttagcccgagacacaactagcatcaatttaactcgct

SEQ ID NO: 695293 - DNA, 372 bp, Homo sapiens
  misc_feature (16)..(16): n is a, c, g, or t
  misc_feature (78)..(78): n is a, c, g, or t
  misc_feature (360)..(360): n is a, c, g, or t
  misc_feature (365)..(365): n is a, c, g, or t
catatgtaagttatgnttgtaccctaatgtgaaaattgtaatacagtcatcccctcaaatatgtttagggaattggtnccccaggaccccccatgggtacccaaaatctgtgaatgctcagctctctgatatgtagaatggtgtagtatttgcatgtaacctatgcacatcctcctgtatactttaaataatctctagatttcttataatacttaatacaatgtaaatagttgttttattgggccaggcacggtggctcacacctgtaatcccagcactttgggaaatcaaggcaggaggattgcttaaacccaggagttagagaccagactggacaatatagcgagacctcatttctantggtncaaaaaa

SEQ ID NO: 695294 - DNA, 516 bp, Homo sapiens
  misc_feature (36)..(36): n is a, c, g, or t
  misc_feature (109)..(109): n is a, c, g, or t
  misc_feature (111)..(111): n is a, c, g, or t
  misc_feature (114)..(114): n is a, c, g, or t
  misc_feature (117)..(117): n is a, c, g, or t
  misc_feature (165)..(167): n is a, c, g, or t
  misc_feature (176)..(176): n is a, c, g, or t
gctcgacgggatcccagcagggtttctgctctgggnctggcaggttgcctggtattatgcccaaggccgctctgcctgggggaaagggcagccaggcagaggcccagtntnttntangctgctgaatttcctggaaggggtgattggatggaaagaggccagaannnttttggggngagactgctgtgcaccccacagtctgactgcacagagccgcctctgttggcaggaggcactgaggctccccttcctgtgtattgagaagcagtgtttgccaatatattttgctttcaattccaagaggagctctgggaaaacctgtggataaaaccaaatgccaaatgttttcccagagctccccttcctgtgtattgagaagcagtgtttgccaatatattttgcttcaattccaagaggagctctgggaaaacctgtggataaaaccaaatgccaaatgttggacgttgtttcctttcctttctctctctgattgttttaattgttctgtggtgttta

SEQ ID NO: 695295 - DNA, 118 bp, Homo sapiens
atcagaccagtgtggagaccaaaaaggaagtattatacgcacgttactttccaccagcaatgcatatgtaactaacttgcacaatgtgcacatttaccctaaaacttagagtataatt

SEQ ID NO: 695296 - DNA, 178 bp, Homo sapiens
tcgatcggtaagatagctagacgggtcaggcactggtggctcatgccgtaatcccagcacttggggaggccaagatgggcagatcacttgaggccaggagttcaagacgagccgggccaacatgatgaaaccctatctctactaaaaatacaaaaatgggcccagctcacgccggtaa

SEQ ID NO: 695297 - DNA, 522 bp, Homo sapiens
  misc_feature (27)..(27): n is a, c, g, or t
aaaaacccaaagaaaacgtacatccantgctgtggataagacactgtgtacaatgtcccgcgcgagaccgccttgcctgccacagcctgtctctggtgttatagaggaaggcgtggcgcgtgtgccagttacaaaagactgtcttgaatcccaggtagtgcctattcactgggtggtctcagaagacttcccccaaagcgcggctgacaagggtgacagcgcctggcccgcgggaactgtccgcggagctggtgctgaatagggcgtgtgcggcgggcgcttcaaggaaactggaatgcgggaccggaggccgcccctcgggcgtgcgaggaggatttggaagaagagcggggaggggaacggcccggaatctcgtgccgcgacacgcggcgccccaacccataaacccatctcttgctcagagagaagcgaaggagaggcccagcgagtaaaagccgaggcccttgaaggctccttcgcgcgcgccttctgcttgaggctcaccttgctgtgccgtttctt

SEQ ID NO: 695298 - DNA, 919 bp, Homo sapiens
cccctggggattgcactctgctgttttaaggccaggtatattgccccgatcgcccactgggccgcccggagagagtcccagaagagaagtgtgtaatgacgccgggaccaataattgtgggtgggccaataacacatagaagggtgtgtccaaaagaggccgcccaatgggagccgtcgtccagaaaggggtaaatttgtggccacaaatgtgtatattgcctgttgcttgggggtgacactaattcggtgaaaatgggtctccccgccccgtccgcaatgatccactggtgtatttaattatggccgtccttttccccccgggtggtgttcccccattttgtccggccaagtgtttcctaaaccccttgttgtttgaaagttgtggccaaaggaacaaatagtccaacataatggccgtacctctctggagtaataatttaccgcccttccgtcgaccaatccttaaacttatggaatggaggtgtgctcccaatagaggggacaaatctctttgggtaacaccccgttttttaaaagaagtttttctttcgtataggagacgccctcccaccacagttgtgttttgttgaaaggtgtggagatgtgtaaaaatctgtcgctgtgagaatatttggcaactctcccccataatgtgcctttaaaagtgccaccttattgcccaacccggggttataatcacacggacatccggacacacaaattttttgtacatctgtgtctctgtacaccaagaacaaatttctcttttaattgtgtacacttgcctcttttaataacacgttggttatacgccacctaaaatccttcattattgcgaacccaattgtccctctccaaaacccctcccaatgtaaaatttttttcccaaaaaaaaaatccatttttccccaaaaaaa

SEQ ID NO: 695299 - DNA, 154 bp, Homo sapiens
catgttccgccaccgtgctagcctggctttgcaatttgctggcttaaaaaatgactcttaagggaaactacacttcttactcaaatatttcttctttcctctggcaaattattaattaaaatgagtatttttagagggccagaaccagtgtaat

SEQ ID NO: 695300 - DNA, 215 bp, Homo sapiens
ctcgacaagtgtcacacattgtcggctaatatgtatttttagtatagacatgtgcttcagccataccggccaggctcgttcttgaacattctgacctcaggtgatcccaccttggctcccatagtgctggaattgtaggtataagccaccacagctggttttgaatgttcactatcaataggccctttgcagaagtacttatcgaagactttccc

SEQ ID NO: 695301 - DNA, 1051 bp, Homo sapiens
gaaatgaactatggcgcctgcgctgagtccgtatcgattcatgttccgttttccaccgtactgttactgatgttgtgctctgtcctcggcaccctgcgatcaggttagagatcgaggtagcgagtacttcgctgaggatagataactagctcaaagctgtgctccgaataagccagagaccggaaatgggctactcgactagtgaggactttaggaacacatggtttgcgccacgaaatgctcaggggatattgcatttttacctcccgtggagggctggaccgtacgcaatccaagctatgtcatttgtaccatctgccggtagagtcgtacagcattctctgtcctagcaagaagatttacatcgggttcgaactgcgcgtgataggcaccgatggtggacctcgcgactacgccgcagtctattatgcacaaccatatgagtcatccttagtccatcgtgtttggcctcggtacgataacgtcctgggccggctcgttccatgttaactcaaggtatactcgcattcaatgtgggaagacctagcgaagaaggggctggaaataatccctagtagtggaaagacttgctttgcataagggcgttgaaaaactgtactgtaatagattgcccggcgaaccgcaactggacatcttctgaaggggcagtttcctgtaattatctagaagaaaagttcgacgagtatcgaagcccgcagagagtagcctgaggcacgaaccggataatctccagggagattcgtcttaggcccatcggaactgagcgacatcaacggtgtgcgtctgcacaagccggacaccggagttgaggaaagtgtgaggcttcacccaggctggaatgatggcggtagcaccaggaacgcaatgaagctaattcaggcccaggtgataactgcggcggcgccccgcaccagcaagggcgggggtcggggtccacctgacgcaaggcataacccccgcgtggatttcaatggcaggtgtcctttccgaactcttggggacggcaatatagccgctctctatattcccg

SEQ ID NO: 695302 - DNA, 244 bp, Homo sapiens
ctttacggtctgaatgcgggcatgccgtacgcacccgtactgcagcgagaattgtccgtggatggtctccaccgcccccacggcctcggtgaagacgtccacgccggggcgcacttcactgtcttcatcttgtgcgggcagcatccgtcatctgcttgctgcacgcagttgtagcactccaggtcctgtgctcctccgagaagcagcagcagcagcagccagcctgtagttcagaccggcggct

SEQ ID NO: 695303 - DNA, 647 bp, Homo sapiens
tgggctctagaagggggtaaagggggtgctatagggtaaatacgggccctatttccaaagattttaaggggaattaattctaggacgatgggcattgaaacgtggtggtttggcgctccacagaattttcagaagcatttgacgcgtagtttataccccgcggttcgtgtgttaggcggtgaaagtgtggtttgtggtttataaacgtctccgggaaattgtgcattcgtgtttttataacgcctaatgtggtgggcgacacgctcatggtaagtgtgcaagaagcgttcttgggtgagtgtaatttatttatctagcgaaatgtcgggggcctctcaactcggggagttacataccttcgaagtgtgctcaacgccgtctcagagggagtctcgcaggtctcgcccggtgggtctcatagcgaaatataaggtgggggaaagttattgtctgaggagttttagaaaatttagtctccgcgcgtataatctcgggtgatacctcggataggttctcagtataccattgtgggtggccccaatttgtgacttgggaggggataaggggaggggatctcgttgtgaccttcggtcgtggttagttttaaaggattgcgataggggattgggagggcaaatgaggaccta

SEQ ID NO: 695304 - DNA, 444 bp, Homo sapiens
tagcgggtatcgtggtctcgctaactatcaggtcctaagctgccgaccttcacagttattgttacagctcagtagatgtagcagggacccccaacagtgagcagcagccatatttattgtgcatcagcgaaaaaacaaagtttccacatccgtggcaatcggcaccatgtacgtgggttgcgacaggtggactctggtggacagcttctattctcttatttaggacccgacccacatcctgctcattggtccacttcaacagagcgctggtaggtccattttacacaatgctgattcgtccgtctttagcacagcgctgattggtgcatttacaatcctttaactacacacataagtgctgatgggtgctatctaacagagcgcccatcgttgcgtatacgacccttcacctggacacagagcgcagatagctgtgtgcatcaa

SEQ ID NO: 695305 - DNA, 120 bp, Homo sapiens
  misc_feature (62)..(62): n is a, c, g, or t
gagcgcgacattcaagagaagcaatgtgccccggagaagagaagctcgccattccagactgncgaaccagcttatcagtgaagatagcagggccatgaactgtagctcgactccaaacat

SEQ ID NO: 695306 - DNA, 128 bp, Homo sapiens
taagaggaaaacccggtaatgatgtcggggttgagggataggaggagaatgggggataggtgtctctacctggggggggctaagccagaagaaactatggcggaggtccataatggtcctgacatgga

SEQ ID NO: 695307 - DNA, 1588 bp, Homo sapiens
  misc_feature (271)..(271): n is a, c, g, or t
  misc_feature (557)..(557): n is a, c, g, or t
ttctgtctccagggaggccacctacaacccaccacacgtgtgggcgcggagagcatttattgtttttaataaaggaagatatctcttcttcccaggaacgacacctcggctgcttttcactttagtaaaaggaaggggggcgccatacatcttgatataccacccccggcgggggtcgttatctgctcacactgatacctctctcgaaataataatatggccgcccccgcgcctcgttaggtggttgccccctacgagcccaacagaaatnaggtggtctgaaaaaataaacgcccttgcgacatgcatcacacaaacaggatgaagtgtgtgtgtggggtgtgtgccgacacacccacaccaccactggttgttggtgaagacagtctgtgtgtttttccgctctgggagaggtggtgccccctcccctcgtggatgttggccgccctctgtgtgtacaggacgatggtctttttctcggacaacgagaaagaggtttggcttcacatcaggccaccgcatgcacttgtctttctccacgagggcatctattgatngagcagccacccctctcaatgctatgtggggggggggaaaaatacttataaattatggctccgcatgaaaccacgcgtgctttttcacacaacactgtgggggtagacacggcagacactattctctctttggagaagagatttgttttgctctccacgaccacccacgcgccgcgactggtctcgccacaacatcactcgcggtgctgtccaacgacgagagctcgtttgtcacacgaggaggggctgtgtctgcgcaaaatagagggccgctcgccacacatgtgaacacacacgcgggcggcgcggacaaaatatacttgtagatgaatagtgggtgcgccgcacaacaaccctcgtggcgagagatagtgggcgccagagcctataacaactcgacgagggggggcctttctcccgcgcgagaattatatatgaataatagccagctctctattgtgtagacctctctgtgatgacaacactcttcttctcgagacagaacacgcaaggatcttgtctgttgcgatgacagaatccacacgaaggtggacacccccccctcttcgtcccccgaggatacccctgtgtgcactcccccgagagagttttcagacaccgtcgagacacctgtgcggtgtctttttttacaccgaccccaagtttgcgcgcgttgccacacatgtggacacccgtggggggagaataacattccacccgccggcccacactgtgagtgttcccccatcccaccgaggggggcgccccctatccagattgttccaggagtggcacccaaaagagggtctcacagagcgcaccatcagccttttctccgtggatttacatgagcatgtcacacaaaatatttgggcgataaaatcaaaaaagagcgcgcccattccagcaacgttaagaaagagaatctcaacacctatttctattcacgggagagtccccgggggaagggttttcccggggaaacacctcccccgcttttttttttggagaaaaatattttttttgcccca

SEQ ID NO: 695308 - DNA, 1057 bp, Homo sapiens
gaaactttataaaccccccggagcccgagcagtgtgaagaagatggctgatgaactgaccccctgtgacctgaccaaatgccctgcgcgcctgttgcatcccgctgtccagcactctactgtccctgcttgcctgtctgcctgcctgtcactcatgcccatatgatgaaatggcttgaagtgggatgctaaggtgagatcaacgcaaaggtgaaggacgaaccacagagaagatccgcgaggttgtctgctaaacctgctcctccaaagccagagcccaagcctaataaaggcccctgtcctagaagggagagcaaggtacccaaaggcgcaaacacgggaaaagctgatgctggcaaggacggggcaataaccctgcacgaacatggcagcatgccaaacacagaccaggcacagaaacgctgaacggtgctggacgatgccaacgtgaagtgtgtgcatttcttgcatcactgtgtacttctggtgactgtacagtttgacatacctatctcttaatcacgttctcatcacccctgccgacactctcgctctcacctctcccttcccctccaaacgctactgcttcgttcgcctcacctacacacttcctcgctcgtcctgtggtcggccacgggcccctttgctcctcgcctcgccgtgtctccccatctctgctcttgccttgtgcgccaccacccccctttcgctttcttctctctgtcacgccttcctcctctggctccccccgtcgtctcgtgactctcctctgcctttcgtccccctttgccccccctttggtcccgctcgccttcgcggcctctcgccaccctcaacctcattggccatacagttggcaccttttttcatccccctattcccccattcttattcagctaattagaggatttatcttcccttttattacgcctatcgaaaattttttttcataatcgttgacccctatatctttttggtaccacccatgttatccgacatcattgatcatctaaataagtgcaccatcgcaattcgcacggtcaatcacacacgtcatc

SEQ ID NO: 695309 - DNA, 1918 bp, Homo sapiens
  misc_feature (845)..(845): n is a, c, g, or t
  misc_feature (1914)..(1914): n is a, c, g, or t
  misc_feature (1917)..(1917): n is a, c, g, or t
gcagtggttgtctcgaccgagataggtgtcagaagacagtgatatcatgcatgactatgttgtatgccgtgtgctgaaggcacacaccacatacgatagaatcacgcctacgctagcacttgaccgcacatcctttgccccagtcgaggagctacttctcatgcggcgacacacgacgagacgagagatctcagtagactgccgttctaaatgatgctaattcccttctcaactacactaattgactagaaccttctgggaaaagtgagaccagagaatcattttacgtaaaccaaaaatgcgaattatgtgctatttcagtgtgattgtgagattgcagatacgtggggattgactgaagacaaaataaaaagatgcttatgggcaagttagggcgctgcggtatatttatcgtctacatggatgctcgcgcaggaagttctttaaatttacaaaggatcagtcggcttacatgaattatcctcagggggcactcgtatgtcagtatcaatcaacacattcggaagaggtagagatctgtaagcaccgctcatggtgcttgctgaatcttatcatgcacgcgaacatacgtcgtgccacaccttcgtacgtataaaaacggatttacatgcgggtgtacatcacgtacaaatctcgtccatacttaagtacatggacatcccaggaatcttatgtacgcaaaggggcgtaaggtgtaggaaggtgatggacggagtcttagagaatccaaagtgagactccttaagtatttaaccggcaagaaacatatccttggtggaaggacaagtgaaacgtaccgcgtgcgtatatattaaagtgcccanaacgaatatatgccgtattggcagattcgaatggggggcaaagtgtgttcattacaacaggctaattgagattcctcgtgagaaatggtaaaagaagcaagtttgggtattatagattggcaaaagaggtaacttgtttgactaaattttcactacgtcgtggaaatccaaaaggttagggtccagaaagttgagcctaaatcggaaagggtggagtaggggttatatgggctttgggggatttagcaacagctgagaattgagagacccgttaattgtaacattagttggtccgagacaatccgtagaaagagattagaaggacatgagggcaatttgagacgtttaataggaaacggctgggtgaaattaatctcagggttcaccgatggtgcggtgtaaccttcgtttccaacgttaataaggagagagagcttgagatggctccggaaagtaaatgtcgggaacattggaaaagtgtggcggaaaggtggggtgcaccatttatttccgaagagaaagtttgtggggaagaggaaaattatggtaggagttttatagagtaacgagattaagttagttgaaccttctcagtgtaccccatgtggtgttaaaacgtcgttaaagtgggaaatagtgaagaggcaaaaattttcaggtggggcgcattcacacacagggactaaaccaccccccaggagatataaggacagggcacacctaaacaacgaaacgaggcgggagagacgcaccgacgaagacaacacacacccataagtgacggcagaagaaagggagaccaacacaagcgaacgcgaacacagagtacagcgctaaatacaggagcacacaaagcagagaacaaccggaggggtagaatcaccacgaagacacagcgacaaagcaaacagaggcaaatacgacagacgacggccgccaacacagagagagaaccaaagcacatccagcagaagaaccaaacaacacacgactggagctatagcaccccgatcagagactatattatcatcgtacggagacgacctaaagacagcagaacagacggagnagna

SEQ ID NO: 695310 - DNA, 428 bp, Homo sapiens
ggaacgtaccaagggttctggccattgatgactacaatcccaattctcccagccctccagcttcagaaatggtgtcacaaggcgtggagctgatggacaatgctacccaagccagaaagcaggtcagtgtgagtgtatctgggagcggaactccagtttgtccacggccgaaacctctgaaagaaggctcttcttcatatccaggactatagagtcgtgaagatttatcaggtggtgaaatcattcagactagagcattcccagagttaacgccattttgacgcatggatcatcagatattcatacccacatagattaacctcgcccacagattctccaccagagatccacagcacggatgtaaccctggaatccgggggaccgcaatcttcgttgtcatgtagtcaaagaatcctaatgatactgtg

SEQ ID NO: 695311 - DNA, 1289 bp, Homo sapiens
cagccctgcagcttacttggtgggaagcgcagctcgaaaagcgatgcctgattctggtttcctgggtgctgctgtgcccacttcgtgtgtgacccagctgctgagtgctgtgctgtgctgtgctgatgtgcccaatgaaataatgaagcgtgggactggctgtgctgtgcattgcatcatgtgacgcctgctgtgtgtgcttgtgatggtatgaccatgttccttggacagactgtgctggctacatgtgatgctgcacggacgctgtgtggctctgtttgtctttatgtgccctcaacattgaaaccactccttctatctgttgtgaacactatgtgctcccagagtgcacacacacagtgtgccttgcacgcacaatgcaatggcagcacagccgagaaatgtccccaggaagagccaagtgcttccaacgttgccgtttacctcccagatgccagagcacccccgcgtatactagggtggttatttggacgcccgttaccacgttacctcagttccggaacctggaacaatgcagagcatcttcccgccacagcgactgcgttacgcgacatctggcatccccgccgcccgagacgacggcactgctgcattccagctcttccgggtacggcccccagccgccaaggtgtatacagcctccccgacaagagccctgcgacccccccacacgcggacgcactcgcgccctttcccagttactctcgggccctcggcctgtaatccacccgcgcttgggtgctgcgcccaacgtcggccgctctaacattctacggtgaggatcaaacgtgagcacaccgcagcgcccttcttgggtgatgctccccaaccaagtcctgtgcgctacacaatctgctgtgggctgcgtactatgcaatcatgctccttatggggccgcacccgcaccgcccgtggatgcggcggccaacaacaggtctgcgcattctagggctcgacgcccacacatcgattgtaggctcctcgccccacccacaaatgcgagctgtcgcccatccctacctctatggctccgacactatttcaccctccagtattcaacgacagatagatgcactgccacccatcctacatacatatcatacccacacactatctcggggccgacagaagatggccgccacacacacttggtctcgctatggtcccctccactatcatcaccgactacagctacggctcccacttctggctgtgtggagcttcacccccacgacactggattggcaactccacgtgcgccccgttgg

SEQ ID NO: 695312 - DNA, 809 bp, Homo sapiens
gtcgactggcatatacattgtttacatgtgttgcactattaatcttctagtgggcctttaaaaacatgtatgttctacatagtgtgtccaattagtcttctcaggataaatgtcctgcaagtagattcaagtgggtgagaggtatacacattgttaatatcgtacttagtaaattaatcctaaccaaaggagatttgaattatgactctctcatgtatagtacagagttgggaatcgtgttttaaaggctttcccacaaagtttggctaaataaattgaagtttattatatatggatcaacatcgttgttattttttgttaatgtcagaagtttgggaagatagtctgtaatagtggtaatataaagttaagctagaattctcgtctctcgcctttcgttcatggatattgtatgggtcctctattcgtgcctcgcatataacactcatagatgatttatacaggggaatgtgtaggtttcaccgaagaatgcttgttttgaaaagaaataccactattcttgatgtctccaagaaaagagacaattggacattgtaatcgtagtgggctgtgatcattttgcacataggttactcatagagtcttatcttttgtgaacagtattctcagacgctcataacgccgattttattatgtacataaccctctgtaaagttgggataacctataggctactttgttatataggaatcggatttagtgaacttaaattattggcttaaagtcaaactattaagtgtgggcactgtcatggtcttgggaattgggtaccaagaatgcatgtgtgc

SEQ ID NO: 695313 - DNA, 1332 bp, Homo sapiens
agctgatagcaggaacaggatcaagtcttccataccagggcaccaggccaaaaccagactgccactgcccctacttgggccccactgctccccagaaagcagcctgctgtgactcactgggcaatatctttgcgaaaccttctcaagagcctgcattggcgaagaacggagcactgcgcatccctgcactgcgctgggccctggactgccgccagcgcaacagaccaccactccctactacagagcctgcaaacctgggccgcgcacgactcgatcaacccacccactccccctacccatctggcgcttcacatgctgtgagaccaggctgcgcaccctactacacgcaaccactccacgccctcttacaagactgctgcggcactgctcgcgcgctggcgcccccaaagcggcacccacacgcaactctcggcacccccccatctctgcgcacgaaccacgcgtaacccttccccagcaaacaaccccacagcggctctgcactcactctcctgctgcgcccccgcaccaggcccacacctgaaactccgcgcgcacgcccgcgcacgctcacaccccttgcacggcggcccccgaggcgcaacacggcacgcccttgccacctcggcaccgaacacgtgccccttgccgccccgcgccactctggcaccccgcaaacggcccttcccccggaggcgcaacacttgcaccccattggccctctcaacccattacccgccccttcatggccattaccctctactcatgagcccgcatcacaacacccccaacaagaacaccccacggctggccaaccttcctttggtagcccacccatataaaacacttgtgacccctaccaaccttgcaagaaaactcgcagcccattggacgccggttggcgcaaggcgcaaactttaccgaaccgccgatcgccaaccgccaccacagtcgcccccgtgggcagaccggcacccccccgctttctgcccccccgacaccactttcacaccccccaccccaccatatactatcacgcgcgcacatctcccacaacagccacacgaggcacaccccaacacaacccccgacatggtgcgccacattaaaacccaaagcatcaccacccccacaacccgacggcgcccccccccaaaaacccacccccattcgcggcacttcgcccccccaacaacccccacaagaccacccccgacgacccaccggcacaacccctgccggcgtgcaccccctttggcgctccgacccacgcccaatcacacctccgggcacccccactcgccgccacccacccctggcaccgccccccta

SEQ ID NO: 695314 - DNA, 657 bp, Homo sapiens
gctctgatcactttcactttacaagcttatgtatccgtctgcttatcacctctgcattactttaaattacttttgaatctatatgaaataatttgttgcagactatcgtggtgcagctgttaagtgtaaaccctgagagtaataacagctactcgatgtatctagcctggacatacctttgtctgccatgaaaatattatcatttcgtacagcatgaaactcgtatttaatcaggctttctatcctaagccatcttgcagacgctatctatcagttagaattgtctaatcactgctatattaatccaggtgttctagcctctacaacctacttcagttccaattgtctaattacagcaatagtttaatacaaaaaaacagctgcaacttgtcaaggatggaaaatgtgtgactcttgtgtagaactaattgtttaccaacttgacattttcctacagataaatgtgaaattttgagtaagaagtctacgcaatgatcaagtatggtacatcaaattttattaagaatagttgagtataaagtactttaattctaaagttataagagaaatatacatttgcacttattaatatagaaattcatattgtgtatattaacatagctttaaactatacggctagtactaatatgtctgtcg

SEQ ID NO: 695315 - DNA, 899 bp, Homo sapiens
cttctgaagaggcccacggcccttagtgcctgccatctgaggccgctctgtcctatggagtgtcgccctacaccagtgacgggccaacacaagtatctatgtgctggaatacaatgattgcatccttgattagattcgaccagaagaattgtcctgcttgcgaacttcagcaaatgtcttctaggctcggtagatgcacattaatggtagcacgaccagtctaatagcaagtgcggcgatacagttatgtaggtgattcagcgaggacgccagcctcgagtcgagcgagcagccactctcccagcaatgacatgaagaccgctgatgagctttcatcaccatatgatcaccagcttacctgagacccggttcacacgtggaccagcttctggactacttctatagcggcaaggtggtgatctccgatgcaaacactgtgagaggacgcctgcttcgtgtgggctccatgtaatttcgaacctactagccacgccttcgagttcactgtacacgatcttccttattaatgtccatctgccgtgccaactgcttgcgctacctcttcttggctagagctgttatgagcctcaaagaggtatcacgacgtagcttactctggcattcgggacaacttccactactgggccagtcctgagggctccatgcacttcatgcgctgtccacctgttatctttggccgcatgatccgtgatgaaaaccttcacgtgctcaatgaagaccaggcgctacagcggcactcatcacttgggtggtacttccggacggcgcgatcggccagcacgtattcaggacagttcttccaatacatcaatctcaatgctgtctcaataagacgctggtgtttgcccagcaacaactggtgggcatggagaacacct

SEQ ID NO: 695316 - DNA, 112 bp, Homo sapiens
aaccggctcctttgatctcacagcactttctctattccttgtatgtctctctttcccacgtgtgtctatcagacattcccgtgtctctcctctttgtccttgagttcctgac

SEQ ID NO: 695317 - DNA, 288 bp, Homo sapiens
  misc_feature (8)..(8): n is a, c, g, or t
  misc_feature (36)..(36): n is a, c, g, or t
  misc_feature (45)..(45): n is a, c, g, or t
  misc_feature (66)..(66): n is a, c, g, or t
  misc_feature (80)..(80): n is a, c, g, or t
  misc_feature (110)..(110): n is a, c, g, or t
  misc_feature (115)..(115): n is a, c, g, or t
  misc_feature (208)..(208): n is a, c, g, or t
  misc_feature (268)..(268): n is a, c, g, or t
  misc_feature (279)..(279): n is a, c, g, or t
aaaccccnacttccttgcccaaggtggcgctggggnactttgtanaaatccttgtaaataccccanaccctcccctctgnaaaggtctcttgatggagtgccgctgatcnctacnggtttttaagttattacaccccgaccctcctcctgtcagccccctcacctgcagcctgttgcccaataaatttaggagagtccccccctcccnaatgctgaccctaggattttccttcctttgccctcacctgcaaatgagttaaagaagagncgtgggaatcnaaaaaaaaa

SEQ ID NO: 695318 - DNA, 189 bp, Homo sapiens
ccccactggaggggcccagggtgcagggggtcctcccccagtccccctgttttctgggcatttgtgaaccccttccccccccccccgtttcctgtttccctcggtgggttatcttttaacccccctgtgtgggtcctttttaaccccccggccctgctccgtttttttttataaaaggatttttgggga

SEQ ID NO: 695319 - DNA, 101 bp, Homo sapiens
cgctcgatcgtcgcttcgaaatcctagcggctgatttccagtgtcgtggcctgcaccttgattcgccaccaccagcacctggctgtgcggcgcgttggact

SEQ ID NO: 695320 - DNA, 264 bp, Homo sapiens
aggcggacgacagacgtcacaaggtagacacgatttacctcgtttgcgttcaaggccgaggccgaggccggttatcgagctgccctcggagaaggagtgatccgggtattcgggcgaggacgccgacaatttagttagctagctcggtaaggatgcgttccagcacaacagcgtgattgacctcgcgatcaccagcaccatagagcaaaatcacctcatcgcgcccggcacattcctccaggaatgtcttcgcggcaccggact

SEQ ID NO: 695321 - DNA, 117 bp, Homo sapiens
gatcgatcgagctggtacctactttccacagtgtgtctaatatggtttccaaaactttttacaaatgtcaaactcaccgtcaacctgaaaccacctggaaaaaaaaaataactgaca

SEQ ID NO: 695322 - DNA, 256 bp, Homo sapiens
  misc_feature (24)..(24): n is a, c, g, or t
caaggaggaagaggaggaggcagngagcagcgaacctgcagttggcatcacaaggcatcgcacagggggccaggcacagcggctcacgcctgcactcccagctactcaggaggctgacgcaggaggatacctggagcccagcagttcgagatgagcttgggcaatatggcaagactggctctacaaaaagttttaaaaaatagctgggtgcagtggcatgtgcctatagtcccagttattcaggaggctgaggtgg

SEQ ID NO: 695323 - DNA, 126 bp, Homo sapiens
cacgaggctggccgcactctgcgccaggcacaaggtggacctcgtcagcgtcggcaacggcactggcagccgcgagaccgacaagctcgttgccgagctgatcgccaagaggccgcagctcacgct

SEQ ID NO: 695324 - DNA, 239 bp, Homo sapiens
gtacggtaggcggcgatggacagggcagaaaccttccaggtgtaggcgcctgtgtgtgggggaacagttcatacatcagctcgatggagtggtcgaggatttgcgcatactagttgggtcaggcccatgacgccggagtttgagggtcatcatgtcatcgtcggccacgccccatgttcagcaggcgctggcgaaggggggtgtagagggatgcttacgtgattgtcgccgaacttggt

SEQ ID NO: 695325 - DNA, 529 bp, Homo sapiens
tagtgactagcgttacagaaggatggagactgcaagcctatgcctggcaggcgtaagctatgagataggagctgaggacgaccagccccatcacgggagtcctcttatccctgagcggtggcctgtctcgttccatctcgtcttgacccaggagaacggcatactgaccattctcaaacctgagcgctggccagatattacttcaaagccatgatgaaggagttccggtgcgagccatcctcacagatgatcgaggtgcaggaaggccagaacctgaagaacaccatcacggggtaccgaaccgcttacagttgctatgggacagtgtctaccttaaacggcgagcccgaacaaggggttgccatggaagcggtgggcctgaacgactgcaggatatccggagaagagaccgtgacagacgaagagggcacgttccgatcacgtagatagcggccgggatgtgtgtaccaggtacagctcaaggcagacggcactgcccacattgagcgggtgctccctcagcataggg

SEQ ID NO: 695326 - DNA, 425 bp, Homo sapiens
  misc_feature (319)..(319): n is a, c, g, or t
gaagagaaggcaaagaaaggcctcatgttgcctccacccccagcacttgaggatgacatggagttccaactggacgggtccctcatctcacggcgggcagtttatgtgttacctggacacaaacaaaaacaaaaccagggccggcccttccgcccccgacctgaacacgccggcctaaggtttcaaactggttggacttgtttgtttggacgacactggaatggaacactgcctccccctttttttggacttggaaggaggtggaacagcacactggacttcttcccgtctctaggggtgcatggggaacccggggaanttaataatggggatccaaaaaggacccccgcccccaaaaaattggttttgggtccaacctttccctgggcccgtgacactcaggagttaataaaagccttggagga

SEQ ID NO: 695327 - DNA, 1088 bp, Homo sapiens
  misc_feature (180)..(180): n is a, c, g, or t
  misc_feature (187)..(187): n is a, c, g, or t
  misc_feature (315)..(315): n is a, c, g, or t
  misc_feature (389)..(389): n is a, c, g, or t
  misc_feature (394)..(394): n is a, c, g, or t
  misc_feature (405)..(405): n is a, c, g, or t
  misc_feature (409)..(410): n is a, c, g, or t
  misc_feature (419)..(419): n is a, c, g, or t
  misc_feature (421)..(421): n is a, c, g, or t
  misc_feature (423)..(423): n is a, c, g, or t
  misc_feature (432)..(432): n is a, c, g, or t
  misc_feature (450)..(450): n is a, c, g, or t
  misc_feature (452)..(453): n is a, c, g, or t
  misc_feature (459)..(459): n is a, c, g, or t
  misc_feature (484)..(484): n is a, c, g, or t
  misc_feature (491)..(491): n is a, c, g, or t
  misc_feature (523)..(523): n is a, c, g, or t
agtccaagcaggagcacaaggatgtgatgtgaggcaggacccacctggtggcctctgccgcgtctcatgaggggcccgagcagaagcaggatagtgctccgcctctgctggcacatttccccagacctgagctccccaccagcccaggtgctcccctccctcctctgtccctaggtcagnttgctgncctaggctccgtcagtatcaggcctgccagacggcgacccacccagcagccagcaactccaagtaacaagaaagctcacccccaaggggcagtctggaggggcatggccagcagcttgcgttacgaantgaggaggacggagagaaggggaggagggcgggggggcacctactacatcgccctccacatccctgattcctgntgtantggaaactgtngccnnagactggangntnctctcggantatctgggaactgtgccntnngagttncctcaggctgctggaggaaaactgngactcanacaggaaagggaaggcccaaagacaaggtagncctggccagaggctggtaaagtcttaaggtctatatgagagtgggatatccctatgctgcctagtgcttgacctttgaactcctgggctcaagcagactaccccaacatcagaactacatggagtaagctggagatacatagaatcggaagcaaccaagcccaggacagacggggacgacccactagaataggacctggaccaagactaagaagagagagagagacatactggccaaccgggaccagaacacctgagcaaaaccagacacgacactccagacccgctggacaccagcggtatcagaccacctggagctgcaagacagcgactgcaccagaggcagaagcgtggggccccatggccccaatacccacccacagggcgaacacgacggacaccacacggcaaaaaaacccactcgcacaacccaccagtaccccgacctgcacaacagacaccaaacaaagcgcaccacaacaacaactacaacaagacccgaacaacgacgagacagcaccaagagagaaagcaacacaccgcctcccaaaccacccgcagcaagc

SEQ ID NO: 695328 - DNA, 221 bp, Homo sapiens
tcacaggatcttatgtcgacttctgctctcagctcttacttaatctgcttcagaggatgctctggcgtctccccttggctcagccatggtatccacgaagagcatgcaacaacgatacaattccctccaaccccggggaaagagagcagcagtacctgtgcagggaggagacacttcagaagctgcttcagccctccagaaatcagagcagaaggtcgacg

SEQ ID NO: 695329 - DNA, 896 bp, Homo sapiens
gttctacaccattcgtaaggtgcgcgtacccagtagcgtaagtgaacctggtcatagctgtatccttaggaaatcctggtcttgactatagcttggctactcacgcattaaaaaatgcccggtggtaatcgagtcgtcttgaacaactccagatggagtcccgacggtcactaactgtggtctatcatagaggagtctcaagctgatgctcgactagtcaaattacgcgtggaccctagacctgataggtctcaatctccgataacatatggcctagactacgtacataacctaaacctactccaatgctagaactaatcgtcccaacaattatattactaccatgacatgatttccaaaaaacacataattggaatcaacacaaccacccacagcctaattattagcatcatccccctactatttttgtaaccaaatcaacaacaacctatttagctgtgccccaatctttcctccgacccctaacaacccctcctaatactaatactgactcctacccgtcacaatcatggcagccacgcattatccagtgaaccactatccgaaaaaatctactctctatactaatctccctagaatttcctaattatacatacgagcatgaataatgatattttatatcttcctcgaacaattatcccactgggataataccggtggggagcagaagaagctgggcagcatatgctattaaagctaatagactccctacactcgtaatagagacaagctaggtataaagtctatctcttatggcagaatttactgagaactaatatccaaacttctagaaccctcgctctctcaaggaccagagaatgcctgaaagggacggttctccgactatatcaatcaaatacctcatacacccacat

SEQ ID NO: 695330 - DNA, 894 bp, Homo sapiens
ggggggttgattccaggaccccctcaggtaccaaaatccccaggtgctgaagtctcctgtgataaaatggcatagtatttgcagtataacctacatatgtcttcccatatatttgaatatgatctcttgattacttgtagtaactaatacagtgtaaatagttgttatactgtattgtttaggaggacataatgagcggagaaaaaaatacagtgtgtacatattcagtgacacgacacagttcattgcattttatttatctccgtgtaattatctttcgaacccaccaaatggagaaacccatggactacgcagtgctgactgatgtatgaacgtattctagatccaagggtttaacgaggaatgtgaaagtcactgatatacggcggaaacaaaataaaacagtatatttgtgctttagtgaagaattatcagttatatgcagaatagaattgaggatgattataacaatgataggagtgactataggaaagataggagtaaggtatattgggctgcgtgtgggttgaggactgaggaagaattgagtggacaggtctccaggctttcggtgcttggacgagagtagatgcgactgtttattaatccatattagagatagcttggaggtattgaaaaacagtgattagctggtaaagatacaaagattctcagaaatcatgtatcccccggattctattactgaaatcgaacgtaatgttgtgctccagaaaaacaccatcttcctcacagtgggtaatgctgacttggcacaacaaattaaagtacacagagttctactttaaaccattcctcttcggaaacttaattcctgtgtcacccagctttatggaagtcgtatttggtgggcccaaccgtaagcttactccgaac

SEQ ID NO: 695331 - DNA, 298 bp, Homo sapiens
gtggtgtacaaacccaacatttctaggaactcatgggaatgattttatgcaactttcgtatactacacaagacgagacaacacatattagggacaaaccttacataggtaatgcgtgtggcaaagccttcagagtgtcttcaagtcttattaatcgtcagctgctacataatacagagaaaccttacagatgcaatgagtctggtaaagcctttcatcggggctcactactacatttttatcagatagtccatacaagagggacaccataccactgtgatgcatgtggcaggatctta

SEQ ID NO: 695332 - DNA, 956 bp, Homo sapiens
  misc_feature (298)..(298): n is a, c, g, or t
  misc_feature (343)..(343): n is a, c, g, or t
cggcacgctgtgggtcgcccacgcgctcggttcagcctgcacgtggcctgagtgataggagtcgaggctgtgttggctggatccgtcctactgggcaagatggcgccccacttggagggctgtggtctgttacaggggtgtgcaggagcgcaagagaatgaagggaccatggggacttgggccacgtcatgttgcgaggattggggcctgcgctgttcaataagccaaggaccgtccctttccttgttgcttcaatatggtccgaaagctgttcacgtctgtgctcaagtccactctnagttttcaaagttcgaaagtgtaaaaagtccgccatagagatgtncacatggaaatacaaaagagataaactacaagaatagaaaacaaaactaaatagtacaacagagagatagaataaaagaaagagaacacagacagagaataacaaagagaaaaaaatagaactgggggtcgtcacggtacaagaatccatcaattgtctcgcacataccgcgcggtaaagcgcaagtatggacacatataaacagtagccacgaactacgagtggcaatgtctatccaacatgagttcgaaagatgtccaggattaacgtggcgcgcggttcgccaagattacccaaacagcaccagcacacggacttcgtccagcgcccgaagttgtacaacagaaatcaatcaaatacgaaacggagaattccttatggaaagatccgaaacacgcaaccaaaaatgggggggaacgacacagttgtccagaccgtgcagtaacactaaagctaaccgtgccacttaaccacccttccagcacgtcgtcgtgcgttccaggctaaaaccacggaaggaagcaacaataatacccattgaaacagcagccgacgcaacactaccgacaaggtatctcccgcccaatagtgggacatacatttgacacctgct

SEQ ID NO: 695333 - DNA, 1040 bp, Homo sapiens
  misc_feature (328)..(328): n is a, c, g, or t
  misc_feature (699)..(699): n is a, c, g, or t
  misc_feature (782)..(782): n is a, c, g, or t
cgaagagtgacatcagacgatgaacatatagaatataagtactacatataaacaagataaaaactttatgagaagagtcaagagctcaatgagagaagatatagagggtcgttgggatgttactatgacagaagagcacatcgcagctccatcgttgtaacatagaaacaagacgtgaagtacgcaagtattgacaattaggtcgaaagagataatacatgaaagatttcgttagacgattatatgagcttacaggaagttaataatagacaggtagtagcgtatacgagacatgaggagaggaaaatgagcagtaggtgagagtcanatcgttagtaggcgaacatgccgtcccacctgtagtacaggtgacatctaagaggcaagaacacgattagatatttatatcaagtgaatgcaactctaaataagtgttcagtgtagtaaagcctcaagccgcaggatcatcagcttcctgcaaatcatcatcagctggccagtggtcatgctgtatccagcacttgagatccaggcgaggcagatcacttgaggtcaggagttcgagactagattgccaacgatgcagaagcaccatctatactaaaactactaatattagccgagtgtggtggagcacacctgataatcccctctacttgagaggctgagccagaagaatcacttaacgccgggaggtgnaggttgcactggaccgagatagtgccactgtactccagcctgggtgacaggtatgttttgagacggagtcttgctctgtcgcncaggctggcacaatctcagctgactacaacctctgcctccaggttcaaacaattctgcctcagcctcccaagtagaggggattacaggcatgcaccaccacgcccggctaatttttgtatttttagtagacacagggtttcaccatgttgcccagtctggtgtcgaactcctgacctcaaatgatccacaaagtgctgggattacaggtatgagccatcacgactagtcctcgtgccgaatcctgcagcccggaggat

SEQ ID NO: 695334 - DNA, 221 bp, Homo sapiens
tagtttcacaggactgcccgcacaatactgtcctaaagacgatgctgcctgtacagtgccagcaccagagctcacacacactgtcaagggtgcctaaagcactagcccaccctactcaccatatgccaatgcacaagtacacttgccaatgcccatgtacattgccaatgcccaatgtggactgatgaacccaccacattgtctccgtgtcaccatagctc

SEQ ID NO: 695335 - DNA, 224 bp, Homo sapiens
ggtggataaaactttccccccgtgtccccctagcaaagggggggggcccgttcatttgttgttgtttttttttcctttgcccccccccgttttatttttgggcaaccagtttggattcaagtttttggatttgtttgttttgggccctggggattgtgagggttccctcccagccagcccgccccccaaaaaaaggggtcccccaataaacccgtcccctgcta

SEQ ID NO: 695336 - DNA, 347 bp, Homo sapiens
aagggtacaagaggactagaaatgaagctacccaggctgactgtcttcaggtaaagattaaaggagcttagacactaccataagtcatttaaataattgcacaagaagtaattattaaatacattttatttgattaataaatatgtacagatatataaaattggtgcatgcttaattcttcaaaccagtcttttagactatgcattaatgggatgctcatagctagtctttaagaataaagccggtagaatccatggtcataatcctgtctggtctgccaaagacctgggtaaccccagtaacactgacaacacagccagggaagaagtggactgacacttgcctac

SEQ ID NO: 695337 - DNA, 265 bp, Homo sapiens
taacatccggtgctgacattataccgctgacgggacagaaacaatcgagggatgctacagtgctcagagagcgtgccgccggcgcgctacactacagacgtcaacgcaccgtaacatgtcgcgtggcgtttcctatcccttcagtcaaaaccactatttcctatagttctatcaaagtacgtaagtgaggcatacaatagaatcaggaactcggggctaaatcatcccaacctggagccaaggctctaactagaaactgtctctg

SEQ ID NO: 695338 - DNA, 85 bp, Homo sapiens
gagcacagcggcagcactgccttgcaccctccagccctcagaagttgcgtaggagacacagcgcctccactgaggcacctctctg

SEQ ID NO: 695339 - DNA, 162 bp, Homo sapiens
ggatcccctaggtggtaagaatgactagcgagtgtgtatagggacctcttgtgtcatgtgtgtgggagtgagtctgcagtaataatgagcatggtcatgatgttcagtttgcatgacaacagagtcatgtctgctgccgtgctgggtgtccctactggggtg

SEQ ID NO: 695340 - DNA, 162 bp, Homo sapiens
ccgtgacagtagatggaagaggtatgtatagacataaagatgaacagaactgattaagaggtgaaaaaattttaaacatttacaatttagaaagacttacaattaaacaaaattattaacgtaaaaggggaaacggtgttgctagaagtcagtctccagggt

SEQ ID NO: 695341 - DNA, 1369 bp, Homo sapiens
cgtattttcgtccgatggcttttgtgatgaatatcttctagctttggaatgtttctccaaaggtgccgtgtcgctttctctttccaggttcgttctaactgtcacacttgaagatgttgggttccgttagcggtctttgaagtaatcttttgccctgttgggaataggccatgaatatcctgtgggagtgtatcccaggggaaaacttcactaactcttcttattcaaacaggtagtatattttgaaagttatcaccgtttttttatgcccttgccaataagtcgtgagacccccctatgccccatatggttcttttgttaagatgcaaaatgggccgtgttttaatagttgccgtggtaaaaaggaataggaaacatctgtgggaaggcatgcctatgttgtggtagccccaaatttaatgttcaaattcgttgtgtcctaacttccacataaccacaaaacctggggggaagtggttttgcttttttccaaaattttatatcctttcgtatacaaacgttgcggcgtgctcaatccaacgctcatagggtatgttggttcttataggttatagtcgtgtgcgtggccaacaaaggaagggaatcttctatgcgcagtcgtccttttgccttttactgggttttttgggggaacccacgtagagtaggaccaaacgttgttcatccttcgtgtcttgtagtgtataaactttgggccgggtggggagatcccccaatattgggggactatgtagtacctctgtcctaaagaaatagatttttcaagggggcttccatccactctccaagcgttcgcttttcgctcccgagagagaatattactctctctctcgtagttcgttcctgcgcctcacgctggcgcagagagcccctgtgggtgagcgtgcgcgcaagccttttggccgtggatgctccagtgaggacggttaggtatgagcgcggactggactcgtgagggagattggtggacgttgtgcctacgcgatacgagcagcaacggcagcaactggaccactgggcgccaaagttccaccttcgctggacattggtcccttccacttccacacgcctgctccatcagggctgagagatgctggttatgcataacccgcagcactgttgaatgtattgtatggtataggagtcgagtattgctcatatagtgtgttgttgtggtgtttctcattttaatctgtatatggtgttgcgtgcactctcttgaggtagagaacagaaatctcttttgttagagatagggaccacatcgggctcgcggcttcttagtcttggttgatataataatagcacaggcccactcctcataggagtattagcatgcaggggatta

SEQ ID NO: 695342 - DNA, 120 bp, Homo sapiens
atagctaaaaggttttgtgatcctgctgtaaacatggagggaagccagcatggcggcacaagcacacagtaccacgcagcaaacagggctaagacaaaataatagaccccaccgcaagtc

SEQ ID NO: 695343 - DNA, 367 bp, Homo sapiens
gtgtgtgtgtgtgtatttcaatagctttttgggttcgagcgtttttttgtaacatggatgaattctatagtggtgaatcctgagattttagtgcatctgtaagctgagtagtgtacattatacccaatacgtagtttttttaccttcacgcccctcatatcaccttcttccatctgagtctccaaagtcttttataccactctgtatgtctttgcatcctcatagcttagctcccacttataagtgagaacatatggaaatcaaaagggaaggaaagctgatggaattttgttatcagcttctcccctgggggaagggtggtccctgagaagcttcagggaggtgacagccggagaggcaggaagct

SEQ ID NO: 695344 - DNA, 945 bp, Homo sapiens
ggcggaagcacggtccgcccggagcacgagagcctcgcctttgccgatccgccgcccgtccaacccgccgcagtcaccatggatgatgatatcgccgcgctcgtcgtcgacaaaggttccggcatgtgcaaggccggcttcggcgcgcagcacgaatgccccccgggccgtctagcccctccatcgtgggggcagacaccaggcaacacagggagttgatggcgtcgggcactggggtcacacacagatccctatgtggagccgacggaggccaagagacaagagaggacatcctccaccccactgaaagtacccccacatcgacgccaacggtgacaatccgttataaaccgaaaacggggggcacgcaccattgcgcagcaacaactccgtgggacaagcaaccaaccttaaccgtaacaaagtgagcgatggcagatgatggacatcccgaaggaagacaccaccgtggcatggaatgaaccaggagggacaacacccatgaaagcccccaaagggtccaacaccgagaagacagaactgaccaccaacaatacaaagtgatacatagaaagacccgtttaaacagcagaaccccaagccaattgtaacacggttagggcttactctcccaaagggctatgcttggactaatacccccgtttgagtacacggccaatcctgggagccccgaggaacccaaacttggagcacattctgatgcaataggacatcccaggatagagaagacgggatccacaccaagacagaagtggtatgcccacaagttacaaaccgaagggagagaaatcgaccacacccccacaatttgcacacaccacatagggcgtatagtgagaccgcctaagggatgagcagatggagacccatggaattagcatgataaactgcaatgtgaaaagacattccgaaacaagagaccgg

SEQ ID NO: 695345 - DNA, 210 bp, Homo sapiens
gatcatagaggacccgtgccccctgggaattggcagagagagaggtcttgaggacattcattaaactgtcctggttatccctggactgcggcatttggggtgatgtcacgtttatattacaaaagcaattagctacttttgaataaaggggggaaagggaacattgaagatgtacccaagttctgagtcagagatctgactttcaaatcc

SEQ ID NO: 695346 - DNA, 177 bp, Homo sapiens
gtcgactctagtagtatcccctgtgacagcatcgcatcagtgcagatacgatagaagaaaaatggtcccatattatgatatattcatgcccgtcactaaagcatatgttgagcttgcggttcagaaggaactcaagcttctgagaggaaaaactatcgagtgcattagccaaattgg

SEQ ID NO: 695347 - DNA, 449 bp, Homo sapiens
  misc_feature (148)..(148): n is a, c, g, or t
  misc_feature (249)..(249): n is a, c, g, or t
  misc_feature (262)..(262): n is a, c, g, or t
  misc_feature (264)..(265): n is a, c, g, or t
  misc_feature (273)..(273): n is a, c, g, or t
  misc_feature (309)..(309): n is a, c, g, or t
  misc_feature (312)..(312): n is a, c, g, or t
  misc_feature (320)..(320): n is a, c, g, or t
  misc_feature (348)..(348): n is a, c, g, or t
  misc_feature (350)..(350): n is a, c, g, or t
  misc_feature (352)..(352): n is a, c, g, or t
  misc_feature (355)..(355): n is a, c, g, or t
  misc_feature (359)..(359): n is a, c, g, or t
  misc_feature (372)..(372): n is a, c, g, or t
  misc_feature (374)..(374): n is a, c, g, or t
  misc_feature (376)..(376): n is a, c, g, or t
  misc_feature (381)..(381): n is a, c, g, or t
  misc_feature (383)..(383): n is a, c, g, or t
  misc_feature (417)..(417): n is a, c, g, or t
  misc_feature (420)..(420): n is a, c, g, or t
ggccccctttcattcacaaagtgccccctccatgtccctggacccttaaaatatccccttggcaccctggtcaaaaactttgtgtttgactcaggtggtccctgcaaagtgccctgggaaggaaaggagccctgatttgggggttttnagggtcaagtaggggttggtaacccctggaaaaaaggactctttcccttcgatccctggccaattatggaggattcggaggtaaaaaaggggaaggaaaanggtttttttttcntnncccccccnccctgtgaaagggaatgggggaagccttatgccccncanctgttccnatttagtatttttttttttttttaaaantncngtntttnttatgacgatggngncnccccngngcaaaggggggccaaattttgtgtgtttttttanccnctttgtaaataaatgcccagtgtaacata

SEQ ID NO: 695348 - DNA, 105 bp, Homo sapiens
  misc_feature (5)..(5): n is a, c, g, or t
agtanagatgcagattgagaacctcaaggaggagctggcctacctgacacgaagaaccatgaggcaggagatgaacgccctgtgaggccaggtgagtggtgagat

SEQ ID NO: 695349 - DNA, 304 bp, Homo sapiens
cctgaacgcagcctgctgaggtggaggccgcagtgagcccagattgtgccactgtgctccagcctgggtgatagagccaaacccgtctccaaagaaaaaaaaaaaaccccaccccccaaaacccggtcggccccggggcttcacccctgtaacccaaacatttggggggcccaggggggccagtttgtttgaccccgggatttcaagaccagccgggcagtgggatccattactgtctttaaaaaaaatccaaaaatttggttggccggggggacatgcccttggggccccagttctttgaagg

SEQ ID NO: 695350 - DNA, 572 bp, Homo sapiens
  misc_feature (72)..(72): n is a, c, g, or t
caaggagaagccttgcgggtgatggacatgctgcactctatgggccccgacaccgtggtcatcacaagctcngacctgccctccccgcagggcagcaactacctgattgtgttggggagtcaaaggaggaggaatcccgctggctccgtggtgatggaacgcatccggatggacattcgcaaagtggaccccgtctttgtgggcactggggacctgttttttcccatgctcctggggtggacacacaagcaccccaataacctcaaggtggcctgtgaaaagaccgtgtttaccttgccccacgttttgcaaaggaccatccagtgtgcaaaagcccaggccggggaaggagtgaggcccagccccatgcagctggagctgcggatggtgcaaagcaaaagggacatcgaggacccaaagattgttgtccaggccccggtgctgtgagggcccccccgctcgcccgtgacacccagggggttggtgtttccgtgtttgtccctgtgaaaacatgtaacgtttgccttaaagccatgcccgaaacttgatattttttttttaaaaaaaaaaaa

SEQ ID NO: 695351 - DNA, 533 bp, Homo sapiens
gggactagatttctgttggtgattgaaattttcagtagactccattcaaagtgatctctagtcccgtgtgtctcatccacgttcctggaggaccaccgacactacatgttttggatgtcttttatgtcactcttattacaggtctttcagtctctgctaataagatgatgatctgaatcaggtgtgtttggttaagaccacctccaggatcatagttgagaaacactgctctagtcaatattggcactgtatttggcactggacgctgtctttcattttatgactgcagtgttgatgtctttaaatgtaaaagatgagataataaaatgatatagtatgttttcaaacaagtctaaagcaaaaaaaaaaaagaccaaataagtttgcactatcaacattttcttttttagacaggaatacgttgtgtgcacattgttgatggactcctatcaatgttttcaaaagcaaaaagattaaagctttcaactttgtctacatatttctaataaactgcccattgcttaaaaaaaaaa

SEQ ID NO: 695352 - DNA, 164 bp, Homo sapiens
cgcaaatatccagtgacaccactatcacgaaaaaacactctacctctctatataaatctccctaaagatctctttattaatcacattcaccagccaacagaactcatcataattaatatatcttcgtgcgaacaccacatttatcccccagcttgggtatcatc

SEQ ID NO: 695353 - DNA, 309 bp, Homo sapiens
gtatctatgacaatagcaccaagaatgtcattgattcatgaaacaatggattatatacaaattgacgatacatctataaaagaagggtcagaccagagcatgccatacctcatccccttatatgccactatccaatattcatcttcttttgtatcataaatgaaactacagactggtaaacgacaatagaatctgcctcatcaccccacccaaaattacttcgattatttactgtctgtagtcatccttcaaagaaaagtcttgcccggggttctttcaatttcatttatttatggagtttattggcat

SEQ ID NO: 695354 - DNA, 362 bp, Homo sapiens
  misc_feature (193)..(193): n is a, c, g, or t
  misc_feature (211)..(211): n is a, c, g, or t
  misc_feature (219)..(219): n is a, c, g, or t
  misc_feature (257)..(257): n is a, c, g, or t
  misc_feature (285)..(285): n is a, c, g, or t
  misc_feature (303)..(303): n is a, c, g, or t
atagcatttaaaagaatatacatagtgggtagatcaatgggctacaggcaaggccttttgggaaaatagtaaacaggttccaagtgtttctatgtcctgccagtgccacccaccaagacaggagggcacacagggcacttggaacagacaaaagataacacctcgtgcatttcacttagtacatatctctcangcatcagcgcttctccangacttcanacttgcatagactgtgggaagaaacaccggcgactgangaagaaaaagggggcctccttatgccangaaagaggccatgcatcnctgaagccgctactgatttgtagccctggctttctgctatggaaacttctaaaactaag

SEQ ID NO: 695355 - DNA, 126 bp, Homo sapiens
atcggcccacctcagactactgaatcagaatctctgggggtaggcacagcattctgatttaccagaccctccaagtgatttggagtgtattctaattttagagaccatctctagaaaggaatgctg

SEQ ID NO: 695356 - DNA, 255 bp, Homo sapiens
ctgaatgcctacaaacgcggcacggcgcctgcacatcgctttgagggtttggacctgacccaggcgcgcaacaaccctgaattgctgggcatcgccatgacgcctgacaacctgcaaatcgacaaggaggtacttgagtacgcgcagcacgggtgttcgccgatcgacagtgcgcatggctttcacagccgttggctacgccggttcgccctgaaggggtatctgggcaacgcgatgaaccgacacacgctgaat

SEQ ID NO: 695357 - DNA, 690 bp, Homo sapiens
agcgggggccgggggctgcgcgctctgtgagctgggtgtccaggctgcgggcgctgctgggcctcgggctgctggtcgcgggctcgcgcggtgccgcggagtcacaaggccagaccagtcgccctggtcagcatcgcggacccacactaggtgggcgaccgcaggcggctgaatctcgggtggctctgctgggactcagagtgtcatggtggatgcactggtgtgtgaagttaccgtgatgcctaggcagagaggccctagggcgccgttggaaccagggaggcgtactttacacagatattagccacgtttcaagcgatgtgagccatacattattggaacttggtgccggcgcgtgagactagtgcttacaggcctagtcgccaacggtcgagtgtgcacaactctcgaccgtttgggagcagccagggcaggagtcaatgtcccagccccctggcctaggcacaaaggggtgggagagacagctgggccaatatggtctattaccgcctgaaaccccgacgaaccacccttgactctgccttcaggcaatatcccgcccacgtccatgtccaggggcccccctactgtcctggtcatctgtggcccggggaataatggaggagatggtctggtctgtgctcgacacctcaaaactctttggctacgagccaaccatctattacccca

SEQ ID NO: 695358 - DNA, 145 bp, Homo sapiens
cgaaggcagatgaagaaagcataggaaagtgctctacctgaatcccgtgcgtagaacatgaacatgctagacatggttccattgcctctaaaacagttgaccacatactgacaggcatatctcatcacagctcattgagtaccgt

SEQ ID NO: 695359 - DNA, 546 bp, Homo sapiens
  misc_feature (18)..(18): n is a, c, g, or t
  misc_feature (83)..(83): n is a, c, g, or t
  misc_feature (93)..(93): n is a, c, g, or t
  misc_feature (100)..(100): n is a, c, g, or t
  misc_feature (102)..(102): n is a, c, g, or t
  misc_feature (116)..(116): n is a, c, g, or t
  misc_feature (121)..(121): n is a, c, g, or t
  misc_feature (132)..(132): n is a, c, g, or t
  misc_feature (153)..(153): n is a, c, g, or t
  misc_feature (161)..(161): n is a, c, g, or t
  misc_feature (167)..(167): n is a, c, g, or t
  misc_feature (169)..(169): n is a, c, g, or t
  misc_feature (178)..(178): n is a, c, g, or t
  misc_feature (188)..(188): n is a, c, g, or t
  misc_feature (193)..(193): n is a, c, g, or t
  misc_feature (200)..(200): n is a, c, g, or t
  misc_feature (205)..(205): n is a, c, g, or t
  misc_feature (216)..(216): n is a, c, g, or t
  misc_feature (218)..(218): n is a, c, g, or t
  misc_feature (228)..(228): n is a, c, g, or t
  misc_feature (245)..(245): n is a, c, g, or t
  misc_feature (262)..(262): n is a, c, g, or t
  misc_feature (282)..(283): n is a, c, g, or t
  misc_feature (285)..(285): n is a, c, g, or t
  misc_feature (295)..(295): n is a, c, g, or t
  misc_feature (307)..(307): n is a, c, g, or t
  misc_feature (319)..(320): n is a, c, g, or t
  misc_feature (322)..(322): n is a, c, g, or t
  misc_feature (324)..(324): n is a, c, g, or t
  misc_feature (398)..(399): n is a, c, g, or t
  misc_feature (541)..(541): n is a, c, g, or t
tgggcaggaggccaactntgccactcatgacctccaggcatcgccctggggtcaaggcctcggagatcaggctaatgggcttnagacaaattncagatcntnccttaggcaggtcncttgngggccgaactntgggactggggtgccgagggnaggggttngctttntntttacactngaggcctctnggatngaaaatnttttnttttgcaaagntnaagcagggtncggacgcccacgagacnccagagttcgcccagtntggagacaaggatgcgcagnntntttagccagngacccaaagttngcagcatctctnntntnccgcccatttgtaccagcaccgtctgcacctggctctgcaggccggggtgctgccgctgctcctcctgcatgtnnatgaccagcagcgtgtagcagatggtgagcggtgtccagaaccgcatggcctccgaggtggtcaggaagtcctggttgatgagggccacagctgccaggtcacccacggcaaaggctatggccagggcacggcccagcagcnggggg

SEQ ID NO: 695360 - DNA, 973 bp, Homo sapiens
cgcctcttgggtcgtggtctcttacctctgtggctccctttgtcccgcccgccttgctttccccgcctgtctcgttcctgcttcttgttctgtcttctgttcttccctcggtccttgggacctgtggctcgatgcctctccgtttctcttcagtgctactgcgcggagcccctcatgggcaatggctgactggggccgggtctcgagtgctgtggcacctattgcacttctgcacgccactcttggggcttctgcctgcgccgagatccccttcgcttctggggctgcagacttgcacttcctgaatgcagttttggatgtccatcttgccaggagagagacggtctcgggtccaggggagttggagggctgtctgctccctgccgtgcatggtcttggccgaatggcgccttaccctgctgccctgggcttttggcctgaagcaaattcctgagtgggggcgctatctggggctctgcccgcactcctgtcctggtccactgcccacccccgtgtgctggctccctcacattctggctgcagtgggagtccgccagtctgacccttgtcaccgcacgctctgcccccaccccgttgccaagaggtcacaccatgtcacgcagcccttgcactgacctgcagccaggcccccaggcctctagtagttactggatgcttccgtgcggctccaacaggcatcgtcttcccttccgcaggtggaggggccgcttcccgcaggcatctgagctctgtcgccggggccgtggtccatgggaagatgttccacgctgcctcactccctcgagtggttcctcgggcaacactcttgaatgtctgagcgagggtcctgcttagctctttggcctgtgagatgcatcagtctatctagtagttttgtaagatgaagcaagatgtctgttcagcggtaattggccctcacattaaagcgtcggccggattaccagcgcgatga

SEQ ID NO: 695361 - DNA, 331 bp, Homo sapiens
  misc_feature (21)..(21): n is a, c, g, or t
  misc_feature (99)..(99): n is a, c, g, or t
  misc_feature (115)..(115): n is a, c, g, or t
  misc_feature (119)..(120): n is a, c, g, or t
  misc_feature (131)..(132): n is a, c, g, or t
  misc_feature (151)..(151): n is a, c, g, or t
  misc_feature (163)..(163): n is a, c, g, or t
  misc_feature (170)..(171): n is a, c, g, or t
  misc_feature (174)..(174): n is a, c, g, or t
  misc_feature (177)..(177): n is a, c, g, or t
  misc_feature (179)..(179): n is a, c, g, or t
  misc_feature (182)..(182): n is a, c, g, or t
  misc_feature (189)..(189): n is a, c, g, or t
  misc_feature (196)..(197): n is a, c, g, or t
  misc_feature (200)..(202): n is a, c, g, or t
  misc_feature (204)..(204): n is a, c, g, or t
  misc_feature (213)..(214): n is a, c, g, or t
  misc_feature (221)..(221): n is a, c, g, or t
  misc_feature (228)..(228): n is a, c, g, or t
  misc_feature (244)..(244): n is a, c, g, or t
  misc_feature (248)..(248): n is a, c, g, or t
  misc_feature (253)..(253): n is a, c, g, or t
  misc_feature (267)..(267): n is a, c, g, or t
  misc_feature (269)..(269): n is a, c, g, or t
  misc_feature (274)..(274): n is a, c, g, or t
  misc_feature (280)..(280): n is a, c, g, or t
  misc_feature (283)..(283): n is a, c, g, or t
  misc_feature (286)..(286): n is a, c, g, or t
  misc_feature (290)..(291): n is a, c, g, or t
  misc_feature (293)..(294): n is a, c, g, or t
  misc_feature (297)..(298): n is a, c, g, or t
  misc_feature (304)..(304): n is a, c, g, or t
  misc_feature (315)..(315): n is a, c, g, or t
  misc_feature (328)..(328): n is a, c, g, or t
caggggctgccggtgccaccngggatacagagtccactgtccccaggggtggggcagacggcgcaaaccgtggcccctgccctccccccaggcaggctnccaaatatctccttgncctnncacgtcacccnncccaatccccctggccccnctctcccccccnccccctnncgnccnanagnccccccnccccccnnccnnngnacacctccnngagccgnccacccnaccgtatcccgcggcnccangctgncctcacccatcccncnccccntccccnccncancccnncnnccnncccggngcgcgtagtcncaccagggccccnacc

SEQ ID NO: 695362 - DNA, 365 bp, Homo sapiens
caggccccagaaacctagcctggagttcaaggagtttgtagggttgccctgcaagaatcggccgccttttcccagggccggaggtaccaggggagcccaggagccctgctctgtttgggaaccccaaaaaggcattgtgatgggtttgccttccagtatgagtatgagcccccctgcacgtccctttgtggtcgggtccaagctgccaggcttcctccccaggtcatgggctgggccctgccctttttgatggatgcccagccagggtttgagccaactccgatgtgagacgtcccgcagggcagataccgctcccccccctgcttcctttgagttttttaataaaataatttcatgtggcagga

SEQ ID NO: 695363 - DNA, 300 bp, Homo sapiens
ggggggaccccgggttttaaaaagggggggggtccgggtcccggccccctccttttagggggggttggggtggggggtgcccacttttttcgggccccttagggccgggggggccctccttttgggcggggtttagggttttcccgggggggatttttttggccccccggggggggcccggttttacccccaggccccggggtaaggtgggggggaagggggggttcctttggttccctttttggggcccccccggggccgggggttccccccccctttaaaattttttttttttttgga

SEQ ID NO: 695364 - DNA, 525 bp, Homo sapiens
tggtaacgatccttctactctgtatctccatgaatttgattgttttaattttccacaaagaagtgagaacatgtgaagtttctctttctgtatttggtttatttcactttataacataatgatctccagttccatctatattgttgcaaatgagaggatctcattctttttatggccaaatagtgctccattgtgtgaatgtgtatatactttcttatccattggtctgatgttggacccttgggttgcttccaaatcttggctattgtgaacactgctgcaacaaacatgggagtgcagatacctctttgatatactgacttcctttcttttgggtatatacccagcagtgggactgttggataatatggtagctctctttttagttttttgaggaacctccaaactgttttccctagtggttaattggtggctaatttacattcccttggtaatggctttttagatatagcataataacaaagccatgatccatgaaacaataaattgacaagctggacttta

SEQ ID NO: 695365 - DNA, 547 bp, Homo sapiens
  misc_feature (429)..(429): n is a, c, g, or t
ttcccaaggacccaaggacccattttcctctctatctgcctaaaataatttcttaataactcctacaacattcccccctgtggagatgccacactaactgctgttagggagttttgggcgacgactccttctggctacttcttgttgcaaaagggcgtcgaatggggaagagcagctagggctcctcctggggtcaatctaagggtcctcagaagaatgatgtgtctatgtgtggttctgtttacagcaccatttggagtttgattgcttctagatgagaagaaacaatttgagttatagtattgtgtatacagggtccaaatatcaatacaagacacataagcaagagagggcttaataaaggggttaaccaattccataaagaagactggaatttattaaagaggcattgtagccactcggggatcnaataatttgatttgatttttaagtacttgtagattttcttttaactagaggcattaatccgaaagcagcatgtttcattgaaaactgcatcactaaacccaataaaaagtcctagcag

SEQ ID NO: 695366 - DNA, 852 bp, Homo sapiens
actgccggctatgatcttgagtgacgatgtccctatcagggtactatcgcatcgatgagagatgaacttcgtggtcagtcatggtgaccaccgaaggcaagggccggccagggtacctcagcacccccagaggcctcggccaggagctgctcccttggagtcctcctttagggtcctctccccgacgtgccccacaagcatcgtagcgcgttgtgcacgcgttcgcgccgcgggcgtgcgggctcggagctcgggagtggtggtcgtagggggatgtggaatttgtgcgcccctgtgatgtgggcccggggatctctgtctcagggcttggtcctcgcgctcttgcacgttggaacgcctggtgggggagaatagacgccgaccggggtccggtccaacccgaactctttagaccgtgggatcttaaaacgtagacgacgagcggaaatggtggagaacagagagagatccttgagtctccactagagaggctttatgggtgaccaaaagaaagacagagtgttgcgctctgtcccccattacatcgccattagcacaaatgtgtcacccaaacataagtctacacacgtgacgggaccgtgcggtacgggaagattgtgcctcgctatgtctgcagcgcccacggtttcacatttgccgtgggcgtgctgtgtgaaccctgtgaccgtgtgcgtggtggacatgggaaggagcggcctcacgtgaccagaatattcttgggcgttgggcaaaaccatcttgtaatcgcgtggggaaatatataaccctcacctgcatcgttctgtgaacaggtgccacaggcccctccaggagttcacacaacaatgactg

SEQ ID NO: 695367 - DNA, 193 bp, Homo sapiens
  misc_feature (155)..(155): n is a, c, g, or t
  misc_feature (158)..(158): n is a, c, g, or t
catggtgctcgatgagccatcgtaaatctcagaggtgctatagtgcccatgttagcatcgacttaacacattacgtcaacggtatagaagttgattggagaacagttgcatgcaatatctaattgaaggcgttacctatgaccttccttagcaanaantacactaagctggaatccttgagtggaatcggccc

SEQ ID NO: 695368 - DNA, 502 bp, Homo sapiens
  misc_feature (42)..(42): n is a, c, g, or t
  misc_feature (269)..(269): n is a, c, g, or t
  misc_feature (291)..(291): n is a, c, g, or t
  misc_feature (331)..(331): n is a, c, g, or t
  misc_feature (353)..(353): n is a, c, g, or t
  misc_feature (359)..(359): n is a, c, g, or t
  misc_feature (395)..(395): n is a, c, g, or t
  misc_feature (432)..(432): n is a, c, g, or t
  misc_feature (482)..(482): n is a, c, g, or t
gatggatacctggaatggacattaagatgaagagagtaattnacatttactctagaacctttaacaagcactgaaaggaagaagcctgagatttgatccttgacaatttctggaaagcactggtcagtcacactgcctggacagagtccaagttacccactaaagcttgaggtggatgttggcttcactcctgcagcacaatgctggcctagaaagcgagcattttcattcttccatggcagctgattctttggtgccagttttcatgntttctccataggccttgtgcanaaagggttctcaatgcatccatctgtgagaataactgcanactggaagaaacatgcctgcanggtcangaactgggccactggtccagaaccgttgtgcctcanaaactattctctttagatgttgaccctgagagactanatgattttcaaagagttgctgcctttttggaacaaggaaacccataatcnagcatggggtacccgttggt

SEQ ID NO: 695369 - DNA, 735 bp, Homo sapiens
tcggtcacgaggcttcgcacatctgtggaagcttagttctttcgctctttgcaataaatcttgctactgctcactctttgggtccacgctgcttttagtgagctgtaacactcaccgcgaagatctgcagcttcactcctgagcccagcaagaccatgagcccactgggaggaacgaacaactccagacgtgctgccttaagagctgtaacactcaccacgaaggtctgcagcttcactccgtgagccagcgagaccacgaacccaccagaaggaagaaactccgaacacatcagaacatcagaagggacagactccagatgcgccaccttaagagctgtaacactcaccacgaaggtctgcagcttcactcctgagccagcaagaccacgaacccaccagaaggaagaaactccaaacacatctgaacatcagaagggacagactccagatgcgccaccttaagagctgtaacactcaccacgagggtttgcggcttcatccttgaagtcaagtgagaccaagaacccaccaattccggacacattttggcgaccacgaagggactttcgcatatcgccaagcggtgagacaatagccgagcggtgagacctttcccaatcgccaagcaaatcgaggacatcaagctacagatggtcttacaaatggaaccccaaaagagtcaataacaacttctacgaggacctggattaccatggattccctggctaaaagt

SEQ ID NO: 695370 - DNA, 264 bp, Homo sapiens
tagagcacgctgaaaccccaggagctgaacacagattgctggattaagccagatttacaaatgggaagcttgcctcaagctgttgatgctgccaggccgaaggccactctagtggaccgtgggtcagcagatgatgaactcactaatcttcaactggcttcatgaaatgcactaatcgttctaacaaacttcagcctctgaagtgagggtcccccaattgttagtccattgtatgacatagagcgagatgatgcgccatcctta

SEQ ID NO: 695371 - DNA, 162 bp, Homo sapiens
gcaacacagcgagaccttatttccactaaaaagaataaaaaaaatcagctatgcgtggtggcatgcacctgtacttccagcaactgggaaggctgcaacgggaagatcacttcagcccaggcaaattgggctgtacggatcccggatgaagactgcagtgag

SEQ ID NO: 695372 - DNA, 356 bp, Homo sapiens
tgattgcatttacacccctgacttgtgtgatccagaatgtgactgctggatgcatgatgatgatttggaccaatatatcatcaccccaaagaagagcacccggaaaggcaaagtgtaaaccaccacccattccacaaaggagatctgacccagacaatggcccttggataggaatccataagaaagctcctcctcttccgatctatgacgaggctctgagaattcttagagaagaaaacctaatacctcctgatgaccctgacctggtcacttggtctcctcatgaccatttcatacctaacagaatcacagtatgtcctgaacccatcccttgtttcatgtatacagtctcaatg

SEQ ID NO: 695373 - DNA, 315 bp, Homo sapiens
tggttaactctaatactccaatatggtactacctacgtggatcctctacttatatgttactcttccccactgaaaatgtaatactactatcttttttacatctttaaaattatatcatactgaaatgcggactgaagactgataaagttggacttctgaagatgtctattcttagaagagacctccacagtatatcagttctcatatcatcacaggtcctccattggagaaaatgagccacccctttgtgctgccccagccgtctggccgaacagaatcacagaacaatgtgtcctgtccccgcattagggtacg

SEQ ID NO: 695374 - DNA, 102 bp, Homo sapiens
ggaaaaactttgtgtttttaacttttgggtccccccatttttaaaaattgctatttggtaaacaattattatgggtcaattaaaactaaaataaaactttta

SEQ ID NO: 695375 - DNA, 460 bp, Homo sapiens
cttccgaagcaactcagtactaacgaaaaaacctacgccaggctacggaagagccgatggccagagtgtgtggacatcaacgtaacgcgaatggccgtgcgtgccactggctggtataaggaattaataggtcctcaggtaaaaggaaaaactctgtggagctctccactgcagcgataattgtaatggtttactaccctgtataaggtactaacctctccccattcccccacatttctttacatcgactttaatttacttcaatagcaaatacagagctgtgtaataattttatattttttaatatggggggttaattgtaaaaaaacaaaaggtttaacagggaccaaagcaattttctgagcaaaaatttctccacccaaaagcccttcatgagggccagccaaagttgtgatagatggaaggcacaaattcaaattcatcccgaccggggaaacac

SEQ ID NO: 695376 - DNA, 159 bp, Homo sapiens
  misc_feature (37)..(37): n is a, c, g, or t
  misc_feature (140)..(140): n is a, c, g, or t
acctgggccacaaggagattggagcccagaatcaggntaaaaagacagaaggggctcaggtcaaaaaggcagaaaggagtcccaggcaaggcaaaaaaaggagagggagctcccagtcgcaggtcaaaaacggcagattncggttgctacatcagggca

SEQ ID NO: 695377 - DNA, 125 bp, Homo sapiens
cacgaggaaaaatattcatcctctctctgtcttcatccacggaatagtttccatgtttttcagtacagtgactttcaccacttgcagcttcccctttagttcccaggattgattcctacacagta

SEQ ID NO: 695378 - DNA, 216 bp, Homo sapiens
gatgagccggccctattcacccccctaacactggcagctattgatctgtttatgtccctgtagtttgtttttctagaatgtcctataaatgggatcctataatatgtattcttttgcatctggcttctttcactgcttagcaaaatgcatttgagattcatccatgttgttgcataaatcattagttaatttctttttattgctgggtggtatcag

SEQ ID NO: 695379 - DNA, 510 bp, Homo sapiens
ttccccttatttcccacagggtttgatgtggggctgacagtttgaagaaagaaacctcctatctgttgcttttagattgtgatgggagctagaagagcctccgggagattattcagcagctttgaccagaacgaagaaaacaagggaggagaagacaagctaaaattgattcgggattttcggcaatggtttgagactgagctaaagttattctgtggtgacattctgaatgttctggacaaacaccttcatttccagcagctaacactggcgagttccaaggtttttctataataaaatgaaaggggactaccacaggttttctggcagaattttgccacagagaaacgacaggacaggaggctggcggagaacagcctagtgggcttataaagctgctagtgattttgcaatgacagaacttccaccaacgcttcctattcgcttaggtcttgctctcaattttcccgtattctactacgaaattcttaattcccctgtggacaagta

SEQ ID NO: 695380 - DNA, 716 bp, Homo sapiens
cggccggccattaatgtaggtaggcccctcattagcccctccgctttacactaaacctacggctagtagtgtttgcaatgtgacggaaatgatttcgcccggtttcaactatgcacctaatacgccagctgggactttcccccactaagggagaatagctggagtccccccggtggcgaccgccctagaactagtggataccccggtctgccggaattcggcgctagggacaaatgcatttcccctaaatgtaatcaccacgaatccaccctcgctgtgcacctttgtcctcaatccaccctcataccaatcgctggcaaccaatgatctattttctttccgtacagctgtgccttttctagaatgtcgtatcaatgactcaagcagtatgtagccttttcagtcttgcttcattcacccaacaaaatacattttaggccgggtgtggtggctcacgcctgtaatcccagcactttgggagacggaggtggtcagttcttctaaagtcaggaattcaataaccagtctggtcaccatggcaaaaccccatctctactaaaaatgcaaaaattatccggacatggtggcacacggcctataatcccatctgctcgggagactgaggcagtagaatcgcttgaacctgggacacggagccttcagtgagccaggatcgcgccattgccctacagcctgggtgacaagagtggaacttt

SEQ ID NO: 695381 - DNA, 195 bp, Homo sapiens
gtgggtgatctagaggatccacacgtacgccttcatgagggtgttatgtagacagaaacaatttcgaagaatacttgaagctagaaggggaagttggttacaaatcacatcaaaaagctactaaaaggactggtgtatttaaaaaaaactaaggcagaaggcttttgggaagagtagaagaattggaaggcgtta

SEQ ID NO: 695382 - DNA, 791 bp, Homo sapiens
tttggcgtcagaacacagagtgtcgtgaaaactacccctagaagccaagaagtggtgaagggaataagactcatatcaacattgtcgtcatcggacacgtagatccgggcaaagtccacctcactactgtgccatctgatctactaacaatgcaagatggcaatcgatgaacatgaaccattgagcaaactttgaggaacggagtgctgactgacgaactggagaaacgggctccttccaacgatactgcccatggggtcgtatgagactacaaactgcaacgctagacacgttggacacaggtagcgctaaatacaacacatatgtgactaaatcgtacgcctgtaggtagtggacacattccttaggacagaatcccaatggctagaggtacactacttgcttgagctgactcgattggactagtcacctcgacggaatcccacagtaggaacgttcataattcaaacaacacacattgaactaaactcgcgggactcagtaccttcatggactcgaccccttgtttggcctggtaccccattgaaagtgagtgttaacgcatagccgtagtgtagatctcgtgttcgaaactttcaagatagcacgctcggcattagtttcctcccgaaacacgcaccgttgtgggtcgagacacccactggaagaaagaccattagatcacctactacctatggggccttttacagaccactccttggtgcgagttgctatggaatatcgccaatcctttagctactaggtaccggagcgttgtttggcgacctcag

SEQ ID NO: 695383 - DNA, 292 bp, Homo sapiens
attgaacatcgcagccgctgttcgggcagagaaataggtcaggaactcgccggtaacggtctcgatatcggcgaaaaaacgcttgtagcggcggatcagccggccttcttcgaggggaggattaaagcgcatcagccttgccaactccgcaagccacgggcaatccgctcgacggcttcctgtaggcgatcaaggttttgcgtgtaggcaaaacgcacatggtgaccggcttgatagcgaccgaaatccaggcctggagtgaacgcaacatgctcggtttcgaggaagtgtc

SEQ ID NO: 695384 - DNA, 207 bp, Homo sapiens
ctgaagactaaggctgctattgaaacttctaaaactaggcctagttttagaagtttcaatagcacattgctgcctgggggttctagtgctattgaaacttctaaaactaggagctattgaaacttctaaaactaggtgctattgaaacttctaaaactagggaaacttctaaaactagtgctattgaacttctaaactagggtactc

SEQ ID NO: 695385 - DNA, 421 bp, Homo sapiens
cactgtacttcaagcagagatcccagcgaggtagataagcatagcaggtgaatagcaacctcggtatctttgtgggcacacccagggggcctctgggagaacacacgatatcaggggttcaacctggaaactacacctgctcctagtcagaatctcacaagaagaaccttgattttcagaagttaactaataatggattatttggactatcttgttcaaactctttgcccgggcaaaatgagaacactgctgaggtctgagagaaacagtgaactattatattgtggtatacagcgaagtcccttgttgtacggtgtgtgctaaactgggtttcagcaatatctgtctcgccatcttataccctgtgcaaaccgggtttacccttgggagagaaaatcatcttggtgtaggtcgataattt

SEQ ID NO: 695386 - DNA, 410 bp, Homo sapiens
agtcagtagcaaaatggggtggaaagtagagttctcatttactcccgccgactcatgtataaactctcccactatcagcatcctccaccagagtgtacgtttgttacaatcagtgaacttatattgacacctcattatcaccccaaatccacagtttatatcaagcttcactcttggtgtacattcaatgggtttgggcaaaagtataatgacatgtacccaccattacaatatcatacagaggagtttcactgctttaaaattcccctgtgctctgcctattcctccctctcttccccctaaccactgatctctgctattgaaacttctaaaactaggtgctattgaaacttctaaaactagggaaacttctaaaactagtgctattgaacttctaaactagggtactc

SEQ ID NO: 695387 - DNA, 301 bp, Homo sapiens
aaatttacgggtcatgcgggaagttaaagccgtagttcaaacgcaatacaacagcattctaacgaccacttttccggacagtgacctggataagctagagatgattgataaggagcaaatctataccgctgtggtttactatgacccagaattaaagccattgagcgccgatgatcttaggcaattgcaacagcagccaccggtagtctttactagtcagcaacaccaagccggtttaaattacctgttaggtaaaatggatttaaaggatattcaggatcatcgactgcatcgggtctta

SEQ ID NO: 695388 - DNA, 1590 bp, Homo sapiens
catgcgtatcgaagagagtgttattatctagttcggggcccatctatcctggacactggcatgatgttcgtccgcaacgacttgcaaggatgttcagacttttgcaaatctaaactgtcataaaaactttaaacaagaagcgcaatcctcgcaaatgttagtgtggaccaaagcattcctggaaacgcacgctggtaaacgacgcttacacgtggactaacttcactttgacacttttgaacacaaccgtacgacacacttgaaccctatacacaactaccacgcgagaagctaatggacatacaaacctactttgactgccgactgacaggaacgcacgtctgacacgacacagtcagacaccgacggaacggcggcccacagggcttacaaactgttactacactgacaaccacggacctttgacacggaaacgaacactacacacgacggacttacgcagaaaacacggttttcaccggacctacctcacccaccgacgaggctcaatcgtcccacaacaagcactcgcgacttctataatcacggacgacccccagtcatatggcaagggccaacacggggccaacacacaggattgcgaacacggacgcaaaacatgagttaccagcaatgtttaacacaggcaggccatggttgagaacatgtggcacgaattgactcctttttaaagacaacagtcgttcgtggttatacgccagtttcgtacctctaactacgtgataagcacttctgtgtaacacagagtgacccccatatatggggaaataacatctgggcaaacccttggcggtaacaactttagtatacaaatttatcatgctacgcgttccagcgggtccagcgtgttacaacgttgcaaacaaagacgcagtttgaagaaaggaaccacttcctatgtcaccgctggcacaattgtgccccaaattccttacgcgttaactctacttcgaggacatacttcagcgggggcatgtgtccaacgaaatctgggctcattcttcacagtgtgatagaacacatcatctattcaacttgggagctagacatgggtgaacctttaacaggtctaaaactgcgcactgccacccgcaagatcccatactattgtaatcaactctacttcgacaaggcgtcaaacttcgtggcgggccccgatcacacacaatgtgcaatgtcgaagccgcccaaccacggaaacgacaacttggccaccccacacgcacgccacacctccgcgaacatcgaaacctccacacctgcgggcccgaaacacaatcacgcgcgcacagaccgcacagcatctccgccatcaccacacgatctcagcgcggacaacgacaaacagcgactacccaacatagtcacactggcgaaaccaacacacccgagtcgaccaccagacaacagacacaccaacacctgtcagcacacggcacacaaacactgacaccaccaagcaaaagaacacagagcaagaacaagacaacaccagcacgacaccacaacgaatccgaataagaatccagacacagaaatactccaccaacccgcaaccgcaacacacgt

SEQ ID NO: 695389 - DNA, 249 bp, Homo sapiens
gcgtctgttcccagggcacactgtggaccttgtgctcccgtccgtgaaccttggcttcgtgtgtgagcactgcagcctccctgggcataccctccagacgccagcaccaccgcaacatatagacctggtgctattgaaacttctaaaactaggagctattgaaacttctaaaactaggtgctattgaaacttctaaaactagggaaacttctaaaactagtgctattgaacttctaaactagggtactc

SEQ ID NO: 695390 - DNA, 242 bp, Homo sapiens
caaaagaaaaagagcagagagagtagagcttaatcaagtccaaaaagcttaaattcaaatcttttaaaattcaaagtctctgtctttccagtgttacctcatgcttctctgttatctttcacatttacatagatgacatattttcatgctattgaaacttctaaaactaggtgctattgaaacttctaaaactagggaaacttctaaaactagtgctattgaacttctaaactagggtactc

SEQ ID NO: 695391 - DNA, 237 bp, Homo sapiens
gtcgagccggtacgcgtcatttatgtaagggactgagtatactggatttgggtatcgtggggttggggggacggtccaggaagcataccccagggataccaagggacaacgtacttatttacctttagtgtcatgcagagctgctattgaaacttctaaaactaggtgctattgaaacttctaaaactagggaaacttctaaaactagtgctattgaacttctaaactagggtactc

SEQ ID NO: 695392 - DNA, 677 bp, Homo sapiens
  misc_feature (72)..(72): n is a, c, g, or t
  misc_feature (174)..(174): n is a, c, g, or t
  misc_feature (241)..(241): n is a, c, g, or t
  misc_feature (393)..(393): n is a, c, g, or t
  misc_feature (427)..(427): n is a, c, g, or t
  misc_feature (451)..(451): n is a, c, g, or t
  misc_feature (592)..(592): n is a, c, g, or t
  misc_feature (603)..(603): n is a, c, g, or t
tcgtcaccgaattgaaatgtgttgtacatctccaaaaaaacaagactgcatcatttcactagcactcaggcnaatgaaaactgaagaaaaaggaactatttctcacacatgagattggcaaaatttcaacactgacaggtttcagtgacagattacagagactgggcagtctcntatattgctgtgggtgtgtgcatctgaaactaatctgacagtgtctattaaaattataggccgggcncagtggctcacgtctgtaatcccggcactttgggacgccgaggcaggcaggtcacgaggtcaagagttcaagaccagcctgaccaacatggagaaggcccgtctcgactgaaaatacaaaattagccgggtgtggtggcgcatgcctgtaancccagctactcgggaggctggaggcaggagaatngcctgagcctgggcggcagaggtngtggtgagccaagatcgcgccattccactccagcctgggcaacaagagtgaaactccgtcttaaaaaaaaaagtcctaatatggtcatattactgaaaacagtagagaatatgtactcaacatttactataagctggtatnaagattacttnccttatattaggtaatcctttacaagcaaagggaatagcattataatcgtaaatccttgccttgtgatagccag

SEQ ID NO: 695393 - DNA, 1902 bp, Homo sapiens
agctctgaccccgagagtcaagcagcgtgcttccggctgttggaaggacaattaatcagtgaagctgcctcttcctaagcaagacaacagttgcagtcagacaagccctcaaggtgagacccaggagtctcccacctcccacctgtgcctgccatggagctcctgaaggcgctgctgctcctttctggagtctttggggctcttgctgaattctgtgtaataccacggatagacagccagctggtagagaagttgggtcaacgtcttttaccttggatggatcggctttcctcagagcagttgaaccccagcgtcttcgttggcctgcgactttccagcatgcaggctgggaccaaagaggacctctaccttcacagcctcaagatccattaccagcagtgcctcctgcggtccacctccagcgatgataacagtagttgccagcccaaactttccgggggcagcctggcgctctacctgcttgctctcagggccaactgcgaattcttcgggagccgaaagggtgacaggttgatctcacagctcaagtggttcttggaggatgagaagaaggccattgggcacaatcatgaaggccaccccaacaccaactattaccagtatggcctcagcatcctggcactgtgtgtccaccagaagcggctccatgacagcgtggtgggcaagctcctgtatgctgttgaacatgactactttacctaccagggccacgtctctgtggacacagaagccatggccggcttggccctcacctgtttggagcgattcaatttcaactctgatctgagaccacgaatcaccatggctatcgagacagtgcgagagaaaatcctgaagtcccaggcccctgagggctactttgggaatatctatagcaccccactggcactacagatgctcatgacatctcctgcatccggggtagggctgggcacagcgtgcatcaaggcagggacatccctgctgctcagcctacaggatggggccttccaaaatcctctgatgatttcccagctgctacccatcctgaaccacaagacctacttggatcttatcttcccagactgccaggcatccagggtcatgttggtgccagctgttgaggaccctgtccacatctcagaagtcatcagcgtcacgctgaaggtcgccagtgccctgtcaccatacgaacagacattttttgtctttgctggatcttccttggaagatgtcctgaagttggcacaagatggcggaggattcacgtatgggacccaggcctccttgtcaggcccctacctgacatctgtactagggaaagatgctggggaccgagaatattggcagctcctccgagcccctgacacacccctgctgcaaggcattgctgactacaaaccccaggacggggaaaccattgagctgcggctagttagatggtagtcctacgatccctcctgatgtcttcacaccctgctgccacctcaagtgcacttggaacaatgccccccagatcacctcagctaccttcccaaagaggatttaagccactccccacctgggagcaggaagggaaaaaaaacctcccctagggaggctgctagtttgagtttggccctgcctgatcccacaggtctttcatgaagactgccccatagcctgaggaacaggctgctcttgacttcctctacataaagaagtctgctggctatgggtgttgtgagtaccactgctctgggaccagggtcccacaagaaggacctccatggcctgctgtggctctgacctgcacacccaacccctgctctctgttatgagagtggtggtcccagtggtcataaggcagcctttggtcatcggcagggccatccaacacaattaaagccttgatttacctga

SEQ ID NO: 695394 - DNA, 405 bp, Homo sapiens
tacagtgtatggtatgctatcattggtgaaaaatacaaataaggggaaagtgaatgtgtgtgtgtgtatgtgtaagtacttgcgaatgtatgacatatctctggaaggcacatagaaaaccaggttgcctatgggaagaagtaggcgatgggggacagtattggaaaggagatttttgactgtatagttttgtgaactatgtgaatatcatctctgaaacagaacaactcctcctactcagatagcctctgctccctcctcctccttcttaaaagtctctgcctgggtgcagtggttcacacctataatcctagcactctgggaggctgaggcaagaggattgcttgagcccaggggtttgagaccagcctgggcaacatagtgagaccccgtctctatttaaaa

SEQ ID NO: 695395 - DNA, 211 bp, Homo sapiens
aacacactcatctcccaggtgttcccatttctgtacttgagcacttatcagagatcggaaaacctggtgctgctcctcctttgctaacgcgggcccgggatacttcacagagccctctctgcttgttcaacatgttggcttgcctatttgaagtaggacaaaaaggccatgcgcggtggttcatgcctataatcccatcattttgagaggc

SEQ ID NO: 695396 - DNA, 100 bp, Homo sapiens
tagtggtcctgcgcagggtcgacacgcttggcgatgtgctgctcagccggcgggcggcaatcggctcaaactggcgggcggggcgacgccgccgttgcgg

SEQ ID NO: 695397 - DNA, 140 bp, Homo sapiens
tgccacgcagtcccacaaagctcataaataccgagagaccgaatttacatgcaggaggaacatctcacacccttgcataatgttacaataaactattacgtacacactctccatcacctaggagtaacgcgctcaaacat

SEQ ID NO: 695398 - DNA, 559 bp, Homo sapiens
gaaccgcacgatgcgcgtcggtcttttctagatctgggagtatctagaccagggctggtggtcattctgatgctagcaaggagtcccccttcaatgccgtccggaaccagttgtactggatttcttcaccactcaggttagtcataatgcccccctaaggctttaaagatggcataaccagcacatatatcccattttttgatgtatgtcacatggctgtataaatcagcttttcctgtgactcttatcaggcacatccaaaagtgctaaatcttaataaccatgaccaccagctggggataattgtagtctggttcccaaaagtctgaagagcgacctgtttgaccatccctgaatggaccgagacacaaacgatcctaggggtcttctcattgtaggaagagcgggctttcaaattggaaccaccatctaccatggcccaagctgtatatacggaaaatggttatgtataactcctagcatgggttcaccatttacagccacaccaccatagtagtgacgtactttcgaagatcctctgtatatacctgtgtagctc

SEQ ID NO: 695399 - DNA, 112 bp, Homo sapiens
gatagagactacctgctcagtgtctcccttgtccgggtacatctactatctgtaccaaacaagcccagccagcccctgctcgtcattcagggtcacatagttcagcgtctga

SEQ ID NO: 695400 - DNA, 316 bp, Homo sapiens
gtggtcgtctctacacggatcccctgtgtgttggtaggagggcctggctgtggctcgacggcccttattgtactgatactcttatggccacatgttcacctgcaatgtttgctgtcgcaggttatacatcgccaagcttcggcccttcatttctgcaacgcccaggactctgatactttgtgtgttgtagggtttattagaggtctagatagcccagatctgccgcagtggactatctccaaggatatgaggacaagctatagggatccagcagtccaatagcctcttacagcctggggagtgcgagagaaaccca

SEQ ID NO: 695401 - DNA, 1078 bp, Homo sapiens
gtcatctactctaccatctttgcaggcacactacatacacagcgctaagctcgcaactagatatttacacctgagtaggcctagaaataaacatgctagcttttatatccagtttctaaccaaaaaaataaaaccctacgtaccacagaagctgccatcaagtatatcctcacgcaagcaaccgcatccataatccttctactagctatcctctttcaacaatatactctccggacaatgaaccataaccaatactaccaatcaaatactcatcattaataatcataatggctatagcactaaacactaggaatagccccctttcacttctgactcccagaggtaacccaaggcagccctctgacatccggcctgctaacaactacacatgacacaaactagcccccatcttcaattcatataccaaatctctccctcactaaacgtaaggccttctcctcactctctcaatcttatccatcatagcaggcagtagaggtaggataacaccaaagccagctagcgcagaatactaagcatactcctcagttaccagcataggatgaataatcgccggtacaacggtacagacctaagataagcatcgtaaataaactatccgaaataatgccaaacaacgaccgacttcctaactactcacctatcaactccagcacacgagcccaccaaatatctgcacccataacacagccatacattactaccaccgttaatccaatagacatatttacatagagcttaaccgaaccgatattgccacaagtgcacaacacgacatccaacagctaaatatgctctatgataaccgcaataatatgtcggatgccacttaacctctatcacagcgagatagatgaccgcagacatatcatgagtcaaggagaacgacggtgaggcaagccgctctacagtcgtcaaccgacaactcataatcatgagaaaaaacagctgccgaatcaagtgtgccggatacaattatcccaggagctcgtacaatatcaatatccatgacatcaatactatccagagagcattcggacgcagtaacacgatcgcg

SEQ ID NO: 695402 - DNA, 220 bp, Homo sapiens
accacaagggctacagccccaagaaggtgcactatgtgcttattccaccgaataatttcgccctgggaattttacttgcccggtgtttagccataaaatcaccgcgattgattgcagtgcgacatatcgtcactgcatcgttactttttcgagctcagagacctttgctctctgttaaggatttccagcatgaccgacgcgacaggactcatggcccaca

SEQ ID NO: 695403 - DNA, 1091 bp, Homo sapiens
ctttttttttttgtggggtcttaatgtgcttaaataacgcggaattataattagccacacaaataaggagagttttatttttttttccgggctcactccaaatcagccggtaagggtatattctccttctacagcctttctccgtgaattttggcatgtggtccctcaattctcccaagagtatagttcataccttatagtttatacacctcaagaggatagcacgtggtgtggaacctatacatgtgacagaaaacgggggcgtgcaagagggtggacagaggggaagcatagtgttccctctcgtggtctctgtggaataaaactctcgagtgtgccacacaaaacacagagaaaacccaacatattgttctgtgagagaaacagtattataatctttctcagtatttatatagagaagccgcggttgtggggaaatctcccgaatcactatgaagagagaagtcttcaatactccgcagcagttgttctccccacaattttgctccgccttcttcctcttcaacttgtgttgttgcgcgaggttgtttatgcaagcaacggatgatcaaagaagaaaggaggttcttcctggtaggaccttagatggttgagcgcaccaacccgccacccagaaaagcttggttgggtgcgcccacgacagcacgctagttggtggggagaaagcaaaggaacaaagcttcgggacgcaaaggtgggacgagacatataaacaaacgaaacgcgaagagaggggcactcggttgggcgccaggattgagaccgtatcccaaacccacacttctctccctggttgggaccaaacttcgggtggcgcgcccacacaacccttcttccttccggggtgggcgcacctcattgtatggaccctcggataggttggatgggtaggatcgctccccccctggttagtgggcggaagagaaggaaacaaacgaaagtccttccctgggtagggggagggccccccctggtggtaggatgggaacaaccaagcaaggagggaaggaagggcagtaagggggggacgacactaagtctggtgttacaacacactcccctcgttagaa

SEQ ID NO: 695404 - DNA, 442 bp, Homo sapiens
gcgcagctggaacctccggctgtcagttgcgcttacagttcctaaccccgagccctgcgcgcagcccgcactatgggaggccccgccgcagctaagggctctggtcgtagtcggtcaacgcactgctgcgcaagcgaccgactaccacgcggacgttggccgtgtcttaagggacttccggaacggggctgtctattggagccaacatatccgggccccgtcatcgcgctggtcatgacgcttgactctgtccgagatagtggcagcctgccatggcagaagctgttgggccagtactagctgggccatcgatatatcgcactccttggaaccgtggtcacggttcgtgttcagcctacaagaggtctccgttgccctgctagtcctgagatacaaggtcgaagacactaccgcagcgacacgcaattcctggcggccttac

SEQ ID NO: 695405 - DNA, 870 bp, Homo sapiens
ggcataccaaatctaatctggatcaggaaatcatagtaagatatactaggtgtgatcaaataccataactagtgaaaacagcatgagtatacaaaaaaaatttgtactcgacatagtcatccttaaacaagtcttacataatgattccttagctgataacttgtaattgactatgtaacgactgtcttgtcctgaaatccagaggtatagtcctattcttgcattcccgggatcttaacttctcgttggaatcttgccactgtctgataaacacaatgttggattcagacgtaaggaaaagcttggtgtacatacacgactggtatcccagaccctattgttatccagtcttaatcgtaattcatctttgttaaatactgtgatcagatcagctactctatagatgtactatgtccggcgagatctatacaatttacttctcactatattgaagcagtagatgcctcgaatcaacattcatctcgtcctctgtttcgttgcaaaactatgtcttccccagtttcctctgtcatggggttattcaactttagacaagattaatggtagtatgtccgtatccagtgtcctgcaaaggcccatccgcaattcacagttgattaactgagaaatgatactacaattcaagaaatacgtcaggtcgagcgtgactatttgctcatctgaacatttttatcactctctttatagactccttggcaccctccatattgaaaccaccataagtttccagttacatggaacacaagggtgcacacggacttgaactgttggcatctcaacggaactaacgacgtgcggtccaacatttcaaacacccacagaggccgtgcgacacttatcattccaggc

SEQ ID NO: 695406 - DNA, 131 bp, Homo sapiens
cgtcccggtgtacagtagtatcggaaatggggctgttcacatccgttgagtgtatcaggaatctggtcacgcgcacgtcggtactcttctctccagatgctgtgctaggtaggatactggtcgagcagcca

SEQ ID NO: 695407 - DNA, 196 bp, Homo sapiens
tagaggatccctgcagtcttctcccatcagagttattgtaggctcggggacggtggctcacgcctgtaatcccagcactttgggaggccgaggcaggccgatcacctgaggtaaggggttcaagaccagcctgaccaacatggtgaaaccccgtctctactaaaaatacaaaaatttgctgatgggagcaagatgg

SEQ ID NO: 695408 - DNA, 928 bp, Homo sapiens
tcaaggggcgtagcccctaaccaagttgttccccgcggtggccgaaaagaagccctgagggccccctttcgggagctcccctcgggagctgggatccaggcgcgtagcggaaatcccaggatccggggtgctgttgggccaggtctcccaaccagtgaccatccctcgggggctggggacccgggcttcccgggggtgcatgcatgcacgatgctgtggtgtgccccgcggtgggggctctcgagcctccgaagctgggcccagggggctgagcacccgggtgaaccggagaaagaagctgcgtggggtgacacaggtgtggtggccacgtatgtgacacacgggggggtggataccgtgggggttagaacgcgtggcgacgtcgagaggggaggtgtctatcaaacatttaagcagcgtgtgtgcgcgggacactgggtgggccttggggaaagataggtcagattgcctgaagggggggggtttaatatgtgtggggcgtcgaaaagcgagtgtgtggcgggagagggaacagaaaagggggtcgcgaggtgtgttttaagcaggaagagtgtacaatggtggggggaaaaaattagggttgttgagcgggggaggaggggaaatatgtgatctccacctgcaggaggtgggggagagaggagatagacattgacagaaggggtaggactttctggggagacgaggggagaagggggcactcaaaagatggaagggtttggtattgagacagaaagatgtttcgggctccgcaaggaattgtttgagtcaagtccctaggcaatatgtaatatgtatctactgtgggaaggaggaaagactttctgtttgtttgggaccccgagaatgttgtgggaggcgtgtgagatggagaaggaaattatactctcttggaaggggtgagggc

SEQ ID NO: 695409 - DNA, 1304 bp, Homo sapiens
  misc_feature (973)..(973): n is a, c, g, or t
  misc_feature (1304)..(1304): n is a, c, g, or t
gctctcgccaggcgtcctcgtggaagtgacatcgtctttaaaccctgcgtggcaatccctgacgcaccgacgtgatgcccaggtaagacagggcgacctggcagtccaactacttccttacgatcatccaactatgggcctgatctatccgaaatgtctcattgctgggacgcagacacatgtgggctcccaagcagatgcagccagactccgcattgtcccttcgccgcccacgcgcctgtggctgctgatgggcaacgaacaccatgactgcgcacaggccatccgacgggcacctggacaccccaacccagctctggcagaaaacctgctgcctccatatccgcgcgcgcgcaatcgttgcgcctcccgctcgtcacaccaccgcagcgcaccctccactgagcacccagcggacccactgctacgccgcgcccaatacacactgctgcccaaccctgccttgcccgtgtcttgcgctgcccccctcgcccccccactggctgccacgctccccctcgtcccccagccccacgaacccaccttggcgtccttcgcgcggccccgatccaagccacctccgtctttccccaggccctccccccgttattccccccctatcaccactctcccaagcgcgcggcaccccattcggcaccacgtccctcgacctctgactgcctgcactgcctgggctcaccggcactgccgcgctcccacacgtggggtaccccccgcggcactcccctctcccttgcctgtgatacctgctccaacgatgcttccccgcctccgccctctgcgcccgggcatcttcaacgcccctgccgcatccggaacacctcggccccaacgcactttcttcgaaccctccttgccaacgctgccctgcgaccaactacccccaacgggacgcccctccggcccatgtcctcgcgcctcgccaacatgacagacgatgaccaacgcccancgacttcccaccgatcactctccgccttacccaaaccttggcataaccccacacctatctttcccctcacaatccacagcaaacataattaaacaacacgtcgcgtcactcacgcacacacacttcacctctaaccctccacaccaacatgctttcatactcacacaaaccagtcacacgtcaaccagcctctctgcgactgtcacacatcacactatgttcgctccatcacccctacttctcctacctccacatcatcctctgatgtttgaatcacacattagtcataccacaacaactgcatgccacatcaaccccaccctcatcaaan

SEQ ID NO: 695410 - DNA, 648 bp, Homo sapiens
  misc_feature (25)..(25): n is a, c, g, or t
  misc_feature (65)..(65): n is a, c, g, or t
  misc_feature (91)..(91): n is a, c, g, or t
  misc_feature (97)..(97): n is a, c, g, or t
  misc_feature (103)..(103): n is a, c, g, or t
  misc_feature (108)..(109): n is a, c, g, or t
  misc_feature (113)..(113): n is a, c, g, or t
  misc_feature (195)..(195): n is a, c, g, or t
  misc_feature (239)..(239): n is a, c, g, or t
  misc_feature (308)..(308): n is a, c, g, or t
  misc_feature (314)..(314): n is a, c, g, or t
  misc_feature (323)..(323): n is a, c, g, or t
  misc_feature (335)..(335): n is a, c, g, or t
  misc_feature (360)..(360): n is a, c, g, or t
  misc_feature (378)..(378): n is a, c, g, or t
  misc_feature (396)..(396): n is a, c, g, or t
  misc_feature (414)..(415): n is a, c, g, or t
  misc_feature (427)..(427): n is a, c, g, or t
  misc_feature (475)..(475): n is a, c, g, or t
  misc_feature (498)..(498): n is a, c, g, or t
  misc_feature (500)..(500): n is a, c, g, or t
  misc_feature (536)..(536): n is a, c, g, or t
  misc_feature (553)..(553): n is a, c, g, or t
  misc_feature (565)..(565): n is a, c, g, or t
  misc_feature (636)..(636): n is a, c, g, or t
caggcaccgatttgcattttatgcnaaacttcaggttttactcaatttttacactggtggaagcngatgtcagtgacttaaaaggcaagcnaatacntttccnattcnnagcngaacaaaaaatacacacaatgtagcgtttttattgggcaagacttgccttttatatttcacgtgagaatgccatataacccntcacactgaacaaaatgaccagggtaccaataacacacatcacntgcaggagtgtttaataagcatattttatttaaataaatcctccagtaggaaatggagaattcattgcntttacntagaaggcnatgtaaatagcnatctgtcaaatttatatatgcagcncaccaatattcccatacnggaaacatcagtatttcnacatcacatcacagttcnnaaaacgactttnaagtctcaaaattccgtgtcaccattggcatgcatcacacatgattcnacccaggctttattaatggttcncntcatatcatcgtctccatcttcataaattttcattngaacattcatcaatccnacactaggatcngtttcagtgtcataggagggcatcacattttcattgcacaccatttcaaccagggtcaggtaatcccaccntgtgttttccac

SEQ ID NO: 695411 - DNA, 522 bp, Homo sapiens
  misc_feature (16)..(16): n is a, c, g, or t
  misc_feature (100)..(100): n is a, c, g, or t
  misc_feature (141)..(142): n is a, c, g, or t
  misc_feature (381)..(381): n is a, c, g, or t
  misc_feature (405)..(405): n is a, c, g, or t
caggaaggattctttnttgaggtcagggggcgcataacaactctctacatactacttcatcccttttaaacattccccacaactcaaataacgcacattnctatcacatatattctacctcattaaccaaataactatgtnnttcgggaacccttgaagagggaggcggaaaacttcttctccgttgagccacttttgacgcttcagaaaggtgtttgtatgttcctgcttattgaacatgttcacgtactaggcccatttcgcaagtgccccacccaaagagactgcattgatcgtccacgcgcatggcgattttaggatttttccgcccgaattcaccaaatcctctctcctattttcttgaattcgggggcgaatatnaacaggccgcctacgcgatagganacgcgacacccccgcgctcgcagccagcccgtccttgtcagtttcacggcaggttcttgccctccacccagcacctcccccgcctttgtccaggataaattctcctcttccccgatt

SEQ ID NO: 695412 - DNA, 258 bp, Homo sapiens
  misc_feature (37)..(37): n is a, c, g, or t
  misc_feature (57)..(57): n is a, c, g, or t
ctcagaactttcatctctttgtacgttatctgttggntcttgcatattgtttatttntccattagaacctttagcataattattttaaattcccaacctgataattccaacatccctgtcatatctgagcctgttctcatgcttgctctgtttcttcaaactgtgttttttgtcttttggtaagccttgtaatttttttgttggaaactagtcatgatgtacagggaacaaaagaacttggtacatagttcttgcaga

SEQ ID NO: 695413 - DNA, 199 bp, Homo sapiens
  misc_feature (99)..(99): n is a, c, g, or t
  misc_feature (181)..(181): n is a, c, g, or t
ctctagacggatcccgccgggtctgaacctgacggcgcggtctgaacctgaaactctgaaactgtaacgacacacgggacgacgacgaaacgacgaacngctgacacgaccctgacgaccacggacacggcccaactactgtttgtacgaacgatgacacgcgggacgacgcaacactggnggacgacacacggtacca

SEQ ID NO: 695414 - DNA, 440 bp, Homo sapiens
  misc_feature (19)..(19): n is a, c, g, or t
acagagatgggacagggancagatcctgaaaaccatcatacctggtgaggagtttgtgttgaggatgtaactgagaaggagctgcagaaatgttggccactaccagtgacatccacggtcatcacagctccgttgatgacagaacagaactcccaagcagtgtctgtctgccgtggtgtggatgtgccagcatgaatttacagtcagctgagtgacaggagaaggaccattttataatctcatagctttgaatggggtgtgatatggtttggctctgtgtccccaccaaatcgcatgttgaactgtaattcccaatgttgcgagagggagctggtgggagatgattagatcatgggtggatttcccttttgctgttcttgtgatagtgagttttcatgagatctggttgtttgaaagtgtgtagcacttctcccttcact

SEQ ID NO: 695415 - DNA, 87 bp, Homo sapiens
ggcctttccggggccctcagccctgggggggggccccccccccggtccccccagtaaaagcctcccctggcaaaggcggtccttcca

SEQ ID NO: 695416 - DNA, 862 bp, Homo sapiens
ggcacaaaactgctcttaagtcatgcagagttaccgtttcggttagccagccacgaagttctggcgagagtcgtctcctcgataccaagcgctgtgtctggcagagctggtgtgagacgagacaatcctgcccggcgcggggataactcaagagttttggccggaccttgtgagcatacaccgagagagtgaggagccagacgacaagcacaacactaatggcgctgaaaccggattaataagggaaccttaggtgattgtggcccgtgaccctccagcaccaatgttctgcaggttccagtgtggggggatgattactgtctcagtgtggcaaggccacaatttattgggacctaatgacaagcccatatcaggggcggtgtaattcctttttgacaacttcattttccctacagaattacccctttaaaaccacctaaggtttgcattttacaaccaaggaattttatcatccaaataattaacaagtaagttggcagcaatttgtctcgatatctaagatcacagtgtcgcctgctttaacaatttctaaaagtttcttttatcccattgtgtttccctgctatgttgattccaaacccaagatgaccccctagtgcagagattgcacgggttctatttaaaccaggacgagataagctcacacagaactatttcgggaatggctcaagaaagtttgccatgtggatgcctaccttaaagtcaggaataactggtaataacgggataaccttcaatagggcccttttggaatcttatccgggggtccctataagagctcatcttctaaattatttgtggtacccccccatataatgttcctggaaaacaagtttacact

SEQ ID NO: 695417 - DNA, 219 bp, Homo sapiens
aattggtaaatattcatgatgtgtgaaaattcatgatacattctgtacagtttcagtcccataaaattggatgttgtgcctcccccccggatctagaagaatatgtcaaactataatctgcttgggattgtgaatgactttgttctttgcttgtgtttttccatttcctataatgcccatgctaacttttaaaaaataaaggttttttttaaagcctga

SEQ ID NO: 695418 - DNA, 406 bp, Homo sapiens
attcgcggccgcgtcgactttttttttttgagacggaatctcacccttcttgcccaggctggagtgcagtggtacgatcccagctcactgcaacctctgcctcccgggttcaagcaattctcctgcctcagcctcctgagcaactgggattacaggcatgcaccatcacgcccggctaatttttgtatttttagtgcagacggggtttcatcatgttggctaggatggtcttgatctcctgacctcatgatccacccaccttggcctcccaaagtgctgggattacaggcgtgagccaccatttcataccgttaatagtgcaaggacatgatctttcaaaaggcagcaccctttgttatacttaggaccgtatcttcactctgtgtaggaggtgggaggtgaaaat

SEQ ID NO: 695419 - DNA, 1252 bp, Homo sapiens
  misc_feature (1)..(1): n is a, c, g, or t
ncaacaagagaaagggcggagagcagaacggcgggcgtggctaccgcagtgtcggtgagtctgtgctccttggtgctgtactcactgcagttgatatcgttacatcgttcgtcccgtcatatctgtggtgtcctctctttgtcttcactccgttgtctccaccctgggtgtgtgtggctctcgcaattatcacgtgtgttctccataccactagtgttctcttgaggggttgagaatttcttgtaggaaagtttctctccaccccgccgttgttgacacactcctcgtttttgtctcccctttttcttgttgggtctgtgtgttttaccccgctcgccgctgcccccgttcccccagtcgggagatcttcttgtgtccgaaataccccttgtgaccccgtttttttccgcccgccgggtgggtgtctttctctagaagttgttgccgttatttttgggcgccggccccacagctggtttcttgaaatgctagtgttgttatagcgccctcccccggttgtgttcgcgcgcccccccttgggtgaaatggccctccccgttgcgctctgttagggggctgaagaattttttatggcgcgcccttaggagtgcgcaacttttctaggggtgccacaggtactattggtcacacaaactgactttcgaggcactgggacatacctggacttagcattaatcttgttaccttatactcccttgaatccccggttccccttttaacccctaggtaccctatctgaaactcttgcaccttcccccaccccggccccaaatgaggtgggaaaaatttgacttaaatgaggggattcggggaaagattaaagaaatttttttttttttgagactccctttgtcaccccggctggagtgccatggccacaatctcaactccccgcaacctccgccctcccgggttccagcgatttctcctgcctcacgcctcccgaggtagttgggattacccggcgcctgcctccactgcctggctaattttgtatttttagtagagacccgggtttcttcactgttggtcacggctggtctccaaactcctaacctcgtgatccccctgcctcgacctccccaagtgctgggattaccaggccatgagcccccatgccccagcccaagatccatttttttatatagacttcagcccctttgtaaatattgtaactggggagtatagagtagaaaaaaagtataattaaaacctttgttctaccaattta

SEQ ID NO: 695420 - DNA, 128 bp, Homo sapiens
  misc_feature (8)..(8): n is a, c, g, or t
aagcagtnatacagactcatttcaaggagctcaaagcacatgtggttagtggctactaaactagacgctgtagatctaaacatccataagttgggctatgcagggatatataaacagttataacacac

SEQ ID NO: 695421 - DNA, 1317 bp, Homo sapiens
  misc_feature (1093)..(1093): n is a, c, g, or t
gactaccagatggcgaccaagatatatagcatcctcgatcccgtccggaaaccggggaccacatactatgcgatatagctatccggatgtatgccgggtcatgcgcgtggaagtcttgtagtctcaagtccatatcagggtgtcgtagagtaaatgtcacgcatagtgataagcgtttagctaactcgcggacggactacgacaccagtctcggcataagctcggggtagtggactgacgtctatgctgatcagagatgggatttcgcgcatgggttcaatgcagttgaaccaccaggcaagtactatctcagcgactagtgcagaaccaggttatacctagacgggacgctaggggagacctccgtttagcaacaagtgagtctgcggagtccccaactcggggatcaacaaacattaacgtgtgacatcgggtcacacttcctagcggaaccaacccttcttgctcatggatccttgactgctggctggccactacgaagacccttaatgattccaatcttgtccttcgcacaacgaccatccgtgggcaagaataggtcacaaggacattgatcggtcgatccttcacatgtattaacaagcatttagctacctgtcactcgtaaacccgtgtcgcgtacccctttgtaggccatccagatttcacaccttagtaatcccaaattggggtacacgaagagctgggcaaattaggcgcagaaacaatacgtcgaagcgggcgtttgccataacaacgttgacatgtatctcgcccatagtaccatcctattaggcataccacatggtcttaggaattcccaataaccgcagcacgacaatactaagtgccatgtgtgaacgacagccgacaacacgatacggagacggaacaggcactaacgcagaaaagatcacaacaaaaaggaggaaataccgaaggagacaacaaaacagagaaaatggacccgcggagaggaaacacgcgcgcggaaagcgaccccccgcgcagcctgcgcgagataagccaccgacgaagggcaacacgcgggtggcctcaatccgcatcacatgcggacgaggcgaccacacgntcaaggacacacgccgcaacacaacgccgcagaagaaaataatctaaagaagcgaagctacgccacacaagaacgcagcaaagcacacagcacacaagagcacacaagcgcaccgacgacgcacacagacgcgaacactgtcagcacaagaaacgagtgactccactcaaccaaaaacgagcatgggcgcacacacgcgcagaagtgagaaaacgacgacgcaa

SEQ ID NO: 695422 - DNA, 288 bp, Homo sapiens
attaatttaataattgcatattttgagctactctttatggaaagatgtatcatctataagaatgaactaaatgacaaactgaagagaacaaaattgtgaacataacacatagtactcctgatcctacatgtctccatgaccacaagacaacaaagatggcaagtattaaaatcgtccccactgtcaaaaaatgttacctgtgtattctccatgcaggtaatatatcgagatgcacgtcacttaatggcaataaatgatcacaaaaatattcaacacaaagacaaaacc

SEQ ID NO: 695423 - DNA, 335 bp, Homo sapiens
cactaaaaatacaaaaattagctgggcatggtggcacgtgcctgtaatctcagctacttgggaggctgaggcagcagaatcgcttgaacccgggaggaggagcttgcagtgagccgagatcacgccactgcactccagcctgggccacagagcgagatccgtctcaaacaaacaaacaaacaaacaaaaaacatcattagccgggtgtggtgcgcatgcctgtaatcccagctactcgggaggctgaggcaggggaatcgcttgaacccgggagacggaggttgcggtgacgagaacgtgcactccagtctgggaacaagagccaaatccgtctt

SEQ ID NO: 695424 - DNA, 267 bp, Homo sapiens
  misc_feature (191)..(191): n is a, c, g, or t
  misc_feature (198)..(198): n is a, c, g, or t
  misc_feature (236)..(237): n is a, c, g, or t
  misc_feature (239)..(239): n is a, c, g, or t
  misc_feature (253)..(254): n is a, c, g, or t
cttgagactccccaatttttggcctgttcaggagcctcagataagtatttgtacttgagaccccctcccccaatctgtatgggcccaaccctgatttcaaacctccttccctttgcctgaagctgtcgtccttcctatggcaggagggggggggggtcccaggacgtgcctcatacatgacttgagcttgncagtccnctgagtttccttttatgagatcaacgcgaggggcctgnntnttgaattaaagccnnctcgcttccttta

SEQ ID NO: 695425 - DNA, 830 bp, Homo sapiens
  misc_feature (401)..(402): n is a, c, g, or t
  misc_feature (428)..(428): n is a, c, g, or t
  misc_feature (523)..(523): n is a, c, g, or t
ctgggaggctgcagtgcaggacaatatatggatcacttataacagttctggaattgcgaagcatgtagcagcggcagattctgcattgagactttaccaggagaagtcaaatatataattacttaccaaaccagcaataaaaactcatagtatattcaaaagctttcttgccagatcaggctaaaatttaaaaatatgcatttttttcccacataaacgaaaattatacaggttttatacatggcctgttttaaacaacagcatttaatgctgttaataccttccacatccatgaacagttgtacctccctgttaatgagggatacataaattggaaactcagtacaactaacctgttgaaagacatctgcaacgcctctaatttctttcttgtgactgtnntatgcttataagcacccttgtacatnatgcatacatgtgtaaatcttatttcttttgaataaattcataaaagtagaattattaggtccaatcatagggaactgccaacgtttcaactgtnttttacttacggtaaagatggcagtcaacagggtcacccaacaaactggaggacgtgaacatactcaaggcttttggtatactggccaattcatgcattttgacaaatcatagtattttgtttttgttgagacagaatctcactcttatcgcccaggctggagtgcagtggcacaatctcggctcactgcaacctccacctcctgggttcaagccattctcttgcctcagcctcctgagtagctgggattacaggcacccaccatcatgcccagctaattgttttatttttacgtggagatggagtt

SEQ ID NO: 695426 - DNA, 488 bp, Homo sapiens
ctgtcgccgcgggagcagccgctatctctgtgtgtccgcagtgtgcgcccggtcccctggcctgcctggacctagtggagagctaccatcaagcctgaccagcagaagctgcagtgccttgtaaggacagcggccaacctgtctacgtatcaggctccatccatggctcactcactgctgcgcgggctctggccaacccacagtcatgctgcagcgcctgcgtgatgactcatggctgtcctctttttccacaccatgcgctacatggtcccaggaccccactggaatccgcacaatgaccgctttgtgctctccaagggcctatgcagctcccatccgtctacgcggtcatgggctgaaggctgtgtttcctgtgcctgaggcggagctgctgaacctgaggaagatcagctccgacttggacgggctcccggtcccgaagcaagctttcaccgacgtgtgccactggctccctgggccagggcctc

SEQ ID NO: 695427 - DNA, 211 bp, Homo sapiens
gccgttcctcaggctccctctccggcatatcggaaccctgcattccctgtctatccgtgttccccatggtcgcgtcccggggactagcatcgtaagttgatatggcagacgttcgacttggtcgtcgccgccacgagcgtcgtaaggccctaagctatacgttaccgatgctctcaatttcgtaactcgtggtcatatgctgtccccaggt

SEQ ID NO: 695428 - DNA, 775 bp, Homo sapiens
ctaggtcgggctggtggttaatcggccgagggttcggccgccgccatggccgcggtggacctggagaagctgcgggcgtcgggcgcgggcaaggccatcggcgtcctgaccagcggctggctgacgcgcaaggcatgaacgctgctgtcctgggctgtgacgcgcatgggcatttatgttggtgtgccaaagtcttcctcatctacgaggtgctatgagtgtgcctctgtggagtgtgagtgtgatgaacatcaatgcatgtgccaactgtgctgagctgtctccaacatacatccatgctgtgtgctggcactatcatttggcagcgctctgctgcaatggcctttaccaccagtggaggtggctgccgtggcagcgtgcctacaacctggtccaagcacggcatcaccaacctgtgcgtcatcggctggggatgtgcagccttacatgtgtgccaacatcttcctgcagcgatgtggggcagcctgctggagtgagctggtggctggaaggtaagatctcagagactacatgccctggacctactcgcacctgaacatctgctgggcctagtgggctccatcgataacgacttctgcggcaccgacatgacccatcgtgcacggactcggccctccaccgcatcatggaggtcatcgatgccatcacaccactgcccagagccaccagaggaccttcgtgctggaagtgatgggccggcctgcggtacctgcgctggatctgcctggctcatggcggtggtgtcatcccgagg

SEQ ID NO: 695429 - DNA, 225 bp, Homo sapiens
gaactccagtacccagggatagctggaactggcttacacagatgtgcgtgacaggaattccgcaacctgagtggattaaacacagcaattcgtatcgaaaaactacattatctgctgacaataaataaattatatcaaaaacaaaggtaaggaatcctccaaaataatcacttcctgattgttttactacattgtactgtcatgtatggactttcggcgtgtgca

SEQ ID NO: 695430 - DNA, 107 bp, Homo sapiens
  misc_feature (57)..(57): n is a, c, g, or t
ttcctagagtcgctgttgaagaaggcctgccaggtgacccagtcgcggaacgaaagnaccatgaccacatcccacctgaagcagtgcatcgagcttggagcagcagt

SEQ ID NO: 695431 - DNA, 148 bp, Homo sapiens
tcggacccgctcaggcgcgtcggagggcagcttgccgccacggagactcgcctgcggcgatgcgcgcgttcagtgtttggcagatggtggctacggtcgtcggtgcttcactcatacagcgggtgtcccgtttcagtgcgtttggcct

SEQ ID NO: 695432 - DNA, 128 bp, Homo sapiens
ccctaaaaaaaaaggttttttaattgtaggagcaggatggaaaaacttttctgcccgaactcggaacggagcagggtaggggccgtgtccagctttataacccttaataaaaagggagttttgcccga

SEQ ID NO: 695433 - DNA, 334 bp, Homo sapiens
tccgcgtgttcgctattcttgattcggcttctcgccatgtcttctcacaagactttccgaatcaagcgattcctggccaagaaacaaaagcaaaatcgccctattcctcagtggatccggatgaaaactggtaacaaaatcaggtacaactctaagagaagacactggaggagaacgaagctgggtctgtaaggattcacacaatggcaagactgaggatttatactgaattgtcatcaatcagtcctaccagatggatttcaacatttaaacctggagactcttcgtgtcttgaattaggatgtttgtccagtaataaaatatagaacctttc

SEQ ID NO: 695434 - DNA, 291 bp, Homo sapiens
ctcggtacccgggttcagagactggagcagtggactgtggctccataagtaggctggagggtgtgagggcagattcatgctatccccacgggctctggctctggtctggagccagctcccttctccctctctgccttccccgctcccattcctgagtgctgaacgtgttcgtggacccctgtgccctgacgtctctcacggaccaaatgtgggcacgcggaacacgctgtatgtgtgtgccccccctggtgctttggccacatggtctccctctctgatgtgtggttgtga

SEQ ID NO: 695435 - DNA, 691 bp, Homo sapiens
gggcggaagaaggccacccaggcctcccaggagtactaagaggtgcccgcgcgtgtccgtgccgcagtgctcccacatgccaccacaaaggccctttagagggccacgagcgtcctcatggaaagagctgagccgttcatacgtgcggggcaagcgggcggcgggtcccgttcgcggtcgcttcacgagtctgcctcgtatacgcgggccgggtccttgagatgtccctggccttgacgctcgatgtcgcgtcgcgggatccggccatgaccgccgtgggtccctcagtcgccgtgcgcttgtactgcacgctcctacacggtccggaagggggtccgggccctgccaggtagttcgcagctctgggccccgcttcttttcgtggcggccccctacccgggtggaacggacggaacacaacccacgggaatactttgacccggcggcgcccccaagcccacgacgccaggttcacagcagcaacctcgcgccacggggccgagcgggcgagttacgcgggcgaacacacacacacccggcccactatgaccccggaaggtccccgccaacacccggcgagtcacgcagcggacacggcgcaggcgaaagcacacggttctctggaaccaggacgctcgcgcccatcaccgcgccgcaaaacagagctggccccacaacgatgaggctcccg

SEQ ID NO: 695436 - DNA, 622 bp, Homo sapiens
tttgtatttttttaaataaaaccaaatgaacccccacaaaaacatctcactccactttttgctttgctcggcatctaaaagaattatgctccagccacttttctgtcacacatctgctgcctgtaaatggcagtgagcagcagtggatctttcattcgttaccgtggcctcctgaaagcatgggtgtgctgggcctttctgccacctgctttgtcgctgctgattttgacagtgctacgtagttgctaattttggtttcaggcttttgttaccacctccctcttctcccttctcatttttagctaaggaagctttggatagatattttctatgcatattactattaaagctaagactgtctagaatttctaaacaacaacaacaacaacaaaaatctaacttaaaatttactttttgcagtattgcaaaatgaatcctaaattattggcttaatcacctgtgttaaagaagtttcaatgcagaaactagacaaaacaactaacaaaatcaccatgtcctttattatttattcttgaaattagcaatctgtagaactgatcacattttgtccgagtagacatgactgggccaattgtatagccctgaaggaaccatcattttg

SEQ ID NO: 695437 - DNA, 636 bp, Homo sapiens
  misc_feature (2)..(2): n is a, c, g, or t
  misc_feature (268)..(268): n is a, c, g, or t
  misc_feature (325)..(325): n is a, c, g, or t
  misc_feature (341)..(341): n is a, c, g, or t
  misc_feature (349)..(349): n is a, c, g, or t
  misc_feature (438)..(438): n is a, c, g, or t
  misc_feature (462)..(462): n is a, c, g, or t
  misc_feature (466)..(466): n is a, c, g, or t
  misc_feature (473)..(473): n is a, c, g, or t
  misc_feature (502)..(503): n is a, c, g, or t
  misc_feature (520)..(520): n is a, c, g, or t
  misc_feature (585)..(585): n is a, c, g, or t
tngggcccacagcagcgtgaccggccgctcccaagccccgggcgcacaaccacagccaggagcagcccctgccaccactgggccaccgtccagggccccacaggaccagccgaagtgccccgggccgaggccagccgggtcaggtgtacccctagcctggggttgagtgaggagcggcacccccagtatcctgtgtaccccaagttgcccaggaggccgagggggccttgggctccatctgcactggccaccccgtgccaagcatcanagctgcgtgagcgggtttgtgtgtgagcgtgtggcggggcctggttgttccccttcnacaaggcttaatcgtntaaaagcnattccacttttcccgctcgggaaaaagccacagagcctggcgatgtcctcaaggggtcccggtggctccagtgcacccagcacactcancgcctctggctaggcaaaccagangaanaagtgtnagccgtgggcgaggtgcttggaggacgcnntggttgcgtggggagcncaggctttgatggtggcgtcgtcgctggccgtgagccgcagctcctgctcctggggactgaagancactgagttgaccacatcctcgtgccgcagcctggccagacagactgttgt

SEQ ID NO: 695438 - DNA, 310 bp, Homo sapiens
aggatcttgagctcatttcaggttcctttaaactggctttataagctcttccttaaaaagcttgatacaaaaggtgaagaaggccgggcgcggtggctcacacctgtaatcccagcactttgggaggccgagacgggcagatcatctgaggtcaagagttcaagaccagcctggccaacgtggtgaaacctcgtctctactaaaaatgcaaaaaataaaaacaaaaaaatttagctgggcgtggtggcatgcgcctgtagtcccagctacttggggagactgaggcaggagaatggtgtgaacctgggag

SEQ ID NO: 695439 - DNA, 473 bp, Homo sapiens
gggccttgctctgtgggtctgcccacggtcaggtgacagccacctccagggcaccgtcagggtggtgctggccacagaggctgcatgacctcccctcccggcgtccctcccccaacctccttccgcaactgggcttccagggccgtaggtgcctttctgcacacaggccgccaggactcgtggtgtctccaggctgtgtgactgcagggccacatgctgcctgcaaacagggcaagaccacggaggcacaggggtcctgctcctgatggggcctcaggaggggcggagaggggtggaagggagggagctgccccacctggacccccgctctccctgctgttgtctgagcagatggatggagtccaggcctgggggcttctgctgggccagcccggcctcccacacccacttggagggtgagactgcagtgggggttgtttttattaaaagcatcatggacacagcaaaaaaaa

SEQ ID NO: 695440 - DNA, 236 bp, Homo sapiens
  misc_feature (144)..(144): n is a, c, g, or t
  misc_feature (183)..(183): n is a, c, g, or t
cgcgtacagttgcggtcaggagcgcaggtctcattcagggtgagataatcttgcgtcgtaggcgaactgttcatacccgctgaggaagcgcctgttgggccccagctcgcagccatgattccactgcagggtgtgagacccggnctcgctctgattgtagtagccgcgcagtgtcggcaggtncactcgggaaaatctgtgcggtgcccctggggctccgtgtcctcgcgggtcca

SEQ ID NO: 695441 - DNA, 162 bp, Homo sapiens
tggtgacagcgcgagagctaaattgaggattcctgaatccagatcttgcctcctatgtgctgtccacctcctctgtgctgtccacctcctctgtgctgtccacccctcgtgctgtccacccctctgtgctgtccacctcctctgtgctgtccagctgtccaa

SEQ ID NO: 695442 - DNA, 480 bp, Homo sapiens
catgggtatatcccgccatctgtcatatagggtgttgggtccatccccacaaattgtcttttggaaccgttggacgcgaagagatgtgggtgatatccaactggttacgaagtttccttagactagcacaaaggggtgataataactggtctgagtttggagccaatttgctctagtaggctccagacttataggattctctttcaccaatagtatggggagtacactcttgtggaaggcaaagtcgctttttgctttgccattatgttccattggcgttcgagtgccaaagtgtggttatgtcgcacatctggtgataaagtcccgcgtgtgcactgaattggtttcaacgattgtgtttactaatctcctctgtcccaaggcgcaacttatgcaggggcccatcgtaggtgcggccatggatggtcctgaaacggttttgtgtcatggacgtgtgccatcctgagaaggcccaagctt

SEQ ID NO: 695443 - DNA, 191 bp, Homo sapiens
ctggaggtccttagcttaatcacttcacaagtgctatacagtaaagataaccgactctagcaggaacgcgtgactcaatggatcgagtcagggggatggtattcatcctgtagtatctctaagaccagctcatccttagagggcatcctgtgctgtccttatcccatacctgccagacggtgtaagatgcc

SEQ ID NO: 695444 - DNA, 181 bp, Homo sapiens
ccccccttggggtctttgggagtttgttttggccccccccccccgggccttttcgaggtgttgggcgactccgcccccttttctcaaatggggggttggtgtgtcgcgtggggggttttttttaaccccgctccttttgtgtttcgtcccctcgcctggggcccccctcccccctgttttt

SEQ ID NO: 695445 - DNA, 223 bp, Homo sapiens
gtatctccaccgggtgatggcaagtgacccgtcttccaagcgccgggcaatgcaacttcagtgttcacgtggcaataataatttaaattgacgctgcctttatgtttctagttatgtgcttaagtgacatacacagcacatgggacgctgggtgaatgagaagttgctgtagacgacctcttggcccacgggcactgggttggcagtgctaggcaccccccag

SEQ ID NO: 695446 - DNA, 666 bp, Homo sapiens
acagaaaatcagtaagaatgtggaaggtttgaacaacactatcaaccaacttgacctagttgacattgacagatcactctctccaacaagagcagatcatacatcctttttaactgcacacagaatttttaccaagatagataatatgtaatgctataaaacaatgttccataaatttaaaatgagtcaggtcacagaaagtacttctttctgacaaaaatgagttaaattagaaattaacaacaaaaatatctgcaaaaatccacagatattggaaactaataacacacttctaaataaccaatgaccagagaagaaatcaaaagagaaattaaaaaatgtttgaactaaatgaaatgaaagcacagcatatcagaatttctggggtaccactaaatggtactttgatagaaattatagcactaaatccccatattagacagtaagaatggtatcaaatcaatgatctcagctcccactttaaggattagaacaagaaaaaaataaactcaaaataagcagatgacagaaaagaattatcaaagcagaaaccaaagaaatagaaaacagaaacattcactgaaactaaaagtggttactcagagaaaatcaataaaattaataaacctctgcctagctgggtgcagtggtcacacctataatccc

SEQ ID NO: 695447 - DNA, 128 bp, Homo sapiens
cccccccccccccccaaaggggggggggggccattttttacccttttttttggggggggtttggaacggttttttttaaagtttttaccgggaacggtttggcctttaaaatttaaggggggccttta

SEQ ID NO: 695448 - DNA, 764 bp, Homo sapiens
gactgggtagttcagggtgaaatgtaatttcctccagtggatgagaatcatcaattgttcatgaaaaggcaatttcacccaaccctgagtcggtattgccaagggttctactccccaagtgggcttcccatcacaagggatctgaggtccaggtgggtgtggtgaggcccagcctgtcatgtatgccttccttccccagtctcaaatgtgagagacggactctgctccgtggacatgagcagccccttgaagggtggtctcattctctaacagtaacagcactgccagaaacaccccctgaatgccacacgatcatctcactttgggtcaggccagcagggcctcacgatcatttcttgaacttgaattttcagtgttattgaatctttaaacatttaaatccccaagcaaaaatctcattacagtgaataaaaaggaatccaatcaaacaagccaccacttccctaatggatggactacctacaactatagtgttttgttatttcaataacaattctatgcacagccaattctccataccaaagtactaaaaaaatgtttaacaagcatttttgaagaaaacaaagagaacttcattatggttaaacttgcttttcatctcagtgttgctttttttaacctgttaataacattgattcttaaaaagtcctaatcaaacttctttatttggatgggccctaaatattcattttcagatttctcttcaaaagtttgaacatcatcattaaaaaaaaaatagcatt

SEQ ID NO: 695449 - DNA, 385 bp, Homo sapiens
tactaggcacttccaaaattatgatacagtaaaagcaaacttaagattcattaatgccagctgagacagtggagaatatatgaataaaaaataaaatttggggtctggcgcggtgctcatgcctataatcccagcactttggggggccgaggcgggtggatcacgacgtcaggagatcgagaccatcctggccaacacggtgaaaccccgtctctcctaaaaatacaaaaaaacagccgggcgtcgtggtgggtgccagtagtcccagctacttgggaggctgaggcaggaggatggcgtgaacccgggaggcggagcttaccgtgagccgagatcgcgccagtgcactccagcctgggcgacagagcgagactctgtctcaaaa

SEQ ID NO: 695450 - DNA, 624 bp, Homo sapiens
  misc_feature (21)..(21): n is a, c, g, or t
  misc_feature (26)..(26): n is a, c, g, or t
  misc_feature (42)..(43): n is a, c, g, or t
  misc_feature (46)..(46): n is a, c, g, or t
  misc_feature (48)..(48): n is a, c, g, or t
  misc_feature (51)..(51): n is a, c, g, or t
  misc_feature (54)..(54): n is a, c, g, or t
  misc_feature (56)..(56): n is a, c, g, or t
  misc_feature (59)..(60): n is a, c, g, or t
  misc_feature (62)..(62): n is a, c, g, or t
  misc_feature (65)..(65): n is a, c, g, or t
  misc_feature (68)..(69): n is a, c, g, or t
  misc_feature (73)..(73): n is a, c, g, or t
  misc_feature (101)..(101): n is a, c, g, or t
  misc_feature (109)..(110): n is a, c, g, or t
  misc_feature (141)..(141): n is a, c, g, or t
  misc_feature (154)..(154): n is a, c, g, or t
  misc_feature (158)..(158): n is a, c, g, or t
  misc_feature (177)..(177): n is a, c, g, or t
  misc_feature (184)..(184): n is a, c, g, or t
  misc_feature (186)..(186): n is a, c, g, or t
  misc_feature (199)..(199): n is a, c, g, or t
  misc_feature (201)..(201): n is a, c, g, or t
  misc_feature (210)..(210): n is a, c, g, or t
  misc_feature (216)..(216): n is a, c, g, or t
  misc_feature (224)..(224): n is a, c, g, or t
  misc_feature (319)..(319): n is a, c, g, or t
  misc_feature (333)..(333): n is a, c, g, or t
  misc_feature (358)..(358): n is a, c, g, or t
  misc_feature (364)..(365): n is a, c, g, or t
  misc_feature (368)..(368): n is a, c, g, or t
  misc_feature (428)..(428): n is a, c, g, or t
  misc_feature (435)..(435): n is a, c, g, or t
  misc_feature (455)..(455): n is a, c, g, or t
  misc_feature (491)..(491): n is a, c, g, or t
  misc_feature (493)..(493): n is a, c, g, or t
  misc_feature (539)..(539): n is a, c, g, or t
  misc_feature (551)..(551): n is a, c, g, or t
  misc_feature (563)..(563): n is a, c, g, or t
  misc_feature (575)..(577): n is a, c, g, or t
gggctcataatggagaaggtnaaagncagatccccgtggccnncgncnagnagntnctnnanagnatnncggncaagtgtttccggaagtgtatagggaancctggggnntccctggacaactccgagcaaaagtgcatcnccatgtgcatggnccgntacatggacgcctggaacnccgtgtntngcgcctacaactngnggttgcagngggaangagccaanatgtgaccggggagggggggccccccccccctgtttatttccataaaagtgttttaaaagggggggtccgcatgtacgtactgcctgcccggggnttaggagggtggcnccggtgttgggacaaaggggattgngtcctnnccnccccccgccctgccccctgccagccagtgcagtttggatttcgggggtggggggccctgncccttcntaaagtggtggcagcccagnggcccctccttcaggcctttggggtattcccctagngngcccaagtcaccctcatattttggggggacagcttgtttggacttnggagttgggggnggtcaaaccccncaggagctgtcnnntcctggggatgggcaaataaattggtggaggacggagagaaccctca

SEQ ID NO: 695451 - DNA, 368 bp, Homo sapiens
  misc_feature (130)..(130): n is a, c, g, or t
ggtcatggctcccaggaagaggcgcagcaggtcccccaggacacaaggaagggacagctgaagcactaagcagtcagacagtcacaggtggcaggattccggaggcggtctggcccccccaacaccaggncaagggaacaacggagcaaggccctgttgctaagacgtgaccaaagccagtgctcctggagtgagtggggacacaggtagagaggcccccttcagccaataggcatctcttacatttaggaagctgctgcattgtcctcagccatgagggctggggtcaagtctccatgcatgcgcctggtcctttgcccaagctccgttctttgcccaacattgcatttgcacccagggggggttac

SEQ ID NO: 695452 - DNA, 151 bp, Homo sapiens
cacaccaagcgaccccctcgcgtaccaataaccagtccggccctgagcgtaaaattaacagcccccgcgtatcacctgtcccaggacacttcgtaacagccctagaccctaactaccgtaccgaacaaacttaaaagtaaaatcccggcgt

SEQ ID NO: 695453 - DNA, 174 bp, Homo sapiens
cgatagctttaaaatggctcatcatcttccagcttcttaaacttagtgcctgttcccagactggagaccttgtggatgggtggagagtgtggagggtattgctgtggtcctgcctgtgcagggtgcactggcacctgtggatcttaaaacttgccagtgcctagttcctcctga

SEQ ID NO: 695454 - DNA, 575 bp, Homo sapiens
cctgccccactagctgtggcctgcgagcctcgtgtgagcctggccgtattcccgcgtctctgcttagtgggtgcacatgtgctgcatggcatctggccctgtgccactttccaatgcgctatctgtgttgctgctgtgtgctgctgttcttgtgtgattactgtgtgccctgtgtgagtgctgccgtgcccttcctgttcctgcgcctgtgtttgcctcttcatgtgaagcatgctgatacctggaggatgatgctgcctgtgagatgtttgggcttcagttgcgtgatgcttctgtgctgcctggggcccatgccctgtgctgcccccgcatggcctggcgccatggcctcctgggagtgtggcctgagttgcctgcatgcatggatgaccacctgccccgtgtgcctgcagtacttcgcagagcccatgatgctctgactgctggccataacatcttgttgcgcgtgcctcgcccgctgcttggggcactggcagagactaacgtgtcgttgcccgcagtgccgggagaccttcccgcagaggcacatgcgtgccaacctggcaccttggcca

SEQ ID NO: 695455 - DNA, 222 bp, Homo sapiens
ggaaaccagatgaagaagatgagattcggaggattgaaagaaaaggccaagatttaagatgagaaaaggatgaaggaaagaagaccccaaaggaatttctgaatttttgtaactgtttttaagaatgttgactttctcagtgatattggtcaaggacaaggtgaacctattcttaaggacctttaaagatatttaagtgaagtctcagatagctcggcccac

SEQ ID NO: 695456 - DNA, 872 bp, Homo sapiens
gaacgtgcggacattgtcagctgcgtttcctgcggtcgcggttgaggagctcaagcttgggaaaatggttgtgcacttcacttgatattcgtgctagttcgcacgattcctggctgctgggatctacaagagaaattgcctggtagaccatcatataatagccctcatggatttactccgtccttcggttagtgcagtcatatagggctgaacgaaagactaaatacacatgaatccgaagtgattacagaatcgaacaggtgaagagatcaaagctttacaggggtggcagagcgatgagatggagttagccaggcagaaagggagccagcagtagaatctgttgatgaaagagaaagacctagagataatttatcgcgtaagaggaccccatcgatttaaatgaatggcatcctggataatgatgcagagcatctctcctgtgtaactccgtcgtctgaccttgtttatctgagaccggaagttccaggataggagtcgtagatatttaggctgcatacgtaatctaggaagagtatagtgatatccgtactttagaaagtgtagttagttatatttaagtgagcctcattcctaagatgccttttttcgttaagtgtagctttcattgtctgttatcgctgtgcgaggtaactatgattcccctagaaggtcgtgccagtaggacatttatgttagctaaatcagcaactttaagatcttgtgggttctctaattcatatgaatttgcgtggtttggtctaatttctttggggctcttctaatttgagtgggagtacaatttttggtggtgaaacagtcaggtggagactggtgcggggaaatgaagggtcaatttgggaaggtaatag

SEQ ID NO: 695457 - DNA, 207 bp, Homo sapiens
accgtccttgcctggacggcagcagccctgtactgccttctccatcatccccagagcgctctgatgacgctgcagccgcagggagggaggggctggccgagggagaggcagcagggaacgtgggtcagggtggggcaccagtggcctcaggtgcggtgcctcagggaaatacatctttagtgaacgccaaaaaaaaccaaaacaaga

SEQ ID NO: 695458 - DNA, 546 bp, Homo sapiens
gttcactctccgtcagccgcattgcccgctcggcgtcggcccccgacccgcgctcgtcctgcccgcccgcgcgcgcgcccgcgcaaatgaacgccaggtgcgtggtacgtgctggctcctcgtgcgtgaccgcgctcatgccatcagcgacgaggaagcccgaacagcactgagctacacgatgcccatgcacgattcttcgcacagccatagatagccagcagccaaccgacaaagcatcatcaaaatatactcaacacaaacaaacctgtagccccttacagataaagtagccacggacagaaagacaccaaccaccaccgacaacatgctagtatgcaaatttgaacccccgggaaaagcctaaaaccgctgcgacatcccaaggcacgtaaccactgagcagcaaaacgcattataacaccacatgctacacacaccacaactaaacaccaaacagcatacgaccttccatcgaaatacgaaacgcactacgaacgaaacactaagaaacctcgccaagcagaatgaagacaggaaacacaa

SEQ ID NO: 695459 - DNA, 225 bp, Homo sapiens
  misc_feature (32)..(32): n is a, c, g, or t
ggcccccccccccccccccccccccccccttngggttcccccccccccccccccgggggtttttttttaaacccaattaaagccttttttaaaaaaccccctttttttttaaaaggggggggggggatcccccccccccccccgggttccttttcccccccccgggccccccccaaaacccaaaacctttttcccccttaaacaaaaaaaaaagttttttgggga

SEQ ID NO: 695460 - DNA, 131 bp, Homo sapiens
ggggggggggccggggtttttttttgggccccccccccgggggggaaattgggaaattttttttttttgggggaaggttgggggggggttttttaaacctttttaaaaaattttttttcccggggggggga

SEQ ID NO: 695461 - DNA, 1019 bp, Homo sapiens
atttgccccacgactcagtactgtttaaaaaaaaaaaatggagcatgtgtattatgtggccaatgtcttcactcttaccttggttttgagcagtaatataccattcctccactgcctctacacatgctgaaccaaatacatcgtgagggggagcgcgagatggatgctcgaattgtcaccactcagaaggatacagcataatgctaagacaagcatccaattcttgatgtaagccttccactgtccagcagtatttcgaggttaccatggatatgctattatgctcataacgtgaatgtgagcgtggtagaattgcgtattgaatggataggcagtcgagcagtacactagaaagatgttgatcgtcattttcatgcattgttaataacaggaatagaccgtgtctctggttcgtactagagaaatggacatatggcgaagtcaaatactaccgcgtagtattcctaagataggggtctcaaaccattttggtaattttgcatttagagttggttaagagaggctttgtgacgactatttagttgagatctaatcttaccagatagcgactggtataaatgattagcgacttgaagtaagtgattgcaaagttgtcaaagtggatagagtgatctaacttaatagctactgactacgtaatcgatgggattacttgcttcagctaacgttgcattaaaccactgagttagctgcctggattacatcagaatgggaacacaatctttcgtcccattgcaaagcatgtaatcgtatatactgtggggattagctccaagtgttggacatcaaattgatgatgttaacacgttcggaaagagcgaacttattcttggccaaggtccagggtaaaggctgcaacaggctgttcacagggttgacacccttggcctcttgacctgattcattgcagacatatatgggccaatatggatcaggggtagctataatggggccgccattactcctggggccctaaaacaataaagggatcggggacc

SEQ ID NO: 695462 - DNA, 380 bp, Homo sapiens
tcccctcctaccccagtccctaaaagaaatggggaaaaaagaaacccccagcaattcagaaaaaaaaaacaagagagagaaattcttattcttattattattataaaacaatattttttttaaaagactgctgcatctttaggaaggatcagaaaccatgctgcccttaaaattcacaacttgtgtgtgcgcgcaagtttagcaacaaacgtacccgtttggcaagccccccctttttttggcctttttgcacgccccttccattgaacaaagatttttcactttcgacccatcctttttcccagttgggaaggggacattcccactatttttcattcatttttgcttttttgaaaaataaaattgaaaaacctccttca

SEQ ID NO: 695463 - DNA, 314 bp, Homo sapiens
attcgcggccgcgtcgaccctcagcctcctgtgcagctgggattacaggcatgcaccaccacactttgctaatttttgtatttttagtagagatggggtttcaccatcttggccaggatggtcttgaactcctgacctcgtgatccacctgcctcggcctccctaagtgctgggattacaggcatgagtcactgcacccagcccactacttgggttttccgttttctttttttcttttttttttgagtgttgccagaactaccaataggtaaaatataatttctcaggtagtctatacaattttccctgccagt

SEQ ID NO: 695464 - DNA, 876 bp, Homo sapiens
gtagttgtgtttacaccgacaaaggaaatgtgctgtcacgggggtttttttagagattccccgcccttttgccggagataccctcggggtctttgcccacatgaaaggaatggtgccgccccgattcatttgaggcctaaatgggtcctcccagaattgcccctttagaacgtctgtgtccgcttcatatgtacacccccctccctcctctcctgatgtttctcgggttaatcggagaggggtaaaactcaaatacctaagagtgtctcgaccacaaactgggaagagtttttttttcttaaatacaccaatggaatggtatacaatgcggtttaaaaccttaaactgtgggactaagatagagaaaaatggaagttatatataagggcgctttttcaaaagtcaaatttggtcgcccataatgtttggagcgcgccccaacacttgtgaagaggtataacacccacaaatattgtctcccacctgtgttctccccctttgattcttctgaacaagacaactggccttttgccccctcttttttgatttcagacacttgtggtgaaaacccgctgtctgaatggggattctataatggcagcatagccctgctctgtgatgcccccttctcccccccaatactgtataaaatcgatgggtgcttgctagtaagttcgaccccccccactctctgtgttaagactcaaagcgaaattggtggagtccccccctcttatgattttttatttttaatacatagcccggtttttgaaaggggatctcccttcccctcgatttttttttttttttaaagaaaaatggggggagaaattaattaaacctttgttttctcccataaaaagaattccattttta

SEQ ID NO: 695465 - DNA, 376 bp, Homo sapiens
ggtggccagggctgggctacatactgggcagtgcaggtctagtcagtgaggtccttaaggtctcgtggttcttccaattgcacagctccaggggccactcctcccactgtgttctgctctttgatgggacagccaagggatatagtgtctctttcctctccatgcttccagcacccaagacagagcctgacatacagcaggtgcttaatacatatctgaacaaatgaatagttgggactgcaggtgagaagtgagggcaaaagaaatgaatttcactgggctctcaagtttcaatttttaatgaagatgtgtaagcacaaagaagcacccaggttctccttctgagtgacaagagatgtcatttaggtgagattaa

SEQ ID NO: 695466 - DNA, 569 bp, Homo sapiens
  misc_feature (39)..(39): n is a, c, g, or t
  misc_feature (112)..(112): n is a, c, g, or t
  misc_feature (125)..(125): n is a, c, g, or t
catctgctggactcctctagctggacctaaccctggtantatagataccaccagagctctgcagatatgcaggtgcttgataaatatctattaaaggaatgaatgagtcatntgctcacagtttntacagctcttgaagatactgcttatagagtatgtggcaatatatggatacattataatgttaaattttaaaggcactatatatggaattatctccaagtaatattgttaaattttaaaaacaaggaacaaaaacagtgtacacagtaggctatcattttgtgaaaagataagctctgttggcaaaagaatatccatacacatatttccttgttaatgggtaggctatctatggaagaaaacgaaataaactggtaacagcgagttagggtggaatggggggcaaactgggggactaaagatactgataggaaggagacatgttttatttttaaataacccctttagtctgtttttgaaatttgtaccatgtatatgatacacgttttgaaaaataaagcagtctacaaaacggtatgcagttgtatgaaaaaaagttaggagtt

SEQ ID NO: 695467 - DNA, 708 bp, Homo sapiens
taagtcttaaggcatcggctggcgggtgtcgggcccggggaacagcgaagaaccaagattggctccaacgtttggcccggtctctggatatgtgactggacgtgaatgatgcttcattttgggcaccccctttcccggctcaaggtagaatggttaaccattgaaaaaaatcccttcccaatcagaataacaaccacagggacaacgaagaaaaggagtaaggggagaagaagggtgaacagctggaagaagtctttacaactctctgcgggtcctggtaaacgcgctcatgttctgggtatggaagggacttaagaattcaggaaagatcaaaataacggggctcttccccactccctcggcctccctttcccggtgctggggggttaaggaaggtccgtggaactccagcactctagaaggatcgggtgaagcgcgaaggcttgcgggcgggtgaaaccaatgtggggtggaagggtccaaaccggccaatctgaacccgaaggctggtgagaagcatggggggcttgggataattcccgaatgacggtgtgcggttctaacctgtttggggccttctttccccaaaatttgttatcttccaaccggggggaggcccccagaatccttgtgggccagggcgggaccgagctgggattcagagccttgtgactcgtcgggccggtccctaatgtggaccgttgccct

SEQ ID NO: 695468 - DNA, 240 bp, Homo sapiens
ctatagcggatccccctgctccgcccctctctgctagtgagcaccgctagagctttcgttaattcctgagtttccagaaacactgagtgcagcttccgttagacttgctctctagccaccgccgctgatgatgattgggggctgaacattcctagggtgggtccctaggcctagggcctgacagggctgagtgtcatagggagttacaccttgaggggtggccaggcatgatgtacccca

SEQ ID NO: 695469 - DNA, 126 bp, Homo sapiens
gtatagagtaaggagccgtggggatctgtacatcttcccacatcctaccatgccctgaggcatggatcctcactatctctgacgcctccatctgtcttatctagtaacagtgcagagagatagaag

SEQ ID NO: 695470 - DNA, 832 bp, Homo sapiens
gctctcgccgcatgctgctggagcctgaagcagagaaggcagcgggtccgctgagcgtcccgagagccccgtgctcccgaccagtgtggcggggtgcgtgcccgtgggagtggctggggcaggtgcgggtggaagaaagggggtttatgtgctgcgccgggagggacgggccctcttccgaatgtctgcggacccaggctctcctcacgctcgcgcagtctccgacgcagtctcagctgcagctgcaggactgagccgtgcacccggaggagaccccacggaggaggcagacaaacattcgcagatgccgcgacaccaaacccagaacctggcctgccagcatggcccagactgttacctagccctgatggcagacctggtcctgtgccaggctcctgcagactttagcagatgttctggaaggagacagctcagaggaccgagctatatatcgcagtgcgcatcgcgggcgacagcaccactgcagggcgtggcatcggacggcgaccatcaacatcaccttgaccagtcacaaataacctgcgggacacccgggccgaagccgacgggactgtgacatgggactcatccagcgggattcaagatggaattacgcttgataccgagggccaggaaaggccagagggtgcatggatggcgccggagacggtggagcggtcaaagggtgaacagaaagggcctaaaccggatcccgggatggaaacaagacctgcggtaaccacagagaatggctgacaccggaccgagtacccctgggacgcagcgagagcatggacccgaaggagtcagggtaactaacggtgagaggaca

SEQ ID NO: 695471 - DNA, 335 bp, Homo sapiens
agcgggtgcgtagtggcacgcacagcagccgcagaccgcctcgcgcccggtcccgcggtcgcagctccagccgcctcctccgcagcagccagcgcctcagctgctcgctctgtgggtcggtccatctccggcacttgggcctccagtaccgcgtcgctcacaagcccttcaggttcgttccactagtgtactcctcccttctccggccagaaccagatacccgtcgaagatggtggaccgtcgagacacactggtgcacacaagcccgtgcctggtcgagctcacgacggacgcgactacgaacgatcattggcccgcaggccaatgaacaaacg

SEQ ID NO: 695472 - DNA, 276 bp, Homo sapiens
ggaattctcctgagtttcatttttgtgactggtacttgaagtgcatcagatgattaacttcatgattagagggctatggggtggtgatatagacatatatggaaaatgggatacccacattaagcagggtgactacctgtataccatacaacccagcacaagaaccacatgtagttcttgtgctggttattaaagagaaaggatatataaggacagaatggaaatgatggcccaaaattaaaaaaaaagggaagtttttccgaggaaaaaaattcc

SEQ ID NO: 695473 - DNA, 194 bp, Homo sapiens
atcgttcagagatcacctcactcattcacatgatagaaactcttctttgatactcataatgcttgatcattatgagagtgttattatgaaagagggaaatatgttcagctgcttgaagaaaatgaccagaaatacattaatattaaaataacgctctcggctgggcgtggtggctcacgcctgtaattccagca

SEQ ID NO: 695474 - DNA, 276 bp, Homo sapiens
ggtctgtgagaaaaaaacacccatggaagaagttacagagacaaaatttgcagctgagatgaaagaatgggcaatctagagactgccatatctgggtatccattccataatcagctttcaaacgctgacaccattgcatacactagcaagattttgctgaaaggacccagatattgctgtctcttgtgagattatgctggggcctagcaaacacagaagtggatgctcacagtcagctgtcgacgcgccgcgaatttagtagtagtaggcggccgc

SEQ ID NO: 695475 - DNA, 802 bp, Homo sapiens
  misc_feature (1)..(1): n is a, c, g, or t
  misc_feature (670)..(670): n is a, c, g, or t
nttgggggtcgccatcttttgtccacctagcgcgccgacttgtgttggtacaatccaaattcggccattatggccgggggacaatgtttttttatatcggtcaaacgtcgaaggagacagtagcctatgacagactttccccaaaaaaatagccaaaatgtacaaaaccacaccggatgtaatctttccttttggatgcgaagctcatttaggaggtggcaaaacaattggcttagacttgatctatgttttcctgggtcatgcggtgaaaaatgaccccaacatagacttgcaagacaatgcctgtaagataagaaaaataccgtaaagaaagtcactaagggaacgcaggacctgaaagaggaaagttacggagactacaaaggccaatgcaggtcctatcaaaaagcggcctggaaatagaaacacattcgaaccagtaaaggtgctgtaaagatggaaactgtggccacttggcgttttacccaggaccatttttagcccaaaaataataaattggaaaatttatttaccatgcttggggggtgccttcaaaaataattatagataagggcaatttattgcacgagtgccccatttcaagaaaacttggggaaacttgccaaagggggggaaccccccaattgacccggccgccgttttaaaaaangggaaccggggaaaccttgccttacccaaagaaaaaggctggaaaaaatctccctttaaaaagatggcgaaataaaaaagagagccgaaaaaaaagccctttaaaaagagggggagcccggttaaatatggg

SEQ ID NO: 695476 - DNA, 259 bp, Homo sapiens
attaggcgcgttctgcgtagcccgcgtagcgcaggctcattgccaaacatggctggtccagcaggtatgggcacatgtgctcatctccgcctcctgcgccaacatgttcttgggctgccactgctgccccttgagcatagagccatcttgccaatcgtggacatgttcactattgctggtttgttccatccagagcaaagggggacaggtgacatgaatctgccagcatgcaaacaacgcctgtggacatttggtcttg

SEQ ID NO: 695477 - DNA, 484 bp, Homo sapiens
  misc_feature (111)..(111): n is a, c, g, or t
  misc_feature (178)..(178): n is a, c, g, or t
  misc_feature (189)..(189): n is a, c, g, or t
  misc_feature (239)..(240): n is a, c, g, or t
  misc_feature (292)..(292): n is a, c, g, or t
  misc_feature (384)..(384): n is a, c, g, or t
tcagtcgacatacggttgacataggaaagctgtggaaagcttgtctgagaaggagtcagtctctcggccctctcccacccagtctggttcctccctggaaggtgacttggnagcctgcccttcggtgggggactgtcctaaacggaaagcagtgcacggcatggccttcactccagcntcctccttatnttggccccagagcactgggaacctaggaacagacacaggagggagggaannggatccacttggtggctgaggaacctggatgctcgtgaccctggggcgtgcnctccaagcagggctggaggttgatgtcgggaatgagtgggtcttcagtggtcgcccccatggctaggactttggcaagaaatccacctaagntcatagaacaccagagaaagcagtggggaggcccttattcactgtgagtagcagaaacattgtccaagaagggacctacagcatcaggtgtgggtaccag

SEQ ID NO: 695478 - DNA, 81 bp, Homo sapiens
cccgaggacacggccgtatattactgtgcgaaagccctttctggcgattataggcactactttgactactggggccaggga

SEQ ID NO: 695479 - DNA, 621 bp, Homo sapiens
atcgaaaagcaggcctaaaactcaaataaatagaatagatgcagagaaaactcgagctgcagctgatcaaaaagcaaggccataaagcccaaatgaatagaattgatccagagaagactcgagctgcagctgattgaaaagcaaggccataaagcccaaatcaatagaatagatccagagaagactcgagatgcagctgatctaaaagcaagtccataaagcccaaataaatagaatagatccagagaagactctagatttgctaatttttccaactccacattcagctactggtgttattgttcaagagcaagatcttgtagaatggctttttcttccacatactaattcatggcctctaactccttatttggatcaaattgctactatgataggaaatgggagaactcggattgttaaattacatggatatgatcctgaaaaaattgtccctctcacgaaggcacaaatacagcaagattttataaatagtcttacttggcaaacccatttagctgactttttgggtattctcgataatcattttcctaaaatgaaactgtttcaatttttgaaattaactaattgtattctccctaaaataactaaaccaattgaacg

SEQ ID NO: 695480 - DNA, 295 bp, Homo sapiens
aacctgtatcccgatcatccaagaagagcgaagaacacgcgctcccagtacacataaggtctaccgcttctagacacagagatggcccatacagctcttaactataaaaaccagctgctgtgcttccattctgagtacagaacacaagagatgccaacaataatgagaccttctactaccaatagatcctagctaatcaaatatacctcaaattaataaaatgtataaacatttatactcatttatatgttcataaattcgcggtatatttcatttttctatgactccctggccc

SEQ ID NO: 695481 - DNA, 309 bp, Homo sapiens
cgtgacgcgtaggatccagcaacagggtggtggacctcatggcccacatggcctccaaggagtaagacccctggaccaccagtccccagcaagatgcacaagagtgaagagatgagaccctcactgctgggtgagtccctgccacactcatgtcccccaccacactgaatctcccctcctcacagattgccatgtatgaccccttgaagagtgggacggggcctagtggagcctgcacctttgctcatgtaccatcaataaatgtacccatgatgctcaaccaaaaaaaagaaaaaaacatgtggcgag

SEQ ID NO: 695482 - DNA, 271 bp, Homo sapiens
ccccccccgggtttttttttccccccctttaaggatgggggccagggccctggggcggcccattgttttttttttttccccttttttttcccaggtttgcccccctttttccccccccggggggggggaaaacccttttttttttttccgcccccgggggggggctttaagggccccgtttggttcccccccgttttaaaaccccccggggccccccccactcctggccttttttggttttcctttgttccccaaaccccaatgggtttta

SEQ ID NO: 695483 - DNA, 170 bp, Homo sapiens
gaaagtttctgaacttagtgatgatttgtgctttttcaggacaatttgtggtgccagcacttaagcgataaacatccccctttaaatagagctgatcgggttttattcgcaggcggcgccgccaaaatattagggggcggaggtgtatttttcctgttaaccttcctcca

SEQ ID NO: 695484 - DNA, 1975 bp, Homo sapiens
  misc_feature (1810)..(1810): n is a, c, g, or t
gtgctgtgcgcgggtggcctctcgatgctagtacgtaggttgcgcggcggtgtatggttctgctgagagcgccttgataggccgtatgttagcagaggggcggtgagtagctacatagagagagttgtgtagatcgccgagcataggtgcccgcgtgcagacgcagagtcctgaggatgggcgggcacagggctggaagggggtccgatgggtggggatgaggaggatcgggggtgagaggggtcgtggtgcccgggcagtgtagatgtctttgttgcgggttatgtgaggggccaagtgaggcacagggtcgtaagtgaatgcacgggatagtgcgttgtagtcgtgccaggtgataccggtcatctcggtggttatgctacccgtgagagcgagagttgaatgcaggcccactcctggggagtaaaattgttcgcaccggtgggcgcaccaaattgtgttgagctctggaggtcgccggagggggtctgttaaccgcgtggcgctgagtggaacggaaaggtagaggttgagtagaggggcggggcgcgttaatgtgtgaggtgtgtgcgttggctggagtgaggaatttagagtgttggcgagtagcgttgttgtcaaaccgaggtgccgagggagtgccctgatgtagattgaggtattgcgttgtggttgggtgagaaggggatttgggaaggtggttgaggtgattggggtgttgatgttgtcgtcaatgtggggggggcctgtatagtaggtgttgtggtgttgttgcggggaagggtttaggttgagtgggatggtgggtggtgtatgtatgtcgtgtttatggtctagtattagtgtaggtctgcgtttaggtgtgtagagtagggtggtgggggtgttttgggagggggtgaatgtgtgtgatggagatgagggatgtcgacgtttgggcaaggtgagtgttgtggaagagtagtggggtgtgtatgtagtttactaaggggttgttaagttgggtaggaagtgtgggtatggtgtgaatgtatgaatggtgtctttggtttgtgggggtgccatgggtagtatgtggtcgtggttgtggcggtagaatgtgtgtgctaagggcctgtgtttgtgtgttgtgtggtggtagagtttgcgtggtgtcgttgttgctattgattagtgtattagtagattgtgctaggaagtcttttgttcgttggactgggaggtggtgtggtgtgtagcgagaaggagtagttatgagtgtgtggtgttagtagattggtgtcctagtggattattatgataaataattgtggatgtgcgtgagggtgcaggggctgtgttggcaggccagtatgtggtcagaagtggtgctgtttgctagttggttcgttcgtgttttgatgtgggttgagttttgcgtgggtctgggcagagaggacgctggagtgggagtcaggcgtggtggagatgatgtagtgtgcctagcgctgtagatgatagggcgagagtagtgcgtggtcgccggtgtgcgtgtctcgtttgagagggatgtatagagcgtagtggcgtgtgcgttgtgtgtgtgcgtgtgcgtcggtgttatagcgtcgtgagagaggaggtagtcatgtgttaggagagtgcaggaggcgtgccgcgctgcccgtgtgcaggaggtgtaggtggattaagctgcgtggaggttgcgtgggtgccagaagtcgatgtgtgcagcgtgtgcgcagtgtgtgtgcagaaggtgtagttgagaggtcagagtgcagtaggtgtgtgtgcagaggtgtgtagnatagtgtgtagtgttcgttgaagtagttagtgagccagagatagttgttagtgcggcttagttaatgttgtgtcagctgtagatttgttgtttaataataatgtaatcatcgagatgatgcatattgttacactactattaattttaactccagggatcagtgtc

SEQ ID NO: 695485 - DNA, 274 bp, Homo sapiens
ctgcagcacacatatcatctaccactctgatgacacgccagcttcccacctcatccaaacttgcacagcactgtttacaatagctatattatagtaaaagacataatgaatcaactctaatacatgagtttgtattccactagatcatgaagtcatccagcacagggattatatctcggcacctggcagagatcacagaccaaggaggagctcaatcaatgtcccttgaagtacataaaaatacaaatttatctagctgtggtagtcttctacg

SEQ ID NO: 695486 - DNA, 541 bp, Homo sapiens
gtactgcagctcaagaaagcaacagaatatgcatcctcacatcatcatatgccacatactctaaaatcaagccacataattggacataaagcaatcctcagcaaatgcaaaacaactgaactcataccaaatacacactgagatcacagtgcagtaaaaatagaagactaagaaaattgctgaaaatcatgcaattacatggaaatcaatcaacatgctcctgaatgactttttaataaataatgaaattaaggcagaaaacaagaagttctttgaaaataatgagaacaaagttgcaacatactagagcctctggacatagctaaggcaatgttaggagggaaatttatagcactaaatcccacatcaaaaagttaggaagaactcaaattaataacctaacatcacaacggaaagaactagagaagcaagacaaaaccccaaagctagaggaagacaagaaataactgaaaatccgagctgaattcaaagaaaccgagacatgaagaaaaaaaaattccaaagatctacgaattcaggg

SEQ ID NO: 695487 - DNA, 546 bp, Homo sapiens
  misc_feature (402)..(402): n is a, c, g, or t
  misc_feature (502)..(502): n is a, c, g, or t
taaactttccctttttggctgtctagtcatcctcgtcggtctactgcttctgggtatcgacattcgtcatcctcatcatcttcagcgtgcccgcttggcccgtagctgactcagcttcctcatcttcagtctccatcctcttcctcaccatcagccttcttcttcctcctcctcttcctccccacctttctttccctcttctgtggcggtctataccctcattgtggtcagccctccgtggctccccatttttccctcattatagcatttcccggtatagcaaggggggcgtcttctttcacattttcgtgccctcttccaacaagcttctcctttctttcctcctttataagtctcctgtgggtggtgtgaaatttgcgaagccgtgggtgttctatacgngctgtggcgtatctgtgacatgtggtgtgggtccacgcccgggtgaactccgatgtgccagggggaatatacacaaagaaagagccgagaagttctcagnggagacctcgtgggcgaataaaagcgtgtccggaagactccggc

SEQ ID NO: 695488 - DNA, 375 bp, Homo sapiens
ggaggcgtctagaggatcccaggctggcggaagaagagcataggaacaagcatgagctacctgaacgggtgcgcggggagtcaaggcccagctacaagcagctgctccagcatccaggaggtccggcggtgcacacgggctgagatgcctgacaacctttacaccttggtgctgaaggtgaaggaccggacagacatcatcttggaggtgggagacgagcagcagctgaattcatggatggctgagctctcggagtgcacaggccgaggcaggctggagagcacagaagcagagatgcatattccctcagccctagagcctagcacgtccagctccccaaggggcagcacagattcccttaaccaaggtgcttct

SEQ ID NO: 695489 - DNA, 199 bp, Homo sapiens
tgtggaggctgattgagacggtgaccagaattccctggcgcacagggtccaaagtagttatgatagtaagagccggcatggtggagataagaaggcttgtgatggaggccagaggtggcctctgtggaggagaacccggtagtgggcggggcagggccggcctccttgcagcccactctggtgctcccagacaacacat

SEQ ID NO: 695490 - DNA, 738 bp, Homo sapiens
  misc_feature (572)..(572): n is a, c, g, or t
  misc_feature (594)..(594): n is a, c, g, or t
  misc_feature (608)..(608): n is a, c, g, or t
  misc_feature (637)..(637): n is a, c, g, or t
  misc_feature (639)..(639): n is a, c, g, or t
  misc_feature (645)..(645): n is a, c, g, or t
  misc_feature (656)..(656): n is a, c, g, or t
  misc_feature (666)..(666): n is a, c, g, or t
atttagcatctattattcctggcagtgccttttaagattactagtcaagagaaaagattttcctcatttagcttagcattttgtgagctgccttggacagttatagtaaaagcttcagtggctttttcagtatagtaaaagcttcactgtatataacaaactttgctggtacttggtataaggagtagataaagcccttcagcttgcttacagtggcttgccatcagtagcactgccttgcagatacccgtttgacctcatcttcctccactgacccagttttctacttccaacttttctaatacagcttgcaacctctggcataacttcagaccttggccattggtctcaactgtttgaaaacctaaagattactcacccatcacgcttagttttgcagcatggtagggggaatgggaagtaaattcttcttaaaaaatttttttatgttgggctcggcacgatgctcacgcttgtaatcctagcattttcagaggccaaggtgggcacatcacttgaggtcaggagttcaagaccagcctggccaacatggtgaaaactcatctctaccnaaaaaaaaaatacaaaaattanccgggtgtagtggngcgcacctgtaaacccacctacttaggangntgaggngggagaattgnttgaacccgncaggtggaggttgcagtgagctgtgatcgccccactgcaccccagcctgggtgacagagcgagactccgtct

SEQ ID NO: 695491 - DNA, 627 bp, Homo sapiens
gacagcattatgtctcatgtatagattgatcagcaggaacatctgaatgtacactcagccccatgtaatgtggatccataatttccaaatgtcatagctcttatagatgctgtctatctatatccatgctatgagtcgctgtacagtcgagatctcgcaagttctataacaggtaggtcataccatgctccatgtatcgagccatctaatccccaggcttcatgctatacataataactgctagtaacgcgtaaacagctattagatcttctgagactagtagccaaacacatctactatcaagatacacaatggatctacatatcattcgtctcactaggtaaacactggtatataatccctaatagacagctccattatgatagaatactgtcaagtgtaactagaagagctccatatactcaccatcagtctgtgcaggatttattcctattccatcattggtaataattgcacttgatgcagcagtaactttaaattcttatgctgcaaacgttaagactgctgtgcaaggtgtgctttcagcatctctgagtactttgtacgtcatccgtgggtcccacgtcagcgtgatcgtaaaggcaaccttggacatggtggagccgg

SEQ ID NO: 695492 - DNA, 146 bp, Homo sapiens
tgcatacggaacaggacgacgcctccgggacgggcaggctgcaagtggctcctggctcccaaaccaggacccgtactggacagaccacagacgacggtcactggcacacagcatgacggcccaaccacgcatgcacggtgcacgcg

SEQ ID NO: 695493 - DNA, 139 bp, Homo sapiens
ccttcagggctaccgattctcaagccttgctcttgcagcgcactgatattcaggatgcaggagaagagtactttgcaattaaatcagaataaaagcagttttttccaaatctgaagaataaaattgagctaatggacag

SEQ ID NO: 695494 - DNA, 230 bp, Homo sapiens
gaaatgggggtggaatggatcacagccaagttagagcagagagatggtagataagacgtgagtgacagcacggtccagcctactcagcgaagaccgtgggtgaattagcatggcacttcgctagatgtctttatccaagtcaggaggaaagaagtggagtgggccacgatgtatgtctcccagggggtcggtacaccatggtgttttcaaggctgttttcaaggcacatt

SEQ ID NO: 695495 - DNA, 320 bp, Homo sapiens
tccaactccagaggcctgccgtgttttctggagcaggtctgccgaatgcagcctgccgtgttttctggagcaggtctgccgaatgcagcctgccgtgttttctggagcaggtctgccgaatgcagcctgccgtgttttctggagcaggtctgccgaatgcagcctgccgtgttttctggagcaggtctgccgaatgcagcctgccgtgttttctggagcaggtctgccgaatgcagcctgccgtgttttttggagcaggtctgccgaatgcagcctgccgtgttttctggagcaggtctgccgaatgcagcctgccgtat

SEQ ID NO: 695496 - DNA, 155 bp, Homo sapiens
atcccccagttgtcgcagtgtcggtgatgtctgggaggctcggtggacatcaggcgcagacggtcagctggatggccacatcggcatggtcggagccctggccgtcatactcagaattgaaatcgcatctggtcatgctctcgccgaaccagaca

SEQ ID NO: 695497 - DNA, 114 bp, Homo sapiens
caaatatgaggatcatggcgagcagaaccggaaggatgctgaagcctggttcaccagccggactgaagaattgaaccgggaggtcgctggccacacggagcagttccacttagg

SEQ ID NO: 695498 - DNA, 773 bp, Homo sapiens
  misc_feature (656)..(656): n is a, c, g, or t
ggcgtgagcagctgcagcgcagaggcagcatccagcggcggcgccagcagttccagtccgttgcttactttttgcttcaccagaatagtcattatgccgaagagaaaagtctccagagaatacgagagggcaaagatgggttccaaagtaatctaaacaggagcccacaagagggttctgccagatttgtcagagaaaccttgttccacaaaaaatgtgaaacaaaacaagaaaaaaaatatctgttaagaaaagaaccgtggagcaaaagtattagcagaggtgctaacgggaagaagggaggacaaagcaggaagttggaaaaggaggcacaggaaaatgattcttgtagataaccgagggagattgagtggtcattgaaaaaatggggggtggatttatgtattctctgtggaaaaactttttaaaaagctattttttaccaatgttatttgggtaaatgctattttaggactctactagtgggcatacgaaatatatcacggatggaccatttatcgtctcatagtcaatgctttggggaaatttacatcatcctcagtaaaataaatatcagttaatattggaagtgtgtgtaagatggattcagaactcatgccttgctttaaaattagtcctgggcatactgcgcggtnactgccatattggatttcatgcgcttctagaccaactacggcttgacctaggttactgtgtttatgacctggttgttgtggcctgtgctatgggcttaacaaacgctcttgttcccc

SEQ ID NO: 695499 - DNA, 272 bp, Homo sapiens
tacacaaaaattttaaagaatagcggaggttgcggtgagctgagattgtgccattacactccagcgtgggtaacaagagtgaaactccgtctcaaaaaaaaaaaaaaagaatagctggggttggtggtagcacgtgcctgtagtcctagctactggagaggctgacattggaagataactttgagcccaggaggttgaggctacagtgagtggtaatctccccactgtactccagcctggtgaaagagcgagaccctatctccaggaagaag

SEQ ID NO: 695500 - DNA, 84 bp, Homo sapiens
caggtacagctgctcgagtcaggtccactccacgccgaggatctggcgggatcactcaacaagcttgggtcaccgtctcctcaa

SEQ ID NO: 695501 - DNA, 158 bp, Homo sapiens
tacgaggtcttaaggcagtgagccataacattgagtttgcctgagcttgcacagttacagagatgaacagtgatcactgcacagacatcaggtaccaacaggtcaactggcactgcacaggacagatgctatcacatgaccgttaggtgcacccattg

SEQ ID NO: 695502 - DNA, 101 bp, Homo sapiens
tggaataaatgtcactttttggaggcaaaagaaggaaccgtgaacttttaaacacccttttcttgggggtaggctcttgccccaggcgccggtcttctccc

SEQ ID NO: 695503 - DNA, 2379 bp, Homo sapiens
accaggacactcttactgtcacaaatcccgcccaagcactgccttcccatccatgccctgccgggagcaccccatcatcctccccattagctgcaggaacggactttggcgccctcagcacccctggctggctcccagcgcacttccacgcctgccctgccctgctgcgctgcgcgcgctaccgcgcgctgcggcgctacgcgcgcctgcggcactgcgccgcgccgccgcgccacgcacgcctctcccccaacgcgcacacgctccaccctgcgaatcccctccggccacctccaagccgaacttacttctccaagaacacagcttgcccctacccactctccaagcctatcccttgccaccaagcaccccttcaccccactccccatatctacaacccggcctgaacaacaactccccagaacggaaaaccaaccatcccttctcccccttctccccaaggcgcggcaacccaaccgccaacaaccccttggcacccccagttgccctacacaccaccaacctggcgcggcccggccccaaacgccgcaaccttggcccaaaccacacttctcaaccaaacgaatcccaaaccccctcctcaacattctccccaaccaccaccgcccttgccactcctcgccccgcagacttactcatcaccccacccccgttaacacacaacccctttgtcaatccagttcccaccttggcttccactcgcaaacataaacacaccttccacaccaccctacttcccaacccacaccaaaaccccctcccacttaacctttactaacagcggccttacaacacgacggaacggccggacccatttaggtagcccccacaaaggcaggcgtcgcaacacaaacgtttggcaaacggcccccctggcaaagcgcctcggcaaccccgtttacctcccataaacagacactaccccctcttcctccccatccctccccgctttttggtcacttaacacccgccggccaaacaggcagcggcgccatgacagttgggccatactactcatggacgccgcgccaaaccgcgcatatactcggggcccgcaccccaaacaaacacctttgctaccccagcagacggaccatactccctaagtattggctcgcgcgcgacaccaacacgccgcaaaccgcgcaaaaccagacacggcgagggcgcatttctatacttcccctaaacaacattctcccccccccgtggcaaacctgcggccacttttgggactaccaacccgcccaacgcggcgcgccccccgctcgcccatataccattctctgtggatcccccacttccccccacttattacacgcgcgatcgccccccccctatgtgatcagtcgctcgtaccaaaacgccagtggcctcaaccgtacgccggcgacccccacttatcgccgtccaacaactaccccctctgttctagggtcccttccccgcacatcctttatccgcctctctcctcctatggtgctaccccgcccccccatactatcaatggtagccgcaagccccacgctattccctaaatagtaagatcctcgacaacccacgacaaactcggcaacgtaacccctagaaccagattatctttccaccacccaaccacgcctctagattataacaacgctagccaaaaatccacactgctactctttaccttagacacccactcgactaggagatccaacctacaatcctcactttactacctaccgcatattaaacgcatcgagtcgtgtcaacttcctccaataaaccccccctcttatagcccccattggcaacattcttcatcccaacacgcaccacaacacgcgctacacccttctccctcttataatcactctaccactccccaccctcaagcaacaatcatccatacctatcgatcaccccacaacccccaaccaacccatcatccctatgccgctcgacaccaccatcccctcacactagcacacaccaccaaaaaacagcctgactgcccccaccaatgactcatcaacaaccgccccacaccacctaccactccgccccctcccctcacccacgacacacaccccaccctatcccccaacaacaccgtccccatcacatacatcctttgagcgcatcatccgcaccacaacaccaaaccgtttcctccacaacaatcattcataccgagaccgacgccccgccttctcgcccaccacctaccacatagctttttcgggcgcacaccgcacacctcccctctatgggaatttcagaagacaaatccacctgttatcaacacgcccgaaataacatccacctccccgcccagcagacaactcgccatcaccctctagctagcaacacacg

SEQ ID NO: 695504 - DNA, 109 bp, Homo sapiens
cattcacaaactaaccctttttcaagatggggtggggggtggaaatgcagtttacccatgtcctcaaaataaagttttggtaaaaataaataaatgtcctttagttata

SEQ ID NO: 695505 - DNA, 219 bp, Homo sapiens
gccagagcagaaaagtatggacaacgctccatcacctgaatgcgccagtctgcgtcctagagagaagcttgcagaagcctcccaacttcaatagcctctgcagagggatgatgactacagcctctggagcatcctgcttgagaaaacttaatgctgtcagtcgaacttactcgtttgtccagccaaaacctgatgacagtcagataggcccgtggcacc

SEQ ID NO: 695506 - DNA, 1006 bp, Homo sapiens
ctgaggcaggagaatggcctgaacccaggaggcggagcttgcagtgagccgagatagtgccactgcactccggcctggtgaaagagcaagactccgtctcaaaaaaaaaaaaaaaaaaaaaaaaaaaaaaaaaaattttgttttgggggaagggggggtttccccccccgggtccccttttgggtggccctattacgagggtgagacaactcccccgccaaatattttcccccccggataagagaagtatctctttattcttcccaggtgtatcttcgtgggagaattttagcccttcccaggggtgaggcctcccacataagagaatttctgttctgctcttctttatataaacacggggatttacccccatcgttgtggcaccccgggcggcggtgttgtcacgaggggggccaccaaagttggggaaactccaccaggtgcgagacgatagaaaacccctttgtgggggcccccaaagatacgtcctccctccggcggattataaagccctctcctcaaaagtcaacatggggggcgacacataccagaatatttttgtgcccccacttgtgggggggaacaccattcttctaataaacaactcttgtgcaacaaaaagtgggggaatctctgtggaaaatatattgtggaccaaacaagggcgggattttgagaacgctttttagggggccccacaggcgaaactaccctttgcggggacactgacaagcctcccccaaaacgttctctccggagaagtatcacccccagacagctgagtcggtctttgtagcaaaaaacattcttctcaacgataatataactcttgctcgcgcgacccaatatcagaagcaggcggtgtaccacatcctatatatgttccacacaaggtgtgggcgctcacacgaagacaactcttcactactagtgtggccacccattaccctttctaaagactcagtttcttctaaaaaaagaggcggggccatgctgggacgcgttt

SEQ ID NO: 695507 - DNA, 434 bp, Homo sapiens
  misc_feature (70)..(70): n is a, c, g, or t
  misc_feature (137)..(137): n is a, c, g, or t
  misc_feature (239)..(239): n is a, c, g, or t
  misc_feature (374)..(374): n is a, c, g, or t
  misc_feature (401)..(401): n is a, c, g, or t
  misc_feature (427)..(427): n is a, c, g, or t
atcaaacagagtggaatggaatggaatggaatggaatcacactgaatggaatggagtggaatggaatggnatggaatggaatgaaatggaatggaatggaatggaatcaacccgagtccaattgaatggaatcgaangaaatggaatggaatggaatggattcaacccgaatggagtggaaaggaatggaatcaacccgagtggaatggcatggaatggaatggaatgcaatggaatgnaatggaatggaatggtagggaatagaatggaatggaacgaaatggaatggaatggaatggaatggaatggaatggaatggaatggaatggaatggaatggaatcattccgagttgaatagaagggaatgtattcnagtggaatggaaaggaatggaatcacnccgagtggaatgaaagggaatggaanggaatgg

SEQ ID NO: 695508 - DNA, 122 bp, Homo sapiens
ccagggctgggcgcagcctagggagagccccctatcatgcccaccacccactcgggcatgggttcatccttaacctatccccttccaccctcctttgctggcttaataaattctgcacttgg

SEQ ID NO: 695509 - DNA, 408 bp, Homo sapiens
  misc_feature (70)..(70): n is a, c, g, or t
  misc_feature (137)..(137): n is a, c, g, or t
  misc_feature (239)..(239): n is a, c, g, or t
  misc_feature (348)..(348): n is a, c, g, or t
  misc_feature (375)..(375): n is a, c, g, or t
  misc_feature (401)..(401): n is a, c, g, or t
atcaaacagagtggaatggaatggaatggaatggaatcacactgaatggaatggagtggaatggaatggnatggaatggaatgaaatggaatggaatggaatggaatcaacccgagtccaattgaatggaatcgaangaaatggaatggaatggaatggattcaacccgaatggagtggaaaggaatggaatcaacccgagtggaatggcatggaatggaatggaatgcaatggaatgnaatggaatggaatggtagggaatagaatggaatggaacgaaatggaatggaatggaatggaatgaatggaatggaatcattccgagttgaatagaagggaatgtattcnagtggaatggaaaggaatggaatcacnccgagtggaatgaaagggaatggaanggaatgg

SEQ ID NO: 695510 - DNA, 433 bp, Homo sapiens
  misc_feature (1)..(1): n is a, c, g, or t
ntgacaaatctgacacatccatgataaagttgcctgacagtctttcaccttaatgattttagtggttgaatcattgtcttcatctttatttcttttaggtgctgcaaaacagtagtcttttcaattctgtcactccttctacgatttattagctgaaaatctataaagaagagcttctgacagggtgcagaggttcacacctgtaatcccagcactttgggaggcagaggcaagtgtatcacttgaggccaggagttcaagaccagttggccaacatggtgaaactctgtctctgctaaaaatacaaaaattagctgggcgtggtggcgggtgcctgtaatctcaactacacgggagactgaggcaggagaatcgcttaaactcgggaagtggaggttgctatgagctgagatcacaccactgcactccagcc

SEQ ID NO: 695511 - DNA, 133 bp, Homo sapiens
  misc_feature (103)..(103): n is a, c, g, or t
gggagtagctctgagcgccggctgtgaggaaggaggttctgggcaagctatagccatggctgtggctgtagccatggcggaagtcctaatcgggtcggttccnggccccgcggaggatcttgccctactcgag

SEQ ID NO: 695512 - DNA, 169 bp, Homo sapiens
tcaaaaggaagacataaataagacaggaatagcatatacctcacaggtattctacaccaaagaacacatcaatcgaaacctggaacacatatcatacacaaaacgcctgagacctatctattactctcatctgatacctccctgacaagcgcctatagcacacgcgact

SEQ ID NO: 695513 - DNA, 349 bp, Homo sapiens
tatgacgtgtggaaactgcaaacaagtaggccttttatacattgatatcttttcccaagttactggatattaaatctgtatgtatctgtatgagtgtttgcctctaatattctcagtgtgagctgctgtgttctatccattgcaatattgtatactcgattgtgtatagaagaagctggtgagagtgccctcctacataaataagcaatcgcagtgttttgcatgcaaaatataaaaaatttaaattgtcctgattctattttgtaaatggagaaacaatcatatctttctaagcggtaatggaggaagactagtgctttgtgcattttgatatatttgagttcatttt

SEQ ID NO: 695514 - DNA, 111 bp, Homo sapiens
atgccctcccctccctatagccccatggtggggctaggctggggctcacccccagtccccagcatatttgtatgtctgtaattaaatatgttaaaataaagtcattatcgg

SEQ ID NO: 695515 - DNA, 290 bp, Homo sapiens
tgaataaatattaaacaactgcagagcacctctgtacagctatgctacgaactgtaggtcgtgcagagcagattcatggtcagggactttttatatgtagctgtcgctggaagagttcggggagggggagtgcttgctggtattgactcagccatgataaaaaagcctttcctcgagcgaacatggcattggagttggcgctcccgagggggaaaggcgtaggctcggcactcgccgagcgaagcacatggtgcatttcgcgacgcgtgcataaggctgactcttctgca

SEQ ID NO: 695516 - DNA, 661 bp, Homo sapiens
cggtacccgatcacgctggtcaccaggaaccacattggccaaccttctctccggtcaacaacgggccacctccccactacgagatgctccaggaggacaggaatggctattctgggggtgccccacaaccggcctcccccgatgtcccccgtgatgccacatccgcagcgagacctccgtgcctgacccagtggtctggtcccggtcaacaccctcttcaaggacacctgctgcctgggcttcatagcaatcgcgtactccctgaagtctagggacaggaagatggttggcgacgttgaccggggcccaggcctatgcctccaccgcccagtgcctgaacatctgggccctgattttgggcatcttcatgacccttctgctcatcatcatccccgtgttggtcgtcccggccccgcgatagatcacggaggcatcacttgaggccacggagctctgcccgtgacctgtatcccaaccgtactctatcttccattcctcgccctgcccccaacgaggcccggagctctgcccttgacctgtattccacttactccaccttccattcctcgccctgtccccacagccgagtcctgcatcagccctttatcctcacacgcttttttaccatggcattccatataagtgtatatgtttttggtga

SEQ ID NO: 695517 - DNA, 551 bp, Homo sapiens
  misc_feature (1)..(1): n is a, c, g, or t
  misc_feature (466)..(466): n is a, c, g, or t
ncctccatcatacctaccatcagctatgtatgttttaagaggttctggtttctccatattctcaccaatatttgttgttactcagtctgtttcattttagtcttttcaggagtataaactgagatttactatgattttaatttgcatttccctattgtctaagatgatgaacacttttcatgcgcttctatcttcctttgtgaaatgtctgtcaatttttttgccatttagaaaactgagttcagacagaccccaccctctacgaaaaataaaattaggccaggtacggtggctcacgcctgtaatcccagcactttgtgaggccgaggtgggaggtttgcttgagcccaggaatttgagaccagcctgggcaacatagcaagactctgtctctacaaaaataaaaatcaaaattttaaaaaatctgtgcatttcactgtatgtaagttttgatgccaagtaaagngaggagaggaccctgggaaagatgaaaatgactgagccatcagctgctcatccttctcccctgctgtcattgcacgaattctgat

SEQ ID NO: 695518 - DNA, 957 bp, Homo sapiens
atatccggcatcgtggtttaggggccagctatacaagactgatccggtcaccgtgtaggaactgacttataacgggggcctctaacgcggtcgcaatgtagagcaaccctcgtaggggagactccgcccccccctagtggccacgcacaacactgtgtggacgaaagggtggttttttggcaaacgcgacggttcgcctttcccggggaaaaaacggttttgttaacacggagggacaccccttttaacgcaaagattggaggattagaaagaagtgctgcggtcgttaaaaaagacaaggccgtccccgacgccattgcagcgcggaggcccgggatgaacgaaggggccgcgctcgcgtggccccgaatttcccccgagcgtttttgaaataagaaaccttcacacccgggcggtttgtcaaagacaccgcttgctgtcgttgcccccccggacttcagggggcccccttttttgtaagccaaggggagtcaagagcccttttcatgagcatttaaaattgggtccaattgggaacagacaccgaacagcccacgggtcactggttccacgcaaaatggggcagtcctggacctccattcccacgccgggggaagtttcttctccctgctgcccgtgctaagatgtaacatgtttagtaggctcccggccccctatatttgtgcggcaggcagtaaatcaccaacaacgggtgtatccggcgcttcccctatttttgtggtgacttcattatggggtaagatagattcccccccgggggaacacaacaggaacccgattttcaattggcgggcccactaggcgctcggggtgcgcaatgtcttctaaaacaaccgtggtgcgccaaatcttctccatatttgttatgtacaagaacgtagatcagagtttacaactttatactttcccgggaaaaaaacacggcccaacataaca

SEQ ID NO: 695519 - DNA, 884 bp, Homo sapiens
ctctgggtatatgatgtgttccccccctcctggtttctgtctcctcaatacatgccctccgttatattgtgttgcaaagtcggcctctattgcgcgccccccctctttgatatcgtctctgtggggtgcacaatcacgcaggacgagcccccaagtgtgtctggtactccctacgcgggttgcacggatctccccgacctgcttgctcccccacttcaaacgtctcggcgcgcgcccatctctctggtcgacccactcatcatggcgtcccgcccctcccctggctgctttcacgcggcgccgtctgagtgatcagccaacaattgttgctttgcggaagcccgtcctttctctttcggaatggccgcgtctctcgcggttctctttcgtagtgcctccccccgggcgcgcgtctcttagagattgttctggcccagaagtatttctccggcatgttctctctggtgtgacccgggagctttcatgttccccctcgtgcttcgcgctggttctgcctctcgtcgggggcactaactcatgcgcaggctgctcgcggcgcctcagccgccgccgtgcgcagtgatcctggcccctcctccttgtcttctaccagtgatttcggtatgcctcgccgcggcactcccgctgacttccctggtggcactccccaatattcgcgcggcccttacggctgtgtcggcgccgaacatctccggtccgctcctcttgataccgatctgcagctactatgtgcggctcacggcggggcgctccacgcaccggtcgcgacccgacggggcaggcgacgtgcagtcgactgtcgagtatacgcggccgcataacctcctgttctttgcatatcacttactaagaccttcatcaca

SEQ ID NO: 695520 - DNA, 277 bp, Homo sapiens
  misc_feature (19)..(19): n is a, c, g, or t
cgttacgggcgaacagggncgcgcttcgcggtggtcgcggcccaagtgcgtttcgctccgcagcgctcggcgacggcggcaaaggagatcaagtcgctgatcgtgtcgtcgaacgagaccgtcgagcacggcgcgacgctcgtcacgaacgcgggcgagacgatggccgagatcgtgcagtcggtgcggcgggtgaacgagatcctcgacgaaatcagcccaccgtcgcgcgagcaaagtgccgggatcgaacaggtcaatcgcgcggtgggcgaga

SEQ ID NO: 695521 - DNA, 108 bp, Homo sapiens
ctgaggcgcttacgttgcgtgcggggcgccgtggtcgtggggggcgcgcggcggggtagcgtaggggcggtgggccggtgccgtgttcgcgtggggtcgggcgggcct

SEQ ID NO: 695522 - DNA, 1078 bp, Homo sapiens
  misc_feature (270)..(270): n is a, c, g, or t
  misc_feature (291)..(291): n is a, c, g, or t
  misc_feature (330)..(330): n is a, c, g, or t
  misc_feature (339)..(339): n is a, c, g, or t
  misc_feature (349)..(349): n is a, c, g, or t
  misc_feature (418)..(418): n is a, c, g, or t
  misc_feature (447)..(447): n is a, c, g, or t
  misc_feature (464)..(464): n is a, c, g, or t
  misc_feature (470)..(471): n is a, c, g, or t
  misc_feature (488)..(488): n is a, c, g, or t
  misc_feature (519)..(519): n is a, c, g, or t
  misc_feature (521)..(521): n is a, c, g, or t
  misc_feature (552)..(553): n is a, c, g, or t
  misc_feature (555)..(555): n is a, c, g, or t
  misc_feature (560)..(560): n is a, c, g, or t
  misc_feature (562)..(562): n is a, c, g, or t
  misc_feature (579)..(580): n is a, c, g, or t
  misc_feature (591)..(591): n is a, c, g, or t
  misc_feature (593)..(594): n is a, c, g, or t
  misc_feature (599)..(599): n is a, c, g, or t
  misc_feature (611)..(611): n is a, c, g, or t
  misc_feature (625)..(625): n is a, c, g, or t
  misc_feature (632)..(632): n is a, c, g, or t
ggagtgcgattatcagtctcatcatatggggatgaaccactgaagttataaaggagcacactgtcgcactacatgtctaaattatgtaggaagattcctgtaatcatgtttttttaatttattattttaaagctatttgtataaaggatggttcccatacttggttattgaatagggggggtggggtggttccttgtggattaaatctgatattgttctaatactgaaagattttctaaatgtcactgctgacataactcccttggtctncaatttaatagttgttaagtnttgcccacattgcatatgcctttcatttataatttattnaccctgctngacttagttngggaattcgtaaatttaaaggtgtgtgtatctgtgtgcatctccctgtcactgtgacacacctagatgngtgttacttcaattaaaattctcaaattnaatttgattgcttcagnagggannatattctcaataatgtnacaataattaaggtctatacatgggtgtatntntctggttcacaacagcacaaaggtcttcatnntngtggntnctttgaagatctttttnnccctgaagtcngnnaatantttctagttatngatactcttctggnatatatnaagcttcgtgtagattgctagtaaaattactacggataggttgttttaacatatggtctatttaagtctgatgtctacggggcaagtgtagttactaaaaactgttccaccataatttggacagaaagagtatgaacaaacaattacaataacctatggcggtggggtacctgaagaaccccagttcggtatttccacgtaatctaagttatccttaaaccatatcaatctggtttgggggcaatatttaactttcccctaatgttttgatagaaacaggcgaaatttcacggcaacaacccttttgggcagtaccttccccacactgtcttggcgccccgcacatttggttcccgcgcccatgtgccctcttaaaaagaaaggggcggattacccttaaaggtgcacaacacgcaaggtaagtcataattcaacggggagaacaa

SEQ ID NO: 695523 - DNA, 837 bp, Homo sapiens
gatttaaaaaaaaaaaaaaccaacaaaaaccttttttcctagtttcagatacacgggattctttatacgagttggtctccatatgaaagcatgctgtccagtcgctctgtgtaagatctgtgtctgagtttggaatggggtgccacactttttccagtcaatcataatggctgtgtcctacggtaccatgtatgattctggtcctttcctatatccttcatgacagattatgatgtgggcttcatatggtgccttacttgtacattttaaaacctaaacgtcttcattcccttccatttcctacatctttaacctttgaccttttgggtaagagaatcagaactattacaaaagcttcatgaaggatttcagatgggtatggtttcaaatttccctctcttaatagttatttcatattcggtatgaaagaccagtttgggatggtcttggacatataggggggaaagattagcagtaatttcactaacttcccttttctctgactttcatgcatttctcatacatcttctttctgatgcttgacttaattggattcctagcaatagtctgcatttaacacgaaagggtgtgtccacattcatcagcttgaacattgactatttcatttgtccagggattttcaggacgaagagtactcatttgggtttatacaaccgatgaccagttcttcttaaaagaaaccgaagttaccggtactctcttgaactaccagtgctgttacgtggagatctctttacacaatatatatttatattcctacacagacctgcagtttgccttcctaatcataagcgggtaagttattcgccaaaaaga

SEQ ID NO: 695524 - DNA, 185 bp, Homo sapiens
  misc_feature (76)..(76): n is a, c, g, or t
ttttttaattttaatttttgtagagatgggggggcaggtctcactatgttgcccaggctgttctcgaactcctggncacaagccatcctcccaccttagtctcccaatgcgccggaattacaggtggctcaggtgtgagccaccgtgcctggcttttctccactatcttgaaatcagatgggagg

SEQ ID NO: 695525 - DNA, 918 bp, Homo sapiens
tggggtttccttttcggttaattctggtaaaaatgaaagggttcccataaataaggggcatgagccctttcttcacgaccatgtggttccattgacaagggggcaggggcaagagggggccgtggatggggagctccttgtgtgggggagaccagggacaggggagaccttgggattcaaacaaggcaccaagacagaggtggggtgggcgcagggagagaagagggctctcaaggggagacctctcacacccctcggtggcccacaagggtggaggggagtgacacagggtgtgcgtggagagaggggcacaagagaagcgtgcccgcggaactccactctctcgcgaggtgtgaggtggagagaaaaggctctcacctcgaggggggtcacattacaagcacccacgcgagtgtgtccctctcaaacaaacaaccgcgacagcgcggggatgtgtgtcgcactcactgtgcgcgcgcgtgggcacaaaaaaggggagtgtgggtaacacgtgcgccccccagcgacgcagggggggcccccaccctaataagagaggggagcacctccacctacaaggggaagtgaaagcggtgtgggcacagtgggacaagtcgggagccacgtgggagaacgaccaaagagaggtgtgctccacacaaaaaatctctctatacactgtccccgagatgtacttccccgaggcggcgcggcaacagccaccacaaagagacccctatcaccaatattaacgagggggagccacaagaagggaggaaggagcgaatcgcaggaagaggagaacagcaagtgggagggaggggtgcacccacacacaaaggaggaaagagggagccacaaggggggggacgccccaagtggggtggaaacaacagggagggagcaccaaaatcgccg

SEQ ID NO: 695526 - DNA, 1069 bp, Homo sapiens
  misc_feature (738)..(738): n is a, c, g, or t
ctcaagcaggcacctggggtggggactggcccgaggcctggctatcagtcagcggtggcagcagcaggacaaggcggacatacaaggagctcaccttccgtgctattctcctgacccgacagccggcctgtcgggagcacctggacgaggggccgcggaaacctgtgagtgcgaaggagcccccgctcctatgcgctctgaaggcctcgactccagcgagacctcatgtgcttttccggtgctttacctggctacgctgccgttgctccgttctgaccctccgtgatgctgctatacttcgtgttcctagcaggaattgggctggtccctgcgtggcaaccaggcacaagggttgatcttcgggcacctcgaaactagttgcacggattccattccaatcgccttcggttcagtcaacttaagcaagtcaacagagagtgggcgagtgagcactcacttacttggcatagtcattgttgtcagcgacagctgcgggcttgggcgccagtccgcgctctaggggtagtgaggcctggtacactcgtcgcagcctcaatagatcgcatcgcgatggtctcggtgggttgcgggcaaatctgtccattccgtgcttgtctttgccataccatccaccggggcaagaacggcgagctggataagcgagagcgagagggctcctgagttggctggggagacaaagcgacactgcagggcgagcgtgagcgggctggcaccagnacccccgctttggggaaatacttgcgccttatcggggggaagggaacgaaaacagacacggtgggtgttccctacactggtgcccaaggccccccacgggggccatgggtccccccaagggaacattgccttggagtttgtggaacacgggcactgggttaccacactgggttggcagtttgccccaacgacatctagcccggagccttggtacacccatttccctggcccaatatgcccgcaaactgggtgtaaacccaaagccgaaatgtgttccgtttcgatgggaccccccctttttcaattggtcttggtagaaggaaacttccct

SEQ ID NO: 695527 - DNA, 170 bp, Homo sapiens
ctatgatgttttatggtccctcggcaggcacaacttcgtccatcacgatctacatggaggagaggaagggaattattggttctgtctggagcctcggcgtgtgcagcaacaacttcgtccacatgagatttgcaacaacttcagtccatccctgacctccagaatcccac

SEQ ID NO: 695528 - DNA, 770 bp, Homo sapiens
  misc_feature (6)..(6): n is a, c, g, or t
  misc_feature (65)..(65): n is a, c, g, or t
  misc_feature (107)..(107): n is a, c, g, or t
  misc_feature (154)..(154): n is a, c, g, or t
  misc_feature (249)..(249): n is a, c, g, or t
  misc_feature (453)..(453): n is a, c, g, or t
tggccnacggtttctcaccctacgtaccatcgatcatccaagctgattgctgaagtcactctaangatccctcttcctggccagtgaaggagaaacatcctaatggngagactgcctgttttcttttgcattgagtccatgtgactaagccgangcaccttctctgcagagacagaagctcagtactgcccaggtacacagtctgcgccagccacagctgagcaacatcagatgggtgggaaattcggnttttgaaacccattaaaatgggcttcactgtagaaaatttaccaggaggaagcaggaagaagcggaccgacttaatcgaatatggcatactggtctgtggaatggatcgttcaattccacaaatacagcggacctaaggtaagctggggccaagagtggctacccattaatggttggctactggcgcttcaacggaaccttgtngcaatgattagaattgcaaaccgcgagagagttgcgattggcgccttccttctcgtaagaacctgtgctcgcgtcgatgggaaggtatatatctagcgcgtatgtgtctcaatatgggtaccagagaacattgcacagcgcacagcgcagccgtaagcggtgtgcgtgtctagagctcgctgtagatataaacacgcattagagtgtgaacgcagacgttatacagcgtttccgaagactctggccttttcgacctcggtatgaattccgcctttctctgagaggggtcttaaataccgcgattataggaggcggcc

SEQ ID NO: 695529 - DNA, 990 bp, Homo sapiens
actagttctagatcgcgagcggccgccctttttatcacagcaatttgagaagtttctcttattggtttctgacgacaagcattgtggggagaaagccaggcataaattagttacgatagttggtgtataatgtttctccagtgaagatttggacttttcttttgacccttatagaatgcataattaaaacagacgtattattttgaagtgaaatattgaatattaagaaaaataaatatagagactcttaaatacaaggagaccacaaactcacatacctagagaaatcaaacaggtaaaagcaagtggtgaagccacatggattaatgagatgatagaaagtacaaaatctactatgtaagtcagattaaagatagccagcttgcgagctgcctcgtgctttgcgatcttttggaagtcaattaactaattacataatatcagtgaatacagtatttctacagtatttgaaacggtgtgccactacccagcaatgccacttctagacatatatccaatgagaatggaaaacatgtgcacacaggcacgttgtagcatgaatatttatggaagcattattcacaatagcctacacagtggaaacgagtccaaatggccatcaagatggaatgactaagataaaatgtaggtgtgtgcatgcagtggaagtattatgttgtggcataaggagaaatgagcactgatgcggggtgttaaatggatgaactgaaagctttatggtaagtggagagaggccgtcataaaaggtaactattggttttcctttcatagggaatatctgataggggtgtcctagagacaaaacgagagcgaatggttggtcagggcgtgtacgggatatgaatgtcgcgagggggggcgtttcggggagggggggacaggttgggttaagagttggcttgaactgtgtgtgcttaactggtgtggagaacatgttgatttcccaacaaagaggggggatttaagaat

SEQ ID NO: 695530 - DNA, 100 bp, Homo sapiens
tgttgggcatctgtcactgtcagctgacacgtggagccgctgaagcccgtggggcaggtgcagctgaagccattgactcggtccttgcagaccccaccgt

SEQ ID NO: 695531 - DNA, 287 bp, Homo sapiens
aataaagtaagctagagaataggaaaatgttattaagaaaatcttaatgaatagtaaatatattttctcttcattaagtggaagtggattctcaaaaaggtctttaccctggcattcccattgagttggctgaggaagagtgggaggaggaggaagaggaggaggtggaggaaggaggaggaggcggaagggttggtcttgctgtctcagggtggcagagtcggaagaagtggaagagaaggatggggaagcaggagaggcaggcaaattcagtgtaacttttattt

SEQ ID NO: 695532 - DNA, 105 bp, Homo sapiens
ttttaaaaaaaagggggggggggggtcccccccttgttttttttccccccccccccccattttttttttttgggaaggggaaatttttggggttttcccccccca

SEQ ID NO: 695533 - DNA, 358 bp, Homo sapiens
ctcctgctacagtcttcttccttttgggcaccaaaatcagtgagtaatgggctggtactagcaccaagtctcctgcttagcttcagtaattttgctttagctctgtggttatcacacttcagagattagatgcgccctggtttataaactatggtaatttttaaactaatgcagagataagggtcatgaaaaattttgatgttgatattctttgtcatctgtactattccaacttgtaatttccaactctttgcaaagagcaaaggactaagtaaaaaaaggaagagaagtgggggtattagcaatttgattgactcaggattccattgggtgaggaactcaatattaaaggttaaaa

SEQ ID NO: 695534 - DNA, 298 bp, Homo sapiens
  misc_feature (24)..(24): n is a, c, g, or t
  misc_feature (51)..(51): n is a, c, g, or t
  misc_feature (59)..(59): n is a, c, g, or t
  misc_feature (130)..(130): n is a, c, g, or t
  misc_feature (196)..(196): n is a, c, g, or t
  misc_feature (201)..(201): n is a, c, g, or t
  misc_feature (204)..(204): n is a, c, g, or t
  misc_feature (218)..(218): n is a, c, g, or t
  misc_feature (250)..(250): n is a, c, g, or t
  misc_feature (264)..(264): n is a, c, g, or t
cacagcgcctctccagacctaccncgggacctaatgttctctacatgaacngctcattnggaggacagcagtgaggtcctgccatagagcaaatgtgttaggagagaaggtttcacatgggacccaacanccttcatcaatactttcctgagtttgatcatcctttagccttgtcaacagagaccctacagagttnttttnggngagcacgtcgtgancttgggggcaaggatccagaaaggtaggaagntatgaaaggggggngtcaacagcagggttttttaggggtcaggcacca

SEQ ID NO: 695535 - DNA, 649 bp, Homo sapiens
ccgggtcgtcgccgctgcggttgaacgcggtgatatgccagcgcggaacaaccgctaccgggagcgcgaggaactgcagcggctgaaggatcgatacggggaccagagacagcagcagcgactccagattccgagtcggactcaagacgacgagcgcgtggaattagatccccagccaggagcgggactttatacaaaacagctctccattgtagaagaagaaggacccccgcatttatcagaaagatgccaccattctataacagaacagacatcagtcatcagacagtgcaggaggacccagaagccttggagaagcagaagaacagtgcggcccatgtacctgacggacatacgagaggaaggttactcttggagaaggcaggccaaaatatgttgactgaggagaactcagactggcgctaagacttccaatcacagactccaggagaacaatcgtacgcaaagttaatgtggaaggaacaagaaaacagctcaagggaaaacgctttccggagcattatgatggagaggaccagtgaaataccgagggacgtgagactaggaggacaggatggctacaagtattgcatgcattaaaacatgccaaaaactagggcacgaagaaagccccagtgaagaaggccaa

SEQ ID NO: 695536 - DNA, 261 bp, Homo sapiens
cccccagaagccttagtgacccagatcttatccagagactcaagatagcctcaaatacagggggggattatgtatccaaaaaaaaaaaacaaaacggaaagggggcgggaagggccagttttggtaaaggccaatgggttgggagtcggccggggggcctttggttttattttcccaaccggcaaattacacaaaggggggggggggggataaccttttttaaggttttttggccccggggggagggggggcccttagggt

SEQ ID NO: 695537 - DNA, 595 bp, Homo sapiens
agcggggttgcaggcgcgtgccaccacgcctgactggctttcgtatttttttggtggagacggggtttcactgagttggccgggctggtctccagctcctaaccgcgaatgatccgccagcctcggcctcccaaggtgccgggattgcagacggagtcttgttcactcagtgctcaatggtgcccaggctggagtgcagtggcgtgatctcggctcgctacaacctccacctcccagccgcctgccttggcctcccaaagtgccgagattgcagcctctgcccggccgccaccccgtctgggaagtgaggagcgtctctgcctggccgcccatcatctgggcatgtgacggagcccctctgcctggctggccagtctggtagagagtgaggagcgtctctgcccggtcgccgatcccgatctgatgtaagtgaggagcgcctcttccgggccgccgatcacagtctaggaagtgagagagcatctctgccgcggtcgccacatcagtctgactatgtcggggaggcgcctcgtgccctcgtcgtcccggtgctgggatgtgcaggaggcgcactcttgcccggaccgtggatcac

SEQ ID NO: 695538 - DNA, 364 bp, Homo sapiens
aagtcatgaggcaggggcaggatgaagcccaggactctgctctggtaagtacaagaaaagaaggggcttaaaagggagagctgccattttaaccattctagcaggaaggcaactaccaggaagactcgtgtattgggcatagttgtcaaggaagtcagtcgtgtactcaaagagcttgtttcagaggaaccggggcaggagccagaaagggggcctgagaaggtgcaggggagggtgcagacaatgaggctgccactcccagattccggctgtgaaagtaaaggggcaggtagagcggggtggtgtggatagatgcagggtgggacagacgtggtcaaaagccagtggagggcctgcgtaaaag

SEQ ID NO: 695539 - DNA, 720 bp, Homo sapiens
agcgggtgggtctcagtagctcgtgcggcgggaggagtggcagcggcgatgtagcccagtttcgcgaaggctgtcggcgcgccgctgggcccgcaggcacccggctcgcgtccttccccgctaggtcgcccggctgcgcgccttccccgccgccatgatgcccaagacggaaggtcagctccgccgaaggcgcctgccaaggaagtagcccaagaggagatcggcgcggttgtcagctaaagcctccgtgctaccacagtggagagcgagagccgaacacacaggcagcagcgaaggataagatcttctagacaaaccaagtgcgaaagcagagaagggaacaggggagcccaagggactccaggcctgaagtggctagatccagagaaactatagagaaggacttaccttgcggaaaacggggataggcgaatgactgaggagagtccagcctcatgatgaatcagtgagagaatggaagttccgagtctgacttaactagagccatagtaccatgtcttatcagtggtccctgtctcgccttctgtgttacaatccagagcgaatagtttcttagtcaactatgttggtagagtgcaaaggttgactcaaggatagctctagaaacagttttgagagaagggaggggaagtcccaccgtctatcccatgtgttataaggtgtacaaattgctttctgattgtcaatgaggttgaaact

SEQ ID NO: 695540 - DNA, 121 bp, Homo sapiens
cacgaggattaccattgattctgacctgtttaggtatctggcctttgtgctcagtcaggaaagctgtcctggtgtccatgcttatgcactgtgtgccctcgtaggtgtaccccacctgacg

SEQ ID NO: 695541 - DNA, 364 bp, Homo sapiens
  misc_feature (39)..(39): n is a, c, g, or t
  misc_feature (254)..(254): n is a, c, g, or t
tggaatagccatcgtccagcacgcgactttgaaggcggngagaggaagtcgaccagcaccgggatcggattgaccgcccggtgcggataggccacgtgaccctggcggccctcgaccgtgatccaggcgttgatgctgccgcgccggccgatcttgaccatgtcgcccagcacgcccgcgctggtcggctcgccgacgatgcagtggtcgaagatctcgccctcggcggccagggcctcgacgacctagacggngccgtcatcggccacgccctcctcgtcgccggtgatcaggaagctgatcgagccagcatgctcggggatcttcgacacggcggcgacgaaggcggcgatggccgattcat

SEQ ID NO: 695542 - DNA, 449 bp, Homo sapiens
gattacacaggctgacaaatttgtgctgcactgttaatgatgaatatgcaactctggcctatctgttccatagctcacagatgcactgtttcccagccatttttcttacaactgcatgtagaaggttgcaaggacagacttcaggcagccattcaaagcaatcctcactaaatgaacaaccacagccaaatactatgtctgcatttgaacagtttcattcacattatgctgctatatttcttatgctgctatattcgagttcaatgctaccacaggcttctcagtgcttcacatgttctttcaccatgaaattgtacatcgtgttactttccaaaattcacctaccacaaagatatcgatgtacaactccttttaaaatgtttcacggccggctgcagtggctcaagcctgttatctcagcactttccgacgccgcagtgggcggatta

SEQ ID NO: 695543 - DNA, 287 bp, Homo sapiens
gaggactacagaataagattatatacatagacacatagctaatcacagtttcctgcactgaatgttcatccaaccataatgtatcaggctacactgggtagtgtatctgcgcgatggtggtcttctaaaaatgctgaatgaggatggacgccgtgaggaagagcattgttagatgtccatagtatgactagagcagttaggtattacatgaataagcagatatcttctaatacagacagttgaggtatatgcactatggtagttgtcgctatatgattgaaataaag

SEQ ID NO: 695544 - DNA, 153 bp, Homo sapiens
agtttataccgaggggcaaactctatgcagagtaggtcgtatgtgtgagacagggtgagaggccattgactaagaggttatccatgtaatcccggtaaaagagataatggtcagaacagggtagcaagagtgagagtgctagaaggaatttga

SEQ ID NO: 695545 - DNA, 458 bp, Homo sapiens
gccaggcagaggggctcctcacttctcagacggggcggccgggcagagacgctcctcacatcccggacagggtggcagggcagaggtgctccccacatctcagacgatgggcagccggggcagagacgctcctcacttcccagatgggatggcggccgggaagaggcgctcctcacttcctagatgggatggccgcccggccagagatgctcctcactttccagactgggcagccaggcagaggggctcctcacatcccacacgatgggcggccaggtagagacgctcctcactccccagatggggtggtggccaggcagagtcttcaatctcggcactttgggaggccacgccaggctctgggaggtgagtttgtagcacgccgagatacgccactcactcagccttggcacattgacacttgaaaacattctttaggtaacattacgttagtagga

SEQ ID NO: 695546 - DNA, 709 bp, Homo sapiens
  misc_feature (626)..(626): n is a, c, g, or t
gaagagaatagaaaaaaagagaccttcccaccgcgcttctcttccgcttgttccgccccttctttgggggggggttttataaaaacccccccactcgggaggaggaaccacaccaggcggtgttttttggattagaaggagaaatataatttggaagatttttggggtgtatactattatgggtataaactttcccgttttctcgtccctcgtctaaacacacttccacattttctctgagacccttcatattgttcgccccttttatatacaccactctcttcggtgtctctaccacacagagcccccacaagggagtctcctcgcgcgctttgagttcacacactgtagacccacgctatgcccacacaactccacgcgccactcccacacatttgtaaagcccacttatgtatataaaggacccacaatatagggactgtttgccaccctccaaaactttatgaaacttcacccaccccctaagtgtctcgtcccatcggaagttaagaaggggaccactcacactctatagaaagtttcttaatatagaaaaggaacaccaatttgtttcctggctttaaccttgggaaaaaagctagccagcgaccaccttattatagaangaaacatttgtgcacctatgttgccctaatcttcttcccaaatgtaactgttataatataaaattaaggggtaccccatgcca

SEQ ID NO: 695547 - DNA, 1304 bp, Homo sapiens
tgctcaatgccttcaatgcacaatccattttcaacattatcattctctacaacagcaccttcatttccaacatcaagcatcaatcatcttggaggtattgggaagtaaacaactcccaaccatatacacatttgaggaaggcacagatattcacatcatacacacatcattaccactttctctgcactgcagcatgctctgatacacttactaattacctacatacccttgcgttctccactcagtcagtcacacacattactcatctatcatactatcatcatttgacaaacggacaacactatactaactccatatcctatcagacacagcaacagcatactagcctagtaagatatcctatatatcatataatactatcccttcatcttacctcgtgcaccccttcacaaacgacttgacagcaaacgcagcaacacttgctcacacgtccatactccagcgtaatcatacggcaacagtcacgatacagacaatcgtatccacgtaaggtcaagtgtcatcctatccagcaatgctgctaggacttacacaggtgcaccagcccccagtattccagtcagacagcacgattacaacgcacacgcacacggtcccacacgctcacatcttactcagacatcactacgtgcgcattcttaacgtgctacacgacgttacctgaagggtccacattgaatcctcatcagcttacaaagctctactgcaccttcaatcatgcaccctcacactgccattcacggacgatcatatcaccctacaccctccacactgccctgctacaccgcactcatatcctaatttcccacctgactcccttcgcacacaccaacacacgccacaacaccggtcaggccccattaccacgcaacctcacccttaccaactcctcttcgccccgtgctaactcctcaagacaaaaccacgacatcacacaacacacccaggcgacaacgacgcaccccgccgagcaaacgacaacactgaaggagcgacgccccaagcaagaacaccaggccgagggcaacaaaaacaacatacaacaacaagaggaacccggaccaaggcagggcaacaccgaccacaacccagcgcccaccgcgacagaagccggcacgcaaacgcggcaccaccccaccgcaccacccgagcacgacagccaacgcaaccgaactccgcaaaaagaaaggggaagaagtatcaatactcttcagaagacgcaagcaagagacaaaccagagaggacacaccgacacaccgaacaacccgcaccaaagcacgca

SEQ ID NO: 695548 - DNA, 697 bp, Homo sapiens
aagatggtgaaaccccgtctctagtaaagataacaaaaaattagctgggcttgatggcatgcgcctgtaatcccagctactcgggaggttgaggcaggagaatcgcttaaacccaggcggcagaggttgcagtgagccaagatcgcgccactgcactccagcctcagcaatagagtgagactgtctcaaaaaaaaaaaaaaaaaaaaccgtgccaattttctcaaacattaccggtaaagattatttccagggtgccatttataattagtatagcagcagggcttttactctgtgttttgcccagattgcagtcgggggcagtgggttggtgtgcgggactttctcagtggccatcattcagtatgcttaggggatttggatagacagggcattagcctggggcattattcacctcattgggtaaaggggctaagaagcctttctttttatatgggcactctcttttttggacaataggggtctatactctgtcacccgggttagagtacactgggtacaatcacgggctcaattgtaggctttaacctccgtggcgctcaggtgtttgtcactatgcccgggttactttgggtatcttgggtagagacggtttcgccactttgcccaggttgaaggatatgcctaggctcaagcgattggcaacctcaattccggaagtgctgagataccggtgtg

SEQ ID NO: 695549 - DNA, 219 bp, Homo sapiens
agctgctgctgttttgagtctagaggatcccatcaggcgattactgtgggtgcatgctggtgttgctcttgtagcagttgccctgcccgttcttgcaggtgacttttccgggcaccagacattctggacatctaccaggtgctcgtgcacaaaggtgttcactggcttgcaccgcccctgtgtcgtatcccgagcgcctcgccagagtcttcgcctgat

SEQ ID NO: 695550 - DNA, 140 bp, Homo sapiens
tgactatcacgcaccatatgaatcgcggtctataccataattcctagctgcggtatccaggcggctcgggccgtgtttgcacagctctaattatatcacaatgtaaacgcttcggtgcccgtgggacacgcagctaagag

SEQ ID NO: 695551 - DNA, 190 bp, Homo sapiens
ctcacccgacggggtggcgcgtgcctgtagtctcagactcgggaggctgaggcaggagaatcgcttgaacccgagaggtggaggttgcagtgagcagagattgcatcactgcacttcagcctgggcagcagagcaagaccctgtctcaaaaagaaaagaaactgctgtctcccaccccgtcgggtggatg

SEQ ID NO: 695552 - DNA, 720 bp, Homo sapiens
  misc_feature (154)..(154): n is a, c, g, or t
  misc_feature (175)..(175): n is a, c, g, or t
  misc_feature (192)..(193): n is a, c, g, or t
  misc_feature (244)..(244): n is a, c, g, or t
  misc_feature (301)..(301): n is a, c, g, or t
  misc_feature (319)..(319): n is a, c, g, or t
gggacagccttaggtgggtcatggagggattatggtctgaagtaaccagcaacctaggaacatagaaggtaatatttggcatggaataatgcctagccttagtagataaagcggcattaccttttttttttttttttttgggaaacaaggtctnggtctgttgcccaggctggantgcagtggtgtgatctnnggtcaccgaatctccgcctcccaggctcaacaattttcctgccccagctantgggggggctgaggggggggaatcacttgagcctagggaggtcgaggccacagtganctgagatcaccccattgnctttccagccgtgttgacagagcgagaccctgtctcaaaaaagaacgaagaaaaggggtggggggaggggactaagatccctatgtcctagagatgggggacatgtgtcatggtatgggaggagggacgctcaggtagtgacgggacgggatgactcgtgtcagggactcttggtcctctgaaacgcaccccgtgttctaggacaattataccgcgtgagtgagttgctgaataaaatttatatttccaacacaaaaaacaaactaaaaaaaacaactccgggggccatctaatagcggggggcggggacaaacaagcgggttactcagaacttgcggccctatgtgcgccaaacggtgggtctcgtagacccccagtttttttcttgcacccaatgctgt

SEQ ID NO: 695553 - DNA, 216 bp, Homo sapiens
  misc_feature (59)..(59): n is a, c, g, or t
  misc_feature (70)..(70): n is a, c, g, or t
ttcggagtgaagaagattgcacttttatgttcaaataatgaaatcaggtaacactgttnaagaaatgacnagttcaagttcatttgacagagtttagtttggggagagttactattaataaaattgagcattttctcttttattatttttatatataaatatacatatatatatatatatatatatattttttttttttttggagcttcactcgaa

SEQ ID NO: 695554 - DNA, 139 bp, Homo sapiens
tcttctggttctcactggatccacttctcccggcgggctttctcggtggcgctcattaattctttgcagttttttaatctccagctcatgctgctgctgcagagagcgctggcgcagcagcgagaactcacggcccggc

SEQ ID NO: 695555 - DNA, 350 bp, Homo sapiens
  misc_feature (4)..(4): n is a, c, g, or t
  misc_feature (25)..(25): n is a, c, g, or t
  misc_feature (93)..(93): n is a, c, g, or t
  misc_feature (285)..(285): n is a, c, g, or t
  misc_feature (319)..(319): n is a, c, g, or t
  misc_feature (335)..(335): n is a, c, g, or t
  misc_feature (339)..(339): n is a, c, g, or t
  misc_feature (350)..(350): n is a, c, g, or t
gaantttcaattatgtttggccccngcctggtcctcgaaattccctgaccctcaagtccctccccgcctcgccctcacacttgtaattccagnacttggggaggctgaggtgggaggatcacttgaggcccagaagtttgagaccagcctgaggaaaatggcgagcacctatctctaaaaaaattaactgggtgtggtggtgtatgcctatagtgcaagctgctcaggagggtgaggtgggagaattgcgtgagcccaggagtttgaggttacagtgagctatgntcacaccccttcactccagcctgggccatagagnaagaccctctctcttnaaancgacggggggn

SEQ ID NO: 695556 - DNA, 1599 bp, Homo sapiens
  misc_feature (268)..(268): n is a, c, g, or t
  misc_feature (356)..(356): n is a, c, g, or t
  misc_feature (1426)..(1426): n is a, c, g, or t
  misc_feature (1523)..(1523): n is a, c, g, or t
gaagcaaccagcggcttggtcgtggttaacgctgtcatatgattccgcccagtgtgtgcattgcgtagctacttgacagtgctggtgttccaggctctcggagaggcccacgccctgaacgatcgagttgactgcctgtagtgtgccgtgaatgaagcatagtgctgcattcattcggactggagagcacgacatcgtcggctcgaggattacggatgacacgaccgtgccgagcgggcaatacgatagcgcgcgtactgcagtaagngaaggatcatcaatattcgtgctgacttttgcggcactgtggcgattccctcgttagtccactacttttcccagagtatctcgtaganttggtcgatcatgacaacatcgcacacagaagatgcaacgcgactgaaagtaatctgtcttttcatggaactgttctctatccaaaaggtcaacgtatctcacgggctcacccaatcgggctgtggtgaactgaagctctcaatctgacaacggatcgagtggctacgggaaaagcattccttgtgcaataagggaatcaagacatacttttcccgccgcaatgtgtcgcacgactgtagttagccgatagacagggtcccctcgatgctatcgcgcaatcgctaaggtgaaaacccgcagttgtgggaataacccctatgcgtgcaaatttccactcgcggttggcaatatttcggagggggggcaaaagtgcatcgcccacctatttgatttgggccaatagaacacttggccttgtttgacggctgttattgggttgacgcaaaaggctaagagtagaagcactgaggcgtagtgacgcgttcggtgcctgtgggatcgctcatttgagatacagcactagaggctttactatctcgtccagaattggtccgaccacccgttttaatcaccgcaagtgtgggagtccaattagcgccgagcagagtgccaaatcagggaaaagggacgacgcgtaacgaaggtcttaaaatcttccaaagtgtccttttgatgagcgttacgttggtaccccaagtaaggcacttccgaaagagcttaggctagacaccttgagttggctctcattagaaacggataacgggcgaaacattgacaaagagaccaacgttggaacggtaaggtatgggcaacacttcttactcaggagaccctccccatttgtggcaacgattttgcgccattcaagggcacactggacgttccagtaaccccatcaagggccagtttatcgaagcggcaaaatctggttcgcagcatggagaaccgtatagaatggaaatagtccagacggaacgacagctgcgggcacactacattcccattgtgaagggcgcagccacctgcttggtcaccgttctggcaatatgacggcacagcggaaaggttncaccattaaggttaccaaaggcgtggggtccagtaggacggtcacattccccattttcgagagcagagcgtgatataaatttccagactaaaaacgngccgacataacggccatatacccggtttttgtggtatctataaagcacaccgcgtgtcagtagatagacctgttcc

SEQ ID NO: 695557 - DNA, 163 bp, Homo sapiens
ggtacggtgtttcagatgcaccaatgtccttgttgcatttgcaggccaggtttcctaccagtggctggcgacttagttttactgggccgacgtggaagggttagggagttctgacgtggtctctgtttaccactggactctgggtctgcatgttcatagcctc

SEQ ID NO: 695558 - DNA, 193 bp, Homo sapiens
tccaggatgaccaggtagactaacctccactctcattacttcatttgactagaaaaaaaaatgtattcaccaaggaacaggacccaattagttcagacttttgttacgtttctttactaaggcaatttttgaaacaccagttactatgcggatggtgggaatttttcatggcttacagaaatagcagacttag

SEQ ID NO: 695559 - DNA, 497 bp, Homo sapiens
  misc_feature (2)..(2): n is a, c, g, or t
  misc_feature (25)..(25): n is a, c, g, or t
  misc_feature (37)..(37): n is a, c, g, or t
  misc_feature (78)..(78): n is a, c, g, or t
  misc_feature (84)..(84): n is a, c, g, or t
  misc_feature (112)..(112): n is a, c, g, or t
  misc_feature (114)..(114): n is a, c, g, or t
  misc_feature (117)..(117): n is a, c, g, or t
  misc_feature (228)..(228): n is a, c, g, or t
  misc_feature (370)..(370): n is a, c, g, or t
gntgatctggggtaatgtcatttcnaaactttagacntatctaatagcctaaaatgacttacaaagaaacgtgtctgngtgtgnatgtgtatatattgataaatgggtatantnaantatatatacaaacacatacttatatactattacccaggtataaattcttttttcaggattttttagatagcagtagaataaaaataattttaaaatgtcatactttatagnttaatttcccccttaaaattaaactataaagtatgacattttaagggggaaattggttattttcaattattaaaggttaaaataggccaaatcactttttatgcaatcatgttttatacagtggtctcattgcacattgtgntttttctgcactttttacggtatccttatcatgctggtatgtcaatatacaccctaaagaaaaactccatttaatgattgtgccttgtattctattattttttgcatcattagtaaaattaagttgt

SEQ ID NO: 695560 - DNA, 112 bp, Homo sapiens
caggagggcaaggttgacagttatctccagaggaggaggagaaagggagaatccgaggggaaaggggataagatggcttcagccaaaatgccgcaacccgagaggggacctt

SEQ ID NO: 695561 - DNA, 128 bp, Homo sapiens
gcaatgacgccacggcttattcttcatagcacccatttgagaccaccgttaccattccgggagtcatatatacacttcaagtaactacaccgaggacttggctcaagggactattactccattaagga

SEQ ID NO: 695562 - DNA, 424 bp, Homo sapiens
cgcgtacatcctcttattaaactcgtaaatactattgggacaggccgggcgtggtggctcacgcctgtaatcccagcactttgggaggccaaggcaggcagatcacgaggtcaggagattgagaccatcctagctaaaaaggtgaaaccccgtctctactaaaaatacagaaaattagctgggcgtggtagcaggcgcctgtggtcccagctactcaggaggctgaggcaggagaatggcgtgaacccggggggtggagcttgcagtgaccaagatcgcgccactgcactccagcccgggcaacagaccgggactctgtctcgagaaaaaaaacaaaatttacaaaaaagatactaccgggcacaaagaatttaggagaaatagaataatcatctctaccgaattctgctctcaattaaacaag

SEQ ID NO: 695563 - DNA, 832 bp, Homo sapiens
acactctactctcctccaactcgtcgcgctctaactcgcacgataatacacccccaaatgcgtttttggctttggctagccttgaggccaaacaacaggacttatacttgcgaattatgtcaaaattcttggcaaaagaaaaggttgcgaatactggcggaatcaagcaaagtttccaagctgcaacagtcttttaccaacccaacattaactaaaggagccacggttgctgattctttggatgaacaggacgctgcctttgaatctgtttttgttgaaactaataaggatccagtagcacctgatttcattgggaatgatggagaaaagcaagatctttgattatttacatgttttctctgcagtagaacaataacttaaagaactctataaaatcatttctcacaatcaaatgcatggtcaccatcatcgccaacatttgctattggtttctatcacgtgttttgctgcatataacctatgaaaggaacacacttaccttggtggccaagcacacctacatacatgtaattataccccttataggaccttaaggccttttggttaacctccaccttactactgatcagacagatgttatttcttaactaatcaacacctctcggttactactgactaatattattaacaatctataatctcctcgattttgtctaatataattataaacccctataataacacgtagttacagaatatcaatacagtaagaagttagttcgtatttaataacctaaaacaagatacactcacattctttatcggataaatactaataaatattggcaagaacctttacatactacacaag

SEQ ID NO: 695564 - DNA, 899 bp, Homo sapiens
  misc_feature (89)..(89): n is a, c, g, or t
tcctcggggccttcctcacagcgtttaactatataggagcctgtggcagacatgtgtggcggcgatattctcggaaaaatatattctgngggcacaaacgtctccaaaagagcgcaatgttgggctttacagcttgtgaaggctctttagataatgggtgtaggcgaccttttccaagtaccccctgagtggggccccacggggtacgccgaggccactgttaatgttgttccaaagagttgatgatgaataaaatcgggtgtttttgtgggggcgccctcttactcgcggaggattctcccctctattaaaagagaaaccgccgccaaaagtttgctccgtgcccccttaatgctgtctagccccccgcttcgcaaaaaatgttctctgagaagaatttctccaagaccttctaatggaaccaaaatgttttcaacagggggggaaaatactcctcaaagggacgtctaaaccaaggggctcgtcccttttgaaagaattttacactccatttatgaccgctttcactaataaaggaccttgtggaatcttggggcaaacatattcacacagcgtctgtttccaattgaaactcccggggtgtctactcccccttgagagccgcgaatttattagtaaggggccaaaacttggcgcgtggaaacctcacatcgcttctcttcgcgcgccatatcggcgtgacttcttgaaaataacctgtaccaaacgtcccgtactgctgtggtataacagacgggcccacgctaacgactccccttcagacgacggtcaattattctccaccggaagatcgcgccgcctgtctggacgccgcagggccccgagctaccaaacggaagaaacgaacacacttcccccagcatacaatatacgaagta

SEQ ID NO: 695565 - DNA, 144 bp, Homo sapiens
  misc_feature (27)..(27): n is a, c, g, or t
  misc_feature (72)..(72): n is a, c, g, or t
  misc_feature (95)..(95): n is a, c, g, or t
  misc_feature (104)..(104): n is a, c, g, or t
actgccccgtgcagactggaggggacnctggtagagatggaggaggaggcaactggtcacccacaacccctncttgatgcctctggcctccttgntgcctctgncctccttggtgcctctggcctgcttggtgcctctgccgtg

SEQ ID NO: 695566 - DNA, 327 bp, Homo sapiens
agacagagccttgctctgtcgcccaggctggagtgcagtggcgtgatctcggctcactgcaacttctgcctcccaggttcaagtaattctcctgcctcagcctcccaagtagctgggattacaggcgcccgccaccacgcccggctaatttttgtatttttattagacacagggtttcaccatgctggccaggctgatctcaaacacctggccttaggtgatccacccgcctcgcgcttttaaagtgctgggattacaggcttgagccaccggacccagccaaggccccggttttgctttactagtctgccgcaactggaaggacca

SEQ ID NO: 695567 - DNA, 159 bp, Homo sapiens
accttccggggaggtactagtggatgacagaggcgtcctgtgcaagacgactggtcaatagctccagatgacgacaaggtgcgcttctcactttctggagtcacaccaaattcctctccgacgatgctgaaccagacggtctctgacgagagctgtgtc

SEQ ID NO: 695568 - DNA, 476 bp, Homo sapiens
  misc_feature (24)..(24): n is a, c, g, or t
  misc_feature (391)..(391): n is a, c, g, or t
  misc_feature (402)..(402): n is a, c, g, or t
  misc_feature (421)..(421): n is a, c, g, or t
tgggacgtgctcttggctgtgaantgtggggtgtgtgcagagagcctgggcctggggttcccagaggagcatcttggggaggcctgcacagtaggatcctgcccatgtgccctgagctgatgtgccagccgtgtgaaagtgctctgacaccgtgggccgtacggagggcctccagaggggatgttgaaggcaggagacagctgtgccgggagcctctgcaggccgtggagggcccgtcctgtgacgtgtcttgccctccctgcttccacctctggtgtttgcttgcttcttgcgttcagggaccctttgcttgcagcgccatgttcttgcatctttcttttgctttttgtaagcttttgggatctttcagttttgatgggattgggacaancatttatcctncttgttgggcacgggtttnaacctaaaaggaaagaaggacagagatttttttcccacaagaagggttaaagttt

SEQ ID NO: 695569 - DNA, 1310 bp, Homo sapiens
gctgatcccccgttgcgggtgccctggctgcgggccccagtgttgtgaggatgcccgggtagtcgcgcgctttcggtagcttagggtctaacgggggtggtgacttagcagatctggatgggttcacacattgtgattctcgaatgcgagagtgaaaactggagattcatgatgaaaagtaggcccgcttcggccactggattctcaagaaggacggaggctgccccttcctgtgcaatagatgccccaagtgaacaccagtcagaggaggagacctaagcagatctgctgtccaagaggagtctaagtcaagcagaggcctccaaggaagtggcagagtccaaactcttgcaaagtctacgagctagggatcaagattattaagccagcccaccatgcccaacacgcaagtagtggccatccccaacaatgctaatattcacagcatcatcacagcactgactgccaagggaaaagagagtggcagtagtgggcccaaccaaattcatcctcatcagctgtgggggagccccaagtcagcctccaggactccggcctcaaacccaaaccagctattgattgccaaaaggacagaagtgacccttggagaccttgggaccaaaacctgcagctagggatgtgaatcttcctagaccactggagccctttgcgagcagaaacgggcagactgtgcagatggtcgacgcagcagggctgcactaatcaaaaatagcctatcaaacattccagtggctttcgaacacgactgacgttctgatggcctcggactcccgcagccatcaagcaacgagactggggaaaacggcaacaatggtcactgggagaccaacgcaacagcgctcaacgggactgaacgaagcctttcgaagaaccactcacacgctctcgagcagcaactcactgagtatctgaaacggcacacccctaaactttcactgtgcgcatgaatacaaaatctcgccaccacaacactacatgtctactacaagaacccccatattacttacataaacgaacacaatcaaatcgctgagtacttaatatgacaaccatcattacaactaactaatacacacactggtacccaaccactactatagaagtactcactctaccaacagcacttcatcacgcaaaattattctccaaacaacacacacacacagaccatctgctaccacaacccagccacctcgactcatatactcacccacaaccaaccaacaacaacactgatgatacccacccacacatcgagccaactaatcactatcacaaactatatctac

SEQ ID NO: 695570 - DNA, 112 bp, Homo sapiens
ttctgcaccacagcggaagacgaattagcagattctctctattattttttgttgttgtttgtgttttaagataagatctggctcaagtgcccaggcgcagtgggaccatctt

SEQ ID NO: 695571 - DNA, 310 bp, Homo sapiens
agaaattcactaataaaaatctttgatttttgtcgagtctgtggggcatctacgtgaaccttgcctacttgtatgtctcccctggacatcatgttttataatttctctcttttgtactctttccctttatttctcacactgatctgacactcaggaaaaatagaaaagaacctacattaaatatcacgggttaatttcccctcgtatatcacactgtgcctctttctctcacctgttctgacctgtcttgacttgaataggtagaggcaactgcatggctgttcatgatacaagtgcaagtcattacaag

SEQ ID NO: 695572 - DNA, 180 bp, Homo sapiens
tcggtacctgtcatttagtccatggcgggcaggtggctcatgcctgtagtcccagcactctgggaggccaaggccggcagattgcttcagctcaggagtttgagaccagcctgggcaacaaggggaaaccccgtctctaccaaagatacaaaaaattaggcagccatggagtaaatggca

SEQ ID NO: 695573 - DNA, 631 bp, Homo sapiens
ttggggctccattcatgggtcacctcgagccacttcagagttcgggaagtgaccacggaccaggtgggaggaatagacttctagttcatgcggggacactggagccagagagtggaaagctgggaaagaccagataagaaaccggcccttggtctccctagggacatgagacaccacattccattggtgctagaaaaacctatccacggatgagtctaacggttccaaacgcctcccaccgggtgtgcacagcggccggggtccatggtcactggggtgcatcaggtggtcctccgattttaagatgagtttccggtctagagatgtcctagtctgctcacgggcgggtggcagtagggtaccctgcgtcctcgaaaagccagagggttcacctagtcagacgaaactccagaacagggctgggggagggcctgacggtccggctcacccacagccgatctgttgcaggtcagcaacggtgtcgtgagcagttgccaaccaccagcctttcgggtgcggttctccagttcacgtctgccagtgggtgagggcagaggcagacctggtcagacccagcgcccctcctccctgaatggagccaaaggttacgagtcgaatcgtactgctaggg

SEQ ID NO: 695574 - DNA, 398 bp, Homo sapiens
  misc_feature (306)..(306): n is a, c, g, or t
  misc_feature (331)..(331): n is a, c, g, or t
  misc_feature (386)..(386): n is a, c, g, or t
tggggtctaattaacgaggagatttgccttctctgcctattcctgtcaacttatttcaattcatggggtcagtagttagattcaaagtcagctgactctattcttcccttttcctagaaatcacatgcctattgttaagatgctggatcattaaaagtcagaaccacagagcatcagtgctgcctactgtagacgcctcctcttccagctcatggggctggatgagctcatcctaattacatgggaaaactgaaggtcagtgcatcaaattaatgcaggcagcattatttcaaagggggcgcatgnacctcccctccctatttacaatttnggtcagtgaaaatgggttgttcttcttcccttgcttgcccaatttttgttcaacngggcctttcagg

SEQ ID NO: 695575 - DNA, 650 bp, Homo sapiens
  misc_feature (333)..(333): n is a, c, g, or t
  misc_feature (417)..(417): n is a, c, g, or t
ccgagtagctgggattacgggcgcccgccaccacgcccggctaattttttgtaattttagtagagacagggtttcaccgtgttagacccggatggtctcgatctcctgaccttgtgatccacccacctcggcctccccaagtgctgggattacaggcgtgagcccctgcgcccggccacattcagttcttatccaagaaattaccccgacttaatcttgagatgatacgattatgccccatattaagtaaaaaataattaagaaaaggttttctctaaatagatctttaggccaaataacccgctgatgaaggcattctgatgccttctatcntgttcacgtcatcttcccaaaaccacgttaaaataacccacctttttgttgggcacatatgaaatttttaaaggagtagaatancccaatgatagagaaccacgagctgcctgaaattgagaattttgattttcttaaagtgtgtttctttctaaaattgctgttccttaaatttgattaatttaattcatgtattatgattaaatttgaggcagatgagcttacaagtattgaaattattactaattaatcaccaatgtgaagttatgcatgatgttaaaaataccaacattttaatttaaggctttgcaacacca

SEQ ID NO: 695576 - DNA, 127 bp, Homo sapiens
  misc_feature (90)..(90): n is a, c, g, or t
  misc_feature (101)..(101): n is a, c, g, or t
tgcccagcccctcccccaacaagatctcttggactcaggcctcaaagcctggcctggttgtaaagtgtgtgtccctgtgtgtgtgttgcnggaggggaggnctggggctggaagtccagaacccagg

SEQ ID NO: 695577 - DNA, 889 bp, Homo sapiens
  misc_feature (515)..(515): n is a, c, g, or t
tcgggactgcgtggacggctggctccatagagaggcatccgtcatttgactaccagacggcggccagcggcggagccaggccgggtccatcagcagcccagcgccggcggctccgcggaaagccgcggagcgctgcgaccgtagggccggcaggtccagacgcgtcagcagcagtcccagcgcatcacatctgtccagcgtgcctccgtgtagatggacagggacagatgagtgagtctgagcatcgtacagtcgcaagtccagcaccgttgggcgcttccaaagctgggatacaagtgacgggagactgcaggaagcaggggccaggggcaaggcccttgcgaagcgagacgtccggctgagtgtccctgggactagcgctgtggtcaggtgacgatcaggtaatggagtcccagaccgagatgtgccagaacaaccctaacgaggaaccctcgggggcgcggaaccaaatacgggggaaaggctacacataagctacatggggcttgcatggnaccataggaatcccccggtacaacacatccactcgacacatatccacgaggaccgggataatccctaccgcggggtctaggcacgtcgcaaatacaagaggtgggcatgaacgggaaagtggcataggaagaggacaggggggaatcacttcgaggcagaagggaaaaggtcacatcgcgcggagtgcggaaccgaagacgcccctgtgatggaggacccctaatgagcggtgggccctggtcctggactttcgcttccaagcggtgagaaggtggaaggacaaagaggttatccaatatcctggggtgaagcttgcgaacaagcgtttttgcttgcccggtctcaccacaaagccggtcaaccacgagagcag

SEQ ID NO: 695578 - DNA, 250 bp, Homo sapiens
gatcatcgtgagtaagaagcctggctgtgtgtaccgtgggaagatgccatagatttgcgttacaggatgtaggagtagatttggtctgtgataggtggaatggagaatacacgtgtaggtgcttctgggtagcactggtgtgtattagtttatgtagccatgccagagtttgtgtgggcgggcgcatgtgcaccacagagtgcactcgaggggactttcagtcacaggatttcataattgtcatcgtcac

SEQ ID NO: 695579 - DNA, 182 bp, Homo sapiens
ggccccctactttatttaaaattgcaatcccccgccctcccttactgcacattttgggtttttatcccttcccaatttttttttcccaaagaatttatgacctattttattacatactctttattttgctcattgcctgtctccctctacccctacacttgaataaaagctgttatgtaaga

SEQ ID NO: 695580 - DNA, 506 bp, Homo sapiens
tgctgtgggggcatcggagccagccatgtaagaatcagagctgctccttcctgtgaatcctaggtggccctatgtcttctgtggagttacagtataaagcagggagctaattaagagtattaaaacttaaaaccattttttgactctgattttaagtacatttttatatgtcagttgctgcccttcacactaccaggccctgcagccacagtgttctgttggagaaacttggggaagtgttttctgaaccagtttctttttcttggggtagagcgtgaaatccagacctgtttttgaaaggacagcacaggaggagaaaagtgactgggacgatgcttcctctcatccaaaacacatgcagagatcacactcactcactcaatagctgtttggtgcacgcttatgcacgacccgcccacctgtgaacttacagtagctgttcatatatgagaagttgtgtttctgtgggggttatttttctggtgtgtgtgtgtgtgtattgtgct

SEQ ID NO: 695581 - DNA, 153 bp, Homo sapiens
  misc_feature (13)..(13): n is a, c, g, or t
caactacagcagnctccttccaagatcagtgatctcagatccccataatatttaataataatgagaaagtttgaaatattgcgagaactgccggcgcaccagggttggtgctccacacctagtaatcccagcagaactgccggacatggtggc

SEQ ID NO: 695582 - DNA, 121 bp, Homo sapiens
cgggattgcgtagtatgaagaccagagaaggataagacaagatggaaaggaggctgggcactggtgattcccacccgtaatcccagcacttatgggaggccaaggcgggcagatcacttaa

SEQ ID NO: 695583 - DNA, 434 bp, Homo sapiens
tggtgcacaatagcaaaaccaaatacttcactaacatatttctgtttaaaacattccctaggtaagttaagaatacttgttaatcattggatttataaaataaatggcaagaatgaatacaaactattacattcctctagttaacaaatttttggcttacataaagggatgtatttattctcagtctctgtttaactgtatgtttttcaagatcagtagtttgggtaaggatcagaagctcatctaaggcaacatgcgctgtacttaaattgccatgctttgggatttcagagcagtttgatgtcaaaagctgttgttagaagtattttcctcagtctttcagtgaatatttaaccccttattttaccttgagaggaagggctgtagtttttattccaaagatgctaggtatagaccatgttgttgctacccac

SEQ ID NO: 695584 - DNA, 159 bp, Homo sapiens
gaatcgagctcgtaccggtgtttccctttgatctcttattattcttgttgttttttttttttggagaagggagttccgctcttctttgcccaagcgtggagtgcaagggcacgcaactcctcagcctcaccaacaagcctccacctcccgaggtttcaa

SEQ ID NO: 695585 - DNA, 167 bp, Homo sapiens
gggggggctcccgcgggggggggtccccttttttttttttccgggggggggcccccctttttaagacccattttttttttgtttaaaagggggggggccccccccccccttttttttggggggttttttcccccccctttgcgcttttggggggtttccccccccca

SEQ ID NO: 695586 - DNA, 1002 bp, Homo sapiens
tagcagagagctcagacagcgaggaggatgagaagccagaccaagccacgcagcataaagcaaacagccaagcaaagcacacagggcagttggcagaagcagcaaggcagcagaaggcaactgtccacgcattgcaggcaggcgctgcatggatcctgggcggcagccagagtccgcggatgcattttgaccgactggtgctgagctcccccaacagctccattctgtggctgcagtacatggactttccacctgcaggccacggagatcgagaaggcccgtgccgtggctgagagggcccttaagaccatcatccttcagcagcaggcagcaggcagaagctgcacacgtgtgggtggctctgctcgaacctggcagaaccatgtcacggcctctcaggcagtccctgacccaaggtctaacgagcgagccgtgcagtacaacgagcctctcaaagtctttctccacctggctgacatctacgccacgtcagagaacttccaggacgctggtgaactctacaagcggatgctgaagcgtaccggcaggagaaagctggtggatcaacatacggcgccatccttctgcggcaggagccaggctgcagccagcaacgcgtgctgcagccgagccaggcagtgcatgctaccacaggcagcatgtggctgtcattgcccaaagacctgccccagctcgacgcccacgcaggcggcatgccgagcgggccaacacccatgagacacacgcatcacactacacaagcgcaccagagcgggcggcccaaccgcacgaccagtcaagcacggaagccagaagggcggtccgggaccactgaccaggaacaacacctaacatggcccacaaacacagaaaccactcaagacatcagggaaacagcaaccagcgagcacaccacgacagccagaacagcacagccctagaaactagacacacaaatcacacaccgagctgagccaccacacaccccggcacgaccacaca

SEQ ID NO: 695587 - DNA, 414 bp, Homo sapiens
  misc_feature (18)..(18): n is a, c, g, or t
  misc_feature (37)..(37): n is a, c, g, or t
aaagccttattgagtggntacaagaacaatgagacangaggaactggagacaagtatagatgactgaagtaattttttagttataaaatggaagaaataaaatggggcagaggaggaagagacgggtcaagagaggatatttaagaggagggaaatttggatgctggtaaaaaatatccagtagagaaaaaaaattaagggtgcagaaaagagaaggtgaactgctaaggtaatgccttgggtagaaaagggggagggcatgcgtagttcctccaggaaggaaggcagggtacatgggcacagatgcagataggtgggtggacacaagagttggaagtctataaacagaaaggaagatataacccaaaggtgaggatgtggggaaaggttgagagtttgaggggaaaagaccct

SEQ ID NO: 695588 - DNA, 222 bp, Homo sapiens
aatatgtacatagacaaacagaaaagattgaagcatttcctcagacgataacacttccacgtgcactaaaaaattgtacaggcctttttgagtaccaggaataagtatatcaggagttcccgtcgtggcacagtggttaacaaatccgactaggaaacatgaggttgcgggttcgatccctgcccttgctcagtgggttaacgatccggtggtgccatgagc

SEQ ID NO: 695589 - DNA, 153 bp, Homo sapiens
atgatcccgacgctctctctgtggtggtgatagggtcggcctccaggtttcaagtcagtgaactgcccgtccttccccttgtttcttgtcgacgcgtgcttgtggactcttggcaaagtacgcacatagggtctcgtccacactcgatcatgt

SEQ ID NO: 695590 - DNA, 439 bp, Homo sapiens
  misc_feature (178)..(178): n is a, c, g, or t
  misc_feature (197)..(197): n is a, c, g, or t
  misc_feature (219)..(219): n is a, c, g, or t
  misc_feature (234)..(234): n is a, c, g, or t
  misc_feature (260)..(260): n is a, c, g, or t
  misc_feature (271)..(271): n is a, c, g, or t
  misc_feature (275)..(276): n is a, c, g, or t
  misc_feature (286)..(286): n is a, c, g, or t
  misc_feature (437)..(439): n is a, c, g, or t
ggtaaagtagtgcccttatttggatgaaacccactaccttctgtcagaaactcaaaaggaatcattgctggcatggtaaccctaaagaaaaacaacccagacaagtgccccaacgacacttaaaaaggtgatttattatcttgcccaagtttaggctgggcatggtgactcatgcctntaatcccagcattttgggnggctgaggctggtggatcaccngaggcccaggacttngagaccagcctgaccaatatgcaaancctcgtccctnctannaatacaaaanttagccgggcatggtggtgtgagcctgtagtcccagctactcaggaggctgagacaggagaattgcttggattcaggaggtgggggttttagtgggccgagatcacgccattgcactccagactgtgcgacagagtgagactctgtaaaannn

SEQ ID NO: 695591 - DNA, 493 bp, Homo sapiens
tccaacgtgtaatgttcggtgggagtggggggggtggtgcgagacttaggttaggagcattggcgacggtgaaggtgatgtggcgctgtatggaagcttgccgttggtgtatataataccaaggatagagatcttatgaagagtatggaacgcctattaggtctctgattataactgagactgagaagttacaataggtagagctttgagggaagagaaaatccatcaagagtacatcaattcatgatattgctggtgaattggccaagaaaaggtagccttgtaatggcagtcgactaagaatgcttatgtgcaaactgatagcttcaatttactagaggtgcatagaaagtttggtaaacaagagacaagtttataggactgggttatatgggcatgtgctaatatgttatgttagagaaagaagtacagattagcaatagatacttgttagatgacaaatcaagagcgaaaagtagtgtaatggagagat

SEQ ID NO: 695592 - DNA, 178 bp, Homo sapiens
tggcagagagacagcccttcccaggttcttttctttagcccacttaaagaacagggacctcagtgctgcaggtttccttaggtaaataaagaggccgggcccaggggttgacacctgcaatcccaacaccctggaaggcttgcttgaggattgcttgaggccagcagtttgagacaca

SEQ ID NO: 695593 - DNA, 327 bp, Homo sapiens
ttttttgagatgtggtcttggctgtcacctaggctagagtgcagtggcaaaatcatggttcacttcagcctcgacctcccgggcgcaagccatcttcccacctcagcttcccaagtagctgagaccacaggcttcaatgtgattgaaaaaattcttcaggcttgtattctctagaatctcaaccgtgataagggtttattctgtaaataatggaagcagtggcagaatcacatgcaaccacatctggctcatttttgtatttttttgtggagatagggtctcactatgtcacccaggctggttttgaaatcctcagctaaagtgatc

SEQ ID NO: 695594 - DNA, 223 bp, Homo sapiens
ctcctggactcaggcagtcctcccatctcggcctcccaaagtgctgggattgcacgtgtgagccaccatgcctggcctcattgatttttaaagtaggacaaggtaaagatctaacccccaagccaggtgtggtggctcacggctgtggtcccggcactttgggaggctgagatgggcggttcacctgaggtcagcctgggcgacagagggagactccatctca

SEQ ID NO: 695595 - DNA, 363 bp, Homo sapiens
  misc_feature (355)..(355): n is a, c, g, or t
gagtgcagtggtgcgatctcagctcactgcaacctctgcctcctgtgttaaagttgttctcctgcctcagcctccaagtaactgggactataggcacatgccaccacacccagctaatttttgtatttttagtagagatggggtttcaccatgttggccaggctcgtctcaaacttctgacctcaagtgatccacctgcctctgcctcccaaagtgctgggattacagacatgagccactgcaccgggcctagaacaggaaatacttctaacgtaaactaccattagagggaaaaatggttcctaaaaggcaagagtagatagaatatgtaagctacggacactattcagagaanaggcagaa

SEQ ID NO: 695596 - DNA, 538 bp, Homo sapiens
tgcaagtcgaaagatattgttctggttgcctatagtgctctgggatctcaacgagacaaacaatgggtggacccgaactccccggtgcttttggaggacccagtcctttgtgccttggcaaaaaagcacaagcgaaccccagccctgattgccctgggctaccagctgcagggtggggttgtggtcctggccaagagctacaatgagcagggcatcagacagaacgggcaggtttttgagttccagttgactgcagaggacatgaaagccataaatggcctagacagaaatttcccctattttaacagggaaagtttttgggaacccccccctaattatccaaattcagatgaatattaacatggagggctttgcctgatgtttaccaaaagccctgggtgtggatggtgacgcaaaggaggtttttatgccggggactggacaaatcccctttacttaaatccgtcctgtttagggacttcagtcaactacagctgagtccataggccagaaagacaaaaaatttttatcattttga

SEQ ID NO: 695597 - DNA, 749 bp, Homo sapiens
attggctccgtagatgtggaggctcaggggaaccgggtctgccgcgcatgcatccctgtctaactggctgcttgtgattcgcggtgcaggtgcttgaggaatccaaagactccgtcgttgcgcggcaatatgaagatggatgctggagcaggccaacgagagggagtgtgaggtgctgaagaaaatctaggtggctcgggccaggggatggagctcgccatgttaaagatacgtagcggaggaagactcgatgaggttctgagtgtcgggcgtgccacgtggtgacaccgggatcgggctgaggcacggaggaacatcatcggtgtccagtgtcccctgatccattctcgacagcctgaaacaagctcacccgtagcttacgcttggaagcgggacttgggaacatccacgctatatagttaatacgagggagttttagagacgtactaggaagtttggaagatatagagagtaactacagaaagcattcttggtctcaaatcgtctaatatattttgatagcttgatatagcacgcagcgtgtaagaagaagtaatacaaaggtgagtcactagatctgctcttgagaagctctaatttgtgtttcctaggggtagtactgtataacaaaagcagaatatgtgtgctatcggttgtgcatgacggaacagtcgggccataatgttcgtttgcctcatttcttccttctagaacaccgaatctagaggggtgtcgccagtctcgctcct

SEQ ID NO: 695598 - DNA, 270 bp, Homo sapiens
tgggggggggggccctttttttttggggccccccctgggcccacccccctccatttttttttgcggcccccctttggggggggttttttccccggcccccaccctttttccttttttttttttgggggggttttttcccctttcctcccccctttttccttttttcccgcccccccccccccccgggggtttttttttttcccctttacccccccgggtgatgccttttttggttttgggcaatttttaaatatttcagtggggggagga

SEQ ID NO: 695599 - DNA, 300 bp, Homo sapiens
agcctggccctgtatatgggccagaaatttgtttggtgagtggatcccgtcggacttgctgacgaatatagagtcgacgcctcatattttctcatcagcttcttcagtctccatccctatggtcatcccactgaaatgactgtcaactgatcatgtcctctcagctgctgtggtcttagctcatcgccatgctgggtgcccatcccactggttcttgcaccctttccaactttttctgtaattgctgttctcatatctgaactggaatgctttattcttcaatttctgtgcccatttcaa

SEQ ID NO: 695600 - DNA, 325 bp, Homo sapiens
ctcacctctctcacacggttctctccacactggtatgggagcattattaccttctttgcttttgagcccttgtatttagatgtcaaagtaagtggtattttttctttcccataggaaatcaatattttgagtaggctggtaaccgttcagacatgtaaaggtctttttgacactcatatcctagcatgaattgaaagtaagctttgaattttccgtttattcttttgaatcatcagaaagtagttacagaaaggaagctttttgagatagaggataccattagtcctttgcccttaagtgtgtaagtttgacccagtgtgtagag

SEQ ID NO: 695601 - DNA, 926 bp, Homo sapiens
catttacccaaataaagtgataggcgatagaaattgaaagctggccgcaatagatatagtaccgcaagggaaagatgatacattatacgcctaatgcctaatatactcaaggactaacccctataccttctgcataatgaattaactagaaataactttgcaaaggagagcccgagctaagacccccgcaatacccagtacgagctaccttatagcaagcatggctaacagagacgccaccatcgccagtctatgatagctaaatatagatgggagagattgagtagtgtatgaggcgaaataagtctattcgagtcctgcgtgatagactggtagtcctaatgatatgacatcttgattattgcgaactgtattaaaattgtgtctcacagaggccctcctaagagtccccattggtagattttacactgtatatgtcccttaatagaggaacagcttctttgtgacaactaggaaacaatactcttgtcgtacgagatgtcaataaattttcagcaatccactacgatacggccgtaaaagcaagtcaccatgttaatgaaagcgttcaaggcgtcaagcacctcatctaccttaataaaagatgccaaagcatatgaagctgaactcctcacacccaatttggacccagtctatcgaccctgattatgaacgaacgtaaattgttcagtaactacaagtcaaacctaatgaaaatacgatatctaccttccgacataatgcctaggcgtgagaatttaaaaaactacctggaaactggaccatattaacagggccaattgattctacgaattctaaactaaacgaagtcattattttacccgtcaattgtcaaaccccaaacaagaggggccatggctcattaagcgaaaagggtttcccccaaacagttccaaggcacctcg

SEQ ID NO: 695602 - DNA, 364 bp, Homo sapiens
accccctgctcccggggagatcactaaagaaaaaaaaaaaattcttagaaaatttttgagcatgagacagaagatgtccctatcggggaatttgaaaacaaaacaaaacaaaccaccacacccttttcagaaattattttcattggagcaaagattcccaaactacattttttttttctttttgaaaattcacatttccaagggatttttttttattatacttaaagttctagggggcatgtccacaacatgcaggtttgttacatacgtatacatgtgccatgtgggggggctgcacccattaactcatcatttacattaggtatatctcctaatgttatccctcccccctcccgggatacag

SEQ ID NO: 695603 - DNA, 392 bp, Homo sapiens
gggcccagattatgatgtcatgtaactcttttattgttatcaaaaaaaaattttttgacacagtatcttgctgtgttgcccagactggagtgcagtggcaagatcacggctcactgcagcttccaactcctgggctcaagtgatcttcctgtcacatgagtctcccaagtagttggaacacaggtgccagccaccacacctggctaatttggtttggttttgtttttttagagatgggctcttgctatgttgcctatactggtctcgaactgctggcctcaggcaatcttcccccctcggcctcccaaagtgctgggattacaggtgtgagccactgcaccctgcctcagtacctccattcttcccacacaccctcctcatgtgctccttcc

SEQ ID NO: 695604 - DNA, 446 bp, Homo sapiens
  misc_feature (67)..(67): n is a, c, g, or t
  misc_feature (286)..(286): n is a, c, g, or t
  misc_feature (298)..(298): n is a, c, g, or t
  misc_feature (388)..(388): n is a, c, g, or t
  misc_feature (402)..(402): n is a, c, g, or t
  misc_feature (430)..(430): n is a, c, g, or t
  misc_feature (437)..(437): n is a, c, g, or t
aaatgtagggtaaaaaaatgtttacatgggcatgattcttttttataatttactttaaagctgtctncatgtttgatgtatctgagcaggttgctccaccaggtagctctaggagggctggcaacttaaaggtggggagcaaagaattctctttatccaacatccaacattttggcagatttgaacttcttcaattttttgcactcaaagcttgttaaaatagttaagcgggcataagttaacttcccatttacaaactttgcttaaaatttgggggaaaatttanaaaaaaaattgncaggattattggaaatttgttataaagaatgaaacattttgtcaaaaaaaattcaaatttactttttaaacatttgaaaaaataaggcanggttgtggttaatntggtttatttttgttccccaagttaaanaaatcanaaaacttta

SEQ ID NO: 695605 - DNA, 112 bp, Homo sapiens
atgctggaatagctcccttttttggtcttggttcaggggggtgggctttccctcccccctccccctattatttggggataaagaatataaagacaaccctggcaaaaaaaaa

SEQ ID NO: 695606 - DNA, 556 bp, Homo sapiens
  misc_feature (165)..(165): n is a, c, g, or t
  misc_feature (168)..(168): n is a, c, g, or t
  misc_feature (172)..(172): n is a, c, g, or t
  misc_feature (182)..(182): n is a, c, g, or t
  misc_feature (195)..(195): n is a, c, g, or t
  misc_feature (202)..(202): n is a, c, g, or t
  misc_feature (204)..(204): n is a, c, g, or t
  misc_feature (217)..(217): n is a, c, g, or t
  misc_feature (221)..(221): n is a, c, g, or t
  misc_feature (224)..(224): n is a, c, g, or t
caacagggcatcccatgagtgccagcaccaagctgaagaggaacagcgcaacccaccacttcccctggatgtttccttgtcgcatggcgtggcttgagacacgtgttcattcccaccccagcttcaacgtcacagcccgtgacttccaacgcttctttgcagacntgnactntgaggaaggntggtacatgtggngccagtnangtgatttgggggnaggnttncagcaagaccttcacctcctccagacccccctcccctcctgtgtgccttgtaaatagaaccagatcaggccgtctcctcttcccttcccgggcccccgggtgtaaatatattgttatgatttttttcttaaagaaaacgtcaattcgcaccgttcaggctggcgccaggcctcccacagctggaatttgcctcttgtgctctggccccaaggtcaacttcctcctctctccaccctggagggccaggggagtggaaagagctccttatgtcttagtttccacagtaagggttgcctgggttcagacctccgttccataaattattggcatga

SEQ ID NO: 695607 - DNA, 332 bp, Homo sapiens
gtatccaaatatcttccaccttgtcctcgcttattttctcctttctgttatcgtatatgcttgatttgatgataaaagagtttgttgcagtagctgcttcctctctgagtgcttctctctgggtcaaaaattcattctttatagatcgtttcttggaattttctagtctctggaagagaaaggtctctccatacggaaagatggaagatgaattctcctcatttgaattttgccatgccacagatttttcagttgaggtagcaacatttcttctttcacggaaatagctcccagaaactccttttgttgaccctggaatctctggtacaggt

SEQ ID NO: 695608 - DNA, 137 bp, Homo sapiens
  misc_feature (19)..(19): n is a, c, g, or t
cagctctctctgatgcganctgggtcctttcgcttcttccagagcttcctttaccatatctgcagtgtatttaacatctgtgcactttggcttgccctttgtagcttcttctaacaacatctcagctctggcaatgt

SEQ ID NO: 695609 - DNA, 309 bp, Homo sapiens
gtggaagtgacatcgtctttaaaccctgcgtggcaatcctgacgcaccgccgtgatgccagggaagacagggcgacctggaagtcaacttacttccttaagatcatccaactattggatgattatccgaaatgtttcattgtgggagcagacactgtggtctcacgcagattcagcagatccgcatttcccttcgcggaagactttggtgcttatgggacaagacacattatcgcaggccatccgaggcacctgagaaccacccagcttgtgagaacttgctgcttcatatccgggggaatgtgggctt

SEQ ID NO: 695610 - DNA, 776 bp, Homo sapiens
  misc_feature (519)..(519): n is a, c, g, or t
agcggagtgttcactccaggccacagactccgaccggaactgacagcgcggcctccaggattgaagccatccctggcttgaagtagcctaaggagatttgctagtttgagtcctgggagatgagatggggaagatgggcccaagctgcaacatgaaggtccatgatgaacagttggcatctcctacagtgcctgccacttggtaatgttcaatgcagccaagggagctaaggtaatgaacaaaacagagaagttcctaccctccctgatgttcattctagcaaatggagacagatgataaaaactgcacatcattgagcaagagggacaccatggataatggaaagatctacggcaaggctggctgtctgccctgtctaaggaggacgtactggaccatcctgctctgcacatccagatgtgtccatgaatacatccataaaacgatggcctgtggaatcctataggaaaatgatccagagcctgggcggtcagaaggaacaaacacttgatttacaanataaatcttctatgtttatgttttaaagacacacagaggaaaaacatttttaaattcatgatttccccccccagattttaactattgtaatctctttctttcctgagccttaggcatcttcattataaaccaaaagatataacttgagattttcccagggtttatatactcgttagagttggaaacatgaaaatggcaatttgggatgtctctttggagtcaaaaaccttataaaaatataatgtactttcaaaaaa

SEQ ID NO: 695611 - DNA, 852 bp, Homo sapiens
  misc_feature (68)..(68): n is a, c, g, or t
  misc_feature (110)..(110): n is a, c, g, or t
  misc_feature (143)..(143): n is a, c, g, or t
  misc_feature (174)..(174): n is a, c, g, or t
  misc_feature (177)..(177): n is a, c, g, or t
  misc_feature (365)..(365): n is a, c, g, or t
  misc_feature (391)..(391): n is a, c, g, or t
  misc_feature (507)..(507): n is a, c, g, or t
  misc_feature (519)..(519): n is a, c, g, or t
  misc_feature (623)..(623): n is a, c, g, or t
  misc_feature (705)..(705): n is a, c, g, or t
  misc_feature (716)..(717): n is a, c, g, or t
  misc_feature (780)..(780): n is a, c, g, or t
  misc_feature (798)..(798): n is a, c, g, or t
  misc_feature (803)..(804): n is a, c, g, or t
  misc_feature (808)..(808): n is a, c, g, or t
  misc_feature (819)..(820): n is a, c, g, or t
  misc_feature (831)..(831): n is a, c, g, or t
  misc_feature (835)..(835): n is a, c, g, or t
  misc_feature (842)..(842): n is a, c, g, or t
ggtaagggcagtcgtccgcgctggctgggcagggagcggcagcagcgagccggggaccccggcgccgnccgcgcgcggtgggactggggctgcggtcccggccgggtggngggctcctgggacacgtgaccggggcgggagcngggccgggcggacgggcttccgcctgggccnggncgcggcccctctgagcgcccgcctccccggaggccccgtctgaggtctggcagtcagagacagccgggcgcccacggcccgagcgcccacggcagcaccatgcccgcactcctggagcgccccaagctttccaacgccatggccagggcgctgcaccggcacattatgatggagcgggagcgcaagcnggcaggaggaagcacagcaggtggcntacagatgatggaacagaagcatgaaggaagaccaggagcagacggcaagacaccaggagatggacgagagaatgtcattagcaggagaccaaggaacaaaattctgaagttgganggagaagctttnggctctacaggaagagaagccccagcttttcctgcagctcaagaaagttttacatgaggaagaaaaaccggaggcgaaaggaacagagtgacctgaccaccctnacatcagctgcataccagcagagcctgactgttcacacaggaactcatctctcagcatgcaggggagccctggagggacacnatcgcccaggnnaccctcatggcagctgacaggagcccaaaccaaatgttttggacccccaagtgcttacgaccnggcactacgtggggtcanccagnngctnttgcagggacnncagagcatggncaanccaggcngcctggtggg

SEQ ID NO: 695612 - DNA, 180 bp, Homo sapiens
gacaagccgctgccgccgcggatctcaccgtcgctcaggctttttagaacttcagccataaaatgggcgcattttccttgatcatatcggtggtacccgtctgttattcttgtgccaactgtgatacgatccttaccaaccgctccgaactcctctccactcggtttcacaggcgccact

SEQ ID NO: 695613 - DNA, 722 bp, Homo sapiens
  misc_feature (68)..(68): n is a, c, g, or t
  misc_feature (235)..(235): n is a, c, g, or t
  misc_feature (261)..(261): n is a, c, g, or t
  misc_feature (377)..(377): n is a, c, g, or t
  misc_feature (389)..(389): n is a, c, g, or t
  misc_feature (493)..(493): n is a, c, g, or t
  misc_feature (575)..(575): n is a, c, g, or t
  misc_feature (586)..(587): n is a, c, g, or t
  misc_feature (650)..(650): n is a, c, g, or t
  misc_feature (668)..(668): n is a, c, g, or t
  misc_feature (673)..(674): n is a, c, g, or t
  misc_feature (678)..(678): n is a, c, g, or t
  misc_feature (689)..(690): n is a, c, g, or t
  misc_feature (701)..(701): n is a, c, g, or t
  misc_feature (705)..(705): n is a, c, g, or t
  misc_feature (712)..(712): n is a, c, g, or t
ggtaagggcagtcgtccgcgctggctgggcagggagcggcagcagcgagccggggaccccggcgccgnccgcgcgcggggccccgtctgaggtctggcagtcagagacagccgggcgcccacggcccgagcgcccacggcagcaccatgcccgcactcctggagcgccccaagctttccaacgccatggccagggcgctgcaccggcacattatgatggagcgggagcgcaagcnggcaggaggaagcacagcaggtggcntacagatgatggaacagaagcatgaaggaagaccaggagcagacggcaagacaccaggagatggacgagagaatgtcattagcaggagaccaaggaacaaaattctgaagttgganggagaagctttnggctctacaggaagagaagccccagcttttcctgcagctcaagaaagttttacatgaggaagaaaaaccggaggcgaaaggaacagagtgacctgaccaccctnacatcagctgcataccagcagagcctgactgttcacacaggaactcatctctcagcatgcaggggagccctggagggacacnatcgcccaggnnaccctcatggcagctgacaggagcccaaaccaaatgttttggacccccaagtgcttacgaccnggcactacgtggggtcanccagnngctnttgcagggacnncagagcatggncaanccaggcngcctggtggg

SEQ ID NO: 695614 - DNA, 375 bp, Homo sapiens
gtacctcggaccggttcgcagtaccccacagcacagcaagcggatgacaatatttgtaaatgtggcaatttgaagaacatagtcaacgtaacaaactcttgtataagcttttctggtttatctgaaaactggccaattctttccttttataaggtctaattagacatggaaagtggcatatgtactctttgagtgttccctcatctccatcaactactttccacagtggacacaggcttgaccttaggggctgatatggagccccactcctggtgtactggttgggctcattttcttgggcagcagagggtataggctagggctagttggataagggggaaaggtgcctgatgatattggggtggaatctcatta

SEQ ID NO: 695615 - DNA, 688 bp, Homo sapiens
ggaggagctcgcctgctgccctcttgcgcgcgggaagcagcaccaagttcacggccaacgccttggcactagggtccagaatggctacaacagtccctgatggttgccgcaatggcctgaaatccaagtactacagactttgtgataaggctgaagcttggggcatcgtcctagaaacggtggccacagctggggttgtgacctcggtggccttcatgctcactctcccgatcctcgtctgcaaggtggccaggaactcccaaacaggcgaaaaaaatgcttgccctactcaagttttcctcctttccctccctgggttggtgctggggcatttggctcacttcgcttcatcatcgactgaggagcaagggccaacgcttctcctcttggatctcttccatctgttctctgctgtggtcatgctgtagctgaccaagctcgtccgggggagaagccccttccctgtgggtctgggtctggcgggctcagctagtcagagtacgtatgatattgtcgacagatagacacgtcaagctttcgacttccgtcccgtcgaagaaattgtcccgccactagtcctctgagggctgactcccagtctcttcactctggtcctcaggcgaaaactgggccattaccagagtcttccttgctcggtgcgacacctgctgtccgattgacggtgatc

SEQ ID NO: 695616 - DNA, 107 bp, Homo sapiens
tattaaaaggcccttttggacgattattcagccactactagcaagaaaatctgaaaggtctcggcctaaagcagggcctccccggaagggagcccaaagggtaccga

SEQ ID NO: 695617 - DNA, 288 bp, Homo sapiens
  misc_feature (27)..(27): n is a, c, g, or t
  misc_feature (63)..(63): n is a, c, g, or t
  misc_feature (80)..(80): n is a, c, g, or t
  misc_feature (103)..(103): n is a, c, g, or t
  misc_feature (113)..(113): n is a, c, g, or t
  misc_feature (119)..(120): n is a, c, g, or t
  misc_feature (123)..(123): n is a, c, g, or t
  misc_feature (141)..(141): n is a, c, g, or t
  misc_feature (145)..(145): n is a, c, g, or t
  misc_feature (173)..(173): n is a, c, g, or t
  misc_feature (178)..(178): n is a, c, g, or t
  misc_feature (186)..(186): n is a, c, g, or t
  misc_feature (190)..(190): n is a, c, g, or t
  misc_feature (198)..(198): n is a, c, g, or t
  misc_feature (204)..(204): n is a, c, g, or t
  misc_feature (206)..(206): n is a, c, g, or t
  misc_feature (209)..(209): n is a, c, g, or t
  misc_feature (214)..(215): n is a, c, g, or t
  misc_feature (218)..(219): n is a, c, g, or t
  misc_feature (223)..(227): n is a, c, g, or t
  misc_feature (234)..(235): n is a, c, g, or t
  misc_feature (280)..(280): n is a, c, g, or t
  misc_feature (282)..(282): n is a, c, g, or t
ggccttttacagatgtcagctttcacnggcctccaggcccaacctcccactaccacccaatcngcctgccacagcaaagngcaggcaccctgggccccctggnggatgcgggngggggnnacngggcatccggggggtggncgancttggtgaccagcccctggcgctttccngagangagcttcncatncccaaggnacgggncnaangggannttnncagnnnnncggcgcnnagcctcccccgcccggccttccgcccccgccccttgacctgggcntnccgctt

SEQ ID NO: 695618 - DNA, 612 bp, Homo sapiens
gccgggcgcggtggctcacgcctgtaatcccagctctcagggaggctaagaggcgggaggatagcttgagcccaggagttcgagacctgcctgggcaatatagcgagaccccggttctccagaaaaggggaaaacaacaaaaaaaaaaaaccaaaaacacaaaaaaaaaaaaaaaaaaaaaaaaaaaacttgtgtgggggcgcgcgctggggcctgggaaaaggtttttaagaccccattggcggtgaggggcgcgcgggggccacaagtagaggtcacgtgcgaaactgtgggcgccaaaagggtggccccaaagagggagaacccgggggcgcaaggagaaaaggggcgcggggagtctctctcacacacagataaaaaaaagagcgcgcggcgggggggacaccgcgagagagtgttctttgtgagacacaaattttctcaaaagagctgtgggggactctcgcgagaagggaggacacaataacacgggggggggaatttcttatataacacagaggaggaggggctaccaaaagagggagagagcgctatggatgaaaatatatacaaattttataaccccccgaaggattggggggggggggaagc

SEQ ID NO: 695619 - DNA, 542 bp, Homo sapiens
gttggagcaagctggtggaatgatggtggggggggtctggtcagtcacatggtcctcattgcaggtctgggattctgggtctggctctccctggtcccccggtactggttctcatcctcatcctggcccgtcgtctccaggctttcatcttccggttcatccaggtcggtcagggtgccgccttggactgggggccgactctgagtctttcttggtgtggactggttttggggaagggtcacctcttctacatgggggacgggtgagggctcgtccaggtccttggtcaggtcttctggctcctcttctcgggggccacgcttggacttagggtaaggggtggagggacctttcttagcatttttcttcttggcttcgggggtgggtgaaggagagggggagcgcttcctcttcttatagtttccccccttctggtcccgtcgatcggaatcggggcggttcacctcatcggtcagggtctgggctgaaatcttcttacggggggagacagggttcgggtcatcatttacttcatagtcttc

SEQ ID NO: 695620 - DNA, 1633 bp, Homo sapiens
agcgggtgcacgagggcccgggccgcgagcagccgcggcctgtcccggtcgccacccttagacagcggtcgctggtctggtgccgaatgcggtgttcccctgccttagcctgctgtgccgcctcccaatgatgagctgggactggtgcgtgccctcgtcctgtccaagtggccgtccgcgagcgccggagcgctcgcggttgggcccgcgccccttctcctgcttgcctccgcgccccaccgcctgctggcacgcctcgcgtgccccgatcgcacatgcagcattgcacccttgcacgagattacccggagcaccacactacaaagcgacttgcccccgcacgccaccacacatgcatgtccacagacacacacgcacaggacacacaccacccaccaacttcccgcacccacgaccattaccctgagccaccccctggcgcaacgccacgccacccgacagcacgcgcaccaactcgcttccgcgacgaaacaccccccactcctcccccacccattcttctaccccaaccccaacccgcaaacctggcctatttccacctcccacaccgccctcgtaccacccccctcttccctctatcacaacaccccccacctcggtcacttacaccactctcccacccgcccccactcccatctctcgacaacaaaattcgcgacccaacacccccgttacaacagccttccccctcgccctccacaccacacaccatctcagctcccatcctcccgtccatcacacccactgctccccatcccaccaccacaccctcgtccaaccaccatcatcaccactccactcaccccccttccaaccccccacactagctcctgcacccatcccactccctcatcgaccactctccccaaacatccacatcctacacactcgctctaccaacacacgcaccaaccacacacacactgagccactccccaaccacctctcgcgcccactatcctcactccaacacatcccacacatactcccaattcctccaccctcaatacactattcgacccactctcaacacaccaatcatcacaccctcactgcacacccctaacaactatcaagcgccttcatagactcctctcacccactcccctagcccacacatcaatctcgtccaccatcagccctcaccctaacaccatccaccagcccatcataacacaccatcatataacttacgtgctacaactcaaaacccaactatactcgacacgactcacaatcagtaaaccaatacactaacactacccctacttatcacaatcacatcagctatcacactacgcacttacgcacattaacctacttaactaccacccctctaaccgcatccgactcgactcacgactcctcagttctccccacacaaacccacatctatcccactgccctctgctactacccactcccacacaccatcgactcccatactcacatcaacatacccctactactatcgatcacacaacaccccataccaaccacaccctactacatcacccaacatactttattccagcaatctaaaaactctacttaaccacacgcaatctaccgactacgtcatacgaatcacccctcctagttccgccaccac

SEQ ID NO: 695621 - DNA, 230 bp, Homo sapiens
gacctccatttcccagaaagacgtgattatcctgtctcaccctctcaagaagctgaggaaagatcacttgaccctggaaagtcaaggccacagtgagccgtaattgcaccactgcactctagcctgtgttgaaaaagcaagcaaggaagaaaagaaggaaagaaagagaaagagaaagaaaagaagaaaatgttggccaggtatggtggctcatgcctataatcccagca

SEQ ID NO: 695622 - DNA, 278 bp, Homo sapiens
acagggatatatgtcccatttttcggctgagagattcaatgttggtgctatatagaacactaagcaggtactaaagactaggacaatttgcaggagaaaggctattgaaaaacttcacaataattctacaggaagccagataatacaacttctaataaatgccataacttagctataacctctatttgtaccttgcacaaggatctaggttcaaaataagctcgaaacacagcactcaccacttcgacagcagctcatagtcgaatgtgaggaacttg

SEQ ID NO: 695623 - DNA, 951 bp, Homo sapiens
gctgcttagaggctgtctgaggtcacagcgagtgtgctatgtgttgctggtgcacgtccacgcgcccgtggtgctgtctgctgtgggtcgtgcgttgaagtgaattgaatccattgtgttggtgaacttaagatacgtgaactcgggacatgctttgtgcttctcggggggggcttccgtggtctgatgcttatacgttatggagtcttgtaccttgcgcgtcttaggctcagcccctagtgtttaagcacgagttgagtccggtatagacgtttgatgccaggacccacgtgaagtttctccggttaaagatggggagtcgctcgaaatgtggtaggattctttataggagcaggaatccatttacgcgcccctttataaagggtagtaagttctccacagaaggtgcgcgaatatgggaaaattacagaaaggaaaagagtatgtgcaatgacagccattagagtaaggaaccatggaactgttagaggagtggctcttccaaacaagaaggaaaaattgtctctaggttcagtcagagctttcaacaagtaataactttctgtatcaaaatcagagtaaccctttctgtattgagtggaggtgttttgaaaatctttactcatgcaaatgtcaagttggagacaatgtctactagaattggtttgtacaataaatgcggaccaaataatttatggttatctcaaagtgaactgaatgggtaattaggtatgcgctggagtgtagaaattgagctaatgtgcatattaatggtaatagtataaatgcaatggtaattataatataaagtgaagaaatgggaagaaagcttttagaggacatgtcggtatacaagaggtgcccttgtttaaatatagcaaaaaaaaaatgaggggcagagaaaataggagagagaaaaaaaagttgagaagggaaaatagaacacataaa

SEQ ID NO: 695624 - DNA, 292 bp, Homo sapiens
  misc_feature (119)..(119): n is a, c, g, or t
  misc_feature (125)..(125): n is a, c, g, or t
  misc_feature (256)..(256): n is a, c, g, or t
  misc_feature (270)..(270): n is a, c, g, or t
gaactgagataaacaggcctttagtgtggcctagaggactatctggctaggagttaggctgtgtttactgtttgatgtagctttggtgtcagagattaaaatttcctctcgtgtaactncttttntctcctttgttgtctttgggtttccctaataactccttcataagtaggttccgaggcttgtagttatttaagctgtaagtccctgttattacacaggagccctattgatgtggtgtgtgtgtgtgtaaaantgttctataatctnatgattagctcttagtgagcct

SEQ ID NO: 695625 - DNA, 1253 bp, Homo sapiens
gctccgtctgctgggaccaggtcacaatagaccaggtaccaggtagttctgagccagaaaggcaggcccacaagaccatcctaatgggtcgcgtcgacacatgggctgatgcttgtgtgagccctgctaggcagatggaccccgttgcagaaagagcttgtgatggagctgatggtaacctgcgggtgtcgagtgcacgtgtccgtagaagacataggacgacgtcgtgaggtcagttcgctcacaggagaccatacctgaaggtgtgggactatgctagttcccgaaagtttctttgtaagatggacctgcagcgattgccggacctggagagaccgcagagagcacctaagctagaggtgcgcatgcatgtcgcgcaaggacccacaattggctatcatagtacgtccgcggacataatgaacggtcttagtgagactacgacgcaaagatcgggaggcctctaggcgcctaagggctatggtagtctccggaggcacaagtgaacaactttttaggcccgacaagaaagagatcgagggtgggaaacccgtggtggcctttctattattttgcgctttaagcgggcagacgtccgcaagctgggagtcgcgtcccatgagccccttacaattgggggaaagagtggaccttggtcagacttcaaggagttgcacgtttggggccccacaggcgcaatgaccggcgaaaggggtccgtacgtacgaacaggggcggatgcccaggaggaacctttactcaaagcctgcatgcttggaccagcttatatccacacctgtatttcctgtgcgtgaaacgaccacccagtccatgggtggtcctcattggaacacaaccgctagggattgtccccttgtgtagagcgcccttgggtgtcgcctttgacatatgggattggattcccagaacgggtccacccatatggccatccatgtgaacgggtcacttagggaaaggcacccacacgatgtgttacaccaaccagatgtcatacgttgggccatagtccaattggtacacacatcgcggggcgaaatttggacggggagcttagaagacaacaaacggagagaaggccaagaggctcggggcggttgccatcgggacttggactgtttcgttcccaacgggcctggccccttggtctattgccattgccttgtcgtgtggcactgcgcaaatcctgggggatataaaggccgccgtgtagggaactggaccaccccacaagc

SEQ ID NO: 695626 - DNA, 498 bp, Homo sapiens
tagatttgtgcccagatcagcatgcagacgagaacaaagccttcaatttcattggaaattttaaagagagtaggatcaagaccctgaagcagttcgtttgaagaactataacaggagatgaaacatggctttaccagatacaatcctagaagacaaagcacaaccaaagcaatggctaccaaaaggtggaagtggttcagtcaaagcaaaaacagactggtcaagagcaaaggtcatggcaacagtttttggggaagttcaaggcattctgctggttgactttctggagaaaccaaggaaaatactgcttattataagagggttttgagacagttaaccaaagcttttgcaggaaagcttcaccagagagtcctttctactgcaacaatgctcctgctcattcctctcatcaaacaagggtaaatttgaaagtttcagtgggaaatcattaggcattcatggtatttggtttcgtgtagtatatagtgtaaactgatt

SEQ ID NO: 695627 - DNA, 780 bp, Homo sapiens
tggggcttcagagataccatcttattctaaagaacgtactgaccaaaaagtaggggaggggcgggggtcttgcgaaatttaatataaataagaaagagggggtgtaaagaacttctctcgtgtggacccgagaaggcgcttcagtctctctcgggagttcacagtgcagtagaaggaatctcagttttttgggcaaaggtgtccagaccacaagacgagggggaagaaccagggcgagggcgctcagcataaaacacatggagcggggcgggtgcctccgcacccggagatactgaggccccaagggagaacacgaccatcgaacgggaacgggaccaccgtgcagcctacaagagaccagtcgaaaacaccgcggaggcggagggaagaaaagataaaacagaggacatacacaggcacgccagaatacaccgaaaattacgaggttggggaaaaaaggcggagacaagagtgagaagacgtacggaaacaacagcgacccccacaaacgaacccccaccacagacagcaaagcagcagacaaccacacataccacaaagaggtgcaccacagttgtaggatgacaaaaagaggaacatggagccgacaccgggatcgaatgcataaagaaaagaagaaccaccacaccccaaagggacggtacccacacaacaacaaaacagacaagagtgggtgtccgcagaagaaggaaccaaccaacacgagacacccaccaggggaggagtaaccgtctgacgaaagaacgaggaacaaaaagg

SEQ ID NO: 695628 - DNA, 890 bp, Homo sapiens
atttgggttttattgtttatgctaaataatactaaaaaataaacatttcattttgaaggcagggtttgaattattcaatttgatccatttatttaatataacgaaaaagaaaggagggggaatggagatcatggtccacagaacaatagtaacgttaaccccgtacaccaacccccaaacgctctatcctatgcatgtgaacatctccacacatcaccatgtcagtgccgtgatattcggatggatgtgcatacgtcatgcaccccatggagacgtgcgctgaatggcacagaggagacatagtgggtgccaagtttaattactctcagaaggtaatgtctagactcaatgacaaaactttgtgttggagcttaatagtccgatgaggagttgtactctctacccagggtgtgtcctcgcatcaatatggggctggatgcctatcgattactaaaagcagctcaataaaaaggccttgtgaaaatatctcttacagtgggaaggttagtggcgattggagtggcggtttaccgaatgcatagaaagtggactagtcaggcatgacatgatggaatatttaccggggtcttcactcaaaatttttgggtaccatggaccaacttagtgtgacttcgttggcattatgaggatttgacacagtagaggtcccaccgagtaaagttgtgcacttccgagggtaagtcgtaatgcaaagagcaaaactaatcccgtgcattggacggcaatctgaagattgtgtccaagcttagaagatttcttgcctgccagatggggccaggacaaaagggcaggtagaatctctccctgtgggagccacaaggcaaccgaaaggcttctcctaccatgcaagtcagacccggacaggggca

SEQ ID NO: 695629 - DNA, 390 bp, Homo sapiens
  misc_feature (292)..(292): n is a, c, g, or t
  misc_feature (360)..(360): n is a, c, g, or t
  misc_feature (381)..(381): n is a, c, g, or t
  misc_feature (387)..(387): n is a, c, g, or t
cgtgttgatcagtccacccagtctatggtgttttgtaacggtggccagagcagacaaagacagtatgaaaacataacttctccccacacgctgaagttataacggcaatgctttcaacaaattgggcaacgcttttgtggttcccactgggcgagggttgaagcttacaaaacacaaaggcatttttgaacgtctggtctttgaggtataatttctattcagcaaattcaccacttcaggatggatggttctgtgaattctgatgaatgtaaatggctgtgaccagacatanaactttggccgaatgtggtgcctcatgcctgtaatcccagcactttggacgtgtcttgttcataggangatccagaaattctcgagtantaatantcc

SEQ ID NO: 695630 - DNA, 752 bp, Homo sapiens
gtgtccctgtcataaggttagggtctcttcatagcgttgggtagctatcggactggggccatgcgtgtcacgacaggtgtgacttcgccacaagacagcccggaactgggctggttaatgcaggtgaggaaccagcggttgatatttgggcaaggcctggcggaaagaaggctgctagaacctgcttatagagccacaacagggtgcagacaactgtgatgtcagccaatgtcactcgttcgcccaccagaaaagtcctcgtcgttcaagtaagcatccagcagtccccagaattcgcctcacttcctcctttgcattctcagtggcctgtattgtctcgtgctgcatgagtgcccaaggtggggaacacccaggtactgtttctgggggcactatatcgggatcagcaaagctcagcccagcgtgcactcactctggtgctcgctggcctcgtggtagtacgttctccgcgcacgctcctgcatctgcatcagcatagatagtgcaataggcgttgctctcaaacacacagaatccatcatcaccctcaaatgctgggaccttgccggcaggaaatttgcggagaaattcaggggtgcggcatgctttggccaaaatggaagtaggggtggtgcggacgagcacgcaggacctgagccccgtctgtactgagcagcgatgagagccttgaaggccctccagttttcagatacgtgtaacagggtcccagccgccatctagttctagatcgc

SEQ ID NO: 695631 - DNA, 1061 bp, Homo sapiens
gtgtgggcaagtcttcggtctagacactcggctggatcagctctccgaacattccttacatatgagtgtgggctgcccggctgggcaggcaaggatccacatcaggcctccttcagttagctagctagctcacctactacatagcagctgctgtgcacatacggctacagcgagtcctgttgcattattcggtagaatagtccgcaaacttaaaggaagttgcaaggttagaattgtgctttgaagattcgtgagttgtgttccgtgtagtagattttcagtagaaaagtccgtgcaagtggagacatgccaggtttctacaggagagcctgagtggatgggctttgtatgcccaaggctagccatgcccgtactgactcagagagtgaccttcctgaagagcgctgggagattctgagtggttcccacagcttcacaggataatgcagctggctgtggttgtatcagaagtacttgagcaatggttcctcagtttgggtctgtttggaggaaggctggggccatcactgcacacgtgacatccctggttcagtttactcagtgatccctttgtataaggacactctgaaggcttccagcatgtcggtcgaacaagagtgagtccattcggtccccacactcccagtccagacagcagacaagtgcaccatcaaatgatcacgggcaacgcgaccgcccacagctcatctcacagaaccaacaacatgggatcaccagcgtacaagcacgacatccacgcattgcatctccgccgagtgacaagcgacgactcactaatccggtcgaagtaattgactacgtcggagaccccagaaaagaaaatacgcaactatagcgaacaggcaaagccacaaacgacgatctaacgagcagacgaacgtaagaacggaggaaaacgtgcacacagacaattgacatacatcaccgtctcccgttcggctagctcgctctgtgctgtgggacgtcatacaacaaccacaaaacacagacgagaaacacaaacacaaaagaccgagccaaaagacacacaccaacaaaaa

SEQ ID NO: 695632 - DNA, 374 bp, Homo sapiens
caagacattgaacaaaggccaaataataaacagcctttatttttaaagtaaaattcattttatttgcggggtagacttgtatggtagactgttaaagacaattttatgactatttatgcacattataatggttacatctgctttttgtctttaaaataaaaaaaaaaatcagagaaaagcccacctttgaatacgtggctgaagataacagccaagagggggtctttcctaaaaatgcaacagataatgctgctagattgttattttgtttgcactttttttgattggcattttaaaatcggtatttaaactgaagacattgtcatgttttattaatttaacaaagttgaaagtgactgctctgtacatcatga

SEQ ID NO: 695633 - DNA, 1041 bp, Homo sapiens
gtgtgtgccctgtgtgagccctgctgctgagcccactgcgccaccctgtcatctacttgctgctttgtggcctgcctacctgtcagcctgccatgtgtgggccaggtgttcctttatttccagtgggactccctgctgctagagacttggcttcctgtgcctgtgcttggtgtgcccctgcatgagtgccatgcctcccacctgcaatggacggccccaccatgggcatggcatggcatgggtgccctgccccactgaatgacctccccgttctgtgcttggtgcgatggctgcttgttccgcctcatgttcgcctcagtgcgtggtcaagctgaccagccgctgccctgcgtggtgggggctacatggcctcacctaccactacgagacccagtagcctagcccacgcccggacgcctggttcgcacaccacctgccggtctaggctgcacaagctcagcgtcggtgcgcaccttcctactttgcagatcgctgtgccgaccctgtaacttcgaccccattcgatgcctgcgcttggctgctttctactcgcaggtgctgctgcaggtcctgattatcatcaccggcaactacaagcttcttcacgcctgatgaccgctggtgcttaccactgcgctgctggacgagcagcaactggcttgtgagcctggccacggcaccgccaggaagacgggcaccttctggccaagggccctgctgggcaaccctgtcggttgttgctggaacctacccgttaaccgggctacataggcactattgcccgtgagccaacattggcctgtaagttacaggaacgacaaggagcataccgttgcaaaagcgcagtttagccttgtaccacgggatgtcagaggggatgagaaaacgttgagcttgccgcaggttttgtgtcgcttattgagcccattgcttgtaggtgggagacgtcacatcctccaccatgctccgtgcagactagtgacgtcgaggaaggtcagtctagtcacttacagtgatccggccacgataacagtatcaggg

SEQ ID NO: 695634 - DNA, 101 bp, Homo sapiens
  misc_feature (27)..(27): n is a, c, g, or t
tgaccctccaacatggcggcggcggtngattagggccgcgggtcggagcactcaccgccgctggaggaaaaagaagaaagcgtcggccgccggctgcctct

SEQ ID NO: 695635 - DNA, 1032 bp, Homo sapiens
  misc_feature (408)..(408): n is a, c, g, or t
agcggaggcggatacctagcccggaagggcggggcccggcggtcgtcgctgggggtgggcgcttctggcgggccgaggtgcacttcgaccgccgaaaggcccctggccacaggaggaatctggtgcgcgaaccgaggtctgctagacatatcgaggagacgcgcgcggactggaccggcggggaaagagcaaccagaggtgaagcgacggtgcgcgacctcacacggaactcgcgaatcacgctgcggcgctctccgacgtgcgagcgcgtgagacgacaacaccctgcctcgtggaagccgagcgtaagctcaatggtggcgccgcatccatggcaggcatggaccaggctgcatcgcacggaacgtcctgactggcatgtctgtgggatgcagccaagagctggcncggtcgctaggggctttcgcgtgcgggagaacatcgcgtcgggaacggtgcagcaaaacatcactgctggccgtgctttgcaagccaagcgctcaaagcactccgtggtgtctgtagggcccggggacgggacacccgtcgaggggccctgatgcctcgggttcgggccgtggtaaccggacatgtacaacgccaagctctggtgctagactaatcgctgtggcgcgatgggttgtagatggaagcctcctgaatggcgcggatcaaggaattatcgcctgggttgcagcgaagcacggcaaattgaccctgggaagcaaacgtgacgctctccgagaaaacttcccgaaatccatgttaatcgggggcacaaccatgtggcgagattcctgcgggcacaaagaccggctcggaaaaacttctaccttttaggaatcgggctcgtttgactggggagaagccggcccgtatttgagcccccggagtaaatgctcccgtcccctttgggtgccccgcggatgcccggtcggagcacacgttgagatagccgctcagggaagaaccgtagacaatctggccgaagacagcgaatcccaacaggggactagccgcccaggtagcggg

SEQ ID NO: 695636 - DNA, 767 bp, Homo sapiens
  misc_feature (568)..(568): n is a, c, g, or t
catgtctgttcttcatggatggatgtagtagtgcaattttggctcactgcaacctttgcctcctgggctccagtgatcctcccacttcagcctcccatatagcttggactacaggagtgcaccaccacacctggctaatttttatagttttttttttcatttgtttgtttgtttttggtagagacagaattctccatgttgaccaggctgtagaaggtcttttccgtagtaatttacagtctgacacttagctgcaatataatattcactctgttttttcacgtcaagcagtgtggaccaagaagcattatggcaatttactgacatcaaacaacctgaatctttaaaaagaattcctcaaaggtggtggttcaggttcccatagcaaaagctctcagtccagttcaaacaaaaccaaacactaataaattactcccgataaaaccaacaacaagccttagatagaaatcctaaattcctcagggaattaatgtagtaatctattcagtttcaattaagttaaacaacaaacaaacaaaaaaacctttagttggagctctacattgtnctagaggtgttagcactataagactatgtggtgagtttgcagggaaaaaaaacctgttaatcaaatcacaagggagatgtgattggtataataaagaactatccttggccgggcgcagtggctcacatctgtaatcccagcactttgggaggccgaggcgagtgaatcacgagtcaagagatcaagaccatcctgaaga

SEQ ID NO: 695637 - DNA, 413 bp, Homo sapiens
tgggaactgcttaggggaaatctgcctctcattctattcaaagtcatcccttgaggttcacttgagacaaatgagtatctgattgcttcctctcccctatcatttatgtaaaaatgcagattctctgagccagactacattgtgtattcagtggaaaacttatcgagggctcaaaagaatgcaaccttttgttgcttatctacttctaacctggaagtccccacttcttgttgtcccaccttactggaccaaaccaatgtacatgttacacatattgactgatgtctctgtaaactgtctaaatgcaaactgtacccccgaccacattgggcacatgtctcaggactccctgaggctttgtcatgggcacgttcttaaccttggcaaaatgaactttgtaaattgactgagaa

SEQ ID NO: 695638 - DNA, 425 bp, Homo sapiens
acatggcaaattacatggagtctcacactaagagaggccctaagcatatggacagaacaggtatttatagttcctcccaggtccgttacgcagttataccagctgggtcatttataccataagcagtgtatgcctagtaacatagctgacattctgcctgtatggttaccacgggaacagagctgatagctgggttaaactgaatccaagcccaatttctcatgctgaaagacaagagttttgctaacacttaagtcacgaatatagccagaggtttcccagcttctgtgcttctctgttagtttcagtagccggagtgattctttcaaatgtatggtggatcactttacctgctctccgccctgcagtgggtcccctccttaactcggagtgcagttgtctacaggccttacctgagcttggcc

SEQ ID NO: 695639 - DNA, 618 bp, Homo sapiens
ctgggtgataaaataatctgtacaggtcaggtgcgttggctcacgcctgtaataccagcacttgggaggccaaggcaggcagatcatctgaggtcaggagttcaagaccagcctggccaacgtggtgaaaccgcatttctactaaaaacaaaaaatacaaaaattagccataggtggtggcgcaagcctgtaatcccagctactcaggtggctgaggcaggagaataacttgaacctgggaggtggaggttgcagtgagccgcgatgcgccattgcactccagcctatgcaacgagtgaaactccgtcttaaaaaaaaaagaaaaaaaaaaaatcggtacaccaaacccccaccatgacaatgcaatttatctatataaacaaacctgaatatataccccttgaacctaaaatatgtttttttaagattaaataaaatacttaaaaaataaaactagtgaaaagggtatgaagaaaacttttttaaatgacatgagaggaaggatcgggtagctcaaaagaaggaagcttcctcagagctcaggagcgggctgtgagagctaaacccagaattttctatgattttcagatatagataataaattatgaacagaactag

SEQ ID NO: 695640 - DNA, 416 bp, Homo sapiens
  misc_feature (130)..(130): n is a, c, g, or t
  misc_feature (158)..(158): n is a, c, g, or t
aaaattggagccgaaccttaaaaaagccctaagataaagtccggtggtcccctgagagaagcccttggaaaaatcagatattgaaaagcggtcattccatttgcaacaaaatatccttgtgaaacaaganttttaacacttgtaattatcaaaaccanaaattaaatagacaatgtctacgatgacatgcatattgcgttgttgttttaaaatgtaggttttcatattatttaggtattgcaaggccaacagatcaggagatgactgccattgacaagacagttggttatattcacagatcccaagagaaggggatgcaccatgccatggggctgagggatgtttcattgtaagaacactggggtcagtcaggagggagagacgggaatacatgggcaagagccttttttggtctc

SEQ ID NO: 695641 - DNA, 440 bp, Homo sapiens
  misc_feature (10)..(10): n is a, c, g, or t
  misc_feature (25)..(25): n is a, c, g, or t
  misc_feature (45)..(45): n is a, c, g, or t
  misc_feature (75)..(75): n is a, c, g, or t
  misc_feature (93)..(93): n is a, c, g, or t
  misc_feature (106)..(106): n is a, c, g, or t
  misc_feature (120)..(120): n is a, c, g, or t
  misc_feature (275)..(276): n is a, c, g, or t
  misc_feature (282)..(283): n is a, c, g, or t
  misc_feature (291)..(291): n is a, c, g, or t
  misc_feature (346)..(346): n is a, c, g, or t
  misc_feature (395)..(395): n is a, c, g, or t
  misc_feature (412)..(412): n is a, c, g, or t
  misc_feature (426)..(426): n is a, c, g, or t
  misc_feature (431)..(431): n is a, c, g, or t
actcgcgaantggaaggcaaaaacngcgagcagttcacgcttganctgaccatgatgatctcaatggataaaganggtgacagcacaatcctnttccgcaacagcnaaggtattcctctngcagagatcacgtttaccctgtgtgaatatcaggggaaaagaacgatgtttattggcggactgcaggcgcaaaatgggaaattccacatcaggaaatccagaatgcgacgaaagcctgccacgggctatttcccaaacgcctcgtgatggaagcnncctgtnnttattgangattgagtaactgctggcgcacggatttaatcgttgccgccacatcgtcgtcagnttctgcttcccaggaagcagctgtgccatgacatgtcggtagtctttanggctttagctttcgccncagagtcggtcagnaaggnaccaggcca

SEQ ID NO: 695642 - DNA, 767 bp, Homo sapiens
  misc_feature (37)..(37): n is a, c, g, or t
  misc_feature (275)..(275): n is a, c, g, or t
  misc_feature (301)..(302): n is a, c, g, or t
  misc_feature (307)..(307): n is a, c, g, or t
  misc_feature (314)..(314): n is a, c, g, or t
  misc_feature (317)..(318): n is a, c, g, or t
  misc_feature (321)..(321): n is a, c, g, or t
  misc_feature (326)..(326): n is a, c, g, or t
  misc_feature (329)..(330): n is a, c, g, or t
  misc_feature (345)..(345): n is a, c, g, or t
  misc_feature (356)..(356): n is a, c, g, or t
  misc_feature (358)..(358): n is a, c, g, or t
  misc_feature (360)..(360): n is a, c, g, or t
  misc_feature (389)..(389): n is a, c, g, or t
  misc_feature (396)..(397): n is a, c, g, or t
  misc_feature (401)..(401): n is a, c, g, or t
  misc_feature (566)..(566): n is a, c, g, or t
  misc_feature (571)..(571): n is a, c, g, or t
  misc_feature (583)..(583): n is a, c, g, or t
  misc_feature (585)..(585): n is a, c, g, or t
  misc_feature (590)..(590): n is a, c, g, or t
  misc_feature (592)..(592): n is a, c, g, or t
  misc_feature (596)..(596): n is a, c, g, or t
  misc_feature (600)..(600): n is a, c, g, or t
  misc_feature (615)..(616): n is a, c, g, or t
  misc_feature (627)..(627): n is a, c, g, or t
  misc_feature (638)..(638): n is a, c, g, or t
  misc_feature (702)..(702): n is a, c, g, or t
  misc_feature (748)..(748): n is a, c, g, or t
acacgctcgtccttccgactttgggttcaaggggccncccggtcaaggcgggaaccccgcccccccgctttcttagtgcgccataggcgggtcccctgagggtggcagaatacccgggattaagggcgccttcacgcaagacaactgagggttacgcttctaagtttctggccaatgtttaaacttgtccggataaagtggctttaaaacatttccaaaaactttttccccatctcataaggaaagggaacatcttagaaactatgaacttgcanaaccaccagggggccggatcttcctnnaggantcaaaanacnngcntgttntgnntgggagagcgggctnaatccaatggngngngccttccctttggaaaaaaatgtgaatcngtccctnntggnattgcccaaattggcccctgccaaaaatgccccccctttgggggttttcttttagacccctttcctgaattggcgggtgaaacccctcaaaaaattgggggcccccgtgtccaccttgcccaaaatgggagggccccaatttggtttggggggaatttttttttnccaanccccccctgggngncagtntnaatnaaanttaacccccggggtnntttccccaaanccggggggggncttccctggtccccaaggcagggcatgcatgttggggtttcctttcccttttttttaagttggncccaaacccccccttaagtttttttttttggccccttccttcaaanaaaaaaatttggggcccca

SEQ ID NO: 695643 - DNA, 268 bp, Homo sapiens
tatagctcataacgccttgtctcaacacacccccacgggaaacagcagtgataaacttaagccatgaacgaaagtttgactaagttatattaattagagttggtacaatctcgtagcagccaccgcggtcatacgattaacccaaattaatagatccacggcgtaccgagtgtttaagaaaaaaaatcacaatagagttacaattatacactacagctgtaaaaagccctagttaaaataaaataaccacggtaacaccattttttcg

SEQ ID NO: 695644 - DNA, 314 bp, Homo sapiens
gtctcgtgatagtgagtgagttctcatgagatctggttgtttagaagtgtgtagctcttcccccttcctgtctctctttctcctgctctggccaggtgccttcttcctgttcaccttccaccatgattgtaatgtttcctgaggttccctagccatgcttcctgtactgcctgcagaaccatgagccaataaaataaaacttttttcctttatatattacccagctcaggtagctctttataacaatgtgaaaatgggattaatacaggggtcagtagcatagtctaaaggaatagttttaaaatagccaaggg

SEQ ID NO: 695645 - DNA, 229 bp, Homo sapiens
cttgcgttatctccccagaccagagacacgtggccaaaatacaatatcatggggctggaaatatcccaaatcaaccagcctcctggtgcttgaaggttccattcactattacctgcacaggatgtaaagaatagtcacagcatgcactctttatccagggaaaattcggcagtatttgaatcacgacgatatattctctttatctgcaacccctgatccgatgatctgt

SEQ ID NO: 695646 - DNA, 242 bp, Homo sapiens
ctggcgagggctcataaatgcactgtggcacttagtgtccgtggtctccagagtgtatgacagctggagtctgtcagtgtcctactgagacagccagactcacctagctagcaacattagttttattctgaacaatatatacttatggaagtacacgctcaccagatacaccagtctgcaaacaggctgtcatggtggtgcagtcctaccagttagttgctatggtttcagacataagacat

SEQ ID NO: 695647 - DNA, 286 bp, Homo sapiens
cggagcgacgcagagctaagaggtggctcccaagccaaataaagcagttccaagtaagaaccacagaatggtactttatggaaaacggggcaaccttggggaagcatgtgcgacattccaaggacacagcactgaaagctaacatccaccagttagccgaagaaagttttttttttttcccaatcacggccatggtggctgggttttccggtagagggctaaaactcttcaataagggaagtacttcagtgagggcctatatatggggcacccaagggaatggcca

SEQ ID NO: 695648 - DNA, 121 bp, Homo sapiens
gacgatcactgctggtggatatgctgtacgcgggatcaacccggcgatcgttatcaatgaggacgcggcatgattaagcattggcggcgcaacgccgcactgaaggcgatgccgcttatcg

SEQ ID NO: 695649 - DNA, 655 bp, Homo sapiens
ctctcccagaacataattttggaaaaggacttggtgtctccatcagtcagtttaagacagcctattattccttcaaaggtcaacatttttgaggtagaggtcaagaggccccatacaaatctccaacgcttttccaatgaaagtttggggcattctggtaagtgttttcttttccaatcacaaattttaaggcggcatcagatgataattctttttagggcaatatattgtccccggatggccccggggccattaggacagatgtgtcaaaaaaccacgtctttttgccaggagaggtaataacgagagtcacgcctctccatgtcttattctagaaggttcttttacagtcccgttcacatacaccatctagagatgagatgcttctccccgcgccagataaaaggttcacattgtctccaatatcccccctgtgttaaaggcatataaatgttagggcttggagcagtgcccatgtccaatgcatctgccagtccaaagcaggactagcccagtttaagtatcccgtcgcctgccgaatggtgcatgttaaagcattaatagaacgggcccatacctctggctgcatgaatgtgcatgctcaaataaagaaggggtgggtgaagaatgtaatacattattaaaatgtttcgag

SEQ ID NO: 695650 - DNA, 575 bp, Homo sapiens
gggattacagatgtgaggcaccgtatccaggctgtatggagtctttctaatcaggacataggcagacagtcctagcccagctttatgccttatgagacgcaacaacgttgaacagtcattgtttgagggacagaggttttacagatggatgataactagcatctgtggaacattatttgtgaaatatagaaatcagaaattccagcgtagcactgtccaaggggaacataatttgacctgcatatttgctggtccatttttagtagtcacattaaaaaagaaaaatgacacaggtgaaattaatttgaatatattttcttaattcagtatgcttaaatattatttaagtatgtactcaatataagcaattgttaatgaaatattttactctttttgaactatgtgtttgaaaccccggatgtattttttttttatcttcaccacacatttcaatttgggttggtcacatttcaagtgctcaggagtcacatgcagctaggggttacctattggacaggcaggcagatcttgagagctccaaagaactgtgtgtcattatattgtggaaaaaaaaa

SEQ ID NO: 695651 - DNA, 503 bp, Homo sapiens
cgtatgtcttgtcaacggaaaggggtccctatccagaccccaagagagcattcttggatctcttgcaagaaagaatctgaggcgaatccatagagtaagcttagtgatgtgtgtcagacctctgagcccaagcaaagccatcatatcccctgtgacctgcatgtatacatccagatggcctgaagcaagtgaagaatcacaaaagaagtgaaaagggccggttcctgccttaactgatgacattccaccattgtgatttgttcctgccccaccttaactgagcgattaacctgtgaacttccttctcctggctcagaagcttccccactgagcaccttgtgacccccgcccctgcctgccatagaacaaccccctttgattgtaattttcctttacctacccaaatcctataaaacggccccacccctatctcccttcgctgacactctctttggactcagcctgcctgcacctaggtgattaaaaagcttttatccacgcaa

SEQ ID NO: 695652 - DNA, 157 bp, Homo sapiens
aggacgtatgggatgaggaagtagtgggatgaggaagtactgggatgaggaacgtactgggatgaggaacgtactgggatgaggaacgtactgggatgaggaacgtcactgggatgaggaacgtcacttaatgcattattgtccggtctcaaatgct

SEQ ID NO: 695653 - DNA, 179 bp, Homo sapiens
gctggagtgcagagcctgaaaccatctagagcatgggggctggtgtgtgtcaggccagtgcctttcttggcttaatgttccaggtagaacttgcgaactgagaacgaatttgccaaaatctgacttgtgttgattcgatccagcggaagccacccgtctccgccagcgtggggtaggag

SEQ ID NO: 695654 - DNA, 805 bp, Homo sapiens
ttaaaaacgaggcactttgcatataatcacagttgtgccagagacactgtcagatacattctagatgaccagaactggtttaataaaaacgaaaatacaacccatggagaaggaatatcttaaagtgaagaaacgcatctcattgtaggcattatttgcctcatagtttctactgggccatgtatgtttccatggtactcatgtattagatattctttccagaatctctttccccaagttgctattgtaagagtattctgctgcgatgtggatgacagtatatacacattaaagcagatctggagtcgtgaaagataggctatacacagcagctatacaaagcagaaatacagtgcagtagcgtgcagaaagccatgaataggtagaggactttatctattaggatattggttaaggatatggaggtaatgagattatagggttgaataaggggtatttgtacaaggagaaagagcatttttgtagtatacgaagaggcaagagaacacattcccagggtgagcctctggtggcacgacacatgtcttgggcttgtgttaccgaacacagtcacgtacagacgcacaacacaacctttttaaccaaagggggtagctactacgggaacgatcaggcaacacaaacagggtttacttaaacagttcggccgaaacgtcttgtacagaatttggttacaaatttggaaccccacttggacggtggctcaacaaagtttctccttacagacagcccagcacagcttccacttctacgtgcccacattgcacaacattacaagagaaaa

SEQ ID NO: 695655 - DNA, 351 bp, Homo sapiens
  misc_feature (55)..(55): n is a, c, g, or t
  misc_feature (75)..(75): n is a, c, g, or t
  misc_feature (122)..(122): n is a, c, g, or t
  misc_feature (127)..(127): n is a, c, g, or t
  misc_feature (131)..(131): n is a, c, g, or t
  misc_feature (158)..(158): n is a, c, g, or t
ccaaaaaatattatccaagcataataacatgtagctaccccaccacatgacaccncagagccacatagacacaancacacaaatcatggccattttaccatgcacatacacatggtaccacncgtgncacntgcaacagacatgcatgccccacgtgngtgacacaggcacgcccagcctgcatgcaaatggacacatatgtacacatgtgaacacccccacaaatgtgaacacattcacctgcacacatacatgcacacatgtctgcattcatacatgaatatgcacatgcacactgacatccacatgtgtgcacacatgtacacccttatccccttctgtcgtcttctc

SEQ ID NO: 695656 - DNA, 381 bp, Homo sapiens
tccataagccagcattgatctgattataaacataagaacagagccgcaaaaaagaacacaggcattatcagccattctctcagacgaatagtaattcccgatgacttcatattgaatgttcacagctggcatgaagtttgtataagtcacttccacagtcagcaaaattgccatcaataggtttactaccatgtaccaggtccccagaatgatcgtcccggtgcgaacatgacaacagccgcagcaccgggttctgtagacccggtcactgcggttccgcttgaaactcatgcacaccttcgtaacaggcggccctcttctttgcccgggcccttgacaagcgttccccacccacacacaatctcaagcgtctgtttcgcg

SEQ ID NO: 695657 - DNA, 155 bp, Homo sapiens
tggtccttcacagtgccaccctcgcctcgccgtcgcgtcgcacacgccgcttcgcccttggcgtgtcctttcgccgtggcggctttttcgctgcggcgggcacccggttccgggttcgcccccctccccccctgtgccgcgcccttgcccactcg

SEQ ID NO: 695658 - DNA, 138 bp, Homo sapiens
aatcctgctgctgctgctgcacgtatcggaccacgagccccgaatgaagcagttcttcactgattacatgtgagggtatttctcaggttctgtgacactgatgtcagttagtctgaattctcgcgggagcagcaggaa

SEQ ID NO: 695659 - DNA, 264 bp, Homo sapiens
cagggagggagtgttcagatcagctcacatggtgaagaaagcggaaagaaaatatgcaccgagagggaatgtgtgcaatgaaatcatggtgacagctgcacaacacagtttgcgaaaaaccactgagctgtgtgctgtaaatggttttatgttatgtgacttatatcttgatgttttaaagaaggaatgcggtagaaaaagcaacaggtctggatgcacattggaggacagccgagaaagaaaggtgattgcagctgggcgtgg

SEQ ID NO: 695660 - DNA, 135 bp, Homo sapiens
  misc_feature (115)..(115): n is a, c, g, or t
  misc_feature (117)..(117): n is a, c, g, or t
cttcatcccccagtggggtcatcatccaccgcatgcaggcaacccagcgcagcaagccggcaacgccaggccacatcacttccctcatctctcacacccctcagtcagcgctccncntctccccctacactccat

SEQ ID NO: 695661 - DNA, 655 bp, Homo sapiens
  misc_feature (347)..(347): n is a, c, g, or t
  misc_feature (495)..(495): n is a, c, g, or t
gtcgcttcatacggggctactgcgtgagacgagacagtcggttcgactagacacatcgacgattacagtacgaatacagcttcaaggggccgtacctgatgcagagcgacagcaccgtgcccttcagggcctacacctggaatgctattgaaagagcggatcaggtctgagtagcacgcatcgataacaagccagagaggctcattcgtggcaaatactcgggcttatggaactgggaagttgaagtgacatttggagtgactggaagatgtctaattggaggtcagggcctggcgatttggtatgcgtgatgcatatgactatgatctgagggcagtggtgtaganagtagtactggtatattaatgataggccacaatggacagagcgattgtgaccatgagaattacgggactggtcaagcgtgggcaaggtgccatagggactatcgggcgaacactatcctgtgcgagcggagaatacctattgccaganctcactggctgtaaggaataggtgatggctttacaccgggatgagaatgattgtgaattgtgagccgaagttgaggatgtgagtatcgctgcacgagggcgtgttggaatatctgctgcgggtggaggtgttaggggagcatgagtgcggctgtgggtgg

SEQ ID NO: 695662 - DNA, 1277 bp, Homo sapiens
  misc_feature (1277)..(1277): n is a, c, g, or t
gagatgccgacaggaaagaaggccaagggaaagcaaggtggctccggacccagctgtcgtgaagaagcaggaggcttaagcaaagtggtgcaatccccgtgtttgagcaacaaggcctcaagcaatttttggcatttggacaaggcacatccagaccgacaagagcagcccgatcaccctgcatatagtagcaacattggccccagactatcatcgaaggttcgcaggatgtgacaggacagagcccaatcccatcgtataaaagaccgtgacttgcaacaaagtaggccactcccttgcggcagttaaacccaggatatcaaacaacatgtggccacttggtgaaccactggcacgacaaacactgccataacattccatgcattgcatatacacgagcttggtgaccactcaacgcaacaggttcagccaggaacacacaacggaaagcacccacacaccaggcacaaagggaaggaaacaggacaacaggcaaagtaagcgaaccatggctagtggcagacaccacaggaaggacacccaggacagcacaacggaacacacggtgaccctttggcattggggctagaacacaatggcgcgcgaaaccaggattcaaccacgaaaagaccgaacccaggcaaaggacagcccaaaacgacacttggcattcaccagttatcccggaaaaggcaaaaggaggcaagggtgtaaaaaccacaaccaaggaatacaaacacccgacccccagtattgaggagaatggagaaaggaaacagaccaagaagacaaaatagaaggccttaccaacaggagatggagataaggagcgtatgtgcacgttataggcaacaaacaacacacagaacaaacgagcataggaaagcaaaatcacgcaccccaaaattcacgagaaacgacccataagaaggacatatcggcaaccatatacacaattattgggacaccgattatggagcagaccacctttggaattaagagttacaggggtcacacagaagaaacagtattaggaggtatgatggctgagataaaacaaacatattaatataaggacactatatgagcgaagaattagaaaaagtaaccgaacagaaaacgatggtgaggaacaaaaataaatgagggcaggacgcataaatagggaaaaacaaattatgagtatgaggaaaaaatgatgagttcaacattaagaaagagtatacacacaaaaacgagacagtgtgatgaaaagactagaaaatcaacccgagttn

SEQ ID NO: 695663 - DNA, 122 bp, Homo sapiens
ttctgttctagacacccaagatctcacaattaagtgctagtgaaatgggacgtcaaacacgtagatctctgacttctatctactcaggtgggtcgagaacataagggtgggtcagaactaaa

SEQ ID NO: 695664 - DNA, 499 bp, Homo sapiens
tttttttttgtcgtccgctccttccttcggttcttccgccctttcgcccccccctttgtgcggctcccttcccttcgtccgcgccccccccgctcgccggtcgccctggcgctgcggcctcgctttgctttttggtcccctttgtgcgtcccccgctttctgctccctcttgcgctgctccgtcctctcctctttctctttttctgtgtcgccgctctccccttcctggtgtctgggcttccgccgcttcttcttcttgccgtccgcctccgtccgctgttttgggctttttcccttgctgctctcgcttttggttgccgtggccctgccccctttctggtgtgttcttcgtcgcggacctcgcttgcggccccgcgtaccgtcccccgttctccgaccctcgcccgctgcttccgggccacgtcgccgcggccgccctttcgtcgtcgtagtcgccccgggcttaccggccggccccgccgggtcccccttccctatg

SEQ ID NO: 695665 - DNA, 544 bp, Homo sapiens
ggtccccatgcacatgttaaacacatgcaaagacatcttaccagttaggggatggaggtgccaagttcctgatgtcagccaaatgccagccttgccagtatgcccttgtaaaagatggcagcctcgggcctgccgtggtaactgttttctgcacaggcacacaacccacaaacgacactaacatacttaagacacattttgcagcagcagtgtgtttttggagatggggtctcactctgtcacccaggttggagtgcaatggcacagtcatagctcattgcagcctcaaactcctgggctcaagcaatcctcccacctcagcctcccgagtagctgggaccacagacgcatgccaccacaactggccaattaaaaaaattttcgtttttgtagagacagtggtctcaatacgttgcccaagctagtcttgaactcctgggttcaagcgatcctcctgccttggcctcccaaagtgctgggattacaggcgtgagccaccactgcctggtgggtggaggaatttggatggcttgacagagatggt

SEQ ID NO: 695666 - DNA, 667 bp, Homo sapiens
gctctagatgatccccggtgtttatcggatgccacaatactatgtatattcaccgaatcaatttcctgagataaggttcgtgtgcgcaagtgaacgcctacgcaaggggaatcttcgtcaaggaaaagaaaaaaaatcttgttctactataatctacagataaatcaaagatacttatttttggcagtagtaaatcatatccctcatcttattctgtgaacagatacatctaccttcttgtctttccccataactattttcatttattgctcatttctattcagaatacttattaaaatatatttcaaaaaagttttaaagccgtattttttcttacaagggatccatttcactaaatatttttatacatgtatgtgtatgtagatatttactacgcctctgaggtgatttgcattgcagcatggccttcaacatacaaagactacttaggctttgaatgagacttttttctaactcttccacgtcaaaaccagggtatctcgaaaagccaacaaaaatcataacatccaccaaaagtcctgggcttcacgtgagtgaattacagaaagacagcatcttgcattgtcatctctccctcttgctctatagtccttgtccctacttgtagaaggcttccactctttgatataggatgtgtcggcctaag

SEQ ID NO: 695667 - DNA, 153 bp, Homo sapiens
caacaacccccctagcaatccccctcgcaatccccatattcgtaatcatcggattcactccactcgcgctagggaacacactcgcatcgcacacccacaacccttcacacccccaaactcttcccttctcatcaacagcgctattcccctccg

SEQ ID NO: 695668 - DNA, 788 bp, Homo sapiens
agtgactcacctgctatagtatgccagcgtggtttgaagggattctttgtataagatccatgcccaattatcgcaaacgttgcctccagatagttcggtttaacgatcgcttatgcacgtggacgattttttgtgaatatcggtcggtatataacggacatcactttgatccctgactttcgcgctgtgagtaactgcctttattggatgtctgtctggtctggcctctctgttaacctacagcacgaagttgtagtcaacaggaaattccttaagacagagtaggatcctggaatgggtgcaaccggctggaatgggattttgcgtatggcgagtgtggcaatgttctaactcctagactagtgcttttgacctcttatctaatgcaatctgttgacaggaagtcccaaggcagtgttcctcaccaataatttcagagaagtcagttggagaaaatgaagaaaaaggctggttctgaaaatcactagtaacacatcagattacatggtttcatgttgacaaaagtatataatggtttaactgctgtcaattgtgccatgcctaacagataatattattgttgtatttttgaataataatacatttgtacattcctgatactgggtaacaagagccatgtaccagtgtactgctttcaacgttaaatcactgaggcatttttactaactattctgcttaaaatcatggattttagtgcttgccaccaccagatgagaagttaagcagcctttctgtggagagtgagaatactccgcgggcaagtagac

SEQ ID NO: 695669 - DNA, 720 bp, Homo sapiens
ggagcgcgcgaggctctacagagtgaaggttgaaagtccgaaggtcatggcaaaacatctgaagttcatcgccaggactgtgatggtacaggaagggaacgtggaaagcgcatacaggaccctaaacagaatcctcactatggatgggctcattgaggacataaagcatcggcggtattatggagcaagccatgccgctcggcggacacgagggaaagctgatgaaacggtgccggcggatctgacgaacatggcagaatggtctcgcaagatcacatcgttgcttgcattgcgaagagaatcgggcagatccgtggcagggctgctgaggcctgtgggtgggagcacccagtgcgaaaccctcatccagttttctctccatctcttctctctttgtacagatcccaatttccctatgtagccacttctcgttgcaagtagaactgcaacatcagcatgtctgcaagaaacaatacaagaatagaaaaaaccaactgcgacgggggatacaatgtagcggggggcgggcaagaaaaggggagtgatgcgacaaggaggctcagctggggaccgaagcctgggtcttgccggagaacccgatcctaccaggggggaccagacgcggggggaaacaaacgggccgggcgcgccccactagggaagggcaggcggccagggaatgggcagaagaaaggccggggtttacgccggactttaaat

SEQ ID NO: 695670 - DNA, 600 bp, Homo sapiens
  misc_feature (555)..(555): n is a, c, g, or t
  misc_feature (589)..(589): n is a, c, g, or t
ccccggccggaaagatggcggttgggttcaaaaccggggaacctttgagggtttccaggagatttttgaaggagaactgccgtcctgatggaggaaaactgggggaattcagacccacaattgtcaacatgggttcaattagtcccgaaaatggttctgttttagggaagttggaaaatcctacagtaatctggggagttaaggcagaattggcagcaccatcaacagatgcccttgataaaggatccgtggttcctaagggggatctaccacccttgtgttaatcgagattccggcctgaacctcctgaagaagaggcccaagtggttagccaattcattgcagatgtcattgaaaattcacggttatttcagaaggaggactaatgcatttttccaggaaagctggcctgggttctatactgtgatctcatttgcctggactccgatggaaccattttgaatgccttgacatttgctttgctagccgttttttgtccagttgcctgaagtactataaatgaagaaactgtttaaccggaggttaattaaagangtgatgacacttttgcttagtgacccttactganaggaggctctg

SEQ ID NO: 695671 - DNA, 438 bp, Homo sapiens
  misc_feature (358)..(358): n is a, c, g, or t
  misc_feature (401)..(401): n is a, c, g, or t
  misc_feature (407)..(407): n is a, c, g, or t
aagccttcttcatatgattgtgtgatttgttctctacacaaaacaactcagcttagagaataagaggtggccgaatgtcaatctatactctggctatattcttgcacagggctgtattctaccagaatacagcaagccactgagcctttgctaagcagttcgcctatggacataagtgcccagaaggaacaactttttataaagtgtctatgtaccttttaaagatgtcttccttgacagaaaaaagtcaagactagcgcaatgaaaagttgtgcaaggcagacccgaataccatgaaacaatggaatgcatatgcatgaggcacacaagaacagtagtgacatttaattattggttntcatttgatcttattatacattgctgaagaatataggcatcangaatangaagtcatcttttatatgtatattcctttgg

SEQ ID NO: 695672 - DNA, 117 bp, Homo sapiens
aagaggccccacagtgtcccagcagtggcacagtagcaacagcagtgaggaagaggccagagtaggctgggtcccctgcacaggagttcaagtatcagaagtccctttcgtcccccg

SEQ ID NO: 695673 - DNA, 130 bp, Homo sapiens
  misc_feature (4)..(4): n is a, c, g, or t
tctntatcagctcgtaccgatatgcagagaacccagagggagagctgtaaggacacagggatccaatacgtaagtactaaagagaaaaagaaaacagagacccggagagacagggacggagacccggaga

SEQ ID NO: 695674 - DNA, 229 bp, Homo sapiens
  misc_feature (134)..(134): n is a, c, g, or t
  misc_feature (154)..(154): n is a, c, g, or t
gcccgacggtctttacctaggccagtggttcttaatggatattacagatcagacttctctgtggagtgtagaaatatacagatatgtaggcactgctttggacttcgtgcaatctctttgcttcgatattcttnggtattaacacaattatgtnctgagagattattatcgttatatccgtaaaaatttttctgggcatagaaatttgtccagtttactctttatagta

SEQ ID NO: 695675 - DNA, 114 bp, Homo sapiens
cccattgagccccgtggatgctcagtcctgatatgaaaatgatgcatagcatttgcatattactgacagacattctcccttattcattatatcattttcaggttccttataata

SEQ ID NO: 695676 - DNA, 903 bp, Homo sapiens
  misc_feature (222)..(222): n is a, c, g, or t
  misc_feature (271)..(271): n is a, c, g, or t
  misc_feature (307)..(307): n is a, c, g, or t
  misc_feature (569)..(569): n is a, c, g, or t
ggtagtagccatggcggccatgagtttgttgcggcgggtttcggttactgcggtggcagctctgtctggccggccccttggcactcgcctcggatttgggggcttcctcactcgtggctttccgaaggctgctgctcctgttcgacacagtggagaccatgggaaaagactatttgtcatcagaccttctagattctatgacagggcgtttcttggaagttnttggagattctacattggcattgactggggattccacgtagcaattttntcataactctggtgaatgtacttcattgtggtcaangctgaactaggcagaaattccagaacggctatgtcccagaacactgggaatattataagcatccccatatcaacgatggatttgcccgtaatttctatgatagtcctgaaaagataatatgaacagaacaatggccgtccttcagattgaacgctgaaaaggctgaattacgggtaaaggagctggaagtgcgaaacattgatgcatgtgcagaggagatggaccctggtattactatgagacaattgacaaggaacttatngatcattctccgaaagcaatcctgacaattaagcattttttctccaaatacaaagtatattctctttattggaaaactaaatttcataaatatattctgtgatctcttgctctccggtgaaatatccaagggagcctgtgacatttactgtctctcagtgttggtccagatttgaggcttctgttggaggaagtttggcatcccagatcccaaagaagggttacaatgtacgtagttaaactggcagacatgggaattgtaactcctaaattgtagcacttggaagggtagagtctattagctgacaagggagtctaaagcttaataggtagcc

SEQ ID NO: 695677 - DNA, 151 bp, Homo sapiens
atccaccaaaagggctccctgagggtttgggcaaggggcctgcttttattagcccttttccatggccctgccatgctctccaaacccctttttgcagctttttttagttcaagttccccagactctataaataaaacctggcaggccctga

SEQ ID NO: 695678 - DNA, 516 bp, Homo sapiens
ttctagaggatccctggtatttgctacaccatgaaagaagatagtgagtccgacgtgggggtccgctctgtaacaatgcacagaattactgcgcctgtagaaagatctgctgatcttagaaacttaattgtacgcttagaatttccatgcctgtactaggaggccttgctgtagagtaggtttactggagatgaggaccaactatatgagggtagagagagcctttctctttcagcgtcaacatttttccctgtctcacttggtgcctctcaatgaagatagtgtgtccagggacttgtaggagtgtaattaaagtaggaccatagcatagaatgggatagtgacagtagcaagagctgtgagatgtagactctagttttgggatagacatccttcaggatcattgagagtgtgataggtgtaaacattgaacgttcaatttctacagctcactcatgtagaaacctatcgggaaaagaattcgcatccaagcctgcatgcttgtaagaaattgaa

SEQ ID NO: 695679 - DNA, 192 bp, Homo sapiens
gcactctagaggatctccaaacacgcaatcttcagaatactaacttaaaaatagctgccaggctgggcaccgtggctcacgtgtgtaatcccaacaatttgggaggctgaggcaggaggatcacctgaggtcagaagttcaagaccaacctggccaacgtgatgaaaccctgtctctactaaaaatacaaaa

SEQ ID NO: 695680 - DNA, 158 bp, Homo sapiens
tgcgccgtggtgtctgcgcttagcatcgtttgacaccttgcggtggccagcaggtgcgggcgtcttcagcacgaagtccttgatggccgagtcctgggtggagccctgctggacgtccatcatgtggctccggggctcatactttgactggaatatct

SEQ ID NO: 695681 - DNA, 205 bp, Homo sapiens
accatcccctcccccgcggcctccgctctccactcccgcttaccctcaactcttcgaaatccgccattttataccacccgcgggcgccgccgccgctgccgccgcacccactcccgctgccgccaacgacgctgccgccaccacggccgccgccgccgcctccagcaccatcctgcactgggcgccgcttaagacgccgcggccg

SEQ ID NO: 695682 - DNA, 279 bp, Homo sapiens
cccccctcgttttagcccttacgttttaaaaacttgttccaaacccctggggttatttcccaaaaaaaaaactgggaaagataaatcccccaaagcccaggggttagggggtttttagggggtaaactgggaaggggggggaaaattagggggtgctttcctgctttggaagggtgaagggtcctgggcccttttcatgtgggggttgaaaagctcccattttgtactcccgggtaaaaagctgtgggaccaaaacaaaatgaaaaaagttttttgtta

SEQ ID NO: 695683 - DNA, 330 bp, Homo sapiens
tgatcagaggatcctcttatccgggagagagaaaaaaggtttatgatgttgggggctgtattagtctgttttcatgccactgacaaagacataaccgagattgggaaaacaaagaggtttaattggacttacagttctacatggctggggaggcctcagaatcacggaggaaggcagaaggcacttcttacatggcagcggcaagagaaaaatgaggaagaagcaaaagtggaaacgctgataaacccatcaggtcttgtgagacacaatcactatcataagaatagcacaggaaagactggccccccgggtacagctccccggatacag

SEQ ID NO: 695684 - DNA, 384 bp, Homo sapiens
  misc_feature (245)..(245): n is a, c, g, or t
  misc_feature (317)..(317): n is a, c, g, or t
  misc_feature (345)..(345): n is a, c, g, or t
  misc_feature (366)..(366): n is a, c, g, or t
aacgggtgatgcggttgggaagaggcgctcatcacttcctagatgggatggcggccgggcggagacgctcctcactttccagactgggcagccaggcagaggggctcctcacatcccagacgatgggcggccaggcagagatactcctcacttcccaaacggggtggcagccgggcagaggctgcaatctcggcactttgggaggccaaggcaggcggctgctccttgccctcgggccccgcggngcccgtccgctcctccagccccacatcccatctctcaacactggtgcattagggattacatttacaacacanaactttgtgggatacattcaactcatangcattgcataatttatgaagntaaaaaaatcaatcaacc

SEQ ID NO: 695685 - DNA, 119 bp, Homo sapiens
  misc_feature (8)..(8): n is a, c, g, or t
  misc_feature (38)..(38): n is a, c, g, or t
  misc_feature (91)..(91): n is a, c, g, or t
tgagcggncacctggggtcggcttgggagacctgaagnatggcaccaagctctgctgggaaatgggcaggcgtgtcactgtggtctccganctctgctgggaatgggcggctgtggctc

SEQ ID NO: 695686 - DNA, 844 bp, Homo sapiens
tgctattaaatggtaaatgaaccaagtgtgtggttttggttttgttttggagacagagtctcactgtggcccaggctggagtgcaggggtgcaatctcggctcactgcaagctctgcttcccaggttcaccgccattctccgggttcagcctcccaagtagctgggactacggggcacccgccacagggcctggctaatttttggtattttaagtagagacagggtttcaccatgtgagccaggagggtctcaatctcctgacctgttgtgaaccaccggtctcggcctcccaaagtgcggggattacaggtgtgagccagcacgctgggcccagtgaaccaagggtttttaaggaaacaaaactattttttgaatcatcagatttatactagctatatggatattagcatatcgggtaattatgaatctagaaattttttacatatttttataatacggtgtagctcagttatgggatgagtgaaagataatcatgggggtcttgaatagtgtcaattttgttacagatacaacattaaattcaaatcgtttactttataaatgtgtccatagggcgacactttagatatcacattataagggaggacggtcttcattgctcgtgggtaatgggtgttgtcgtcacaagtatatgggactcctgagtgtagggtgaacaggcttacatggtgtggccggtaaaggccgttggtcccttggtgtatgaaaatgggtcaggttttaggcaaaactaggggagtccaacccgataggtaaaatgtgtactggaggaaatagttttgtccattgggccaatttttgcaacaaattggagttacgagg

SEQ ID NO: 695687 - DNA, 758 bp, Homo sapiens
ttgctgccacctactggtttcatagagccattgtttgtttgtataatatggtgggtatacggtacataattgggcccaacttgtcttgtttttttgtgggttcttttaaaagatgtgctctcaaaagaggtatacgtgtggtcgtagatcactcgcctaatttactagtttggggggcgacaacagtctaaatctgcttgggccgcccaaaagctaggtttggtcccaatatctttgttctcaccactagatgccggacgatgaaggacatatcttgcgggggtttacaaagattcgggcaagactctccaccaacttgttctccattgtcaagtgtgtacaagtgccagctttcgagcttcttgcttctggttacgccctctaatcccgagtcacactcaggggctacctggcaatctgtcttccagcaaccctgttgcaccttagaaagctgctcattgatggctggtatcgatgactgctacacctctagccctggggctgcatcttccaccctgggcaaacttcggccaaggccacactttgaagcaatgttgtggagaccttgacagctacctgacccccgaccttctggaatggagactgtattcgcccagtctccctatcaggagttccctgacacctcgtcaagacccacaccagagtctcccgcaccggactcaggctccagctgtggtacaaaatagggtttttaaacaagaaaattaagtgaattaagcgtgaaaaaaaaaaaataa

SEQ ID NO: 695688 - DNA, 172 bp, Homo sapiens
tctcgctttactccagagtcacattgactccggaacgtgagggtactagggctgatggagatccccagtgcgatccctgaacctcctgcctcaaataccagtaccaccagagtaaccaccctactgccactgatccctagctctgaccctggggatcctactagatgtctga

SEQ ID NO: 695689 - DNA, 173 bp, Homo sapiens
gcaagtaaagcacacttttttttctcctaaaatgtttttccctgtgtatcctattatggatactggctttgttaattatgattctgtattttctctcctctttttaggatatagcagtaatgctattactgagatgaatttcctctgtctgagatgtaatcattgatgcttga

SEQ ID NO: 695690 - DNA, 630 bp, Homo sapiens
agttaaccgtgtagcaactgttcatacagcatctatgtcatacagatgcctgtggtaaggaatctagagatgaattaaagtgcatggtgtcgggggccggcctcagtggctcaggcctgttatcccaatactttgggaggtcaaggcaggcggattccctgaggtcaggagcttgaaaccagcctagccaacatggcaaaaccccatctccactaaaaatacaaaaattagccaggtgtggtggcaggcgcctatagtcccagctgctcgggaggctgaggcaggagactcgcttgaacccaggaggcggaggttgcagggagccgagatcacgccattgcactccagcctgggcaaaagagagagaatccgtctcaaaaaataaaaaaaataaaaaattaagtgtacaggcggatgctgtgggttatgtaccaatgccacgccgtttcatatctgggactgggcatccttggattttggcgtcctccgcggtcctggaaccgaccccctgtgggcaacaagggaccactgtgtgtttcagtgtgagtatgagatgggtgtgagtgggacttgcgtatgtagaggtgtgtgtgagtggagtgagtggagagtgtgtgtaggcgataatca

SEQ ID NO: 695691 - DNA, 318 bp, Homo sapiens
aggtcactctagaggactccccctgcgggtctcatactctgtatggccaacggtttaaaatggtcaagcataaaaaaaaatgacatttggataataaatactgctcttggggctgtaataaataaaaagtttattaaccaagggaatgcacttatcccagcccacaagttatcttcaaaatgtgaatgaaaaactaattatatagtggccataagtacacagcttacgcagaccaaaaagctgctccagattacagccgtttaaacgaacagtgggagctccgcgtccctttgctccctccccgttcgaggaagttat

SEQ ID NO: 695692 - DNA, 100 bp, Homo sapiens
gtacaacattcgggtgaaaataatggtggtatcgacatttacaattttggtggcgaagatggataatcatctttgaaaagcatccgtagtttaaacaagc

SEQ ID NO: 695693 - DNA, 151 bp, Homo sapiens
aatgaatataatcgatgagggacatttatctagaagatataaaggactcctgaaactcaatataaaaaggcaatctaatgaaagaatgggcaaaggggctgagcaaggcggctcacgcctgtactccccacactttgggaggccaaggcag

SEQ ID NO: 695694 - DNA, 1035 bp, Homo sapiens
ggctgctcgtggaactgccccacatcactctccttacccagcatggacctcatggtccattcatggtaatgctggccttcagtctggagctactacacacaggttctggatgctctcctagctgcttgcatccggcctggctgtctgagccctttgcttcgcggccacgtaaccggaccgcgtgtctgttgggacaggctcagatgcagacatctatcggaaagaactatagccctgtggtcctccctctctatcccatcgtctacagcgatcccaggcgtacgagacgcgagaggctatcgcacgcgcacgtccgtggcgagggctgatgcgtagttacacaaggcccaaatggtggatatcgtggtcttgcagcagaccccacagcacgcaggcgcataggcctgtggggaaacgcccactggatggttctcgtgcagctggtgaagaacgccgagcgttccagtgttcctcgttgcgataatccgttgcgccagcgttcactggtcacactatgcagagagggggtgataacatggtggagcttccaatgaatgggcgcaacacgtaggtctggcgaggatcatcaaaccctctggtgggaatgaatccaaattttctctcttgttccgttcatggttcaatgtttgcttgcacaacgagaagacttgggtctcttcttgtgtcctaatgccggcgcaatgggattttggcgcttggggctactttgctgcaaatgtccctctttgtagccatttcttccctacccccgggtgcacccccctccgtttccttggtcgccccctgtgctcctgtattgcctggtgcaagtggggccaccagaggaggaccgccctgctggaagattggttcttgtcttacaagggcgaggccgggggagcccccgaggggcttgggacagcggggctggttggcctgtgcccagatgttctcaacccacccggttcttttggtggttgccatgacgacggggggtgccctttagttggccctatgatccgagggcctgtttgg

SEQ ID NO: 695695 - DNA, 175 bp, Homo sapiens
taacggatgtggggtttcctttcggagtgataggaaagttctggaatgagatagtggtgatggttgcagaacaatgtgaatgtacttaatgacgctgaattgtacactattaaatggttacaatggtcaattttatgtgtatttgatcataataaaaagaaatctaggctgggaa

SEQ ID NO: 695696 - DNA, 250 bp, Homo sapiens
ctccccgcaatccaggcgcacttctgaaacagaaacggagtcatcagattgctcacagtggccaatcttgccctaagtcaaagctctgaagcactgcactaaaagagctcttggaacacctatggataccccaggaaaggaatggataaagttaagccatgatgacctagttgaatccagcccttctgcaagtgcctagttttgacttctgggatggaagtccttccaggcatgccaagagggaaggaaa

SEQ ID NO: 695697 - DNA, 888 bp, Homo sapiens
attatcctaccatgaaccatctcctgtctagagaatagtagtatatcggctcaaactcaatatcgtcaccctagatatgccttgaagagaataatgaggtatcgggtgtgaccaatatgaaatagctgacatcatcgataatcgtcaaataccactcgctcctttaaacgcaactatggtgctctatgggcctgtactagtctttgacggctgcgaccgtacggatgggactagccctactagtctcaatctccaagcacatatggcctagactacgtacataactaaactatccaatgctaaaactaatcgtcccaacaattatattactaccatgacatgactttccaggaaaacacataagtttgaatcaacacaaccaccaagcctaggttattagcatcatccctctactatttttaaccaaatcaacaacaacctattgagctgttccccaagcttttcctccgaccccctaaaaaaccccctccttaatagtaaatactgatcctacccctcacaatcatggaagcaaagcattatccaagtgaacactatcagaaaaaatctactctctatataatctcctaacaatctcttaattataacattcacaggcacagaataataatatttatatctctttgaaacaaattatcccactgggtataataccgatgaggacagcagaagctgaagaagggcctatcgatttaactagatggtctccctaaatgatattatcaaaacctagtcaaaaattatatccctctgcagaaataagcgggcaaattatagagttcaacttaaaattggacctgcaagtggccggaatgtcccaagagaaagccatcccaaatgttgaaggcaataacccacaccctctct

SEQ ID NO: 695698 - DNA, 118 bp, Homo sapiens
tcatgcactttatttaaccatttaatattctgtcatggtacctgattcataggtaggattttgaatattaatgtatgttaatatgtttctgaagtacttacaatcattcttcagcacg

SEQ ID NO: 695699 - DNA, 157 bp, Homo sapiens
cctcttcactgtgccgagctctaaacaaaaatgagaataagtttgtaaatgacatgaaaaagcttggaaatattgtgtaattaaagttgcaggaaatcagacaaaaaatgtatttctaaacacatatagaatgccttgtaaatttcaggttccatat

SEQ ID NO: 695700 - DNA, 711 bp, Homo sapiens
gagacgcccaccgtgtccctggcactctgcagcaataaaaggctagagaagggcagggatggtgcagaggagaaagggatgaacttgctccgaggacaaaggaagaaataaaacctgaatggagttttgaaagtcgaaatcttgcaagccaggaagggaggagaaaatgtgaagacataataagctaatacaggtgggagaggagggtgtcaaccaagacatgaaatggcgtcatgtgttttaggaacgtataagcagctgctggaatataacatgctgggagagaaatgaaagagatgcatctggagacagaggaaggggctgggtcctatggagccatcggcgatgtcctgagttgttcttgagcacactttgtgggtatcaaaacacttacctagggcctgggactttgtatgaccagagtcgtgagaagtcaacatcaccacaatggccatttctctgctgcgatgggttatgggtagaagtacgtgttttctgatcaccagccagttttttaaaataacagaggttttgttccgtatgacacatcaaaataggttctatgggggctaggtaataccatttaaacattatatctgaaaagtcagacctctattcaggtgaccgaatgcaggactctgccagttgacccttagaaccaaggtacattgaggggatggcaacggcatgccgtgaaacaccctgattcac

SEQ ID NO: 695701 - DNA, 1055 bp, Homo sapiens
gagcagaagaagaagcggaccttccgcaagttcaccataccgacggacgtggacctcgaccagctgctggacatgtcctacgagcagcctgatgcagactgtacagatgcgcgccagcggcggcggctgaaccggggacctgcggccggaagcagcactccctgcctgaagcgcctgcgcaaggcccacgaccgaggcgccagccatggccgaagccggacagtgcgctcgcagacgcacctgccggcgaccatgcatcatcctacccgagcatggtgggccgccatggtggcgcgctctacacaccgcgcacacgacctatcaaccacggctggcacgatcaagcccgagcatgatcggcccactaccctgcgcgccgcacttctcccactcgacctaccaagccccgctccccgccatggcccggacccgcgccatcggcggcccaccccaactccctacccgaatatacaatcccgtcctcaagctacactggcctcaagggctaaactaacacagcgcgccaccactgcacatccagacacaccccccgcacaccaccgacccagccacacacccgccgccgctcacgcatcccacaacacaaacacagcggcgagcgaagccgcgcgcgtacttcgaggagagagcgcatacaacacagctgtgccgtgggcgatgcccaacacaaaacgctagcgaagcgggatagtcttaccagcagaccgactaccgcgctcacgccacaccaccaagagcgcgggccacgcgactacactgcgccgcacagccagcaacaatagatgatagacgccctgctagaaacaaacgcgattgggacgcgcagcacaaccaagaaattaccaccaacagaaagacagtgatgcagtcggtcgcaccatagtggggcagaacgcagagctgacggggagaaactaccgtagcaggcagagaaacctcccctcatgcgcgtctgcctactagacggaacaaacgaaactagcgctcatctactcgctacggcgtcggtcctcagcaccacaagcccacccgac

SEQ ID NO: 695702 - DNA, 667 bp, Homo sapiens
gctggttggccaccgtgcatcgggatgccagtggagaagaggtacaacagtgtcctgttcggaggtctcatggctcggcattctctgtcctggcaggtttctgtgtgcgccacggtcagctggggccacctctgactgcttggggaggcgcccggtgatgtctgctgtgcctgtatgggtgtggcgcgcctcatatgcagtctgggccacctctcggagcttggcggtgcttcctggcctccaggctgagttgggggcgatcagcacagggaacgtcagcctctccacggccagtcgttgcgtgacctgggctcgcctctggcccgcaggtcgaggcatggcggtcattgtgggtggttcttctcactggggcttcaccctgggccctatgctcgcgagcctccctgcccctggagaactggcaccctggttggccctggtcttcgcacgcctccgatcgctgctgttcatgcttctgcttcgctgcctagagacgctgcccctggagaaacgggcgccctctatcgccctggggttccgtgatgcggtgatctgctcagctcccctggccctgtctgcgcttctcggctgtcgcgtcgtggccaggacccaccctctggagagaggttcagcagcctgcgccgctgggctatgtctacttcctcta

SEQ ID NO: 695703 - DNA, 91 bp, Homo sapiens
gtactgttccatcccaacagtggagctgctggagagtatgggggcctgcagactgtccgcctggaccatcacaaggccttctacattactg

SEQ ID NO: 695704 - DNA, 1038 bp, Homo sapiens
  misc_feature (202)..(202): n is a, c, g, or t
  misc_feature (249)..(250): n is a, c, g, or t
  misc_feature (607)..(607): n is a, c, g, or t
agccgattatctcagtgcatgctacttacaagatgtgctaagatataagcagaacaaagcatacagattgaccttgaatcataggattaggagatgaatgattgaataatagtatgaatcaatgagtgaacatatggctgcaaataaacacccaatcgaacctaccacccagcatcgcttcgtctataaccatgtatctagnatgtgactggctaagaaacatctcatctaggattttcttgggccagnnccgcgttgcaagcaaaaggagctgtggactggtatccctgggtaagcaagactactcaagtcagtgcatacagttagtaatgagcctgaccataagagcgttagctataaaaccagtacagaacgctgaacttcgccatacttgccataaaaagacccttagactacaggttctcacagaatcgatagtctactagtattacgtaaacgccacatagaatctcttagatgctatgggcacaagatatcaacacgactcataaagtattataggcatacgataatagctagctctcatcctaatacgaggctcgatactaatttaggataatacgctgcactctctcggtaacattantattgaattagccacagtatttactgacaaccctaaaccgcgtaaatgcatagcacattgggttgcacactcgggaacatctcagcacttgcaaggacacgcatcgtaagatattccgcgcaggtacatttgatgaaggaaaaaatgggccgtagagaatctgttaagcatcgtaggacaaataggtagtgaaggaacaatggaagacctctcaaataaggggatagttccctagcaaattctcggattcacacctgggtgtctatagctgcaaattgtttgggatcttgcctccacggtgcataatgcgttccagggaaacatcgaatgaacccgtaatcctggaaagcctcttggaataggatatttaaacgtgacagttactcagaattgctggtccagcctcatgagttatgtcttaagcaatttag

SEQ ID NO: 695705 - DNA, 381 bp, Homo sapiens
tccagtaaggtgtgccaggtgtgccgtggttcacgtatgcgggctctgagtgggggtggggtacaagttggaatgtatctgtgtgatgttcgtgagagtgtgggtgtactgaatagggagttgcataagtgtggagggcctgtgcgtgtaagtgcatttgagatgcgtgtatatgagaacgggagtatttagatgggattcgtgtgagagggtgtgggtgtatcagtgtagggtatatgtatgaaagtaggtgtattagaggagaatgtgggcacatctgagtaggagtatgtgagagcgtggggtatatctaagaccgcgaagacctataggatgtgagcagggctcagcctatgtctgaacgtctacatggctatgaat

SEQ ID NO: 695706 - DNA, 512 bp, Homo sapiens
ctggtgaaccgtgccgggagatcgtgtaagatcttccgatgagagtgagtcaccgtgtctccaggctcgaggttaaagagaaccgcgcatagagtttctagtagttctctgtatcttccgcagcatcagtaaagagttctacgcatataatgagcaaatacttcctgataacttacgaaatatctgcttctgtggcaacatctcacgggatatgtttcgagggagatcctccgagtataccacccctctaatgcagttcagatacttcagggattagctcctcacagttctccctgattgaaaactctgcgtacatacactgtgatctcgttcttttacttactgtttgcaaacagatcaaaaggagcccgtcgtgggaccaatagacgggctctgacttccaactgtccttcaactgacaaattgcttcagtgccaagtgatcttcccagtcattggtccagctcttatagacatactccgggactcctcattagtaatatcgtcggggat

SEQ ID NO: 695707 - DNA, 148 bp, Homo sapiens
  misc_feature (3)..(4): n is a, c, g, or t
tannggtgaaggatctaaggctggagactgtcacaccagtcaaaggatcgcattactattaacttttataattcggtgtagccctctagtaacctagtgaaatggttcacagagactcccagtctgataatttccggaaagatggttt

SEQ ID NO: 695708 - DNA, 539 bp, Homo sapiens
gcatcatctagtgttataaagccgcaaccggcagttctcgtacctgattgagaacagtggtccagtgactgagtggaggtggcccacactcgctacttcaggggcggcatgctgaccaacgcgcgcctcctcttgggccccacggtccgtctgccggacctcatcatcttcctgcacacgctcaacaacatctttgagccacacgtggccgtgagagacgcagccaagatgaacatccccacagtgggcatcgtggacaccaactgcaacccctgcctcatcacctaccctgtacccggcaatgacgactctccgctgctgtgcacctctactgcaggctcttccagacggccatcacccgggccaaggagaagcggcagcaggttgaggctctctatcgcctgcagggccagaaggagcccggggaccaggggccagcccaccctcctggggctgacatgagccattccctgtgatgttcactctcctcccaaagcaaaccacagccaagcctgtctgagctgggagtccccttcccc

SEQ ID NO: 695709 - DNA, 851 bp, Homo sapiens
ggaggctcagaatcatggcgggaggtgaaaggcacttcttacatggcagcaagagaaaatgaggaagaagcaaaagtggaaacccctgataagccatcagatcttgtgaaacttattcactatcacaagaatagcatgggaaagactggcccccatgattcaattacctccccttgggtctctcccacaacacgtgggaattctggtagatacaatttcaagttgagatttgggtggggacatagccaaaccatatcattctacccctggcccctccaaatctcatgtcctcactattcagaaccaatcatgccttcctaacagtcccccaaagtcttaactcttttcagcattaacgcaataaatccacagtgccaaagtctcatctgagacaaggcaagtcccttccacctatgagcctgtaaaagtctagagagcaagctagttacttcctagatagccaacaggggtacaggtatcgattaaagacggcgtgtctccaaatgggagaaattgggcaacaatagaggggttacatgaggcccatgcaagtccgaaatccagcagggcttgtcaaattttaaagttccacgaataatctccctttgactccaggtctcacatccaggtcatacgtgatgcaaagaagtggggtgccccatggtccttgggcgagtctgcccctgagggcttagtagggtacaggcttcccttcactggctagcttgcaacggctggttgatcagtagcctgcgggctttggcacggtgcacccggggaaaagcatgctggaggatccaaccgatctggggaccgagaagaggggggcctattttacaaaatcacctagg

SEQ ID NO: 695710 - DNA, 327 bp, Homo sapiens
tgcggtggctcacgtctgtaatcccagcactttgggaggccgaggcgggtggattacttgaggtcaggagttcgagaccagcctggccaacatgaaaccctgtctctactaaaaatacaaaaatcagccagacatggtggtgggcacctgtaatgccaactactagggaggctgaggcaggagaatcgcttgaacccaggaggcagaggttgcagtgagctgagatcgtgccactcgactccagcctgggagacaagagcaaaactctgtctcgggggaaaagaagaaaagaaagaaaaacacataggtacctgtgatatatcagtt

SEQ ID NO: 695711 - DNA, 497 bp, Homo sapiens
ggcctgagaaatttctttctaacaacttagttattgatccagaacccagctttgggaactgccactttattatttcataaacttcactggaagagagattgtgcctatgtatccaccattctatcacctgtgcctagtatgtttatggcatgaatgaatctcttttggatgaaaaagtgatggtgaaaccctgtctcattcatagtgaaaacacatacagaacattggaaaccttcacccagctcattaaagataatgcttgccaatgaaccacaacaaataacattggtttagggatctctgctactatagaccctagagtatctggggcatttctcatgaaagttctgattagtttttcctgaggcactactttatggtaataaaattggcattccatcaacaggttgatcgactgttcaggcttcccttcaaggtggcttgaaatagcagaagcaatagtctcttttaaataaataaaatttttttaatacata

SEQ ID NO: 695712 - DNA, 301 bp, Homo sapiens
aaggagctccacaatggcaaaggaaagcagatgagaaactggctgcggccaggtgaccagaccccattcaggagtccacgggagaagaggaggaagtcagccagaggtctaagccacaaatggccaggaagccaggccaaggagtctaaaatagtcaggattgagagacgtgggcaccacgggtgagaaggacacctgtgcctttgcaggcagtgtttcctcctgggcttccttcctacccaaaaccagaacggggcttggctgggtctgtgcacacagttggaaacagtggacaagtgct

SEQ ID NO: 695713 - DNA, 833 bp, Homo sapiens
ctgcagtcgatcagaggatcccccgctaacctggatagtcacggccaattcgcccagcgccattacccccgaaaggataccgagagcaaagtcaggaataagaaagcagctatcagataacttgctgtgcattctatgcactgcattttggacgatattacttatctcattggttataacttttttgagccgggttccgatgcaatcccctgtcgtaaagatcaatctctatgaggcttgcgcgatcaagtcgtgggccgcatactgtttttttatacagttatcattgcgtagctagctccaatgctggtagctaacgatagttgagctactaatttgacgtctggacgtcaatttattttgacgtctggacgtcaagtggttatagttttttcgaataaaatttaggtgaagattgaatgtcattagctcctggtgtcatacgtgacgcgatcatctctttcctacacgcgttaggcagtgatgcttcgtccaccgaaatagtcgctgggatttcttgcacgctcggtcaagtttccccttcttcggttcgttcgtacctagccctcaacacgccaaaaatttttgaacgtacagaacgaggccgctatcgcttgcaggggcttcctctgattcatttatctggcgtgggtgatttcacaaacacgaagatcggacaggctagcttgtaccgtgctgattgcttcgactggttagcgtcgcaggaagctagttcggtacacgccatagtgactgatccgccttatggcctagttgaatacaccgctaaagaaacaacaaagcttcgcagtgggaaaggggtaccgagctcg

SEQ ID NO: 695714 - DNA, 451 bp, Homo sapiens
  misc_feature (447)..(447): n is a, c, g, or t
gaggggaaaaagtcaaaagaaggacaagacacagtaggatcagagggctacggtctaagagcgggagctacagagctggaaattaccacggaaaacacggaaaggtggggcccttcacggcttcctcataaggataccagaggcaaccgggcatattaagctggacactgggcagatcacggtgtaaatggttttccaggaatacaagtggggacacttctgttcattggaccttggagtggacccttaaattttattatggttttttttcccctcagtcttcagctcacggcttcacttctagttccacccacttaccaaatatgatggactcatgcaggtgaattaaaccattatggcacactttttccctctcctctctctcagtattactcttaactggaatattttaaccggaacaatttaaataggctggacattcccagntggg

SEQ ID NO: 695715 - DNA, 151 bp, Homo sapiens
tcccccccccccaagggcttcccgttttcccggaggacgtggattttttttaaacaaaagggggctccccaccctgggtttccttttgcccccccagtgggggtggcccagggccctgggggccaataaaaacctttttgggtagccccta

SEQ ID NO: 695716 - DNA, 194 bp, Homo sapiens
ctgcagtcgatcagaggatcccccgctaacctggatagtcacggccaattcgcccagcgccattacccccgaaaggataccgagagcaaagtcaagatttcaatgcttcggcaagattcgcgagtttgccgcgaatcgagccatcgataaccaggtcgccggcgcgaatgatgacaccaccaatcagggtggca

SEQ ID NO: 695717 - DNA, 623 bp, Homo sapiens
ctgcagtcgatcagaggatcccccgctaacctggatagtcacggccaattcgcccagcgccattacccccgaaaggataccgagagcaaagtcaggaataagaaagcagctatcagataacttgctgtgcattctatgcactgcattttggacgatattacttatctcattggttataacttttttgagccgggttccgatgcaatcccctgttgtgtcatacaaaggctgtaccgccgtcacgtatttctgattggtcaggttcttcacatccagcgacaccttccagtccttgctcggcgtttcataccccacgttcgccccgaagattgtgtaggagggcgcatagaagctgttcgcataatccaccgccgtacgcgaagccgattgcacgttcaccccggtatagaagcccgccgggtgctgatactgcacttcgccctgatagatatgcttcggaattcccggcagttggttgtcgccgaaggtcgggtcgtgccggtagtagaagtcgttgtaggtgtacacctggcgcagggtgattttttcacccgaggtgttttcccacaggcgcgtattcaagccgcctcgatcccttgatggatcgtcgttggcgttgaatg

SEQ ID NO: 695718 - DNA, 121 bp, Homo sapiens
  misc_feature (68)..(68): n is a, c, g, or t
agcaggcccaggccccagaagtatggaaaaaatgagcttgactaccccacacaaatgaatccactcanatgttggcaagtggagcagagtcccaggacaggtacagaaacaccccccagtt

SEQ ID NO: 695719 - DNA, 246 bp, Homo sapiens
tcccaggggccccgcccaagtttttttttaaaagggggggggggatgggccctcccataggccagtccccccccggatttaggccttccccgcttggggtgatggaagggaaattaaaaaacttgccccttcaaaatgtttttttccgggggccgccccctggttttgggcccccgcctttccaggaacttggggatgttagggttcctttttttttttaatttttaaagataaggccccccttta

SEQ ID NO: 695720 - DNA, 905 bp, Homo sapiens
  misc_feature (905)..(905): n is a, c, g, or t
gtcagatgttgagatgacatgatggcacccctgtgacatgagactgtgaatgcacttgaataaactagatcagatatgactgacaaaagccccatgagccacgatgtggatggagtgattgacgactgatgacgctggcacagcaatgctcaacttataatgcctcctaccacatgacgtccctggaaggagctgcacggacaatggaccaaacgactgactgacgacgtctaacttacacgtacaatgaacaacgcttgcatgggacgactgagtcctgatgtgtgaccacgactccgaacacgcccaccaaatgtcgatatgtcaaccctggactcaccactgtgttctgtcgcagagtgcccctggagaccatatcaaccagtgtgaccattcacttggcagactctgtgaatgcacctctaaacaagcgacaaccacttgctgatcaacacggcacaggatactgaaatatagcagatcaaaacttcacattcaaagctgaaacaggtgatcatagatgtcagggccatgacaaatacgatacacgcacaccatacaagtgatatggagatgacaagatgtgataacagcaaacaatatatgagaaagagcagactactgtgaccctcgtgacatgagagacgtactgaagcttactcaaatcacaagaatgaacgaggtgctacccaatgggacaatgattggaaccacaattggtcacagttacccacaaaaaacaaacgtccctatccttcacacccggaccgacttggcaccaatccaaacagaaccaaatcgtatcacacctttgagcaaattggaacaaccatatcgctcaagcattaacgaaaacacagaacattcgacaccccaacacatcagacgttgcacatatcacacgn

SEQ ID NO: 695721 - DNA, 235 bp, Homo sapiens
  misc_feature (196)..(196): n is a, c, g, or t
  misc_feature (215)..(215): n is a, c, g, or t
  misc_feature (230)..(230): n is a, c, g, or t
ggaccacttaggaacagagtgtgttatagaagatggaaaatgttgtagcttcataatcttgcaacttcattcttcttccacaagattctttcatctttctccttccgagacatctttctattatcacgcttcacgagagttttcgatgtcactctctttggagaacagcatctctccctcttctgtgctactttgntgcttccaggtcgaacggngtaccgcagctcgcnaattc

SEQ ID NO: 695722 - DNA, 281 bp, Homo sapiens
gcccgctgcagaaccagactgtctgagactgccctgggcagcggggtgagcagctgagctgggcttccgcgagccggagaaggcacaggccatgtcccgggtcccggcaggtctgcgcagtctgttcccagcgctcatgcgaggcctaaaaaggaggagcaaccatgtccagaatccctgcaggacaggaaaagtgaggggaaatctcgacatggaacaaccctacaataaaaactgcaaggaaacctggaaaacgagggaacagccagacacgatgaacg

SEQ ID NO: 695723 - DNA, 188 bp, Homo sapiens
cagaaagactcatataacaagctgaagttgtgtctagagaactagaaaacaagaaccaactccaaagcaagaagaaaagatataactaaaaccagagcagaaatgaatgaaactgaaacccaaaaaaatccataccaaggatcaataaaaaaaggttggttatttgaaaggataaacaagatctataa

SEQ ID NO: 695724 - DNA, 132 bp, Homo sapiens
aagtagtcacggcagaaaagaaacgcgaacactaatgcccaggagaaaaagacaggtacaatacacagacgacacgacaacgtgaacaacaaacaaacaacagccataacaacaccaaactaacagacacgc

SEQ ID NO: 695725 - DNA, 588 bp, Homo sapiens
aattagtggcggctggcagcgccgctgtagcgcccgcgctggcccaggtggaggtgggttcggcctcgcccctgcgcaagctggtgcctgccgagacactggagcgctcggccgctcagcaataccagcagatgctggagcaggcccgcgccaagcgcgccctggcgccgcccgaacacccccagctgcagcggctgcacgccattgccaagcggctcatcccgttcaccgccccctggaacgagcgcgctggccagtggcgctgggaggtgaacctgattggtagccagcagatcaacgccttttgcatgcccggcggcaagatcgccttctacaccggcatcctcgacaaactgaagctcaccgacgacgaagccgccatgatcatgggccacgaaatggcccacgccctgcgcgagcatgcccgcgaacggctggccaaaacgcaggccaccaacctgggcgtgcgcttgggcgcacagctgctgggtttgggcgacctgggcaacgcggcggccagcctgggcgcgcagctgctcacgctcaagttcagccgatccgatgaaaccgatgtcgatctggtggggc

SEQ ID NO: 695726 - DNA, 294 bp, Homo sapiens
cccacgcgtccgcccgattgaagccccccttcgtataataattacatccccagacgtcttgcactcatgagctgtccccaccattaggcttaaaaaccagatgccattcccggacgtctaaacccaaccactttcaccgctacacgaccgcggggtatactacggtccatgctctgaaatttgtggagccaacccccgtttcatgcccctcgtcctagaattaattctcctaaaatctttgaaatagggcccgtatttaccctatagcaccccctctaccccctttagagccca

SEQ ID NO: 695727 - DNA, 626 bp, Homo sapiens
  misc_feature (285)..(285): n is a, c, g, or t
  misc_feature (307)..(307): n is a, c, g, or t
  misc_feature (380)..(380): n is a, c, g, or t
  misc_feature (387)..(387): n is a, c, g, or t
  misc_feature (399)..(399): n is a, c, g, or t
  misc_feature (418)..(418): n is a, c, g, or t
  misc_feature (429)..(429): n is a, c, g, or t
  misc_feature (444)..(445): n is a, c, g, or t
  misc_feature (509)..(509): n is a, c, g, or t
  misc_feature (525)..(525): n is a, c, g, or t
  misc_feature (558)..(558): n is a, c, g, or t
  misc_feature (564)..(564): n is a, c, g, or t
  misc_feature (607)..(607): n is a, c, g, or t
  misc_feature (610)..(610): n is a, c, g, or t
tcggtacccacggtgtcataaacgtgatattgggtctatccagtgccgccgttaaatggcttaaccccgtatccaccgacactacaaatttagccccggcagcacgcgggcaacgccttccagactcatcttcggcaatacttcaacataagcaaatccttccgccagtcgtttcgcccgttcttcctcatgcggcgcgcccacggaagtttaatccgtattcctgaatcagccagtaaaccaatcaattctcgccagtgttcttccggccagtgtttatcatcnacgggtcgtcgcatgaaagaantacggcatattcgcccagcatcctgtaggcaggttcgtctagaaaaatgctgtgcgatagcataatcgccctngggtttntgcggtttgctnataggcccaaaccttttgngcaaaacagtntcgcggggtgcgttnnctactggcggtggcctgcttggtttttgccaatatggatggcttacgatttgtaaaaaactagngcttggctaagaggtntccgcgagcggtctttgcccagtccatgctcanatgctnttaatgccaatggcggcctagtatcgccgttctaccccaagcngcngcgccttttttaccta

SEQ ID NO: 695728 - DNA, 146 bp, Homo sapiens
gaacaaaggttgatcactgacaacaactggattcttattggctaaagatgatactagaagaatctatgatatggtttggatgtttgtcctctccaaatctcacactaaatgtattcccagcgttggaggtggggcaggatagcaga

SEQ ID NO: 695729 - DNA, 1219 bp, Homo sapiens
  misc_feature (990)..(990): n is a, c, g, or t
  misc_feature (992)..(992): n is a, c, g, or t
ggggtgattagcccggaaggggcccccctccgggggtttgtggccggagaatatttttccgcgggccccccccgaagtgggggccccccccccgggggcgtcccaccgggtgtccccccggcggatcttttgttcgccgcctttgccgctgattaatctttctcctgctgtgtggcgtgcgtccccctcttcttcgcgggttttctccgccgccttgtttttttcctcctcctctctctcgctcgcaaccccacgcagactggtgttctcttgaccccacaatccccccccggagattatattggcgccctgtgagagagtttcctcgagaagagagatattttcctcgagtatattatagtgctcctcgagagaaccctctggaagagaagagatagccgcccctcgagagaccccccccccacagaggagacaataaatactctcccccttcgcgctctctcccccacagagagaaccactcgacgattgtgagacacccacgcgggagagatcgccaccgcacacgcgcgcgagatatctcgtatatattagagcggccgctttgcgcgcccgcggcacacatatatgtcgcacgcgcgtgtatcacacactgttctcacacacacacgcacacgtgtgccccctctcgtatatatttgtgtataccgtctctctctatatatgagctctctgctgtttatgacacctcttttgtgtgatgagagagagtgcccacacacagagagagtgtgtgagaggtctcaccacagtggtgtgatgaagagagaggactctgtgtgctctcgccgctctctcgtgtcacacactctcacacagagagacaactctctctgcagcccacacgaatagcgcctcgcgcgccctcgtcgccttttctccacacatctctgttctctatatctctatatctctcggcgctcgcgccaaggagagaagagagaaagagacacttcgcgaatatgtgtngnggtgagaagagaagaaagatgggggtgggaagaaatatgggggtggggacccaccacatggaaatatttagagagattaacaccccaactgggcccccgagtgtccccccagggccgttaaacccacatttaatcaccgagagatccccctttttttttgttccaatgattttaattattggaaagccaccatttttttaataacccaaattaaaagttttaaaacc

SEQ ID NO: 695730 - DNA, 165 bp, Homo sapiens
aagattcatttctttcggcagtagatgtagattcatcttttaacgtttcttcaaatttgtttctgtcaggctttgtgttatttaaatggtttttaaaattatcttctatgttatcaataacctaaggcataggtaataggtttcttaaggtagatttacctcata

SEQ ID NO: 695731 - DNA, 774 bp, Homo sapiens
gtttatgttttgtttttgggttttttttttttccttgaaacagggtttcactctctcaaactccgtgggctcaatcctccaccaaacccggccagtatttctggttaatggtagataactgggattctcatgttggctgggccattcagtctggtggcaatatgttggtttgggctcagggatatataaaggaagtccagcctcacagagatagttagaaaagggagcaatattttggacagccttctcaaataatggtggatatatttatctgatagcataccagaattcaaaaagagaaagttggtaagtgttatgtgcaatatagaatctaaatcctatcaatgaatgtttcatactctcttacattgaaattcattgggttggtcttacactttggtgatcatggtatctccccttgccaggtaagtatgtcttatactttggaagggatcttttattacccatacttgtttggtaacatcatgcgtcagtcattgggaaaatatggcttcatggagtaacgtaaatcttccacagggtggacccaattcattatataatatcttaaaaatcatgtttattatcaccagcataacaatggtttttatggaaactgtgcagttctctgtgaacatatgacttctatcagtgcaccccaaactgctttataactttgtgtgactgaggatcgtggtcgtaaccgtactgtgactttactttaggacaacttactactttggatgtcctgtggcccagaatgtccggatacca

SEQ ID NO: 695732 - DNA, 339 bp, Homo sapiens
  misc_feature (291)..(291): n is a, c, g, or t
gacgtcaaggaaggtgagtggtgaagggtttttacatatatacaagaattcatgggctgggcatggtgtcttatgcctgtaatcccagcactttgggaggctgaggctggaggatcacatgaacccaggagtttgagactagtctgggcaacatagtgacaccctgtctctacagaaaattaaaataaaatcaggtgggtgtggtagtgcctgcctgttgtcccagctattctggaggctgagatgggaggatcgcttgggcccaggaggtcgaggatgcgttgactggtngaccatgccaccacattccagcctgggcgacacaaagtcctttgtctt

SEQ ID NO: 695733 - DNA, 516 bp, Homo sapiens
tacacgtcacagtattgatgtgatttaaaatgtttcagtgaaaactttggagacagttttaacggatcgcgaattaaccatagaacatgcaagagcggatgtatattgctttaagcaatcactcattaccaccaatctgtgaaagtaaagcaaaaaataataataataaatgccaagggggagagagacacaatatccgcagccttacaccttaactagctgctgcattattttattttattttatttttttggtatttattcatcaggaataaaaaaaacaaagtgttattaaagattgaaaatttgatacattttacagaaactaattgtgaagtacatataaggggtgacatattattacttttttggggactgaagaatgggtgtggctaacaaatttttggattttgaaaaaccctgctgggaggagttaataaaaaattcatggtaaaatgaatgtatcataatcaatattttgttggttgaagaggttgctaatacattttaatgaggt

SEQ ID NO: 695734 - DNA, 311 bp, Homo sapiens
tgctggcgtatgtgtactgagttttgtctgaacacctgtgttcacggcttgggggcatcatacctagcgagtgcaatttctgggttaaactgggaatttaactttttctcctttttctcaaacactttgaacgtatacctgactttgcagctggcacgggcttagcttctcagcgctgctacacgccacagcccaattcgcgcttgctgctgctgctgctgctgctaattcctctctcttcacgcactctacttctccctcctctactactcctctactctactacacacgctagatagaacgctgctacg

SEQ ID NO: 695735 - DNA, 1660 bp, Homo sapiens
ggacgagggggtggccgcggaggctttaacaaaggccaagaccaatggacctccagaacgtgtagtcttattaggagagttcctgtcatccctgtgaaggatgacatagttgtgtaaatgtaccagagatgaaaataaggtgccttatttcaatgctcggtgtttacttagaaatacaaagaacaaattggaaggagtggatgaagtatttggacaagctcagagatcttgatttgtcagttaagttgtcagaaaacatgaaggcttcatcctttaaaaaatacagaagttttatatagacccatataagctgctgccactgcagaggtttttacctcgacctccaggtgagaaaggacctccaagaggtggtggcaggggaggccgaggacggaggaacgaggaggaggtggcagaggtggtggcagaggcgggggttcaagacggtggcacgaggagatggccggtggggcgctcagagggaggaagaggtggtggttcagagggagaggaccttaacgtgaaaccatgttgacagacatcacagttgatttcttgattaactgatgatctgtcctactatgggatgggaaacttgttcttgaacacgtttggagatctgggcatttattgacctggtccacaaggtcggtcttgcaaggtgcacggaatatagatttggctaaaaaaatggaagtttaatgggtgagggcggcgcctggggggcaccaaaggacaggtcctggggaatagctgcaataggggttttcgtcaaaaaaaaaattggtcggtgcattcattaggtggtaactttttctttgttccttcctcttgctccttcctcatgtcgtaaacggcagtaaaactagccagatgaaggatacagatagatgactaggagagtagaacgtatagagatacgaggctgagctaagtgtagcgataaatgcaacgcaatactggacagagcgagaaacgaagaacaccgagaaaaggaagaagaaagaagagatcagcagacgaagacacacgcgaacgaagcgagacacaccgacaagaaagagagcgcagaacacggagaagagacaagaaaccagaagacacagagaagacaaaaagaagagacgaacccgacatagacaacacaacaagagcagagcagacacggagacggagcacgaacgcagagggacgaccgccagagacaggacgaaacgagaaagacgacgagacacagcgagaacacaccaaagacgacgtcgagagaaaggcagcagggagacagaagagcaagaagacacgagcaaacacacacagcagacacaatcgcaagcacagagcgaaagcagacaaacaagaaaggacacagaacaagacagagaaggaagaacgagaagagacagaaggcgaagaacaagaggaaagaaagaacaaaaaaatgagccccacaagaagaagcggaaaacaaaaagaaaagacagagaagaagccagagaacagagaaacaagaagaaggacaacaagaaagaaagaaagacagaggaaccgaaagaaggacaaccagaaaagaaaagaaggagaggaagaaagacgaacgacaaaagcagaaaacaaaagaaaaacacacagaagcaaacgacacgacagacaaacaacgaca

SEQ ID NO: 695736 - DNA, 586 bp, Homo sapiens
  misc_feature (79)..(79): n is a, c, g, or t
  misc_feature (218)..(218): n is a, c, g, or t
  misc_feature (284)..(284): n is a, c, g, or t
  misc_feature (336)..(336): n is a, c, g, or t
  misc_feature (340)..(340): n is a, c, g, or t
  misc_feature (389)..(390): n is a, c, g, or t
  misc_feature (395)..(395): n is a, c, g, or t
  misc_feature (425)..(425): n is a, c, g, or t
  misc_feature (430)..(430): n is a, c, g, or t
  misc_feature (440)..(440): n is a, c, g, or t
  misc_feature (457)..(457): n is a, c, g, or t
  misc_feature (464)..(464): n is a, c, g, or t
  misc_feature (471)..(471): n is a, c, g, or t
  misc_feature (512)..(512): n is a, c, g, or t
aggaaagggcaagaggaaagtgggagggcagggggtcccggcagcacccccaggggggcagcacattgctcctggcccnggcccacctgtggccgcgccaacccgcttggactgagtctgacctggcaggaactgcatgacagaaaccacagtaacaagtggcaaactctgaggacaggccacccatcaccaccaacaccactagtggtgttggtggngatgcctatgtgagtgatctcccaataaaaaccctggacatctaggcccaggccagcttccctggnagacaacatttcacacaagtgttgcacaattcattgctgaagtaattatttnctgnatgactccatgactccactaggaaaggactcttggaaacttatgactgnnttctncaggttttgctccatgctccttttcccttnctgantttgttttgngccatttcctttgctgncccaatnttctggnggctttcaaataaacttttcaactctcatataataattttntcactttaacattccatttttaaatataggtttcattatatgctaaaaatcttcataccaccaacaccactggg

SEQ ID NO: 695737 - DNA, 155 bp, Homo sapiens
tcccctagcggatacatatatagagtaaagctctaagactcctgagccaactttactgtacctagtcttacctaggctgggacatgaactaagtaaagaagccaaggcagtacagatctaagcatagcagagaagtacgtctacatactaaaaca

SEQ ID NO: 695738 - DNA, 709 bp, Homo sapiens
  misc_feature (87)..(87): n is a, c, g, or t
  misc_feature (183)..(183): n is a, c, g, or t
  misc_feature (196)..(196): n is a, c, g, or t
  misc_feature (226)..(226): n is a, c, g, or t
cccaagattttgtttttaattttcttgcaaaaatggtccagcttttccccgagtgctccaagaggtcggccggggcatccctcgccnaccaataatggattgagaatgcttccagcttctagccaaacgtgtaaaagtaggaatgctccaaagtcaccggtgttctggtgttgtctctaactnccagcgagcggcntatttgagtgtgttccattccctagattcncgcatgtatgtcccatggcacgcacgcatatcagtctgtcactttcgcgaacatgggatagaagtcaacacactggtacgttatgactgacgtggcccatgagcatgagtgcatttgctcatcaggcacagacttggcagggtcagagaaccctctgtgggcagacacaggcccatgcatgacctgtagtgggcggcataggaccagacactcggaaaggagtgtcgagtactgaggagacgcactcgttggctcaaccgctctcgctgcatggaaagtaccgatacagttttagtcatgcctaagctcacaaggaccaggtgcgtcatgagaattcataagaattgatgtaggttcctggagtctcaatatcccgatcggcttgattgtatgtacaaggccctcttctgttaaaaataagatggtatgtagaccatgtatgacctcagtcaatcataaccatgggtgcaagtaataattcta

SEQ ID NO: 695739 - DNA, 625 bp, Homo sapiens
gttggtcatggacgggcaggcgtgtagaggcgatgtgacttcgttggtgctggagcagtgtggtgacccatcaccgcctgatactgcccgccagccagccctcagacggagagcgagtatcagtgcgtcgctggagataagtgtgcctacatcactgtcatccaacacagacgtctcctcgtggatcgagtatcccagcggccaggtgtatgtggcagccgtgcgcctgcagcgtgtggtgccgacctgtgagctatgccggacctgggcagaggtgcgctggaccacggatggagaggaggtggtggagagcgccgcgctgctcctgcagaagggaagacactgtccgacgactgatgctgaccgatggtcagctcgaggaactccggcaagtacttgtgtaaaattgacgatgagtcggactccttcactgtcaccgtacacaaaagtctaaacaaatcagggacagttcaaataaaattccgggaagtatgcgtcctcttgaaaaagccgaaaaccgggagatctggtcccgcttcccccagggacctctgatattctggcctctggtcccctgtctgctggaagaggctcgtggctcgtgtgacagtcagtgccgactgag

SEQ ID NO: 695740 - DNA, 433 bp, Homo sapiens
taacagaaagtgggtgataaacactgagtatctcaaacaaatttatctactcaaaacatggggtatgtggctcttatagtagaaaaccacggtggtcttatctcaaggccagagtgagatgtgagaaatgacctctggcattttggtgggtaccaacataaagagaacagggaatctgaggagagcaaaggacaacttctctgcagaacgaaatcactgtcattggtgaggtgtgattctacttcatttcttcatcttcctgtccctgtccctcttacttcaaatacttctcttttctccctggttatttcctctactccctccttcctcttttttatccctctccttgtttatttttcatccctccagcctcagcaacagaacaaggccctgtctcaaaacaaagaagaaaaaaaagagaatactatgactc

SEQ ID NO: 695741 - DNA, 221 bp, Homo sapiens
cggtacacccataattaaatatctcccatgaaaagatgctcagcatcactaaccattaaaaaatgcaaatcaaaaccataatgagatactacttctcacccattaggaaagcttattttcctcttttttttttttttttttattggaggcagggttaccccaggcggggaaagaggctcagcgtggggggaactctctagagtcacccgtgcaggcttgca

SEQ ID NO: 695742 - DNA, 978 bp, Homo sapiens
ctcaagcgttacgggtccgcctccgcgatcgcagtagccgtacgtgaccgtagtgacgatacggagaaccagttgcagcatgacgacgcggacaggctcgagcacatggactagattgattgagtccgctcgtcggctcggtccgtgcgagcaatgggggtccgtgcattgatgctagtgggctacacttcgcaggtacgatgaagccgcccggtgtcccttcttcgcgcttcatgcgatagagtgctccaccaatgatatccaaggtactaagtattgcagtgcgagtagtgggttctctcacatggacctaccgtattgatggggctgatgcacgtgcgggaagacatagataagaagggacagtcgcatacatcgcctttgaaggccaaaacctcacacacgggaaaccgcagggcaggtcggatacgaacccagactgtgaagggagcgaaacccataggagaaccaaggacagcgtgggaatacacaactcggccgttgtcgtacaaaagagagacgagtacgatgcatgccgactcgactggaaaagcaaacgccctagcgagagaggcttgacaaaagaacacgaatgagaccgacacgcatggaaaaggcgcccctcatgtgcgacacaaaccaggcgaaccgaatccagggacggcgcaagccactcaaaggagaatagcagagacaccgggccctagcgagggcacccaagaggcaaaagatgaagaattgaggactaagaacccaggtgacaaggaagctaactccacccaatgtatagcgaccactccggtgggacccgaaaaacacaccatgggagtcaaatcgaacgaaataggaagataccagagatacaatggtgaaagaaaaacaccaaacaacactgcaagccacagaacaaaaacaacaaaacacaagaacagcacacggaccaccaaccaagggacaacaccaatgcacaaatcatgg

SEQ ID NO: 695743 - DNA, 178 bp, Homo sapiens
tttttttttttaacccctttcccaggtttttggaaagggaaaacccctggcccccggggaaaaaggggggggtttccctttttttttgcctgccccacccctgcccccattgggtttggcccccccggggtgtaatttctttcccccccctaaaaaagtgccttttttccgggtccca

SEQ ID NO: 695744 - DNA, 465 bp, Homo sapiens
  misc_feature (185)..(185): n is a, c, g, or t
  misc_feature (357)..(357): n is a, c, g, or t
  misc_feature (418)..(418): n is a, c, g, or t
  misc_feature (438)..(438): n is a, c, g, or t
  misc_feature (454)..(454): n is a, c, g, or t
cttgcttctttaacctcttagtaaagtttgtgtattctagattaccacagttccagagacaatgctggcacaaggcttccagcccatcctgtccactgacacggagaatgaaatcgtcctgcctctgggctccttagatcaggtatccagagatttttactcctccagtgccaggcagggcctancgtccataaactcagcaggaagtagttacggaaaacagatctccgcccttctgcagcccccttaagattaaggaggagtatctaatctctgaagggggaatgaggtaggaggtgggactcaactctgggaagtgggggctcaggcactcagaccaaactgagcacttagctnaaaataggtccaggggcagatgctagttttccatagggacacaccgacctgtgttcaagtncagtttcaccatgggctctnggcagcaccccagaantttacccaccc

SEQ ID NO: 695745 - DNA, 267 bp, Homo sapiens
ggcacggcctctacacctggcgataccttcctcgataaaagcagcaagagctaccgcgcggtggagttcttcgactggcaaggtgaccccacggtttggcgggcagatcgaggccgtttaccagaaggatattcgcccgggcagccaggaccagacctggatgtcgctgggcgtgcgcccggcctatgccatctccgaacagttcaaactggtcaccgaacttggccatgatcaggtcgaggccaccggtggtacgcgcaagctgag

SEQ ID NO: 695746 - DNA, 682 bp, Homo sapiens
ctaggcacgcacttggccccggcgccacccgtaccccttccgccagagcatgtgacacggatcccgggtacctcgggacgatggacgagaagctgtcgaataccaagatcatctttgtggtgtgtgggcctgggctctaggtaagggcacccagtgtgagaagatcgtgcaaagtatggctgcacccacctctccaccgcgggacctcctgcggtccgacggtcacggctcaggctcggtcaggggcaagaatgctgtcggaaatcatggagaaggggcagctggttccattctggagacatgagtcggacatgctccgggatgctcatggtggccatagacgtcaaatacttccatagaggcttcctgattgatggctacccgctggaaggtgcacgcaaggagacaggagctttgagcagacggattggacacgtccagcacatgctgctgtagtgtggacgcgggccctgagcacctatgacgccagcgggctcttgatagacgtgtgatgccgaccagcgagcggcgtgtggagcggacaactgaggagaccactcaatttaagcggctggagacctattacaaggccacagaaacccgtcactcggcttctatgagaaacgtggcattgtgcgcaaggtcaatgctgagggctccgtggacagtgttttctcccagg

SEQ ID NO: 695747 - DNA, 165 bp, Homo sapiens
tggtccgacgacaaggggcgacttcctccgactcttccttggcttcaactagctggggctgcagctagcagtcaggagcagctgtggtggcagcagccacaggggcagtagccacaaaggcagatggattcagccatagcaaggccttgcactcttttcagcaag

SEQ ID NO: 695748 - DNA, 242 bp, Homo sapiens
gacagtcagacctgggctgactggaagtatcttactttggtatttttggtaggatgcttagccactgcgaacatctatattcattacatgtacaacagacatatgaagtgatgacgcctacacatctcacactgaacatgttgaaagcagaacggctgctcttactgcacacatgtggtcttactgtgggcttccccattatactcgatggtacctccatcctttcacttagccagtcgata

SEQ ID NO: 695749 - DNA, 341 bp, Homo sapiens
  misc_feature (312)..(312): n is a, c, g, or t
gtagaaactaatgagaaatgaaggttgtgatcgtcctgttcctgcctgctgctctctccctaagttgggcttgagaaacagtttctataggagagggaggagtcctaatgtaaataccacctacacccaaggctgtatgtatttagcttaatctgatgaatcaggttgaactcgtaccttagcagtctaagcctgaacgccataaagcctttaagtccattcctggtgttcaagtgagaaggttctgggtcaggcgtggcactggttggtaaatatgtgtcaatattttgttcctttggaggtgaagctggngccattcattaatgagcccacactgctga

SEQ ID NO: 695750 - DNA, 993 bp, Homo sapiens
ggttcgctcaggtcctttagaccagagtctttatgagcagacaagctttgtatgagcggtcagtctggtggcatggataacagtctggcgtccacatcggccaatgtacatagagggacgccgagctggtgtgatctctgtcgctggatgtggtcaccggagagcgagtgcagatagactgatgactgtcgtgacagggggcatgtcgcagtgtgagcccattcaactgggtcgcgccgggcagcagggctcgtggtaattgggcaacattctcccgtgtatgcagcaacgatcgctgacgaacgaaataccccatgtatcgacttcataggaaatacgcctctcagcttgttgagttgcgccttcacgcgcagatagatgttgctcgtagcgaacctgtggatcagagacacctaacaactggcacatccccttctcacgatctcactccagcttgcggtagtagcatattactggtgagtgaagaagcgtaatctgcaattggaactgactgcaaggtccttcatgatgatatctagctttctcgccagtcctgtagagctgcaaccaccacctgaattctcacgggggatctgcacaacgacatctgtgtccagcacgacacgatgaggtggtgtcgacacaacactggcctccgatgacccatggccaagtcttcaaatgcctgtaccatccgcaaaggttggatagatcaatatggtccctccattgtccacgtctccattgctttatggcctgggttaggcccgtctcaacgcagcgtggaagtgaaggagtatcgagctctcacagtggcggaactcacccagcagggctttcgatgcaaagaacatgatggtgcctgtgaacccccgcaggcgataactcaacggtggtgctgtctttccggggtcggatgtcccttgcaagggaggggcgatgagcaaattgcttaacgtgccgaccaggaccgccgtccctttttgggactgg

SEQ ID NO: 695751 - DNA, 157 bp, Homo sapiens
ccgcgcctagaggatccccaagcacaatgtacagctttcttcggtccgtccatgcagagatgtaaaagcttaagggtcaaacaataccaattgtataggcaacaagtgatctggaacactatgacaagactcgtcatgaagaatttaaaaaatatga

SEQ ID NO: 695752 - DNA, 422 bp, Homo sapiens
  misc_feature (78)..(78): n is a, c, g, or t
gggcgctaagactcggtctcccttcggtctgagatctgctaggccggcatacctgctcatgtgctaatatagatgtgnatgaacctctttacaacggatttgtgtttgtcgttgctcacagacatagaaatctggcatatctatttgggtgatgccaccatctttgctccagtgctgtgggcatggtgtcatggttgtactagggggacaagaaaaacttaagaagagagtagtgctgatatacagtaaacttgcaatgatgcgtgctcatggaggcacagatcacatggatgacataaatacaccattaatactcaaattctatatttaaaatttgataagaaaagccatttgaaaaaaacattatttttaataactaggaactgaatgaactgatttagagctgacttactctgtgtttt

SEQ ID NO: 695753 - DNA, 309 bp, Homo sapiens
cgggaggattgcatgagaccaggagttcgagaccagcctgaggccaggagttcaggaccagcctgggcaacatagcgagaccctgtctctacaaaaaaatcaaatcaaatcaaataattagctgggcatggtggtgctgcctgtagtcccagctactcggcaggcagagacaggacgattgtttaagcccaggaagttgaggcggcagtgagccgtgatcacaccactgcactccagactgggtgacagagccagaccctgtaaaaggaaagtcaacaaaatttatgtaaggccagaacaccgtcgaag

SEQ ID NO: 695754 - DNA, 1648 bp, Homo sapiens
  misc_feature (326)..(326): n is a, c, g, or t
agcaggtctactcgggccaccgcaatcacggctgcgtagctgctgggtgtgctagggagaatctggataataagacagcattgttgaatcaaggatgtaggtatccgtggcgagtgttgtgaagtggggtttacatgggagagcagtgagagaggctaatcgaagagtgcgaggacgagtcaaaagactaactctgaggagaagagcgggattgtaggtaccctattggttgggctcggtccgagtgaaggcaatagctcgtggagttggacacgcgcgcacggtcgggtaggacatagagtcgcaagaacgcgcacgggaagaanagcaccaagttctccaggaatgctgggcatcgttaccatgtccttggatgtggttgcaatggtaagcagctgcctcgtagtagcgttattagcacacttgtttctccttaccctccgaatatatctccctaagtaggatggctaaatcgtcgcgagaagggaccgtgcataagcgtggggagcacgggtaagtgaaagggtgaaggataggccgttggcccctagttcttagcgaaacaccgccttccccaaatcgggaggcttaaccgagggcgtctgagtctcgacacgtagtgttgccccaatggtatagcctttcgctatcgcggaaccagatagaatctcagatccggtgagaatctagatgctacgggggcatcgaacgttaagtggtagccccgatggctgaatcggaggcgaacgcatggcgggttcgggcttgtgtccccgtggtcccggtggacccatatctctgggaacgactcctttgtcgatgaccgctacaagatttcccatggggatgcggtagccagaaagggctccaacgttctcaccagccatctgggtttgggaaaccggttgcgcgtttggggacccaggaacgcccgtactatgaaacgcgggccctgcccacaaggttgcgaattcgcaatgtctgggcgtgttcggaagccggcactcggttgggacaccgggggtccggagtcccacttccgtttaccggcttgggggaggaggccccaagggcaagacgaggctcttaacacaactcaattgggggttccaattccccccgcgggaacgggaacccagaacgccacatgtaactcccacactgcgggggccttgtggtccagcggaacgggctctcgtggaaatacctttgacgttacaaagggacaggccatttggtgggggaacagaaggcaggcattgggggcattaggacggcaaaacagaatgtatagctatggggggaaattccctttgagttatacaccttgcgagatctaaaagagcgcacagcgcatcacgtcgggattccacggctccggagaggcaacataggtgtcgcctatggccctggcgggacaaacaacccaggaggagacacctcggaagggggaaacgacacagtgtcccaccaagaggagggggggcaccgtagaaaattgaaatctcccgtgaacagctgtgtagacacaccagagaagccccgggagagagagagaggcacaaagaagaggaagcccaggaggcacacacggaccacacatccacacaaaagacacgacgcggagaggagacagcctccggccagg

SEQ ID NO: 695755 - DNA, 144 bp, Homo sapiens
gtcgtcagttacacagcgcactgaagccctgaactcccgggcccaaaccatcctcctgcctcagcccaccaagtagatgaagccacaggcacgcaccacttttcctggctactgatgtatagtatcttaatattttatgtttta

SEQ ID NO: 695756 - DNA, 361 bp, Homo sapiens
  misc_feature (321)..(321): n is a, c, g, or t
ggtggagatggggttttaacatgttggccgggctggtctcagactcctgacttcggatgattctcctgccttggcctcccagggtgctgggattgcaggtgggagccactgtgtccggcccatttttgttcactttaaaacttataccaggcttggtggctcctgcctgtagtcccggcattttggggggccgagccgggtggatcacttgaggtcgggagtttcagaccagtctggccggcatggtgaggccctgtctttaccaaaaaatacaacaattagccgggtgtggtggtgcgcgcctgtggtcccagctgcttnggaggctgacacagggggatcgctttgaactcttgtctca

SEQ ID NO: 695757 - DNA, 316 bp, Homo sapiens
aatcaccacgacatatatatgtgttcaactcagagcacacgcactctcaacaagctgtcgagtataccccggaaggccacgagctatgcatccaagactccgggcctggttcagcacggggacatgggcagtatctcctcctgaggacataaactaccctcggggctacacatgagtaagcttcacctatactgagggtgcacagaagcatcaacttgcctacaaattccagcatgaaccatggctccacaacagctggccacacagaagccacatccagggactgggctaacactggagaaggggcccggaaaag

SEQ ID NO: 695758 - DNA, 197 bp, Homo sapiens
gctgagagcaagatgggtcaccagcagctgtactggagccaccgcgaaaattcggccaaggttctcgtctcttgtcgtgtctgttcaaaccggcacggtctgtataccggcaaatatagcctcaatatgtgcccgccagatgtttacgctcagatacgcgaaggatatcggtttcattaagttcgactaaatgctct

SEQ ID NO: 695759 - DNA, 222 bp, Homo sapiens
cgggcataatgtagagctcttgcgcccaaagtgcccagaattattcactgacagtgtaagacttccaaggctctgagtatcaaaaagtctgcctattgcttccgcagctcattcttgagcatcgctgccacctcatggtcattgaagatcgggtggggaggctcgttatgaacaaaaaataccattttggtgctctgctccgtgtacggctgactcttttga

SEQ ID NO: 695760 - DNA, 192 bp, Homo sapiens
  misc_feature (125)..(125): n is a, c, g, or t
gagcggtctcagctcatggtacccagatcggatttgtttccactgtgccagaatgggaactccttacatggagttctgtgatatggaaaaaaagaaactactccgtgcaaaaccaaccataaagntagaacgttcttttcagaccgttttctttatcatcgttttgtcctatttaggggccacacgccacag

SEQ ID NO: 695761 - DNA, 757 bp, Homo sapiens
gcggcccagcgtggggcaacaggtcaggacccccagcgtgcgaaagggaaagggtgttgaagaaatgaggaagagagggtttgtggagagaaccccgagagtgagtgagagagagtgtggcagtattatctggcatagactgttatatatgacataattattggtgaaagacgcgaacacaatatgtatccctaccgtatagtgaaataggggccctctttccgtaagctgctgtacaccccgccactccgagtgaactcaggagaattcttcacgagccaaaacacgcccattcttgaaacacatacactgtagcacggattccactttaatgtaacacttggtgaaataaatgtaaattatagagatgggaaaccacgaattaaaaggttacacggggtttaaggttaagggattggtgaagggggtggttcactacgagggagtcctcgtggtgttgaaaacccactctgtcacgcctcgactggtggttaccccacgggctatacactgaagttataaattgtgtagagttaggtacacccaaggagtacacgatgtaaactggggagaactgagtatgttctgtagaactgtagcccatgtccattttctgcgtcctgatgctgtgctgtagtgtataaggtgttaaccttgggggaggctggggcacagggtaccccggacctccctagaccacctcctatgccacctcctgtgaatctataattacttccaaattaaaagttgaaaacca

SEQ ID NO: 695762 - DNA, 107 bp, Homo sapiens
ctctcgtgtgtgtaaagcctggctaactcaaatccacatagtcgagaaagaacctcataattaatgatgatgtcctatcacacagtccactagacacccacgtacta

SEQ ID NO: 695763 - DNA, 1688 bp, Homo sapiens
  misc_feature (1)..(1): n is a, c, g, or t
  misc_feature (669)..(669): n is a, c, g, or t
  misc_feature (1079)..(1079): n is a, c, g, or t
  misc_feature (1424)..(1424): n is a, c, g, or t
ngcagtgtgcgtgcctgtgtatcggcagcctgctccgtctgtgcatatgctcccccccgctggtgtggttgtggcaccaagaccgactgtgcgtcgtcttttggggggccaccgcctttgtgttgagaccctttcgtcaagggggtgtcccccacacgacgggtgtgtgctccgccgagcaagtgctcctggtcgtgttgttgttaaacacgctgctctccggtcctctcagcttggactctgtttaccccgcggtttctctccttcaaggggtttacttctgcgaggcggccccctttggtggttgtgggcccgacatatgttttccgcgcaccagaaaagccctccccgagacgaattattatgtggatgtgtgtgggatatgccctcctggtcttacacccaaaaaagtgtttgggggccccgcgcgatttggggtgtctagaagggaaaccccacttgtgggataggaattccaatagggtgcccgccctcttgtgaacgagggagggatgtctctagatgctgtcttgtttgtgttgctccccgctgccccgcgcgttgtattacggggggagtttctccaagagaggagtgcccatactttggagatgtttgcttttgttctcctctagaggggggggccccactccttttctgtttctaaanagggaagttgtaaggggtttttgtggacagagaagttttatatgccgcaacaagaggtggcccagcggtgatgtctcaggaaccacccgcggtggccccacgtggcgcatcagacgcgcgcacacccaagggggtttctcaaagagccgcaacattgtgtgttgccctatgatctcgggggggagcagtcacacacagatggtggcccacacacactcacgggtttctcggtgcggtgtttatagagagggccctcccacacagagagaggtgtggcgcgcaccctcccgcgacacaattctacccgtgtgggcgcacactcactatcctctctggcgcacacagcggtctgtctcgacgagtcgtgtgtctctcccgggtgtcgcgacacagagaggctttatactctngtggcggggggacaacacacagaagttcccgcgccacaagacgcctctcacacacacttgtgtgtccccctcattgaccacagcagaggtgtgacacacacggcgccgtctttgtcgcggtctctctctgtggcgtctggtataccgcgcgttcactgtcctctccgcacactcacacagggggcgacactctgcgcacattgtttctccgcgcacacctcggtgtgcgctatagagacactctgtgtgttcacatgatatgtggcgtgtgtatatcgcaatgagcactcggctatacacacctcacgcgcccgcggggctgtcacctcgtgccacaccctcggnggcacaacatttcgcccaaaggccacacctcttgaaacccacttttctatagagacctatcacaggtaacctcgaacccccgagccttctggaaaggaagactgtattttcacacccagttttccctataacaggaagttcacctgaaccacacctctcaaaaacccacacccccgagtttccctgcagcggactcaggctccccctgtggctcaccaacatagggtttttaaaccagaaaaattaagtgaatttagccgtgaa

SEQ ID NO: 695764 - DNA, 308 bp, Homo sapiens
gtggcaacaacagtagagagagtccaaaaaaaaagttaaagtgatgagtaataaccatgttactttatgcatgcattttattgggggaggggaggtcagaataattcacccaaatctagtggtcttatttcataggctaatctgggtttatatttgcattaaagatacgggagggcaatatttacagagtttagtttttcttaattaaaaacagtcctctattaatatagtgtgaaatatctttcaaaatttagagtttaggtttaagatgtctactagatatctttaagattttcctgtaaactcac

SEQ ID NO: 695765 - DNA, 1376 bp, Homo sapiens
  misc_feature (572)..(572): n is a, c, g, or t
  misc_feature (601)..(601): n is a, c, g, or t
  misc_feature (616)..(616): n is a, c, g, or t
  misc_feature (631)..(631): n is a, c, g, or t
  misc_feature (713)..(713): n is a, c, g, or t
  misc_feature (931)..(932): n is a, c, g, or t
  misc_feature (952)..(952): n is a, c, g, or t
  misc_feature (961)..(961): n is a, c, g, or t
  misc_feature (967)..(967): n is a, c, g, or t
  misc_feature (1003)..(1003): n is a, c, g, or t
tggcgtgtccctccagaggatttgacgggacaggttctggtagggggctcttcctgcctagcaccgcgaggaagaaagaggtaggggctggtctggtcaccagaggggtggggcggtaccgctgtgcgctctggctggctgcggaatcagggggagagcgaggcacgcgtggcaggctgagggaagtcagctatggcagcctgtgcgggctggggtgagctagacatgtgagtccgttcgggcttgacgtggcttgtggccagcggcacgcgggccccgggtgctcgcgtgctatgcaggcaggcttgctggtggcgtcgtgactgtggagggcgtggcgggcgtcgttgccgcaaacggcagcccgagattacggttcagcgggtttcgcgaagagtcctgtattccacgtgggtctattgatgggattgcgggcaagcctggcctcgggtgcttgtgcggggcaagccttgagttgcggtgctacgcgactgggtcggtcggaggagtcgccctagatcattggccgtcgcccgagcccctcgggcacttactttctttcgagccccggntatccctctgttgaccgactggtactgcnttggcgccggggcgnaggggccatttaccnttgtgtgagcagctgcctagtggttgtggttgcgttgccaaccggtgtggccctgcggtgccgtcggcgtccttggcaccgnttgttcgccagagtgcgcgtgtgaggtgccggatcgtagccgctggtgtgcaaccttggacctaggaaggtacgcttggcgtcgcattccgacgattggtacgcacgcgtgtacgctagctgcagcagtggtcttgcgtgcgaggtgcagcccaagagcgcatgttaatcgcattgcacccgcgatatagatgcgccgcgtgaaggggtcaccttcanngacattcgccggattttgangaagacacncagagnaggtgcttctggatgaaagccttcgctggaagactntaagactccatcgacgtcacgcgaagggtccttacggtgcgcaaagttggggccccgggagaaaaccaatccgcggtttacggtaggttctccagttttcaacacataagagcgtttttaaaaagttgtcctggcccttctaaaggcagagtatattggcggttacgcgcaatatccgggaagtgtcccggtaatagtcagtggagaactattacgctcctaagagcagggttttacaggagaaaaaacgcggtgtgagggtaacaggggtgggggaatatgtgcaggagagaacaacgactaggggcaaataatgtgggagctatatagagagcaccacacccgaagaagtgcgtcttaacacatgtgtacg

SEQ ID NO: 695766 - DNA, 392 bp, Homo sapiens
  misc_feature (338)..(338): n is a, c, g, or t
  misc_feature (342)..(342): n is a, c, g, or t
  misc_feature (370)..(370): n is a, c, g, or t
  misc_feature (374)..(374): n is a, c, g, or t
acccaaatgttaatatactattttttcagaaccagagatttctttctttatgctttttgttttaaaatggcatgtgttgcttttaaagccagaaaaagggggcaaagtttttaaggcagctgccttgcttgtcaatgaaattctcaactccaggcttctcttagggaaagaggcctccccaggatcccccgtcctaccccgggcggtcgggttgagttctggagagactgctccaatccccgaggcggaaggaggcaaccgatttggcgcagcactcagccagggggtagaagctcaggggaggagccgagcctttctcctgtccaagagcgagatcntggntacgccgggcgcccggagccctagtccnagcncacagccatcgcggtcgc

SEQ ID NO: 695767 - DNA, 319 bp, Homo sapiens
gatagtatcaatcatacctatctaataaagacctccacaagatggccaaaaaggacaggtttcacgaggagctagaatacgatggaagatatcttggagagtggtacatcacagagaggacagagaagctccatgcccctttccatgacctaccctattcatctcttccatctggctgttcatctatatttcttaaaatatgctgttgaataaatgggcaaacataagtgaagtgtttccctaagttctatgagctgctctagcaaattatctgaacccaagaaggtggtcatgggaaccccccctgaggcatgacaaa

SEQ ID NO: 695768 - DNA, 1592 bp, Homo sapiens
acctccacgtgtggataccacaaaggggagttgatgttcttaactatatgtgtgggttgggtaatatgtgactcgcacttctggttagacacatgtgtgtggtgaaccaacagtttttttttgtggggggaacacgagggcgcagtgttttttcgcgttatttaaaaacaagcacgaagggcgttgctgctgttttcgttagaataggcagcaatattttcccacacgcgcctttaataatcctgtataacgcgggtttatttaggagacaccacggttcgtcagacaagaataagtgggtcgcccacataagtcgccctgtgtggcccaccagggaagcttctctatagtaggtgaactagtattcccagcgacaatattttggggggggaataaacaccgtgggtcgctaacttgtctgaaggggcgaaacaagtgccgccttcctcaacacccttgtatcacccaaatgcttgttccacgttgtcccccactgcgctgtgtaaggaaattggtttgtccagaacacgccgtgttacttcagagagtatctttcgggacagttttaattttgtgttctcaaaaaggggtcgcactaatttgtattatacgacaaggttgacgccttctggtgggtaattaagccctccccaagacctttaaaggcgttcaacccaaaatggcggcaacagtgtcctaaaattagaggccccgtcaaaagtagcttttgaatatatggtgggtttcctccgctctctcaataatagtatggcccctctcccccctgatgtggtcttcttggtgcaagaccacctcgtgttgttggaatccccctgcggtgaaatcaacggcgggttcgaacccacgctaataaacagcggtggccccaacgcacacggagacgcatggggtctgttatattgcccctcctcggctgtatttatatagattacacggggattatccccactgccgacccacactttctctcgtagatattatgtagtctcgttctcctatcttgtgtattagtggcacgtgcacacttgtcccacaagaaatcccacacatatatattcacacacccacacataacacaaagctcgtgttacacacatttttacaacaccttcatacactaacatattatatgattgcacgcccactcttttctaaaacctctctttgatgttcccttcggtacaataattatatgagttgcaatagaggagtgtacccatcggaaccgtgtattcactgtgtcaccgcgcgtccagtaacgaccatgagcaccacttattgaggcacagaatgaaacttactcttcacgtcgtataactctggggattagtgggatttttctgagtttggttttgagctttgggggagaggggttggctcataaaatacagagctacatacatctaatgagaacccactcaccatatacccccactacctagttaaataaaattaatttattaactggcactcttgtaaatgcttttcatgaaagtttattttaaggcgagtgcataccttctgtaagcccatccttgtcttgtgataatcaagtgaaattgtttttctta

SEQ ID NO: 695769 - DNA, 561 bp, Homo sapiens
  misc_feature (498)..(498): n is a, c, g, or t
gctcctcctcgcccgtcgcgaggtccatcccgggccagccagcatgtccatccgacttcagctaccccggatattcacctcgctgctcagccggcttctcgggccgcggcgcccgaggtgcgctctgagctcctgctcgccccggcggcttggcagcagcagctctctacggcctcggcgcctcgtcgggcgctgcgtggccgtgcgctctgcctatgggggccctggtggagcgtccggcaatcacgcgcagcgtgcaccgatgtaatccatgatgcctgtctgggtgcccgactgacgggatggacgaccagacctccgtccctccagcgggtgcgccaggaggaggagcgagcagatcaagatcctcaacaatgaagtttgcctccttcatcgacaaggtgcaggtttgctggagcagctagaacaagcatggtggagatccaagtggacagctgcgtggcaggagtcgagaagtcggtccaagagacagtccgncatccgcagatcatgcttgtgagcgcccaggattggctgggaccttccggggtcagctctgag

SEQ ID NO: 695770 - DNA, 675 bp, Homo sapiens
cctccaaaggttaccaactgtccagctgagaagaggaagcccatccgagtgctgtctctctttgaaggaatcgctacaggggctcttggtgctgaaatacttggggattcaggttgaccgctaaattgcctcgggaaggtgtgtgaagactccatcacggtgggcatggtgcggcaccagggggaagatcatgtacgtcggggacgtccgcagcgtcacacagaagcatatccaggagtggggcccattcgatctggtgattgggggcagtccctgtaatgacctctccatcgtcaaccctgactcgcaagggcctctacgagggcattggccggctcttcaaagagttctaccgcctcctgcatgatgcgcggcccaaggagggagatgatcgccccttcttctggctctttgagaatgtggtggccatgggcgttagtgacaagagggacatctcgcgatttctcgagttcaaccctgtgatgatagatgacaaagaaaggtcagctgcacacagggcccggtacttctggggtaaccttcccggtatgaacaggccaatggcatacaatgggaatgataagctagagctgcaggagtgttggaacaagggaggatagcaaattcacaaaggagacattatacgaggcattccatgcaaagaacaagtcatcg

SEQ ID NO: 695771 - DNA, 364 bp, Homo sapiens
gagcacccagtaatgcgctgtcactgaagtaagaggactgagatgccatctgtggggcccgacagggagtcacgtctcaagagaagtgtgacccataattcccgcaaagctgtgaaagagacctctaattccagtgacctaaaagtttcacacaagcctttatgcaaatccttcggcattagtctatcctggccccagcaggatgaccctcacatttaaaaggatcaaaatctcaaacattgtgggaggaaaacgccaggcctgctggggagagggagaaggcaggcctcaggattgtgcggagaaccatgttgccatctgcataacgcccaaacccaatccaagtgccaggaagggaagcact

SEQ ID NO: 695772 - DNA, 212 bp, Homo sapiens
  misc_feature (162)..(162): n is a, c, g, or t
  misc_feature (170)..(170): n is a, c, g, or t
catgtgctgtaggccagcgctttggtgaggccaatggtgggaggatcacgttgagcccaggagtctgagacctggcctaagcaacatagcaatgacccccatctctaccaaaaagaaaaaaaaaattagccaggtgtggtggtgcacaccttgtagtcccangctactcngggaggctcaaagtgatcctccgtacctcagcctccctgagt

SEQ ID NO: 695773 - DNA, 282 bp, Homo sapiens
tgtcacattgcttctcataggactttttgtaccatgtattagtccattctcatgctactataaagaactgccaaagactgggtagtttataaaggaaagagatttaattgactcaaagttttgcagggctagggaggcctcaggaaacttaacaaccatggtggaaggggaagcaaacatgtccttctttacatggcagcaggaaggagaaaaatgagaagtgaacaaagcgggaagccccttataaaacaatcgtgtcttgtaagaaccaattatcatgag

SEQ ID NO: 695774 - DNA, 280 bp, Homo sapiens
gagccggcgtccaaagctggacccgcccgccggggcaccttgctgggactcctggcgcgccttgcacccagccagggccctccctttgccagcctgggctgtgcctggggaaaggggtcggcccctcttagctaggcctgggccggtggagtctgctccctccacaaccctaaactcagaccccacggtccagtggggaacctccctttctctccaagggtgcttgggctccaatcgctgcttgaagagttcaggacacacacacacaccccacgggccc

SEQ ID NO: 695775 - DNA, 582 bp, Homo sapiens
cagtgggatggctataatggatttggtaatgatggagcaattttggaggtggtggaagctacaatgattttgggaatcccaccaatcagtcttcaaattttggacccatgaagggaggaaattttggaggcagaagctttggcccctatggcggtggaggccaattctttgcaaacccccgaaaccaaggtggctatggcggttccaccaccaccagtagctatggcagtggcagaagattttaattaggaaccaaagcttagcaggagaggagagccaaagaagtgccagggaagctccaggttccaccaaatttgtgaactcaccccagcccagtggtggcagggcctagctgctacaaagaagacatgttttagacaaaatctcctggggaaggggcaaaaaacccgaggccggtatttgtgcctaattgtaaacccggttattttagtttctgttctgtggaaagggtaaagcattcccccaaagggttttaatgtagatttttttttttgccccccccgctgttgattgctaaatgtacccgtctgttcgggccgctgaataaatgtctttttttta

SEQ ID NO: 695776 - DNA, 764 bp, Homo sapiens
  misc_feature (764)..(764): n is a, c, g, or t
cctccatatatccattgatcagctcattcaacttcctcaagtctttactgaaacttcacattctcgatgaggcctattcagtatttcaaactgcctcccagctgcagcattccaaaaccccttactcttctgtgtatttttgaaaggatttattgagatataatttacatagtgtagagtgcacacattaatgtctacaagtcagtggcttttagtatatgcacagataagtggagccatcatcacaatgaattttagagcattttcatcacttcaaaaagaaaccccaccttccctagctgttaacctcctatgcacccatcccctactcaatcctaagcaaccacaaatctgttttctgtctctatagattttcctagtctgttttcatctaaatagaatcatacaataggtggccttttctgcctggcttctttcagttggcataatgctatcaaggttcatgtacgtatggtactttatttctttttataactgtataacattcaatttcttggatataacatttgtttatccaataatatttttattgacatttgagttgtgttcagcctttggctattttaaatactgctgctaaaaatacttgtgtacaatttgtgtttgaacacctctttccaataatctgggtgtatacctaggaataaaatttctgggtcatatgacaattctatgtttcatatatttagaagccatcaaattattttccaaggtggcagttctacccatagagtatctaacgn

SEQ ID NO: 695777 - DNA, 159 bp, Homo sapiens
ggagttcaccactgaagtgagctgtgattgtgccactacactccagccagggtgatagaacaagatcctgtctctaaaaaaataaaaaataaaaatacttttattgcaaataatacaattcatcactgaactagattctagtcattgtacataagacaa

SEQ ID NO: 695778 - DNA, 873 bp, Homo sapiens
ctgcgctgcctgaggtgaggatgtgaacctgccctggtcactttagtgtgtcctgggccctggcctgggccatggattcaatgcctgatgccctgctgtccctgctgtcttctgcttcttcccttgctgctgctgctgctgctgctgctgcctggcccctgtgagcttgggccctgagccatgtgccggagctgacgtgagaacgactgggttcgcctgcccagcaaaatgcgaacgggacattgcgtgttaactctgaacgtcactgcagaccactttgcaatgacggctcctgtgattatagccttgcacaatggcagcagtgaccgtgcagcaatctgattttgccaatggtgcatgtcagagacctttgcagacattacacaacctggtacacaaagtgggtcaaggtggtgcatggacatcccctatgagctgtggaactgagacttctgcagaggtggctgacctcaagaacgcagtgtgatgtgctggtggaacgagtatgacggaggtgatcgacgactggtacaggaaccaccagcgagcgacgacctgactgactccctctgcgccaaccacgtgctgaccggaaacgacaccagttggcctggcaccgcagtggtccggcaagaaggcgcgacacagccggcctgcgacgggacgacgtccaagaagaacagcagcacgcgcccacggcagcatgccccaagcagtaccaccagcaattcacagtaacgtgagatggagtcggccctgcaaaggataacaccaaccacctagcgaccgactcacgggaacccagaaacgcaataccctacttccacatccagcacccctgtttaatcctcctatccccacacaggaactacc

SEQ ID NO: 695779 - DNA, 305 bp, Homo sapiens
gccagcctgcctgggttacatgacaggactttgttattaaagaaagtagggcagcatatacagagatctaagttcaacatgaaggacattaaagctcccatttaggcaaatgttctccacacagaatctcctcatgacccccaccttctccactacatatctaagctcagacaaaacaagcctgcagacaggacacaactgtctattcaactgaaaccttgatggacaagcctgactccatcttaaggtgagaagctatctgagtacaaggtcaaattaatgagctggagagatggcgtcgacgc

SEQ ID NO: 695780 - DNA, 348 bp, Homo sapiens
tgtcacgttatagagtaatcacagtgttctttgagcatcaacctacctcccctgtcagctcttcataggtaattttgcacactctggaagcgtcttgacagccatacatctgtctttgtattaaggcatgtcgttcaccagcttttccatttctgcgaagcttgcttccggtacagactgagctaacgctctcatggttatgtattcaagacgatattgtatgcgtttgtcagtactcttagtgtactctatagcgtgaggctgtgtgctcagggttacggatacagtcaaaaagccctagagggacctcagcggagtaagttctagtagttccatatctgtagatgc

SEQ ID NO: 695781 - DNA, 373 bp, Homo sapiens
aattgagggggtgatggaaatgttccatagcttgattgtggttatgtagcaggacatattcgggtagattttattgtatctcaataaaagtttattttaaatatttttaaatggcacataaaagaaaaataaacaaactggtcaataagccaaagttcaaaaacatttagtcacataatagttctactacagggaagaaattctacttacttctcaaaaaaaatcactgtttatgagattttgctttgaatcttctcaatgtgtggaaatacaattactactgcatcagaattactttcatctctgcacaacatggttaaaaactactgacaggcaagaatcatgacagatacccgtttttacccaatgcaag

SEQ ID NO: 695782 - DNA, 1085 bp, Homo sapiens
  misc_feature (133)..(133): n is a, c, g, or t
  misc_feature (433)..(433): n is a, c, g, or t
  misc_feature (661)..(661): n is a, c, g, or t
  misc_feature (709)..(709): n is a, c, g, or t
  misc_feature (720)..(720): n is a, c, g, or t
  misc_feature (723)..(723): n is a, c, g, or t
gcactgtgcgtggcctattcgggtcagtgctacatttctcatgcgcaaacagggcgtagcgccaaccgtggcgattgctcgcaggcgtgccgtttgccatacacattgaaagacgatcaggggcgggtggttncctatgaaaaacatctgctgtcgatgaaagataacgatcagactgccaacctcggcgcgctgattgatgctggtgtacgctccttcaagattgaagggcgttacaaagatatgagctacgtgaagaatatcaccgcccattatcgccagatgcttgatgccattattgaagaacgtggcgatctggcgcgcgcttcatcaggtcgtactgaacatttctttgttccatcgacggaaaagactttccaccgtggtagcacagattatttgtgaatgcccgtaaaggcgatattggcgcgtncgattcgccgaaatttatcggcctgccggtaggcgaagtagtgaaagtggcgaaagatcatctcgatgttgccgttaccgagccactggcaaaatggcgatggcctgaacgtgttgattaaacgtgaagtcgtcggtttccgtgccacatacggtcgagcacaaccggagaaacatcagtaccgcgtctggcccaatggaaatgcccagacagattgggcacaaaatncgtccacatcaaccactaaaccgtaagtcttgatcataactggcagcnaggcactgacnaanaactacacgcgaacgttcgagtgagcggtaacattgaactgggcggctggcaggaacaacggattctgaccattaacagtgcagacggtgtaagaatcacgcatacgctggcaggagcagtcgcaaaagcaaataaggcggaaaaagcaaggaccaacctgcagacggctgggacaacgtgagcaaccgtaaaacgccggagtgaaaaacatcggggacacataaggccaaagctggacagagtgacggaaagcgacgaaacgagaatagacgaacgaacacgagacagcaaggggtaactgcgataacaacgataaacgagaacaaaggaatcaaggaggagcgaacaagaggcacagctt

SEQ ID NO: 695783 - DNA, 1290 bp, Homo sapiens
ctgcactccagacctgtgtggcagagccagaccctgtctcaaaaaaaaaggccttgtggctgggcgaagtgtgctcactcacacctggtaatcccagcgattttggtgaggttagatggtgtggctggatctacgaggtcagtgagatcaagacgcatcctggactaacgatggtgaaaccccgttctctactaaaaatactaatagaaaaaattacgctggatgtgcgtgacacgcacctgtagtcccaactactcagaaggctgaggcaggagaatcacttgaaccctgggaggcggatggttgcagtggatgccaagatcgcgtcattggcactccggcctggctgaccagggagaataaaaaacaaaaaaagccatttaatggggtgtgacagggaccgtggatgtaatgcttcaggggatgccagggtatggtgaagtggtcactaagtgggcacaaatgctgttttttacaaaagaggtcaaattgggctttcgctcatattcctcaggggacaaaatgtgggcgcccttcctgagccataagagtagagaaaagcataccaacgtggggggcatcatccaaccagagataaacacggccattgggcacacgggagaaagccctggtggagcacttggcggaacacggggtagcccaagtgggggctaccgatgcgaccagtgaagtatggcgttttcgcgtgctaaacattcgcgttggaagccatcgttttttcacatcgtagttccccacaggcaaaacacaccttgtggtccgatgaaacatggtggcggttgggttgcccaaaataattcccacatcacattttggcggagaccgcctggatttgtggtaaactgagcccgtttgtcacaaccaaaaggggtaggccacccccgtgtgattataccaacaaaatctaataaggagagacagcggccaccatggtgcctcccaacccgtgataagatggcacacccgtggggccgggcccaaacggacgacaggcgaaatcaccatgacgggcaacgcgatcacaccccacacctgggcacactgggtgcacacacacacgttcgctaaagacacccaccaactatcgggacagtgtggagatcgtcaaatacaccccacatggacggctgcacacgcggcatcttctgaacctgagccgaaacactcgcagatcgaaaatacccatgcaccacgctccaccgcgtgagaccacctaagaaccagacgataccacaaccacgatatttcagtggcaagcatagcagcgat

SEQ ID NO: 695784 - DNA, 674 bp, Homo sapiens
  misc_feature (674)..(674): n is a, c, g, or t
ctcccggctgcctttttcacctctgacagagcccagacaccatgaacgcaagtgaattccgaaggagagggaaggagatggtggattacgtgcgccaactacatggaaggcattgagggacgccatggttcttaccctgcacgtggagcccggtgtacctgcgtgccgctgatccctgccgcttgcccctcaggagccagacacgtttgaggacatcatcaacgacgttgagaagataatctatgcctggggtgacgcactggcaacagcccctacttcttcgcctacttccccactgccagctcgtacccggccatgcttgcggacatgctgtgcggggccattggctgccactcggcttctcctggcgtcgtgccagcccacggcatgcacccgagctggagactgtgatgatggactggctcgggaagatgctgcgaactaccaaaggcattttcgcaatgataacacgctggcagaaggcggcacggcagtgatccacggccaagtgccaggtgaagccaccctggtggccctgactggcccgctcggaccaaagtgatccatcggctgcaggcacgcgtcccagagctcacacaggccgctatcatggagaagctggtggcttactcatccgatcaggcacactcctcagtggcacacagctggctacn

SEQ ID NO: 695785 - DNA, 175 bp, Homo sapiens
tctagaggatcccttgctttggacgcgtgaggtgataattcaagacaagcgcggagagcagtacacagcacgtacgtgtgtcagcgtctcacgtctgcacagactggcttgattgcaggggtacaagttcaggtctcccaacaaaggccctcccaggcccccattcgagaaaaac

SEQ ID NO: 695786 - DNA, 905 bp, Homo sapiens
cctggcgtcgcgtaggagggaggatggagagcggcgacgaagcggcatcgagaggcacctgtgtccacttgcgctccgccacattgcgcgacgccgtacccgccacactgcatctgctgccctgcgatgtgttgagtgtggactgggccctgcccctggtgtgggcgcttcttcactgccctgccatcctgccagtggcccctgatgtggactctgaacgtgtctgtttcggtggcctgctgtctactgtgtgtgagatgtgatgtgttggctggttgcctgactgtggcctcgttgggatactgtgatgtgtgacagaagagaagtgtgtctgatgtggtgaagcctaggacccctatgctgggattcctggtgactagactgacgcaacgaggagtgagccgcctggagctgttgactatcgacactgctatccatatgtgcagccaactgccaaactttcaaagctctgcgtttcaacccctgatgaggagatctcggagacctcagttcctcttgagcaccagtaaattgccgaaaatagtatcatgtagagtggccattacaactatggggccaaagcctatgtcgtgcaaagctgagtatcagacggcaccaatgtgttgccccatggaggagaagctcgatgtcaagtgctccaggtcgatggccgtttgtaaaaacaactttttgccatgaatatgacccgcgccgcaagttccgcctgtttactgagctaactgtcatagtgttacaaagaaccctaagtgctatccattatatggcggcaacacctgtaagtatacacccagttcgaaccacgcgaaagtttaatactggtgaagtgcttctaatacgacgtagggccacccgtggttttaagcgttctgggcgtgctgaccgtt

SEQ ID NO: 695787 - DNA, 393 bp, Homo sapiens
ctcaaacccttgctgtgcttttaaagctcaagacccagttcgaaagatactaccctcttcctgagctcctcatcacgccacagaaagacagatcccgccgggtaaggggacagccagtggcgcgaacctggctgtcctggttcctcgtacagtagccgaggccattctgctgggatccacgggatgcctcagtgaccttcccagattcaggtcacctccacgcatactcccgacaggcctacctcctgggacagctcctcctgtctggagagtcctcttcctggtgctttgggcacggcgctgctttgatggcaggtcttccctggagcctgtgagacctcagtgtggcttcgaaccctctccgtgttcagcttgctgagtggcattggcccg

SEQ ID NO: 695788 - DNA, 458 bp, Homo sapiens
  misc_feature (289)..(289): n is a, c, g, or t
gaagcctccccatcagcaccatgaacccaagtgctgccgtcattttctgcctcatcctgctgggtctgagtgggactcaagggatccctctcgcaaggacggtccgctgcaactgcatccatatcgatgacgggccagtgagaatgagggccatagggaagcttgaaatcatccctgcgagcctatcctgcccacgtgttgagatcattgccacgatgaaaaagaatgatgagcagagatgtctgaatccggaatctaagaccatcaagaatttaatgaaagcgtttancaaaaaaggtctaaaagggctccttaactggagtgaagccacgcacacaccccggtgctgcgatggatggacagcagagagcctctctccatcactcccctttacccagtggatgggctagtcctaattgcccttggtcttctgaaaggttaccagccgtggtcacatc

SEQ ID NO: 695789 - DNA, 318 bp, Homo sapiens
gtcgaccctttgtttcactaccatacatgcaatatgtatgatgttcaggatcccacatacaatgcctgtagtgggctcttaacccatttaccagccaagaatatgctaaagtcacaaatggtaaacatgtatactgtgcgagtgagcagcggctggaaagttggggttgatgcttaatctgtatgttaactttgactggatttagaatataaatccagatggacctatagcaatagccaccccttggaatcattgtttttcttctgactgctttcttgctgctgtgaccaaagaccagacagacaagaagcgtcgacg

SEQ ID NO: 695790 - DNA, 130 bp, Homo sapiens
gtgtgtacggaagtgttaaggaaaggttgggaccaggcattgtggctcacgcctgtaatcccagcactctgagaggctgaggcgggtggatcacttgaggtcaggagttcaacaaatacttactcgtaca

SEQ ID NO: 695791 - DNA, 179 bp, Homo sapiens
gaaggccaacttaaaggatccctctgttagaaaagaattttgccgagcaaacatctcgtccagcagcttgtttgtgcgcgtttcttcgaaattatccaaaaaggtcttgttagagcttgtattgttagcagggcccgtagtagtggaattattcatatttgctcttgaacgttttctag

SEQ ID NO: 695792 - DNA, 282 bp, Homo sapiens
tgacccagtcctctctctgacggggtgtcatttggccttaagcaacaccaagtccactgtggacagatgcagtggctagtggctctccccattaccttctcaagacctcagtgggagcaccagccaatggtaccatcggctgggctgccaggtaccctgggcctggcgctgcagacctgagctggcttggacccatttgaggactgaactaggcagtgcatggctccagtgccctccctctgttccctattttacaccaacccctgttcggttgagcggaga

SEQ ID NO: 695793 - DNA, 578 bp, Homo sapiens
acgcatgcataaagaaatgctaggagccagcctttatacttcgatggacggtgtgtcctggatggtgctccacgtatgaactacaaaaccatttggcttgccagattgaaacaattggcaggaaaggtgtcttcaaagagaattccatatgctccttctggtgaaattccgaagctttagtcttcaagatccagcctaacaagaaacctaaagtgtagagattgccattgtttatttgtgatttattaattattttgggaacttccaggatagcaacagtactctatctgtgcctactaaccagtggttcaacagtgtaaaccaacggtggtatcctatatcagagtctttgaattctttgaaaaacagaaggtcatccacctgttgtgaccccccggccggcaaatgggacaggaggaggacaccctgaaggctacaactgagaagaagacaccgcgctacaccacagctgcaacgccctatacaacaccaagaggctaccaaccaccaccaaataaatgaggaaaaaacggggacacccggaaaaaagcggcctggcaaacacatagagaatacca

SEQ ID NO: 695794 - DNA, 186 bp, Homo sapiens
atgaggtctctcctctttctacatgggccgctcccgagggtcgggtcacaatataccaccacagtggggacaaatcaccttcctattcgggcagggggcaaagcttcagttacaaggaccaccacgatggcgtacccataccgtgcaactagcataagcctctcgatacccagaatatacccatcc

SEQ ID NO: 695795 - DNA, 866 bp, Homo sapiens
agcgggcgcagccaggtctgcgctggcgcggccccggctcccgcccgctcccagccgggccccccagcggtcggcgggacggctcccggctgcatgtctgcccgtccgccccgcgcgggggccgagtcgcgaagcgcgcctgcgacccggcgtccgggcgcgctggagaggacgcgaggagccatgaggcgccagcctgcgaaggtggcggcgctgctgctcgggctgcccttggagtgcacagaagcccaaaaagcatgcgggtattcgacggactctatccaacctattatatatgccgctcatacgaggacctgctgtggctcccaggtgcttgtgttgctgggccctctagcatactgatggctgtggtacttctggttccttctgatgatgggcgtgctttctgctgcggagccggagttcttcatccggagtgcgcatgtaccccccgtcgctgatcgaggaggccagccttcaatgtgtccatacaccatggcagcccccgagatctcgggccaggagccccagcaagccggggccgcccgtattacaccgacccaggaggaccgggatgagccctgtcagggaataccatggcaattggttccaggtcccacccaaatcaccccaggggagtgtggcctgccagcgcctcagcctagtgcaacagcctcggccccgtcgaatcgtgtagtgacgggccagtgactggagtactgcccacgttcgacatggagaagacgttttcacgcgccgtttccccgtgtggctttcaggctcgcgatgaagtgggccttacgggtactggtgctcgtgggtgctaagggaagtacctatgaattactccaaagataccccccgtc

SEQ ID NO: 695796 - DNA, 147 bp, Homo sapiens
cttttaaaatttgaaaaaaactgaattttgaaacagctttggtcccaggggtaaagaatttgggcttttcctgaacctggccccatttggaatcccccaaaaaaaaaggttgataatcctttccggtttttttttttagagaaaaag

SEQ ID NO: 695797 - DNA, 1039 bp, Homo sapiens
cgtaccgcgtgggtcgcccacgcgtcttggttaacatagtaacgaagatacgtatgccctattgagatcgcgagtggcgaatgcaccttggttgctccttgctctttcaaggaagtttctagatcacctgttgaccaaaggtggcagttatttttggtggggacgaggtcttgcgtgcggctcatgagatgatctgctctttgccatgcctagtggagctggatggaagggtttggcagaaagggacacagggggatctgccaaaccaagttggaacgatgagcgtcaggaatggctatgaaggaatgcacagtggtacctccgggaatgcgactagtcaaagtcaccaactggtcaatgcgcgtccatgtcgttggaattaacattactgcggacataacagcttggggtgggaggacggtctaaccccctcactgtgtagagtcctctggtgtgtgttggaccgagcctcgatgtggtgctggactttgatgcatttagtgacgacgtgtgcgtcttggcccatccggtgtttaccagtgatccttagcagatagggagatcattgggccagagcaggaggctagtgtacaagttgatccaggagggaaactattcttccatctggcttcagtaactgtgaatgacttctacaggctgacacgtagcctgaacacaggcctggttccaccctggaatggtagagaatgccttgcgatcgtctgggtcagtcagtacctctgctgtgctgattgaggactggtctctagccttggtctgtcgtcacataagaagcgggtgcatcagcttggtgcctcagagacctccgtgccgcaggggcgggatattgttgaaggcaagtggacgggcgttgacgtacgggcagtaatggtatcagacgggcggtggccccacgagggtcacgacaggggccagggggccagaaaaaggcgcatggaagtctcccggtgggcccaaggcccagggggggcagcgcagcaggcctggagacaggtgcaattgaaccccaaggcggaaa

SEQ ID NO: 695798 - DNA, 84 bp, Homo sapiens
caggaataacaaatgtttattcagaaatggataagtaatacataatcacccttcatctcttaatgccccttctgtcgtcttctc

SEQ ID NO: 695799 - DNA, 143 bp, Homo sapiens
ttccggggtgtagggtggaatttgtactgccacctgatggtattatgataccagttgatataaatcttataaagcttaaacatatgtgtaggtaaggcaacgaatccccagataactctcttgaatttgagaggtatatacca

SEQ ID NO: 695800 - DNA, 104 bp, Homo sapiens
agagggccctgttaggggtcatgggctgggttttactaatatataggcatgtgattggtgggtcataagcttgcgttgattaagtcccagccattgcactccgg

SEQ ID NO: 695801 - DNA, 169 bp, Homo sapiens
tggtcccctccaggataagtgagttggagaggatttaaaaaccaaccctgccaggcatgggggttcatgcctgtaatcccagcacttagggcagcaaaggcaggaggattggttgagctcaggagtttgaggccagccttggcaacatagtgagaccccagtttttcca

SEQ ID NO: 695802 - DNA, 437 bp, Homo sapiens
gactctagtcaggaagaaaagagggcaggaggaagtaacccaatgcctttaaatacaaaacagatgacagacaaaatactcatttatcctataactatggtgggttaggggagccaaaccaagtgtgactgtgagcacgttcactgagaggcatgacaacattatagaagaggtctttccattatgtctggttctcttattttcttaagtcaagccttaactatgaacatactttaagatgatacgggtctgtcaccataaacctgtaaaagggcatcgacagcttttcagataatccaggaatgttgagacatggctaagtttctagctgatacttagtcattccctcttgatattgttgggatgggtagccaaaaggcaggcttgtgggagttaagagccaatgatacctggaaacataggatacagtagggaga

SEQ ID NO: 695803 - DNA, 315 bp, Homo sapiens
ccattcacatgcctagtcatatagtacaccccagtcccatgaccccctaacaggggcccgctcagccctcctaatgacctccggcctagccatgtcatttcgacttccactccgtaccgctctctcatactaggcctactaacccgacacactaaccagtataccaatgatgcgtcgcgatgtaacacgagaaagcgcattccatggcctccacacactcacctgtcccttataggccttcgatacggtataatcctctttattacctctgacgtttgtttcttcgcgcgatctttctgagccttttaccactcc

SEQ ID NO: 695804 - DNA, 531 bp, Homo sapiens
gaaatgatgatatcatgcaacatgcagggaaagtgttatctatacgatactttacactatacatgaagaactatcagataaaagatgagtaaatgattgacgcctattcatagataaactagaaaaggtggctgtgagaggaggagctaaaacactaaaacctgaatctagatctaatgtgcaaagtaaaatcctgggttcatagatcaaaagcacacctgttcgcttctatcatgcattggcatgcacaaaagagattgaagtgttgaataaacacttacttttgactatcaaaaccaatggtctacctggttaatctttctgaaaaagactacattagaaaagaaaaacaaatggttgataaaaattacagagtgggtggacaagtatgacccaggtgctttggtcattccttttaggtggggccttggcactcaagtttgcaagacttgagtgctgaggagagacagaagtatctggaaggaccataacacaagtgctttgccaagatcattaggctggattgcagcc

SEQ ID NO: 695805 - DNA, 759 bp, Homo sapiens
acagaagaaccagagtggggaagcatggttatataaatgtatgcaagagggttttctgtagatgggacggaagcaatggatgcttgtggtccaataaagtgcttgatgtctgaaaggtgtcgattatggtaatatactgagctaagatcctgtttagataccatggttatgtggctggtagcaaggagaactcgctgttattcggtaacatccttggtgagttggcgtaggctagtgtttctacaggaagcataatttgtctctatagagggctattcttatgatcagggttctcaatggagtacaactcttgctttcttagcgcttacttgaatctatgccgtagtaataaaggtgagatgcaacacacattgaagagcttctgtatcaccggtccgtgaaattttcagtctggcaatgtctttgtattaagactgaatcttgttttagagctaacaggagatcataatggttccatgatgagcggtgtaagtcctgcaaggaatgtctatgtgatgaagcaaggtgtgaatctgtatttagtcttcaagacagtggtcagagtgacttaatattgtatcatggcattgatccccttcatcctgaaaatgagttttatggtatgtcattttacttattttattcattagctaacttggtctatgtatattctagattttggctagtgtactcgattataaaggatattcatccatccagggattgattttggattttaatatttcttgtgaagtttca

SEQ ID NO: 695806 - DNA, 405 bp, Homo sapiens
gtctagagcttagtgatgggagatacccgtgggcacatgatacagtagaccattctcctcccttggttctgggaagcctcccaccctgcctactactaggcttaccccttgttgtgctgaagggtcttccacagtggcctccttggggacccagaacccggaggaaggggcatagaggcaggaagtgaggccgatgtctgcaacccagaccacttcgtgtaatgggctcttgaccaaatcccttttttttgcgatgtacccgttcaagcaaaacaacgttttggttaactaaggattgtgctaaagccgataccaggtacttccggtgtttggacaaataacttaatgcatgcggggctgaaaacctacataatgggtagatgggtgcagctgaccaccatggca

SEQ ID NO: 695807 - DNA, 698 bp, Homo sapiens
ggcgggctctccccgcagtggacaagctggacccaacttcagagcgaccagcagagcaagcgcacgcccctgatgcagcgccagaaggctccgtggagatctgccatgtgctgctgcaggtcagcacgggcccggcccatgcctcattcaccaggcccttagggccctcccctgcccatgctccctggtgccagcctcctgcccctcaaggctggagccaacataaatgcagtggacaaacagcagcggacgccactgatggaggccgtggtgaacaaccacctggaggtagcccgttacatggtgcagcgtggtggctgtgtctatagcaaggaggaggacggttccacctggctccagcacgcagccaaaatcgggaacttggagatggtcagcctgctgcctgagcacacggacaggtggacgtcaaacgcccaagggacagtgcggggtggacgcccatcatcttgggcttgcaagcagtcacaagcacatctgacgtgatccgcatgctacttgacacggggcgcctacgtcaccctccactgacaacgcaggagaacatcctgcctgcactgggcctcctttcacgggcagcgtccggccatcggcgacagtccttctgcaatgcgcgctgtgaccctccatgctgtcaactaaccatggggacacccccctgcacatcgcagtcggcgcaa

SEQ ID NO: 695808 - DNA, 1057 bp, Homo sapiens
gctgggtttcatgctgagtgagacccctctggacctacaaaacgtgacaagcgtgtggacgataatggtacgacatgaagctgagccggtacgtaactggtgctgagagtgtttctgagggtgaaggaatagatgctaatgtcaggctccgatagataggtctctggtgatggggtcacagtatcgcatttagaccagaatcctggaaccctactgatattgaaggtaagaagcagctgatgacaggggagttgtctcgctggacttccagttcagtggcctgcactagtagtacgaaacaacgctagagggcctggccctcctgatcgatgggatgtggttgcttgacaatgatcgaagcctagagctccagaattgccgaaatgctgaaacgtctggattcgctctgaatttatgctctcagagggaaccaagagctttaggcaaccagaccattggagctgactctttggagacggcaggaccaccgcgtgggtgggaaagaaggggcgatacccattgtgtgtgaactgatgtgggatacaacggacagacttcttcaaacctggggccaaaagacatgaagaaacccaagggacgaagaatccagtcaacacgagttcacaggctacagaacgaacggaatgtaacaaccgtggacagacaacgtgccaggaagagaaatgccgtggaccaggcccacgaggccaaaaagacggagggacgcagggcaacgcgcccgactgagtgcccccgaaagaacaacagtggtatagtgacacccgcaagggcgaaaggcttttgtcttctacagaaagccaaagtgacgggaagacgggctcaatccgtttcaaggcgttaaaatcttggggtccatcacaaagcagcagcaaattggttcccaacggttccaaccgccttcggactggacaagggcgacatgcatggatccaatggggaacctttctagccttggttacgggaaccacacacatggaatggcggcatcgccgcggccttggcaacacaacagcaagggtttacatggggaccccct

SEQ ID NO: 695809 - DNA, 339 bp, Homo sapiens
gtggttgccagggcctgggacgtgggggaaatagggagatgtttggtgtctgttaggaagaatgaataagctctggagagctaatgtacagcatagtgactatagttaatagaaccgtattatatacttgaaatttgtgaagagagtagatgttaaatgttttcacaacaacaacaacaaagataattgtgaggtggtggatatattaacttgattgtggtactcatttcacagtgtatacatatgtcaaaacatcatgttgcatactgtagatatataccatttttgtcaatcattcctcaataaagcaggaaaaattattgcattttccacatcaaa

SEQ ID NO: 695810 - DNA, 101 bp, Homo sapiens
tgtattgtcggtgctgcctgtattggcgttgctgcccgctgattctgacccaacagtatcaccagctcagagcagtagatccagaagaagtagaatcgcgt

SEQ ID NO: 695811 - DNA, 588 bp, Homo sapiens
  misc_feature (507)..(507): n is a, c, g, or t
tgggagacgggggtctcactcatccatgaggatggtacgggttggcgacgttgggggcctggacggggctgcctcctccgcgggtatgaccaggacgcctacgagggcaaggattacttcgcccgtgaacgaggacctgagctccgggaccgcggcggacaccgcggctcagatcacccagcgcaagtgggaggcggcccggtgtggcggagcagctgagagcctaccgggagggcctgtgcgtggagtcgctccgcagataccgggagaaggggaaggagacgctgcagcgcgcggacccccaaaagacacatgtgacccaccaccccatctctgaccatgaggtcaccctgagggtgcggggcccgtgggcttctaccggggggagatcacatggaccgggaagggggatggcgaggaccaaagtcaggacaccgagctggtggagaccagaccagcaggagatagaaccttccagaagtgggcagctgtggtggtgccttctgnagaagagcagagatacacatgccatgtacagcatgaggggctgccgaagcccctcacctgagatgggagccgtcttcccag

SEQ ID NO: 695812 - DNA, 423 bp, Homo sapiens
ccagaaaaggcctgtctgttcagacttttcttggcccctctgtgtagcattccttcctttagggtatgggggaggactctctgtaatgagtgttttgattcacaatcagattagagtcctgcttgggcaggtaaaggaaggacaggaggtcagagaggtttcctgaggcctaaagtgctccagcattataacaaggactatgaaagttgggagccaggaaatgtggatgaaaaacaatatataattatcgtgataccacatccattgacaatgttttgtctgcatattcctttgacttttgcctgatttgatttgtcaggatagttaaaatgttaggtgagatagtctaatttcttctttttaaaaagattttcaaaatttattttcaagacagcctgggcgacagagcgagactccgtctca

SEQ ID NO: 695813 - DNA, 219 bp, Homo sapiens
ctctacacggatccccggcatgatgcgctttcataataatctatgctatggggatcaggggtgtaggtgtgccttgtgcgctaagacgtgcgctagggcatttttaatcttagagcgaaagcctataatcactgcgcccgctcataaggggacggccagggctattggttgaatgagtaggctgattggtttcgataattactagtatggggataaggg

SEQ ID NO: 695814 - DNA, 276 bp, Homo sapiens
  misc_feature (46)..(46): n is a, c, g, or t
aggatcactggcgtcgttttatatcgttcgtgatgtaggcgtacanacctagcgtgcactcaagcctgggcgacagagcaagaagaaaaaaaaaaaggccaggcacagtggctcaggcgtgtaaccccagcactttgggaggccaaagcaggtggatcacctgaggtcaggagttcgagaccatccaatatggtgaaaccctgtccctactaaaaatataaaagttagccgggcatggtggtacatacctgtaatcccaaacatataactgaactc

SEQ ID NO: 695815 - DNA, 176 bp, Homo sapiens
tccggtcgactgctcgaggttgcgcgatcaccaccgtgcgccgttctcgacgggggctgggtcttcacgtgcttggtgttgaccgcgatgcggcaggggtggtctcgccgcgggtgtcgttgttgatgtccacgtcgaggatgttgttgacctccgtggtgatctgcgtcgttact

SEQ ID NO: 695816 - DNA, 541 bp, Homo sapiens
  misc_feature (541)..(541): n is a, c, g, or t
ggccgggcgcggtggctcacgcctgtaatcccagctctcagggaggctaagaggcgggaggatagcttgagcccaggagttcgagacctgcctgggcaatatagcgagaccccggtctccagaaaaggaaacaaaaaaaaccaaacgccaaaaaaaaaaaaaaaaaaaaaaaaaaaaatttttgtggggccgcgccgggggcccggaaaaaagttttcaacaccacctcgcgtcggggggcggccggcgccgcccatgtgggttacaggtggcacacgtggggcgcaaagaggctgtttgctcaagcggagacaatcccgtggtcatacgacatagggtgcggggggtttcctccccaccaaattagaaagaaagagcgcgcccggggggggcgacacacccgaggggtgttccgtgaaacaaacatccacagagagggagtctcgcggaggcgccacaacagcgggccctacagcagcacggggggtcccaaagcggcgacgccggatatattaaaattgacgccgccgagaggggggan

SEQ ID NO: 695817 - DNA, 224 bp, Homo sapiens
accgtggaccatggagcactcgggggactttttcgatggaacttcggccttcatgctgacacagatgggatacagaaggagcgccggcctgaactgcagcttcctgctcgaaaccaggctttttaacaccagagtgagcatactgatagccggagtcaagaaccgagataagtacctgctgcgcttactgtacctgcaaatcaaggactaactgcagcgtctgc

SEQ ID NO: 695818 - DNA, 382 bp, Homo sapiens
ctgatatgtctgacttgttaaaggtgttggtaatagttaatctcttcagagattgggagggcctggaagaaaaagatctagctatgtaagtagagattcttcacagacgcagattttcccacacaaaggatggctttgcagggccatttcaagatatggcagaaaaacgtgtttaggggtaaaatatttggattttcttccttgtgttgtacgtgtctatgccacagtccgataggcacgctacgtcacgccatatagaattacataaaacccatctgatgagaatgtatagtaggtagggcactactctccagaccccttagacaggaatctgggcaagattaaaaaatagagcttagccctctcctcaacaaggccagac

SEQ ID NO: 695819 - DNA, 1584 bp, Homo sapiens
cgtctttctgttttctccttcatgtttgattcgttcgttggtttctatgttgttgtgcctgcggtcgttcgttgtgttctgtttggtgtttcttctgttgtttttccttcttttttctgtcttctgtttttgagcttttctatttctgttatttgttgttggccttgtagttttccttttgtttggccggttgtttgtgtgttctgttttttgtcgcttctggtggctctcctgctccctgttcttttctgtagctactctctttgtcgtctgttgtttccttgtgccttggtcgttcctctttcttgtgtctagtttgtgtggtgcttctcttgttgtttatcccactcgcgtgtgcgggtggtcttgtgtctgtttttttttctttgcttgctattagtggttcctctcgtttttttatgtttttcgttgtgtcgctgtcttttcttttttgtgcttttttttgtcttccgcttcgtgctcttttttcttttctttctctgttttttggttgttttgatcgtggtttctgttgttttccttgtctctgtgtaggtttgttttttttgtacttggattgcttttttgctttgtcccggctatgtctgcttgctttttgggcgtgtgtattcttcttggcttctgtgtttcttttggttacacatggtgctctgttgttcttctgtgatgctctttgtttgtccctatttgttagttgtgtgttttcggctgcttgctcttgtctatggtcttgctctttgtttgctcggttggcgatggtccccttgttggatcgctggctgttgtgtgcttgtctttttgtgcccttggttccattggaggtgtgggtgctgtggtacttgagattttgtcgcacgttgggttgttttgcgagtggttccatcggggttgtttcgtctaccgctagtatgtgttgggcgggcgcgttctacgcgtgtttatatcgctcgttcctctgtattcccctttgtggtccccttattcgtgcccctttccgcgtcctccatgtcggcatatgttgtttttatcccctatgtatccccgtttggtccgcgctgtctccaaggggttcctctcgtggtgtatctggtctgcttccttgttcccattgatgcttattgttgtaccggcattttgctattggttctcggcgtcggtctaaagagtcacgatgctgtgttccgtgttgatgggtgttcctttcgcgtgttgatgtcttactgtttaacatgaacatcatgttggtgcccaataagttaaccttacctgtcggtttgcgttaggtttctagtcatcaggactatctcactcctctccagctcactgttttgtaaaactcagaattctgttcctaagagcccttcagagcaaagcgtgccgaaggttagttgtcttctgatgtgctggtcctttcttatgtcctcataataagctcagatgatggtatctgtgagtatgtatttgcaaattcaaaatatagttcggtaagtttcttttttcacagttgattctttaaaatagaactgctgtacagagcttgtattacgtccatggttatacgat

SEQ ID NO: 695820 - DNA, 553 bp, Homo sapiens
tcaagggtgtggtcatgtagccatcataacatagggatttggaagattgaggtatgcggaagggccagttccaggaatagagctcatgcttggtccaaggactagggcagggccttcaggagctcgtggctttgaggagggataaaggagaaggattggtagcaaatggcccagagattcttacaaatccaccttcatccataaggaggttggagggtgtatgatgatcctctcttctaaaaggctccctttcaaattacagaaccattgggtaattcttctattacccagggaatcagtgccagctccccaggcactgagtcccaggaggaagacagctcatcttcattcgtgggaacctgtcctatatgtgattgtgcccttgggtaaagtggactttacaagttcgttattgctgttgtttgagcagaggtcatgttttttgtgttactgttgttttttttttttttttttcaaattataaacctcatatatatgttaaagcttaaattcaatctgatgtagagatttaactgtggaagtgaaacctctc

SEQ ID NO: 695821 - DNA, 1175 bp, Homo sapiens
  misc_feature (173)..(173): n is a, c, g, or t
  misc_feature (176)..(176): n is a, c, g, or t
  misc_feature (181)..(181): n is a, c, g, or t
  misc_feature (187)..(188): n is a, c, g, or t
  misc_feature (198)..(198): n is a, c, g, or t
  misc_feature (206)..(206): n is a, c, g, or t
  misc_feature (226)..(226): n is a, c, g, or t
  misc_feature (241)..(241): n is a, c, g, or t
  misc_feature (251)..(251): n is a, c, g, or t
  misc_feature (255)..(255): n is a, c, g, or t
  misc_feature (262)..(262): n is a, c, g, or t
  misc_feature (283)..(283): n is a, c, g, or t
  misc_feature (287)..(287): n is a, c, g, or t
  misc_feature (295)..(297): n is a, c, g, or t
  misc_feature (317)..(317): n is a, c, g, or t
  misc_feature (332)..(332): n is a, c, g, or t
  misc_feature (341)..(341): n is a, c, g, or t
  misc_feature (344)..(344): n is a, c, g, or t
  misc_feature (347)..(347): n is a, c, g, or t
  misc_feature (362)..(362): n is a, c, g, or t
  misc_feature (391)..(391): n is a, c, g, or t
tctctctctctcctctgtagcgctgagcgcgctgatgactatatgaggatgagggagtggttggacaagatgctggatcagagcacggactgttgaagagcggaagctcatccgggtctgcactgtcgtgagctccgacaaaggaagagagaccagcgggacaaggagcgggnacngcggntgcagnnggcacggggncggccagnggaggggcgcggaacacagngactgagaccaccangaggcacagncagngggcagntgatggctctgctgtcagcantgtnaccaagannngagcggctcgtccactccantgatggcacacgganggcccgcancancanagtggagtcgagttncgtgaggcgctcggagaatggcagtggcngcaccatgatgcaaaccaagaccttctcctcttcctcctcatccaagaagatgggcagcatcttcgagcgcgaggaccaggccagcccaggggccggcagtctggcggcgctcgagaaacggcaggccgagaagaagagcagagctgatgagggcgcagagtgtgcccaagatctcagtctcacaggcgcgcaaggccatgactagagaacgctggagaacggagggcgcgggcgagagccctggcggaccccgcgcagccgtgcagagatacaacagatttcggggtccccaacgccaacagtatcaagcagatgctggctggactggtggtcgagccaagactcgcgggtaacgagcacgttgacactccagaaattctactacagactggagtggatgggatgggcatgtgtgccctggtgcacaaattacttcacaggacgcttagactatgggccagttaaggccctaaagaaccgacggcagacacatagagggtggccatactaatcggagggagaacccaatgcggactgggccggacgaccgagaaacaacaagacacatggtgcaggttacaacgaacgtactgagaagagtggttaaacggtaccatgagaagaataaccgcaggacgcacacagagcggggggtaacaacagagttacaaccggtgtggggccaaccattatgatggagcaccacagcgtggcagtagcaatagtgacacaacccacacagtacattagtataagcaaccagcacagaagcgtaggatgaca

SEQ ID NO: 695822 - DNA, 199 bp, Homo sapiens
acgttgcccgctgagatcagatgggtcaccagcagctgtactggacgccacccgcgaaacatcggccaggtttctcgctcttgtcgtgtctgatcacaccggcacggtctgctccggcaatctggcctcaatctgtgccgccagtgtttccgtcagtacgcgaaggatatcggtttcattaagttggtctccctgaact

SEQ ID NO: 695823 - DNA, 283 bp, Homo sapiens
ttagcaatttctccaacttggaatggctgtactttacccaattgtatctaggaagtaactaactcgctatcgattttacaggctcataggcagaagggacttgccttgtctcagatgagacttaggactgtggacttttgagttaatgttgaaatgagttaagactttgggggactgtgggaaggcatgatttttttgaaagtgtgaggacatgagatttgggaggggccaggggctggaatgatctggattggctgtgtccccacacaaattctaccgtggg

SEQ ID NO: 695824 - DNA, 217 bp, Homo sapiens
atgatacgaatcgagccggtacccctcaatttcaggccttttatggtctattcagagatcaacttcttccgggtttagtctggggagggtgtatgtgtcgaggaatttatccatttctttgagattttcttctagggtttttatggttttaggtctaacattaagtctttaatcaatcttgaattaattttggtataaagtctggttagggatgtgt

SEQ ID NO: 695825 - DNA, 246 bp, Homo sapiens
gctagagtctctagcctagggtgttcatgaagtcagactgtcacaccaactgtcgaggaacttctgagtataaagactggcgagaactttatagaactacaatgggatgttgcccaggagggtggattgctattagagaagcaacccacagataccagactgtacttctggtgccattttccccttcttagtccacttgataacttaaccaatcctctgcctttgtaccacttggcccttatcgag

SEQ ID NO: 695826 - DNA, 145 bp, Homo sapiens
cccgtcacgacagatcctgagttagatttattcttagatactttatacattctcaacacagcagcacaatcttgcaacagtggccaacacacacaacatggcaaaccccagttccaggcagtccccctccaactccaggatgctt

SEQ ID NO: 695827 - DNA, 487 bp, Homo sapiens
  misc_feature (14)..(14): n is a, c, g, or t
  misc_feature (129)..(129): n is a, c, g, or t
  misc_feature (174)..(174): n is a, c, g, or t
  misc_feature (237)..(237): n is a, c, g, or t
  misc_feature (263)..(263): n is a, c, g, or t
  misc_feature (290)..(290): n is a, c, g, or t
  misc_feature (314)..(314): n is a, c, g, or t
  misc_feature (340)..(340): n is a, c, g, or t
  misc_feature (353)..(353): n is a, c, g, or t
  misc_feature (369)..(369): n is a, c, g, or t
  misc_feature (401)..(401): n is a, c, g, or t
  misc_feature (403)..(403): n is a, c, g, or t
  misc_feature (408)..(408): n is a, c, g, or t
  misc_feature (462)..(462): n is a, c, g, or t
ccttatccttaccnttaaccggggatgtctgttagaacaaaactgtataccttggtctaacttcagcgctttttttaaaaaagcaacaacactctagaacactttttcttttgctttgagatatttganatttacacatttgttcaagtacacagattctggattcaataggcnggatctacaggatcttggttatctcttaatatcttgagctaggcatggtacttctggagcgcnaggtactatctgggcattctaaaacngcctggattcttgtaaataaaattgtncttcagttgtggtgtggtttttgnataacttgggcggggcggtgccaagntgccccccctggnccccctcccccagggnacaaaggaggctcttcttaaaaggtatggggncncgggnctatctttctactctaggggccatttcctactagcatttcgggtagggccatgngggctccgggatagtcttcaatata

SEQ ID NO: 695828 - DNA, 571 bp, Homo sapiens
  misc_feature (45)..(45): n is a, c, g, or t
  misc_feature (138)..(138): n is a, c, g, or t
  misc_feature (201)..(201): n is a, c, g, or t
  misc_feature (222)..(222): n is a, c, g, or t
  misc_feature (225)..(225): n is a, c, g, or t
  misc_feature (305)..(306): n is a, c, g, or t
  misc_feature (316)..(316): n is a, c, g, or t
  misc_feature (324)..(324): n is a, c, g, or t
  misc_feature (340)..(340): n is a, c, g, or t
  misc_feature (346)..(346): n is a, c, g, or t
  misc_feature (363)..(363): n is a, c, g, or t
  misc_feature (376)..(376): n is a, c, g, or t
  misc_feature (404)..(405): n is a, c, g, or t
  misc_feature (423)..(424): n is a, c, g, or t
  misc_feature (429)..(429): n is a, c, g, or t
  misc_feature (465)..(465): n is a, c, g, or t
  misc_feature (560)..(560): n is a, c, g, or t
gcctggggtcatcctggacaaccgtgctctgggcaaagctaaggnaggcggcacagaagttcatgcacacagagggattccagccgtcacggtcattcctgacatattcaaacatcttcatggtagggaaggtcttgngggaagagacaaaaccgtctgggttacgggagccagccacaacattcggggcccctggggggnatgactgagcccaccatttcnggngcttgtgtctgtagaaactcctccattggccagggctgtgcatctccttgggggtcttgggctccacatagcaggtcggnngctgtgtggntggggctngggggtctgtgcagtntaactnccctgagaagagacganggtggcttcccangcggctgcgtagacagagcagagggggnngttggtgttaactccccnnagggntctggggaacttccaggtttgtctgcacacatgtantgctcaaatttgtatcccatgtacataagctcccggaggagcggtggccgagcaagcctctgggcccgagcgttcggtgtctccacttcactcangtatagtgttc

SEQ ID NO: 695829 - DNA, 776 bp, Homo sapiens
agttataaaacaccaagcagatgtaactcaaagaagactacctcaaggcatttaataatcacagtcccaaagatcaaggataaaaaaaggatcttaaaagcagcaagagaaaagaaaccaataatatacgatggcgctacaatatatctggcagcagactctttagtagaaacgtttcaggccaggagagagtggcatgacatattgaaagtgctgaaggaaaaaaacatttaccctagaacagtgtatccagtgaaagtatccttcaaagtgaaggggaaataaagacttttccacacaaaagctgagggattttgtcaacaccagacctgtcctagaagaaatgctaaagggagtatttcaatcagaaagataaggacattaatgagcaataagtaacaacctgaaggtataaaactcactggtaatagtaggtatacagaaaaatgcagaatgtcataacactgtaactatgatgtataaactactcttactctaagtagagagactaaactatgagccaatcaaaaatattaactacaacttttcaagacatagatggtataataagatataaatagaaataacaaaaagttacaaaatagggagactaagttgtagagttttattagtgttctttttacttgtttatgaaaacttattataagattacaatactggattataagatagtatttacaagcctcatggtaacctcaaaacaaaaatataacatggataccgaaaataaaaaacagaaactaaatcatatcacc

SEQ ID NO: 695830 - DNA, 253 bp, Homo sapiens
caaaaaaatttttttgtttccccgggggtggggaaaatttgggggggaccacccggggggtttccccccggggggccccccccccttttccccgggggggggtttcttcccccccccggggggggccccccctttttggggttttttccccggggggtttttccccccccccgggggggggggggggcccctttttttcccttttggccccggggggggtttttttttttttttcccccccccggtcctttta

SEQ ID NO: 695831 - DNA, 109 bp, Homo sapiens
gaacgggtatgcggttgcaggatgcggttggaagtgctggagcaggaagaagctgaggcgcgtgagaaggtaacccatacgcataaggtggtgcgtgcagccaggagcc

SEQ ID NO: 695832 - DNA, 118 bp, Homo sapiens
tccccttccccacagtgagaggggagggctctgggccagagaagttccttagttttctttggaatgaaatccctccttccccccatctctgagtggaggtaagcccaccaatctgccc

SEQ ID NO: 695833 - DNA, 165 bp, Homo sapiens
acgatgtcacgtagaggatcccgcacgagcatcatacatgtctctgcctaatctgcccttaggagtcaggctgcacccgtggagatcccaaacctagccccctagtgagacaaggacctgaccctcctgcccgcatacacaacccacaagccacggtcaacccac

SEQ ID NO: 695834 - DNA, 297 bp, Homo sapiens
  misc_feature (209)..(209): n is a, c, g, or t
gcaacacagggtgaccccatctcttaaaaaaaaaattagctgggtgaagtggcacacacctgtggtcccagctactcaggaggctgaggcaggaggattgcttgagcctggggaggtcgaggctacaatagccatgattgtgccactgcacttacagcctggggtgacagaacaagaccctgtttttaaataaataaactaaatcaatncaatccatcaatcagtcgacctatgttaacttaactttacttgtagggtaatttatccgatagccagctattaattagggacttcttg

SEQ ID NO: 695835 - DNA, 383 bp, Homo sapiens
gtcgaccggctgagcagtcacgccaaccacccttcccgctgggctggtccttgggatttctgtccctctttctttgcatcctgcctcttccttccttatagttaatcgtcgctttccttttcttccttttatgaaccttccgctcaatggtttgttccttcctaaggatgtccccaagtcaaaataagccaggggaccaagaaggttttccttgtgtagaagcccccaggtccctgcatgtgggggcttatggagagacttcctacactgagatcttgcccggtgtgaaaatctgactgctggtgtgcggtgtagacagcacttggctattaggagacgctctcgcacgatgcatgtctgccagctgctgcctggcgtcgacg

SEQ ID NO: 695836 - DNA, 244 bp, Homo sapiens
  misc_feature (8)..(8): n is a, c, g, or t
gacccaantggtctttatgatgcaacaccccacttaaccatatgagagccattcagtgctgctcgcagtgccttctgattacagacacactcatgcttcacgtctgatcaggaccttccccatggagcccatgtggcccctcacttggttggggtccacttatgagtacaaaggggcatcactaaaatctcagctggctggtgggaaagtacttgtctgtctgtccaactacgtgctagtgcta

SEQ ID NO: 695837 - DNA, 558 bp, Homo sapiens
tggttttggaaggggtatgtggatcttcatctttaataaatattaccaacttgtgaaaagcccgacaatgtcaaggactggcaagagtgccccatgtgatggggttgggaatgggcagctcactggtagcaggtgctgggggactcagtgggggtctgggagaagcacttatgtttatagcaaagaatggtctcataaatgggtatctggatagagacaagatgtagtgggggaataaaaactagttggcttagaaataattatagactctaaagctcaacaaaaacacctttctctagtgtgtaaaaattacatacttttttctcagaggggagggggcaacacctttaaacttagaaaacacctttcatatttaactcagttcttcctcatattactctcaaatttgtgtcacttaagtggcctttcctccctcgcgtggacattcgagagagaaaccaccgtgggttatttcggtggcagaaagttttaatattttcctcacaaattcaatttctcgtggggaaaaaagcggtgttacacttttcaagagctctg

SEQ ID NO: 695838 - DNA, 117 bp, Homo sapiens
  misc_feature (9)..(9): n is a, c, g, or t
tcgttagtnagtagtaagaagtagtatctatctttaagattcctgcatcataatgggattcctgtgataaataatgtgcaggaaacaggatgcagagaagtccaagtggaagaaggt

SEQ ID NO: 695839 - DNA, 118 bp, Homo sapiens
cgtcctccaagtccgcggttcctttggctcgcgccggttgctttgcacgaggccgcatatcctgtgcatattgggccagaccttacgctaatggatgaagaggccggcaatgtcaata

SEQ ID NO: 695840 - DNA, 318 bp, Homo sapiens
gagattgacaatatcaagaaccacgcgtgcaagttggaggccgccattgccgaggcttgaggagcgtgtggagctggcggctcaaggatgcgcgtgccaagcaggaggagctggaaaccgccctgcagcggggcatgcaggatattgcacggtcacctgcgtgagtaccaggaaatcatgatcgtgatgctgaccctttacctcgagatcgccacctaacgcaagctgctggagggcgaggagagccggttggctggagatggagtgggagccgtgaatatctctgtgatgaattccactggtgggtcagaacataag

SEQ ID NO: 695841 - DNA, 295 bp, Homo sapiens
  misc_feature (90)..(90): n is a, c, g, or t
tgcggacccttagacagcggacccccccaatagtgccttcatctgacagatacttccactcagccagtgcacagcaatatccagcaggtnacagggcttattctctggcagataaagaagctccaatgctcgccagccatcctggtctggatatcaatcatccgtgagttgcgaacgtatttccgggcttctgtctcgtcataaaacagctctgggggtccgccatgctccggacgccggccggcggacgccatttctcacgcctcagaagcacacctgccctgggtggtatcag

SEQ ID NO: 695842 - DNA, 316 bp, Homo sapiens
gggtagaacaactagggtcagttttgcaggtggtaagccatttaccaagatagttgtaggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaactgttcatacaataattgttcattattgttctcaacttggggctctccccaacctggggacccttcctta

SEQ ID NO: 695843 - DNA, 372 bp, Homo sapiens
aggattcggcacaaggggcttcccaagttccagccgcaagtccaacttaaccaactttccttcaaagtcaggaaccgccaattttcggaaaaaagcatgttccaaaaacaaaggctcttttcccccgggaggaaaaaaaccagccaagaaaggcagcacccttcccaaggaggtagaaaattctgcgaaagcccagaaaaatccggcccgcttttttccaggcatcgggggcaaaaaaaactgattttctaaaattattggatttggaattgggaaaaaagggggaaaatgtgaatggggccggatctttcacctgggattctaaaaaaagctttgtcttcagaaaaactaaaaataaaaggcccgccccta

SEQ ID NO: 695844 - DNA, 122 bp, Homo sapiens
gctaagatggacagcgggactggagctaggaactaggcgagggaagacaaagaaaagccagccattgccattcactgagaatcactgtcgctttctaaagtgacccacgttgatgctggcag

SEQ ID NO: 695845 - DNA, 742 bp, Homo sapiens
cggacgcgtgggtcgcccagcagtcggtggtgaaccttgcccttgagtacagttcaagtgaatctggataatagttcatcttgctttagcttagataccagtgtatgtggtctgtggctacaggacagctggttctagtctgcttccacagtctgcttaaaaaactgtctgacttcgtgaatatatagaccatgtttaccgattctgatgaagagaccaattaagattcattcctcattctgttgctttccagtgggaggaagagtccccatgaaataagatgaaactgattccatgcactagtacatgtaggcttctcccttgtgcaaagcttagcaattgtacggaaactttgatcttttgtccaagaaaaggaatgtctgacaggcttaagctttcggtccccttgcacttagactcgaagttagtaagagtccttaaaggccttgttaagtagcagacttccaaagagattgccatttaaggatttcgtagcatgcttaaaagtctccagattttcatgctgacattagactatagtatacagtgaggttaagaatcatgtctatgactttcactctaagactggcaaaaggacaggagtctgctatgtatagtcaagcattcattccagtagaagcataatctcatctacattcctgagaccagcaataagccttccaggtaaacctccaaataatcattgatgggtaatacggacaatctagcccctaggtgaagg

SEQ ID NO: 695846 - DNA, 133 bp, Homo sapiens
ggtacccattgaatcgactcgggtactggaggatctctaacagaccaggctccagcttaacgatatttggaggtcagcacgtgctgctcacgtgtctgacgtgaacttgtacaggtaggcatgcaccgcagat

SEQ ID NO: 695847 - DNA, 254 bp, Homo sapiens
taaccgggatcgacagtgccgccggggaactcccacagtcccgccatcgacatgccggcgggccgttgggcgatcagcacgcgaccgtcgacgtcgaccagggccaccgcggcgaccaggaccagcggccggtcgccgagcggcggcgggccgcccgggcactcctcgtcgaatgatgaactcaagaacgatagctgccgttgatgtcgatgtagccgtgcgtcagatcgcaggtccagaccgtggcgcggccg

SEQ ID NO: 695848 - DNA, 367 bp, Homo sapiens
ccaccgcacctggcaaaatgctgtctttaagtcagcgaactgaaaaagtaaaagactgctggttgtggtggctcacacctgtgatcccaacactttgagaggctgagggggaaggatcacccgaggtcaggagtttgagaccagcctggtcggcatgcgaagccctgtctctactaaaaatacaataattagctgggcgtggtggtgggcgcctgtggtctcagctgcttgggaggctgaggcaggagaatcacttgtacgcaggaggcggaggttgcagtgagccgagatcacaccactgcactccagcctgggcaacagagcgagactccatctcaataaataaataaataaataaatatttttt

SEQ ID NO: 695849 - DNA, 330 bp, Homo sapiens
  misc_feature (181)..(181): n is a, c, g, or t
ttgtccacagataatgttgggtgtaggtatgtatagtaaacttcatcattcacgtgcagttctcgttgagcgaagggtcacttcacggcattcagtatctgattgagcagtgcttctcatcagaatctgtttccatggatacaaacccctcttcggacagaagcttctgcatccctgcaanagcatgttgtgccagcttcacattcttggattccaaagccaactggagaggcagcaggcatttctccctcagtacatgtggagggatcttggcaatggtatccagaccacctagagtttccagggcccaggtgcagctctctcttgttg

SEQ ID NO: 695850 - DNA, 235 bp, Homo sapiens
tgctccactggttgccaggctagagtgactggtgtgatcccggctcacacaaactttcaagccatttcccaggttcaagccattctcccgccccagcctcatgagcaggtgggactacaggcatgcaccacaatacctgatttttctttttcttttttttttctgtagtagagatggggtttcaccagtgtgggctaggctggtctcgaactccggacctcaagtgatctgcctg

SEQ ID NO: 695851 - DNA, 81 bp, Homo sapiens
  misc_feature (44)..(44): n is a, c, g, or t
gagcaaggggcttacgcagaaggacctggccacgaaaatcaatnagaagccacaggtgatcggcggactatgagagcggat

SEQ ID NO: 695852 - DNA, 223 bp, Homo sapiens
  misc_feature (65)..(65): n is a, c, g, or t
ccgatcgctttggcttctggagccagagcctttgccgttgtgggggacagggagctgcacccaantgtcatgaaatgcagggacatggccatgcccatcctctggagccagcacagccgggcggttgatcccagaacttgtttctcctgtccacactttgtttgagcacaatggagcacgcgtagaaacggaatgaggcatggcaaatgactggccagtgccc

SEQ ID NO: 695853 - DNA, 317 bp, Homo sapiens
cgggcgcccagactctgagagagagcgacggccatcatagaacagcgaaggcagtcgatcggcctgcggtccgcttcggcattcgcaggccgcaggcgggaggctagagcccccaggcgcacctcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggaagcggccg

SEQ ID NO: 695854 - DNA, 329 bp, Homo sapiens
gctcgacagagattagaacataagaacaattagggtgggcaggtaggtggctcatgcctgtaatcccagcacgttgggaggccgaggcaggcggattacttgaggtcaagagttcagagccagcatggcaacatggtgagaccccatctctactaaaaatacaaaaaatgggccaggcatggtggcatacacctgtaatcccagctactcaggaggctgaggcaggagaatcggttgagcttgggaggtagaggttgcagtgagccaagattgcaccactgtactctagcctgggtgacagagtgagactctgtctctgtctctctctc

SEQ ID NO: 695855 - DNA, 193 bp, Homo sapiens
aggagcatcagcgggggtaatggagacatgccaaagttatattctgtaagttttcgtggggtgaggggagcattacatcattatataatgggtacttcctcaagtcgcgggtcatcagtgtctggtgtcagttgctgcacaaatatctaaaggatatggattgctgtctccacgcgagctggaggccagtcaa

SEQ ID NO: 695856 - DNA, 962 bp, Homo sapiens
  misc_feature (206)..(206): n is a, c, g, or t
aattaagagatccaggaccatatttgataagagttcctaaaaataatgtaattattaatgctaaagactgctcatgtatcttgatctaattactaaataattacatatttatttacctgataaatatgtatctagttctacaaggtcacatttatgtggaagtccaaagtcaagtccttaggggataattttgttttggctcagtnggttccctggcttcccttttttttttttttttttggaaaagtggagtctcgctcgtgtgtgcccaggcgtggaggtgcagggggtgcgactcctcagacctcacgttgctcttcctcgggccctcccgggtttcaagcaatttcttcgtgcctcagccctcccaagtagtgtgggattacaggcaccgtgccaccattgccgtggctaatttttggtattttatagtagagacgggggttccactatgtgggctaggcgggtctgtgaactccttgacctcgtgatccacccgcctgggcctcccaaagtgcggggcattaacgggcttgagccaccgcaccgggcctctccctcgttcctctctagaatccaattagggatgttgggtactactcatatggttaaacccgttcaccaacacttttttcttttcacaaggtgagatcagcgaaactctggtttaaagataatctgaacaggccctgggaggtaatcacattgcgccctttcgtggaaaggccattcgtggttagaaatcaccttatctcaaatttgactcgggggactactatataaagtagcgtgaacatccccatctgctggttccctagggatgcccaaatttgcttatgtttttacggcttaaaccgggaacctgtactattggagcggacctcgcatcaaaaattttgaaaaacaaaaacaaaacaaaggggggttactcgcggacagacctttatgaaaagaaaagggca

SEQ ID NO: 695857 - DNA, 212 bp, Homo sapiens
tcatcgagctcggtaccgctcaccgacgggtggggttgttgctttgagaggaagtacgcttatttttttttttggtctttggtttttttttttccctttttcctgggaaaaggggttctcgcttattttggcccaggcggttctcgaaactctggggctcaagctatcctcccgctttttagcctccctaaaagcgggatttacaggcttga

SEQ ID NO: 695858 - DNA, 220 bp, Homo sapiens
  misc_feature (71)..(71): n is a, c, g, or t
ttttgatgaagtccaatttattttttctttttgtagtttatgcttttggtgtcatcaaagaaatcattgcncaatccaagatcataaagatttacatctgtattttcttataagaattttatagttttagtttttatttaagtctttatccattttgagttaatttttgcaattaactcaataattgcatccattctttcccacttcaattaatttttca

SEQ ID NO: 695859 - DNA, 247 bp, Homo sapiens
aagagtccatctcactagaataggatattatgcatagtgagctgggccagaagagtatggaacaaattagactcagcctttctaatcaacttgaatactaatcttagttgagaactctttaagtccttttaaaaactatgtttctgatggttcaagattaagaagcatactgacagcaaaaaacgcagccagattttatgaataagtgttgtatactcttaaaacaataatttgttatgttcgtgta

SEQ ID NO: 695860 - DNA, 517 bp, Homo sapiens
  misc_feature (27)..(27): n is a, c, g, or t
catttagggaaagctgagataaagcanctagaatctcaaaaggatcgagccaactcggtgaataagtataaagcataactatcacatatgtaaacgcgagtaaccctctccaatataggggaggcatataggaaacaggggaaagtagcagtatgaacaagagtaaaccgggtagtagaaaacaacagcatagggatgaaaacctggcaaacaaagaattactattttaaggggtacaattttggcaaggggaagataactcaattcctacatttccggctcttggtatgaaacatttttccttcggtaactagatatgggttttcctcctccatagtaggatcaccggatattggataattaatggcttaataactactggtttaatgataccaccatttatgtccacattcctcaagggcttaatttccaagaaaaaataaggtcgtagtagcacagggtgataagctccatcttccaaccaattttaaatggtctcatgggtatgtatatcagg

SEQ ID NO: 695861 - DNA, 116 bp, Homo sapiens
gggttgtgtataccgaaggaggtgccagcagtgtgggctcccatctgtcctcccacccccatccagcccacattggatttctcagctgagcagcaaggcttagaatgaatagccct

SEQ ID NO: 695862 - DNA, 1355 bp, Homo sapiens
gcgctctcggcttctgctccggggcttcttccctgcccgacccggtggccctgaccgtggcattcttcccctggacctgatctgcgcagccctggctggtgctgcccagaaggagcaggcaggcgcggtggtgcgcgctgtgtgcgtggggaggccgtggccaggagctgcggctggcaagctgggctgggactgctcggccgcctcctgcccggcgagcagctcagaccatgctcgcctgaagaactggacgtatctagtggctatcttcttatctccatccccatcggcctcctctcttcagaacagcccggcccctgggctcgcaagcagatcggcggcagccacgccagctcgcaggcgccctcgcgggctccatccctcctcccacgctagctgcgccccccaccaccctcccgcatccctcctgcgtccacccaccactccgcggcacctgcggcccctccactcccacggccccacgccctgcctccctgcccaccgccccctgcgcctcctggcccctgccacctctcctcactccactcctccctgctcccaacccgcagcccctccagccctcccccgcggctctgccccaccacccccctgccccacccacaccaacgccccgctcccaccacagcctggctgccaccctcgccacacgccgcgctgcccccctgcgcccagccggcccgctcccacggccaccctccccctcctgcccccccccacgccacgcaaacccgcgggcccaccacggcccaaccgagccccacggcggcccacacaccctgggcgagctacgctcggccacgccacgtccgacatgccacccagcacacggcaccaccacccaaccccaccagcaccacacgcaacaccctcgcaccccatacctacccacaaggccccggcaaacccacacgaccaccgacaaacacgcggcgaccagcaccaacgacgccacgactaaccacaggagagcaaggcgccacgaccaaccgccggacccactggccccgccccccgaccctcggccggccccgcgcaacgacggccagcgaacgacgagcaagaacacagtcactaccgccgctaccccagatgggcgcgccgcgacacaacaagccgaaccaacccaagcccacacgcgctccaaccccagcgcacgactgcgagagacccgagccacgcactaccaccgcgccaacacacggacagcagcaccaacccccaccgctacacccacacccgaagtagcgcctccacctggcacacatacggcatcggatccgcacagacagcaacgcgagaaccgctcgaagcctgacaacagctcacgctgcgag

SEQ ID NO: 695863 - DNA, 220 bp, Homo sapiens
  misc_feature (8)..(8): n is a, c, g, or t
  misc_feature (50)..(50): n is a, c, g, or t
  misc_feature (63)..(63): n is a, c, g, or t
  misc_feature (136)..(136): n is a, c, g, or t
  misc_feature (187)..(188): n is a, c, g, or t
ggaagatntgcaaaggttatatgcaaatactgtaatattttatataaatnacttgagcacctncagattttggtatccctgagagttcctggaaccaatccccttcagataccaaggaatgactgtacatgtttgngtagaaaactagttgtctctacctagtctccattctggtcacttctttagnntcctaatttcagagtaaggccagtctccttct

SEQ ID NO: 695864 - DNA, 1173 bp, Homo sapiens
  misc_feature (937)..(937): n is a, c, g, or t
cggcggtgtgccctcgataggtatgtctcctggtacaatgggtggttgactgattcaattcctctcctataattccttctaccgcgttgggtgcgcttcaccatgtgcctttttccggccgcagtagaggtttgtcctctgtgccggaggtcaaaaaatttgagagtacaccctcacactccataattcccttgaaggcctatcggttcaaaacaggcggttataagtgtttcttctccttaggttgaggtggcgcccttgtacattgtacctttagcgctaccgggtactaataatcgtgttcccgctttgtggagaaacaacaattgttgtgtgacttgtttattgggggcgtttgccaaaaaattttgggtagggtgtagacacctcattgggcgaacttgagcattaaatttaaaattattgtatgtggtaagatttcatcccaacggcataatcggtggtcacccccgtttggcttcccttaatttgtccctcgggggacgcccatcttcaaaaaggtaaccccatggtccctctgttgttgccccatctaacgccactggttaccctacgttatatatgacggtttcgtagacaaaatgtggacatacaatgacccattgtgattgtcgcatacccttcgaggcccttgagagtttaagtctcacaacagagttactggtccacttgcctcggcggcttgaaggctttcgatgctttcgggcattaaggacaattgggtctacaagacttttagagccctacaaggcatcgtgcctctttccctcttcctgtccttgcacatctacacacgtttcatccccttctgcatagccaagcaaatgagttttcatctgatatcgtgtccagactagctctacgatttgtcatgaactagattacgccatctgtccgcacgctaccatagccaaangactaagcttccatggcacatccatttggcacctatgaggcaacggtctagctataaccgttctggctttgcacaatatgtacccaggtcaaaaggggactttgtgtttttcttagcaatgatatcactgtctgggtcactttcttaagcttgtaaccgcccccccagacttataatcttaaatggtattttcctttgtttaagctgctgttactccgttggattggattgtgcca

SEQ ID NO: 695865 - DNA, 233 bp, Homo sapiens
gttgatggaggtctgagtctagcagcctccccgattgactgcgcctgccggccgtaggggttacggcacacgctgagtccagttctggtgtatccgcgcgtggcggccgcgggcccggcattgacagattgattgctctttctcgatcccgtgggtggtggtgcctggccgtgcttatttcgtgaagcgatttgtctggttaattcggtaccgagcgtcgaatttctgtaatc

SEQ ID NO: 695866 - DNA, 791 bp, Homo sapiens
  misc_feature (1)..(1): n is a, c, g, or t
nagtatatgcaccaccgggtacgcgtggttaccacactctagacgggggtaagattaatatgtgtccccgtttatagaggggggcacaatagtttcggtgggacacgggggcccgcgggttttttgtgtagtcccccatgtttgtggcgccgccacatgttggcctggaatataatgtgttcttcgagcgcgttccccaaaagggtcttatctgggataattgttgaagagaaaaagagatggtcttagctcccccggagttgtttataggcaaactgttggtgtacccaataaatgactcggtattgttccccccccgcgatgtgtgttacgctcgtatgttgtcggccatagagccccttctgatagataatatgtgggggggagacctacaatcgccatgcaaagattgggccagtgttgtctgggagcacccgatgtgggctcccacgtgcgattcttctgttagtgagcctgcacggagattttctcaaaggagtataaacttttagcagatctaaccagatttcacgccggggaccctgtggccccagagagatgctgagcaagcagggcgagcttttacccccaagctccgcatggagtggtcgaagactaataatgctttctcgcgaagctatctgtttctggaagcttctcacgccaacatgttcggcgggagatgctgcgcaatcgcattgaatagcgccccgggcgtcaagggcacctctcattattcttgtgttgccgccacgccgccccccagaaaaaaactggcggcccacaaaaca

SEQ ID NO: 695867 - DNA, 263 bp, Homo sapiens
caggttgtgggtagggtaatttttatgaggtttacttagatggctgtcggtgtgccagacctcctgacactccaagtcacacaccctgtgaagtcccgcacaggacccacacctcattgtaccagtgggttaggctcgtggaacaagcagagacatgagaggagagtgttggctatgtcacgtcccaaggattggattatacggagccgattgcaacgttcgtatattgagttcgtaaaagagaggcccacatgtgtgttgcg

SEQ ID NO: 695868 - DNA, 868 bp, Homo sapiens
aactgctcctgttgcaggattgcgtcccccacccccctggtggcgcgtttctccacgccgcccccttgtcttgtggccccacccttggctcctcctgggagttcacccacccccccgaggtattccccgcgcgcgtatttcatgtatgtacaccaaggggaggcggctgtcacccacacagggggtttaagtggcgaccaacccggtgcgcacgaagtccctctatttctggcgtccacacatatcattattagctccccctctccgccccgcatttgtccctccaccgatattctctcctttatatggatcaggtgggggatcctattctgattcctgcccctcaacatggtgttccctccggggggtgtttcttaggtccttcttttaatttcccctctgtcaccgcctcgtcgcccggggtttctgttcttcactcggggatataattcagacctcagtttcttcttttgtctggggtacctcaccgccgccgccctggtcatttgtcggggagtagcttccgcacgaacgccccacgcacgaataatgctgcgtggtgaagtgtggtggcgctcgcagttgggactcacatacagatcaccgttgcccgcactattgactcctgcccacgctcccctaaccagacaattaggagagctctccgttgtcctcttcgtattctcccaggcgtaatcacctggttggatgtacccaccgacccttttgccccccccacacccaggggccccatcggggtccctgcgtcttttctgtccacccggatactcgccatatcatgaggacccccaagataggagggcatgacaaaaaatggtatgctccaaaatacaaaataaacgcagaa

SEQ ID NO: 695869 - DNA, 273 bp, Homo sapiens
gtgcatggtcctcgctgttggtgtaagaacgatggccaagttgcatgctccttgctgttcgtgcacaaggagtggccagtgcatcgagccttggtgttcgagtcaaaggaaggagtatgtgcatgtcccccatcatactttgagactactgactggtgggtagactatagtattgcagcaaatcctgtatgagagagagatgttggcttcctttttgagtcttgtgtcaggtgctgagaccttttacatgggctaatacagggagagagtctt

SEQ ID NO: 695870 - DNA, 993 bp, Homo sapiens
  misc_feature (178)..(178): n is a, c, g, or t
  misc_feature (189)..(189): n is a, c, g, or t
  misc_feature (191)..(191): n is a, c, g, or t
  misc_feature (357)..(357): n is a, c, g, or t
  misc_feature (361)..(361): n is a, c, g, or t
  misc_feature (652)..(652): n is a, c, g, or t
tggtggtgcgtctgggggggcttcctccccccccgcgcgcacccccctctcttatgaggggaggagagaccgcggggggccgtcttaatatcctctctcatcccccctctccgcctgctcttgagtagaagagagtagagagccctccttctcggggggagagccgcgcccacagcgncgagtatttgngncgcagagctctgctcttcttctctctccgcgacgaggagaggagttgacgtaccacttctcgtagcactcctcctccatcatctgcgaatgagtattgcgtgaggagagctcttctgactgatagagatctcctcatagggggaggaaaaagagatggagaggatntagnttgagagagagacggcacacaacacaacacagcagaggggcgtgttttcacagcagacccacatctagtgctgttttctgtttgtctactcgcgtgaagagaccaacacatcgggaaagatttgtatttcgcacgccacgctcgtatagagcggacgtcacatctgtctgttctatcgacacacctctcacgcagggaggactctctcatcacccacgctgcgtgcgctcttcttagtacacccaccagcagaagtgatgtgatcactatcgagtgtcggtgctatatgtntgtgagacaccacctcgcgccaccacggtcggacatcttttgctcattctctctctacgagagcaccacatctgtggaagattctttatatgagagtatgtttgtaagcgccgcgcggagaattgagagtctgtagttcttgtcaccacaaaaaattttggaggagaaacaattgcggctccggaaccacattttttctctctctgacacccgcttgtaaaatttttgtgggggcgttttttataggtagaggggtttttttataaggggacccctctctctttgtaaaatttaaggcggttttccccttataagaaaaaaaaattttgggccaagcccca

SEQ ID NO: 695871 - DNA, 793 bp, Homo sapiens
ggatcacttgaggtcaggaattagttgccaggttaggcaacgaagtgattccccatctctataggaaaattattttaggccaggcgcagtgacttgcgcatgtaaatcccagcactatgggaggctgagacgggtggatcacctgaggtcaggagttcaggaccagcctggccaacctgtgggaacccctatctctactaaaaatacaggaagtggccatgcatggtggtgcacaccgtgtagtcccagctactcggggaggctgaggcaggcacaatcgcttgcaagccgggaggtggaggttgcagtgagcccaagattgtgccattgcactccaggctgggcgaacaatagcgtgaattccgtcacagtacataaaagaaaaaatcttaacagatggcacaatacatctcttgaggtggtgtggcactaaagtacagtgtccttaccaatcaaacgtgtgaaatgggccggtagagaacccaggtgtcggaaatgttgaccggagtctgtcgtttgggatcgaatgggatactgggcgggtaaaacatatggttgtggagggggttaagaatcagatacaataatcaacttctgaggaggaacaagcgagaaaggttttatataacgaaaggcacggagggggaacgtcagtgagaggcaaatgacggggattcttaagaagggagttcattataagagagtgcgatatatcgaaaattcgcccagcggggttgaaggagtacccgaggaggaacgtggatgtgaaaagaggtggagataacaagaaagc

SEQ ID NO: 695872 - DNA, 657 bp, Homo sapiens
cacaaagtgtttttatttaatgaagaaacagtctttaacagaaaaaaggtattgaaatattaaatggccaccaagtttactttgaagcccatttttggctgtttagtcagcatgaagtgggcatgataattttttaatatttctttttgtgaaatttcctgtacagccttttgtaggattactacaggttaatgtgagttgaggaagacagtctttctcaaacaatactacataccttttattatattacaaacctaagtgttttatatcctagagtcaaggaacaaatttccttaggattatagtattacatgccataaaatactatgctttattggtcccatgttttgtgcaaatttaaaagatggcttttttataaggataaactatggatatataaaaaaccatatttttcacaactaaaatgggcattattttttccaaagtttaaaattggtattatttttacccttggttttgacattcaatccgtccaatttggtggtaggcttaaaacgggcggcatataacagaatgaatttttaccggttagaaattcggaaagggcaaaaaatgaaaattgggtttatttgcctttccaaaaaaatatctcacttttaaaggtgtttggtggtccgccccgcccacatttctcta

SEQ ID NO: 695873 - DNA, 519 bp, Homo sapiens
  misc_feature (172)..(172): n is a, c, g, or t
  misc_feature (193)..(193): n is a, c, g, or t
  misc_feature (307)..(307): n is a, c, g, or t
  misc_feature (428)..(428): n is a, c, g, or t
tttacagcatgtgaagtgggaaatcaggggtctcacagccttcagagctgagagccttgaacagagatttacccacatatttattgacagcaagccagtggtaagatttactaaaagtattccttatgggaaacaaagggacgggctctggctagttatctgcagcaggaanaatggtccttaagggacaggntcacttaatgctaattggtttggtggttttaagaacgccttaaaacgggtttttccaccctggggtgggcccagggttgtccccttgccctcaattcctgggtaaaacccgacnaatctttccaagcatggggcgtcaatggccatcacgagcatgtcacagtgctgcagagattttgttaatggccagtttttggagccagtttatggccacattggggggcctgttcccaaanatgtccccctttgttttgcaaagggttaaaagcaaaggcagctttgtcaatggtggctacttcttgcagagtcgggatccaaatctgcaga

SEQ ID NO: 695874 - DNA, 776 bp, Homo sapiens
agcggggtggttggcgtgcggtgcctggcgcccgacgggccggtggttgcggggcctcccgcctcgacccgggctgtgggtgcagccgtggctggctgccggggaccgcaaggggcggaggaaaggagggggccggtccaggcacgcagaggagcagccgaccatgcccctgagacaacatggcctccttgatccaacggatcgccacgccaggcttgcctcaccttccggtggcagcggggtgctggcctgggccgcttccgatcgcgacgacggcttctggcccggaggcgccgatgcagccgggcttccccgagaagctgagcaagctgaagatgcctcctgacccagatccggccgaggacttgaacatcgcccgtgcaaggcactactgcagccgctgcctgaccaaacctgccgccagatcacctacatgcacatctacgagacggacggcttcagacctgggcgtgttcctgctcaagagcggcacgtccatcccgctgcaactgacaccgggcatgcacggcatgctcaaaggatgctgtacggcaccggtgcgcatcaggatgcgatggaacaagctagaaggctgggcacggctgggcaacaggccgcgggaccttgaccagcccgagcaagcacgtaccgagcccgacggcttgcagccccgggagcgagaagccagtgcggacgggcgtgctgggtacggaagagcgaagtcaccgaggcaagaggaccatgcatactcaacgaacgggacaaactgacagatc

SEQ ID NO: 695875 - DNA, 480 bp, Homo sapiens
  misc_feature (67)..(67): n is a, c, g, or t
tgtctgtatgtggtggctcttgaggttctcatgccatcagttgtgtggtaatgtatgatccaactanaaatggatggaagatgatgggcaaatatgacttcaccaaggagcaatgctgggattgcaactgtacagaacaccatttatgcagcgggaggattcgatggcattgaatttctgactacggcggaagtgtataatcttgagctcaaatgaatggagcccctatacaaagattttccagttttaacaccctcaccaccctctcaaactaacacgcttagtgatccccttatgttctagcagacgaatccttgccaacagccaggttctttgcgccgtccatgcctccccccttctcatccccccttattcccccttatccttctcttcccttccctcccctcccctttcccccgccccccccccgtcttatcctcatccttcttctctccccttcccgtatcattccctaacccc

SEQ ID NO: 695876 - DNA, 843 bp, Homo sapiens
gctgagtgtggtggcgcgcgctgtgtcccagctgcctggggggctgaggggggaggattgttgaagatcgaggctgcagtgagccgtgtcacaccatgcatgtagcctgagtgacagaatgagacaatctctaaaaaactaaaaatcaaaattttaaaatattcattttaatttatgccacggttgactccatcctcataggtactgaatattgtgtttgggaaaagattttcagtatggatatttcaactcaatggtagaagagaatgaaaaattaagctgaaaatattagagagctggattctggggcccattctgcaccttcatagcctgttgtgtagcctctgatagttaagtgacctctgatcttagtttccccatctttaagatgggatggttagcaaagtgatctctttccagctctacaaagctatagattttttttttcatttcacaactagtaaaccttttatatttaaggacgtagattataactatgagataattagggtatgaagaacatttttattggcatggtaaaatttttccttagtgggacaggatcttaagttgagatagccacagactatttctattttccaaacttttgtaccctccttggaggataattcatcccgtcctcaattaccttttgaacacccagtctattattattatgcccgagtttgttagcccaacaaaaatcctattggcgacttagcattctcggatgtggaggggcattttacggacttcggcgccacatcccggtgtctctcgcgcgccagccttttacactgtctcacaaactcgtggcgccccaagtgggtttaacaaaaatgc

SEQ ID NO: 695877 - DNA, 203 bp, Homo sapiens
caccacgcagtatgacctgtacctgtgtgagggcttcagcgaggccctgaagcagtgcaagtatctaccatggtctagagctccctgcccctgaagaggtcggtgcagactacgggggccagtacctgcaccacacctactacccctacgccgacaggccagaccacaacaccaggattgttcccagcatagctgggcattgg

SEQ ID NO: 695878 - DNA, 114 bp, Homo sapiens
  misc_feature (23)..(23): n is a, c, g, or t
cgcaagctcaagattcgaaatgngcttcgagcacctgctgggcatgcagcgctacaacggcagctttggcctgtggagttcggacagcgaagaagagtactggctaaccgccta

SEQ ID NO: 695879 - DNA, 479 bp, Homo sapiens
  misc_feature (44)..(44): n is a, c, g, or t
  misc_feature (84)..(84): n is a, c, g, or t
  misc_feature (88)..(88): n is a, c, g, or t
  misc_feature (91)..(91): n is a, c, g, or t
  misc_feature (107)..(107): n is a, c, g, or t
  misc_feature (121)..(122): n is a, c, g, or t
  misc_feature (126)..(126): n is a, c, g, or t
  misc_feature (134)..(135): n is a, c, g, or t
  misc_feature (140)..(140): n is a, c, g, or t
  misc_feature (148)..(148): n is a, c, g, or t
  misc_feature (180)..(180): n is a, c, g, or t
  misc_feature (184)..(184): n is a, c, g, or t
  misc_feature (190)..(191): n is a, c, g, or t
  misc_feature (199)..(199): n is a, c, g, or t
  misc_feature (207)..(207): n is a, c, g, or t
  misc_feature (211)..(211): n is a, c, g, or t
  misc_feature (220)..(220): n is a, c, g, or t
  misc_feature (224)..(224): n is a, c, g, or t
  misc_feature (236)..(237): n is a, c, g, or t
  misc_feature (257)..(258): n is a, c, g, or t
  misc_feature (266)..(266): n is a, c, g, or t
  misc_feature (317)..(317): n is a, c, g, or t
  misc_feature (327)..(327): n is a, c, g, or t
  misc_feature (334)..(334): n is a, c, g, or t
  misc_feature (349)..(350): n is a, c, g, or t
  misc_feature (353)..(353): n is a, c, g, or t
  misc_feature (365)..(365): n is a, c, g, or t
  misc_feature (371)..(371): n is a, c, g, or t
  misc_feature (373)..(374): n is a, c, g, or t
  misc_feature (376)..(376): n is a, c, g, or t
  misc_feature (416)..(416): n is a, c, g, or t
  misc_feature (422)..(422): n is a, c, g, or t
  misc_feature (427)..(427): n is a, c, g, or t
  misc_feature (435)..(435): n is a, c, g, or t
  misc_feature (439)..(439): n is a, c, g, or t
  misc_feature (445)..(445): n is a, c, g, or t
  misc_feature (461)..(461): n is a, c, g, or t
agtagtggccccaaatgccaggctgcactgatatttattggttntaagacaaaggtggcagggtaaggaatttgaaccatctantatnatnggtttggtttcatggntattgtgtaatatnntaancccctaannaaatnaatggaanaagaggcagatttagagagaagagtgagagantagnttatgnnattatttntgaatttnaganatttagtantttnaataatttgctnntgctatctaaaaggcagagnnaggtatanaggatggaaaatgaaagcggaataggagagtgaaaaatgaagaaaagaatnaaagggaganaggcctntggataaatgcgggnnggnatgaatgatgtnaggcantnnanaagaggtggaggagtagtcttctctaaactcccccggggnaagggnggctncttttccnagtntgctangtagtgggtgtttttncttgacactgatgctact

SEQ ID NO: 695880 - DNA, 361 bp, Homo sapiens
agcactatatcaccaaggcacggccaggataatcgccgcattgtctggaaagaaggaatcggcccttgtggccaagagtccaggggttatgttcgtgaattccaaactggtgatatggtctcaaattagggttaatacccaaccaaagaatatagcctttatcctttccggcttgaccggctttaggttccaggttaaacgcagaaaccttgccggtcagggtttaccggtacctgtgttaagtctaagagtgtctccattgtctcttacctgtgatattatattatactcatatatttaatatatgtgtactcagagtctatatagagtctatttatatttatatatatttctcgcgtgg

SEQ ID NO: 695881 - DNA, 545 bp, Homo sapiens
  misc_feature (502)..(502): n is a, c, g, or t
  misc_feature (542)..(542): n is a, c, g, or t
gggtgtatagcatatagcatattctatttcaaaaatatatataactggcacatacattatacaaataataaaacaagtagttttaatgcacatgtgggctacagatgctatttttactgtgcaatagtgagacatttttaggtattgattattaatggtatataaatctactttttagtagttctataatgactttattcaaaatttatttctgatgaacttttagcatattttagatgagcaatattgttgaaaatttcatcaagtgagtaacttgcttgaatgttaggggattataaaatgggagaccatgtttcatgcctaatatatattttagcacagtacacatggatgttaattatgataaggtacattttttttttcttgaaaactttcatattatggtagtttccctctacggttttgacttagaatatcacagtttctgggatgtaaatgggagttgatcagccagtcattgtgtccttctctttgcatttangttcatcctggaaaggttaaaggatgctcagaccctcttncaa

SEQ ID NO: 695882 - DNA, 264 bp, Homo sapiens
  misc_feature (13)..(13): n is a, c, g, or t
  misc_feature (110)..(110): n is a, c, g, or t
  misc_feature (251)..(251): n is a, c, g, or t
gacaggttggccnatttcctcaatataaatatgattcaataaaaagtaataaataaaataaaattatttttaaaaatactatatctgggtaaaataagtagagaagaacnatctattagttatctgagcattaaaaatatatgaacagaatatgcatatttatatattttaatcagtttcttgtcgatatattttctaatagacaactttttatttcaatatagaaatttttcttagaatcacctgtaaanttttctaaaagtt

SEQ ID NO: 695883 - DNA, 167 bp, Homo sapiens
tgaggatccgagagacgacagaggggaatcaggagctgcaggcagatcaggacagcatgtccaatcgatgtgatgtttcagcctgactcacggtgcctggtgacgtacgtcagcatattaaagtgtggctgcaagaacctgcaggaggcagaagaatggtaccaatc

SEQ ID NO: 695884 - DNA, 463 bp, Homo sapiens
  misc_feature (15)..(15): n is a, c, g, or t
  misc_feature (21)..(21): n is a, c, g, or t
aacgtgcgaatatcntcggcnatccatgccgaatgagtcttcgctgaaacgtacgatgtactggccggtcttgcggttgaggccgacaaatccctggagttggtcggcggcctggcagataagctcggaagtgatgcgcatggtaaacctcactgaaaagtcccacagggactggaaagatggtttacacgcgtggcagaaattaccgccctctgacggggcagctacccgtaagaatactgcaacgccctgcaaaaaagtcgacaaaattggccggtgcgcacgttaatgtcggtttggtgatagcgccgttcgcaatcaattgttaaaaaggacaccttctcaaagttacctccacgaaaggacttcgcatatgcctgtcacgttttccaaaagcgccttgctgctggcgttgatgctcggccttggccaggcacaggctgccgaaccggatattcgcacg

SEQ ID NO: 695885 - DNA, 983 bp, Homo sapiens
gggtggtcagaaccgcctgaggtaaaaacgggtggcactggggaagcgtatgcgtggctcccgagagcctcgaccacttgtgctcagatgtccgcgctcgacctcctggatggatccagtgatggcttcgtgtgattccgcctggattagcacgcgcgctgtggcaggagcgccaccctctaatctgctcccgagactggacgcccggtgcctttccagcagccgcgttgtgtctttccgggcgcggtccctcgaacgactggctatcccctggcgtggctgtttgactcgctaggtgggatctggtcatcgacaagatgcggatggagggctaatatgcaagatgggtatggcatccactagctctgctcataagtatctgcatgtgattccagtaccttggattgtacatcatactctgcatcctgaggacctgaacatgctaactggtggctgcagatttgtcttctagaggagcaagtgtggtctgtggacatggcaggttcagcctcacctgggattttgtgtgcactagaaggtgccaaggcctaccctagactattaaagcagaactggcgtttaacatgacaccccaggtaatttgtgtgcaccttagagtctgagatgcactagtgtagtgattcgcagggggacaattttgacctccagtgggacatatctggagacatttcttgggtgtcacaacgtgctgggagacggtgctactggatctaaatgggtgagcgcaggtgctgtaaacattcggcataccggcactccgcctctctgccgaagtatgaattaccccccggatgcctagtgaaggtgaggaccctaacttaaatcccttgcttcataatctcggacccgggcctacctcgggcccggggactcccctctctcagttacaaaccaccgtggtcagaccttcgctgtctgagcctcgagccacggaactcccccccagaataccttcgggcgcc

SEQ ID NO: 695886 - DNA, 87 bp, Homo sapiens
caatgtctgtgtgtgtttttttttaagcgtagaaaacctggaaaatacagaaaagcccaaagctaaagaaataaaattgccgggtgc

SEQ ID NO: 695887 - DNA, 464 bp, Homo sapiens
tcgtcccagcactttggaaaggctgacgatggaggactgcttgacgcccggagttccagatcagtctggcacgatacagggagatcttgtctctacaaaaaatttaaaaattagttgtgtgtggcaggctaacgcacctggtctcagctacttaggaggctgaggtgggaggatcatttgagcttgggctgtagtgggctgtgactgcaccactgaactccagcctgggtgacagagcaagacctcgttcttcaaaaacaaacaagaaaagtcaagtcccaagccccaagccccataacaaaacaaaacccaaaacccacatacttgataaaagacaaatgtgtaaagaactcttaaatctcaacaagaaaacaaatcaacccaagttttaaaaatgagcaaaagatctgaacagccacctcaccaaagatatacagatagcaaacaagtatattagaagattc

SEQ ID NO: 695888 - DNA, 257 bp, Homo sapiens
cttttggttgggggttgagccccttaaaaaaacccccccccccggaggcctgcctttttagggatttttttgggggcctaaggcaaaccatggggtgaaaccccggggccgggccttttttaggaaaagggtttttccaacccccccccccccccccgggggtttttttttttttggggttggggaaagggccccccccggttttgggtttttttttggggaaaaaaaaaaggcccaaaaaaaccaagcctttggga

SEQ ID NO: 695889 - DNA, 135 bp, Homo sapiens
  misc_feature (91)..(92): n is a, c, g, or t
ccgacaagaccaacgttaaggccgcctggggtaaggtcggcgcgcacgctgggagtaggtgcggagccctggagaggatgttcctgtcttnngaccaccaagacctacttccgcacttcgacctgagccacggct

SEQ ID NO: 695890 - DNA, 198 bp, Homo sapiens
gtacagtatgcatagtccatcatagaatactcactgtaatatataaactcagacccaaacattaatcatattcttcaaatatctactcatcttcctaaataccatactaatcttaattaccagctaacaacctattccaactgttcatcgccatgagatgttggaaggccttccaacatctcatcgcgccatcattgg

SEQ ID NO: 695891 - DNA, 128 bp, Homo sapiens
taatttcagaaagtcaggtatttggtttaagagctgtgggagtccacgctacctggggtgctcggacgcttaattgcaaaataattagagaaaattggtgactgctttcatctctgtttcatctttca

SEQ ID NO: 695892 - DNA, 217 bp, Homo sapiens
tacagttctttattactcatcttacagccagtctccaggagtgcggcaacagatctgtactcttcttaaaaagttgttattgtaggatacaggacagttctcaggtactttataaattggagcagagtatatccgaacgtgaaccagagaatgagttaacctaacagcacccttctgtttctttacagcagtttaagactttctgtgcccgtttcaa

SEQ ID NO: 695893 - DNA, 104 bp, Homo sapiens
taggatggagaggcacccccctcttctagaggcctgggggcagcgtgacttggggggcagacttgacactagtgcccactcactcagatgtcctgaaattccac

SEQ ID NO: 695894 - DNA, 182 bp, Homo sapiens
tgcccggattacaggcatgaaccactgtgcccagccaaaacctgtactcattaaacatgatcctctttcaatagtggaaacatatgacagtagaataatcctttaaaaaaacaataaaacccatccagtcacaataagtcagaaatataaataaaagaaaacaatataagggctccttgttc

SEQ ID NO: 695895 - DNA, 142 bp, Homo sapiens
gttactagtctctgatcccgcccaccttgatggctcgctcccttaattccagcttcccttcatgatcgcatttccttctcagattcgggttctcatgctgaggctgggcagttcttgagatatatttgcattaaccacccag

SEQ ID NO: 695896 - DNA, 629 bp, Homo sapiens
  misc_feature (68)..(68): n is a, c, g, or t
ttcattgctgacggattcgcagtgttctgattcagtcagataggatgcattcctacgttctagatgtncagctagtcagagtcagcagagagactcatcggtctaaacgtataggcatatggccaatgtccgagaatctaggagtcacgtgtacagtatcatacgtttggatatcatcagctgcgtcactttgcactagtgtacatgctcgtcctaatggtaagcatcatgactcttgtcagtttgcgatggagtatttgcatcctcaggccgtatacagtcctggagcagtgcatcaggatgaactacatgaactgtcaagtggacttgttatagctagtagtcaacaagtaaggtagatccagtgtacaatatgtgactgtggtcagttagattggctttcgatgactatggcacaatagaatggagtgcagtcactcctatggggagttctgagtaaggttgtatcgtatacccatacggttaagcagtgtggaggtagcgattgaaaggcttgcacactgcagctctcatttgtgcagcaatcagatatcatcaagatgaatatagtgctatgaatagcagaaagatgtataggcctgtgatccttcgtgactagtcccaggcac

SEQ ID NO: 695897 - DNA, 456 bp, Homo sapiens
aaaaaaaaaaaaaaaaaaaaaaaatgaaaaaaaataaaaaaaaaaaaaaaaaaaaaaaaaaaaaaaaaaagggggaaaaaaaaaaaaaaaaactttgtgggccgcttgggccaattcatttttaaattcaacaaactttttgcttgcggccgaatttaaacctaattggccaaattccccttatagggagcgttttaaaaattaattggccgtgttttaaaaacttcggaatgggaaaacccttgggtttcccaaattaaatcccttggaagaaaatccccttttccccagttgggttaatacaaaaaaggccccaaccaatcgcctttccaaaaatttgcccaccttaatgggaaaatgaaaatggaaagcttaaatttttggtaaaattccggttaaaatttttgtaaaaaaagcttttttttaaacaaataggccaaaatcggtccctttatt

SEQ ID NO: 695898 - DNA, 343 bp, Homo sapiens
  misc_feature (10)..(10): n is a, c, g, or t
  misc_feature (13)..(13): n is a, c, g, or t
  misc_feature (16)..(16): n is a, c, g, or t
  misc_feature (132)..(132): n is a, c, g, or t
  misc_feature (188)..(188): n is a, c, g, or t
gggcgacagnggnagntgcggcgcgaccaggccgggcacctccgagcgcaaggacagcgcgaggtccgcgcagcccagtgcattcatggagttttgtgcggactcactctatgatgtccctgttgttgtggncgcagcgccgtctgctcagcgcccgggtcaataggagccagtcctttgtaggcgtncttggtagtcacgagcgggggcccaggagttttccggtctttagcccgccggggcccccacggaagccccccgcgctctcccgagtgttcaggatgttttacgtggttcacccagccgtcaaggtgccgatatccgagcggctgtacctggtgta

SEQ ID NO: 695899 - DNA, 312 bp, Homo sapiens
cactcagtttcaaatgctgatgacacctgtacacacacacacacacacacacacacacacacacacacacacacacacacagagtctatacaactttgcgtgtatgtaattggcatcatctcaaatatataccatatctctccctcactaaatgtaagccttctcctctctctctcaatcttatccatacatagcaggcatgtgagagggtggattaaaccaaacccagctacgcaatattcttgagcatactccctcaaatacccatatagtgatgaataatagcagatcagcgtgtagcgacgctaaatg

SEQ ID NO: 695900 - DNA, 662 bp, Homo sapiens
tacgacacgtctcctctgtgtctttgaaatacacgttcttttcttccacggcacttaacccaactttacccatatttttgtttgtcacctacaaggactgtaagttcccttaaggtgaaaaccaaggatatttggttcaaccctctatactcacccccttgcacatggtgtatgcttgataaacatctcccgaaagaatgaactgaatgaaaaacacggtcaggtactgtcagatttatgcctcccttcagctgcctaggtttataaaaggatatcaggacatcaagcaactggctgtctaagctaataatgaatgtcttggttaaagagaacacagcattttattctatactagaaaaactttcttacgaacaatttcttgaagttttcttggtactttaaaattgtaggcctttatgccttatgtgaaaaagaaacaattcataaacacctgtaaagcatgattctctttgttgtttttttttgagacagggtttggtgcttgtcgcccaggctggagtgcaatggtgcagtctcggctcactgcaacatctgcctcccgagttcaagcgattcccctgcctcagcctcccaagtagctgggattgcaggtgcacgacaccatgcccagctaattttttgcatttagtagagacaggctt

SEQ ID NO: 695901 - DNA, 786 bp, Homo sapiens
ggttcctcctttgccctaagcgaatgaaaggtaattaataaaatttttcccacatcttaaaagatcccattaaggcccactcaggggggggtcttccaggaccttgcaagaaagtactaactattgaggttcgggctaagtcaagcttgtatgagaggtcatgactttcatgaaggcgttagggctgttttaatttataaagaccagagtcccaaatggaaaccagctggtcttaaaaaagttcctgaggaagatttgaataatccccttaagtctttgggaaacagtgatttgaaattttgaggggccaggcttttaaggtatattttgtagcatgggttggccatctacagcatgtgggcccaatccagcctgctgcctgtttttatataccctgtaagctaagaatggtttccgccttttttaatggttgggaaaagaaatccaaggcttattattcctggcgtgaaaattatcagaattccccaataaagctttattgggaccagctatactcctctgtttatatattatctgtggctgctttgaaatgagtagttgccataaagatggtaaagccccccaagcctaattattttctgtttggtttttgtcagaaaaaagtttgtccatccctgttttaaaagatggaaaaatgtgaagatctttggagattttcttgagtggtatatttaattgaaatgggattttcgtttgggttgtatgttgatgaaatccacttaggtataccatataaaaaataaagaccctgaaaattgttttgga

SEQ ID NO: 695902 - DNA, 271 bp, Homo sapiens
tcagctgtcttataaatgatgccttctgcaagttaaacataatatagattcagttttttaacatgatctacttacaacatactaaacaaataatagaagtatatatatattttaaaagacactatctcctatgaagtctaaaaagggaaatcatgacaagtcccggatcagataaacaccactgcatcattaaaggggactaaaaagaggcttaaaataaatctgattagaaatatccatttcccggggtttcatcctctcagtacggcgg

SEQ ID NO: 695903 - DNA, 162 bp, Homo sapiens
caaggtgccgtcgctcgttcggggctggtcgtgccgctgccacagcggacgcatgtagccgtcatcattgatgcgtctagacgcggtactagatttaacactacgctaatcaataccacgacaccagacgacatccaggggagacaataactaaccttccga

SEQ ID NO: 695904 - DNA, 263 bp, Homo sapiens
  misc_feature (13)..(13): n is a, c, g, or t
actcgggcggttntcatcggtcagcagttttgcaggtgtttgcgaaaggccgggacgttgcccatcgggcctttgagcgcaactaaggcttcgcgcagttccagcaacttgttcaactcgggtacttggcgggcgacggcgtcggggccgaagtcattgatgtttttgaatttaagttgcacattcaagtcggtgtcctgatcgttgcttaaaacagacggaaccgccatgtccagagcaacttcggctttagtcagtacttc

SEQ ID NO: 695905 - DNA, 955 bp, Homo sapiens
ggggaggcggggccggagaggagagaggaagaggaaggaacgcgcctggcgtcactgagggtgtcacccgggaccgcggctcaggaaccccagacgcacgggccttgtgctgtcgctgccgtggcaccccttctagaaggactctattctctataacagaagtgggagccttggacaactgaacgcctatctctagctcaagaaatgtcagctctttttttttttttggagactgtcacccagtcgggagtacaggggcgccatcttggctctcggtaacctccacctcctgggttcaagcgattctcctgcctcagcctcctgagtagctggggctacaggtatgcaccatcactcctggctaattgttgtatttttagtagataatggggtttcaccatgttggccagggtggtctcagactcctgacctcaggtgatctgcctgcctcggcctcccaaagtgctgggattacagacgtgagccaccatgcccagccaagaaatgtcaattctttatcgtagcctggctttccatatttctcactagggtttttattctctagtttgtaaatcacatttggcgtttgtagatcactccttcccttttagtggcattctctattaggtgtccatctcccaatatgaagaaacagttttctgctttttcctcctttatctgatccatttacagatttattacatttataataggctaggtattggggatacaaaaatgaataagatatggtctgttttcaaaggtatgcagaaacttttctatatattcctactgacttgtatttgtatttcttgaattaaaaacaatcctggctgtgtttttttttttttttttgctcttagtgaatctttgtttcttcttttcattatggcattccagttgagtttcaccacgcattatcatgagaataaataatttcactgactttaataat

SEQ ID NO: 695906 - DNA, 726 bp, Homo sapiens
aaaaatatagggtaggtacgagacaagtagttacgtactcagcggcggcgcggcgcgtggtgttgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagtacatcgcggtgcacgtggtcccggaccagctcatggccttcggcggctccagcgagccgtgccgcgctctgcagcctgcacagcatcggcaagatcggcggcgcgcagaacctgctcctacagcaagctgctgtgcggcctgctggccgagcgcctgcgcaatcagcccggacagggtctacatcaactattacgacatgaacgcggccaatgtgggctggaacaactccaccttcgcctaagagccgcagggacccactgcttgtctggcgctggctccacccgggaaccccgccgcacgcttgtgttctaggcccgcccaccccaaactttctgggtgggggagaaaataaacgggtttacgagaacctagagacattacctcatccaagaaacaatctcgcgagggcccccctataaaccgcggtgtcggtgacaagcacgcgttttcttcgacactgcgcactgttgggccctacgtcgggttcccgtgatcccaattttctcttgtccccag

SEQ ID NO: 695907 - DNA, 873 bp, Homo sapiens
gtctcaaggtaaattaaggatttactgaataaggtgttgacaaatccagaccattttattttatttttttatttatttatttttgagatggagtcttgcttgtcgcccaggctgagtgcagtggcgtgatctcagctcactgcaacctccacctcccgggttcacgccattctcctgcctcagcctcctgagtagctgggactacaggcacctgccaccacgcctggctaacttttttttatatttgagtagaaatggggtttcaccatgttagccaggatggtctcaatctcctgaccttgtgatccgcctgccttggctcccaaagtgctgggattacaggcgtgagccatgcgcctggccagacattttagaatggggaaattttagttgagaaaaaatgcactgtaaatatgctttagttttaattcagtgtgggatgcactacctagcgaaacatgtgagaaactatatacttctcagagaaatatctgacatctatggtcattccattgtatgttttttccccagagatttccataatttaaataaaatcctagatccaggtctggttttgtgcataatacttcatctatttaaattataaatctggtttaggatcaggtgtgtaccttaatgtagatattttaatataatcacttataaagaggtaaaagatactttcagatgcgcaagtggggatctgtcgctgcccggaaggcagagaacttactcggtcaaatatgtgtaacccaaagataacttcgggtcaccgcgggaaacaaacacgccgtttcagacggagacaaaacagggggcagagggaaattttaacaccggcccatgtaggcacacattctcgaggtacaatca

SEQ ID NO: 695908 - DNA, 453 bp, Homo sapiens
accgagctgcagtgatgatgctgtaagccctgtaggaggcagaacagtacgtccttgagaaagtggaaagttcttctgatgaagaacgattactcagaagttttgtgagttcaggtggagaagcttcttagtggtgtcattggtcttccttccctggagggtgattgaaagggcttccggaattctcagaacccaattttggagagctgccagcattatgattagtacaatgccagcattatgattagtacaatgccagctatatttgtctgcaggagcttttaacctgggattcatggactgttgaagtcaaggattggtgaacttgggtgggaaaaaatacatttttgtttttactaacctctatgtgaaatgaaacattttcttcaataacaactgtaagtaaaaccagagtagaattggcagtacctgtgactttgttactaaaataaa

SEQ ID NO: 695909 - DNA, 335 bp, Homo sapiens
  misc_feature (274)..(274): n is a, c, g, or t
tcgacagaatgggtctcactctgtcgcccaggctggagtacagtggcacaacctcggctcacagcaacctccccgtccccacttcaagcgattctcctgtctcagcctcccgagtagctgggagtacaggcacatgccaccacaccaggctaattttcctgtgtttagtacagatggcgtttcaccatgttggccaggctggtcatgaactcctgacctcaagtgatccgcctacctcagccttccaaagtgctgggattacaggcatgagcanctgcgcccggcctgcttcctgccaagttaaacggcatgctagctctcagctccccatgccc

SEQ ID NO: 695910 - DNA, 169 bp, Homo sapiens
agcgatacaaaggtaatagtagctgggcgagcaacttctgttgctgcgtctgagggcttgggtcctgagcctccgctgctggccttgccccagctcagtcgccctccaggtgccaaagagctggttggttaagaatcgatggagccagggcttggtgatcctggtgagt

SEQ ID NO: 695911 - DNA, 199 bp, Homo sapiens
  misc_feature (67)..(67): n is a, c, g, or t
  misc_feature (109)..(109): n is a, c, g, or t
  misc_feature (121)..(121): n is a, c, g, or t
  misc_feature (140)..(140): n is a, c, g, or t
  misc_feature (145)..(145): n is a, c, g, or t
  misc_feature (149)..(149): n is a, c, g, or t
  misc_feature (165)..(166): n is a, c, g, or t
  misc_feature (169)..(169): n is a, c, g, or t
  misc_feature (179)..(179): n is a, c, g, or t
gacaagctctcgcgagacgagccgtgcaggctgaaaaaatggcgccacccagtacccgggagcccanggtcctgtcggcgaccagcgcaaccaaatccgacggggaganggtgctgccaancttcccggacgccgacaantttgngaantttgctcttgggtccnnggnggcaatcaanaaagcaactgggggcctaac

SEQ ID NO: 695912 - DNA, 426 bp, Homo sapiens
gaagtgcacctgtgctaccagcagacaccttgctagacccttcagacatcttccttaatcctcacaaccagcctgaaagggacgtgcatccccattctacaagtgagggttccgattcggagggtttgacttgctcaaggccacaaagctagtaaatggtaaagtcaacactggcaatctttgaggactgttcgcctgactcatcaccaggctgccactcagtaaaagccaaggcacagtcacctttaacaaaatgtacagattgcaggccagatttatgggacctcctgcagattgaggcaatggattaagtgtactttatacttctcaggtacatattagcaaccagacgctcccatattccctctgtgtctctcctggaaaaccactgataaagaacaataataaaatttattctaagccaaa

SEQ ID NO: 695913 - DNA, 439 bp, Homo sapiens
cacgagtagtatatatagtagtagagatatagatatagagagagctatagagagagagatagatcagatattctgctcctgatctcgcgatatctctctcttcttaccctctctctcccagtgatattctcttcctcactcctcctctctcaccgcctttcggttctctgtacttttacttcccctcgtctcgctcctccgtgcccacctcctacctgcatttcttcctggaccccttctcttccttccttgtcgacttgtacatcctatccccttctgccatattctcttcctcacgcatctttgctgacctcttcctttctttccctccatcttttcgctttcctgcttccctcccttgtccttttccacttttttcacctcctctcattcttctttccccctttctctcacgcctctctccctcttgcttcctttc

SEQ ID NO: 695914 - DNA, 251 bp, Homo sapiens
agactgttcgaccagggttgggatggagggagtttacaggaagcagacaggtccaacgtcgaatgccgaattcctggtctggggcaccaacgtccaaggtgggccactatcgcatgatgtggcagagcgaggaggtcttgtgtgggttttcgtgattcagatcacttgtctatgccccaggactccggatgtgtactcggtgcaggccatcgcacagctgacgcttgttaggtgatagcggcgtgttgccc

SEQ ID NO: 695915 - DNA, 228 bp, Homo sapiens
ggggaattcctcctcctcctgggcgaattccaccgcccactctcatcccgtcatccaaaaccacagtggcttcagaaaaaccatcttttataatggggaggctccactctcacaggagaacaccatggcactatatttagactctctcagtaatcacggcttccttacactacaacgaaacaccccaagccgtcagtgcggatctactctctcttgcgactgccacgg

SEQ ID NO: 695916 - DNA, 145 bp, Homo sapiens
  misc_feature (119)..(119): n is a, c, g, or t
  misc_feature (121)..(121): n is a, c, g, or t
  misc_feature (123)..(125): n is a, c, g, or t
  misc_feature (130)..(131): n is a, c, g, or t
  misc_feature (135)..(135): n is a, c, g, or t
  misc_feature (143)..(144): n is a, c, g, or t
gggagtgtgtggataccaatttgggagggggcaagtttttggctgaggccagcctttggcctatagtcggccctctttaccagatgttctcagggggtcccagtcctcataatgctcgncnannncggcnnggantaaagggnng

SEQ ID NO: 695917 - DNA, 111 bp, Homo sapiens
  misc_feature (52)..(52): n is a, c, g, or t
  misc_feature (67)..(68): n is a, c, g, or t
  misc_feature (74)..(74): n is a, c, g, or t
  misc_feature (82)..(82): n is a, c, g, or t
  misc_feature (97)..(97): n is a, c, g, or t
  misc_feature (99)..(99): n is a, c, g, or t
  misc_feature (105)..(105): n is a, c, g, or t
  misc_feature (111)..(111): n is a, c, g, or t
gtctcgtgtcttttgaaactttttgcgagtccactgtgggggaaaaccattnaaatgtgatgaatgnnggggangattttanacaatttcacaatgntnttcccnccaggn

SEQ ID NO: 695918 - DNA, 584 bp, Homo sapiens
aaaaaaaaaaaaaaaaaaaaaacaacaaagaaaaacaacagcgacagacagacacgagcgaaacagcttaagacgaagagagaaaaaagagagaaggcgaccaggacgagacagagaaagaagagaagcagccacacaaccaggcgacaccacggaagagaggcaacagaccagcaggcagagagcgaacaccgggaacaaagaaacgaacagagagacgcaaagagcggagaagacgaacgcacgaaaagcccgaagacaacgcacagacggcacacaaagaaccgagcccacgagcaaccccaacaagagaagcagccggaagagcaagaacagccccggaagacagagagggcgagagccgcgacgagggcgccatagagagagagcgaagagagcggagggagagagcacggagaagcccaggagccggacggtgagcgggcgggctgagagaaaagcaggaacctacacagaacaggagagaacagcgaccggacccgggcagcaacaagaggacgaagaaacaagaagacgacgcacacaaaacgagcgcagagacaaacaaaactagaacacaaaga

SEQ ID NO: 695919 - DNA, 991 bp, Homo sapiens
cggctctctgggtagctgggatacaggcatgcactaccgtgcctggctaatttttgtatttttggtggagacatggtttcaccatgttggccaggctggtctggaactccaacctcaagtgatcctctggcttcagcctcccaaagtgctgggattacaggtgggagccatggtgcccaggtcagaaggttaaattgtttcagtaaaaagtcattctgttgtggaaatgttacaaatgcattgctaaaagggagagaaacatccaggcgtaaacacttatgtcagggatcccttatcctggtggaataagcataaacttggagtcagaattaattgcattctcttttacttattatgagtcaggggacaagtttcttagcttctctaagcctcagcttcttccttgcaataataacacttggctgacagtgttatcatgaggattaaattaaatgacatctagtattctgcttggcctagagtacacactcagtaaaactgatccctttctcacttctcccaggcttagaagttttctggaggtaaattgcatagcccacagctgaagttgatctcttggttcttcctcattcttttttagtaacagaatgatagaagttcgccaagtactggaggacaggagaacacctgagctcagggatcagactctaggataagaaactagttcagccaggaagtgtgccactgtgcagctcttaagatcatatgctcaagtgtcaatcccatcgcacatgttaataactcaatgtcacttgatggtagaagatctctagggaactctgagaaaagacccagtgtttggagccacctgagagcacttagcttactatctgtctggccaagaataaataggctcgcggcgtaatcacaactggtaggtggcccaaccaaaggtctcccccacctctgaaaaggggcaagtgggtcctcccgcttatttaaaaaaaccgggccaaacggcaagcagcaa

SEQ ID NO: 695920 - DNA, 253 bp, Homo sapiens
gctcaacattctttgtaagccacaggctacctcggacttcacgtcataataggctcaacttgtactcagtatctgcttcatccgtcaagctaactactttcatcttatacatccacaagcactcagatttgggcttcgaagtcggcgacgtgactactggtcattctcgtagactgtggttgtgacatagtttctagtatgtctccatcgtattgatgagggctcttcaataacaacaggaagagcatcaagg

SEQ ID NO: 695921 - DNA, 335 bp, Homo sapiens
tggggggggtccaaaaaaaatttttttacaaaaacaggaaacagggccctttggcccctaaaatggaaatttcccaaaactacttttaaaggaacccaaaagacccgggtgcccgagggggctttggccctgtttgaatttttgggaaaaggaaacccctttaggggctccgggggcccttagggtttaaaaaccgggaaaaaaggggactgggtttggaaatttttgaccaaagggggacagcaaaggggaaaacctgaaagctttgccggataagggtgaacctttcttataaggaacaccaaatggtttattccaaggcaggggccaagtga

SEQ ID NO: 695922 - DNA, 334 bp, Homo sapiens
taatgaacagataagggagcagagtggttaaggacttacaggaactataactatactggaataaggaatgaatcaactgaccttgggacaagacaggtatattaacataaattgttacttgcctttctcacccagttaatcagtctctgtacttgtatccctttaagaaacaagtgtcttggttaactaattctgttaatatggttgtgctaaattcatagcaggtgcctataatcatttgcttttagatcaaaccaattccatatcagaattttccttggtttactatagatctttggctttcagttgttgtttgtgtttattaatgtacaat

SEQ ID NO: 695923 - DNA, 310 bp, Homo sapiens
ggtcatataaggaacatcataaaatactgatctctggaggtgtcaagatcatacaaaagacaatataaagacccaggaacaattggagactgtcagagaacaggcagaaatgacaatcaaatacaatgtggtatgttgaatagtatcctggaacaacaaaaaccaaaaaaaaaaaaaattactttagtgaaggccaggcgctacggtacctcatgcctgtaatcccaacattttggaagaccgaggggggccactgtttgaactctggggaatctcctctagagttcacctgaaggatttaaagctttgg

SEQ ID NO: 695924 - DNA, 585 bp, Homo sapiens
  misc_feature (50)..(50): n is a, c, g, or t
  misc_feature (52)..(52): n is a, c, g, or t
  misc_feature (61)..(61): n is a, c, g, or t
  misc_feature (508)..(508): n is a, c, g, or t
  misc_feature (561)..(561): n is a, c, g, or t
gggcaatcaatcgcgcccccccggggcgaagctcgtctggtatcttcgancnaccataccncagaggacacgcatccacacaggtgcacctcaactagagaccccagcgaaacccgcctcgtgggctcccgggagcctactacacggccggagggaaaaccaccacaagccagacgcaacgcccaccggggccccaacatacgcttcagaaagtcgaatggcctaactaatacagccctacctccctctccactggggagaccatctccagatagctcgtccctaagggttcggttgccggaaacccgggaacgtatcgctcctcttaatctccccgcctcgggaccaggcaattcccggaggcaccagttctacaaacaacatcccccatacagagcgcccagcatacacacctcaacgtccaatacatcttacttcaatttttccccagccttcctgtccactggattccgcaccccaactaccccacgcccgctgtccgcccggngacccgctagtgactagatcctctataatcacacggacgaacgagacctcatncgcgaggactggacatcacccagt

SEQ ID NO: 695925 - DNA, 177 bp, Homo sapiens
aacaaaaaaaaaaggggggtttgggtttttaaggccccgaaaaacttaaccggggaaatttttggtaaaaagggaaaaaaaactattttaaaaacccctttttttttgggaaatttaagaccccccccggttttttctttcccccaagaaaaaagccctgggtttttttttttttta

SEQ ID NO: 695926 - DNA, 626 bp, Homo sapiens
  misc_feature (60)..(60): n is a, c, g, or t
acagaaaggtctatcatttgggaaggtgttcgctttgactgtcgatctatgtctaaaacntggatcgtttcaacatgatgttacgagagcgatcgactatgcgacggttgttgcgagatctcagctttgagtgtcagctgtccgtgatctgaattgaagaagacaggcatttgcgatcagttgcctccttctgtgccttttatatcgtggccaaaggtaacagacagatgaaagaacttttcagtgaagatgtatgaaaagttgatatggaatctagggcccaacgcttaatagttcaacggtagtatatgaaagggggttctgtctgaagagaaggtacttgccaatgtagaatgttggtgcgcaatagtaattacacaaactactgaaaatgagtgactattgagaagtgcataagcatccggtgtgtgaacggttgatcgcaaatctctcacagcatgatttatcatcgttcagactacacccatgtgcgattgcacactggtgaccatacaatacgacgtggcgctgtcacggaaccgagcctggggcacactgtggcaatccatacccggagcgtgacggtcgcgagaatggcattatcgtccccgacaaacctcgatccg

SEQ ID NO: 695927 - DNA, 332 bp, Homo sapiens
acacatgttccaccaccaatgcttctaaaccgactcagtaatgcgtcgcatttgctgcatgggttcaattgagcaatcagaaatttgcccctgagcaaatgcccacacctccatgctaagcctccagcaacacttggcacatcacgccttcgcacacacagcacatttgtccttgcaagctctgtcatcttgcatcatccagccactggcatttgtagcacacttgtttgcttgcattttgcaccttgctcattgcaagttcacacttgttcccacattgagtccattttgtttcaatcacccatgtcaccatcatcttatgcagttccaca

SEQ ID NO: 695928 - DNA, 325 bp, Homo sapiens
tggtaattcctcctggctgctggctcctctgtccggagggatgcagcacagacaggtgttcatcatccagcgctcaggcaaatcttatttagcaggaagataagactcaagttatacctacgagagtggtagcacctacaccagccgaagcacagataactgcagactggcccgccgtttacaaaggcccagcctgctcaaacacaagctccattggtcttacaagttgatggaactggggatacatcatctgaagaagatgaagatgaagaagaagactatgatgatgatgaggaggaagacaaagagaaagatggagctgaag

SEQ ID NO: 695929 - DNA, 916 bp, Homo sapiens
tgaggtttgaagatggtgggtagtgagctaaagctctgatgtgagtgggagtcagaccagtgggcagccttggaccttaagagtgtccctttcctgtaacccttgcatcaagcacacctattctaatagtagaagtgacagtcatgaggatggtagccacaagagggcgctctagacagacagccattttcctggtgctctctgggcaggacaggtggtgtaaggccagccaggctgaagaatatggagaaccctgacatgggggcaggaacccccataccctgccaccacagggccttgtcccaccctgaggcaaaggtcacctggtctcttgtccctgttggcagaggttaaaatgttgattgctgtgtatgctgtgtgtagcccctgagaacttcatgattacccatccctttggaagctggcaggtactgtaggtccctcttgtcccagatttcaccaagtatttgtcacagtgccctggtcaacttgggccagtgtgtcacagacaatacttgagaagtgagcttgttagaaagacacagatgggaagatacaatgacctctgcttgctggaggggctggagattgcctggcccttgggtgggaaatgggccatcctcaacaaggttcatgcctcctacagccacaatatgccgcatctcacagtagcgccacagctggccatggttcatctgttccatcccgagagggagaagcctaggggtatgggaagggacagattggatggcggggtccgaggaaaggcccatccttttggggcatcccccttgaagtgcttaagtcggacggggctaccgcgacccgtcgaagagaggaggggccccttggacctggtcgggataaaacatatattagccgcgcgacagtaccgtttgattagtaataaaaatga

SEQ ID NO: 695930 - DNA, 408 bp, Homo sapiens
  misc_feature (221)..(221): n is a, c, g, or t
  misc_feature (276)..(276): n is a, c, g, or t
  misc_feature (280)..(280): n is a, c, g, or t
  misc_feature (286)..(287): n is a, c, g, or t
  misc_feature (289)..(289): n is a, c, g, or t
  misc_feature (291)..(292): n is a, c, g, or t
  misc_feature (304)..(304): n is a, c, g, or t
  misc_feature (306)..(306): n is a, c, g, or t
  misc_feature (309)..(309): n is a, c, g, or t
  misc_feature (397)..(397): n is a, c, g, or t
  misc_feature (402)..(402): n is a, c, g, or t
  misc_feature (404)..(404): n is a, c, g, or t
gttgggattaatagaaccttattttagccttccatcccccatagttcacgtctctagtttattgactccgaaaatgacttcatttttgaggtgagactaccttcagccatcccttgtataagagtttagtgttggcctggcgtggtggctcacacctgtaatcccagcactttgggaggccaaggcgggtggatcacctgaggtcaggagttcgagaccancctgaccaacatggtgaaaccctgtctctactaaaaatacaaaaattagccaagnaggnggtatnncngnnataccacctgcntngangctgaggcaggagaagtgcttgaacccgggaggtggaggttgcagtgagccgagattgcgccattgcactccagcctgggcaacgaanaaaanancacc

SEQ ID NO: 695931 - DNA, 839 bp, Homo sapiens
taatcagtctcctgggtgtctactaattaaatcttattcctgcttgctttcttgtagtcatcaaatggatataggatgtacaattttctctcaggatccaggtcttcctaagcacatgaagaatgcgtgaactcttacccaagcaacccaggcccatccctatgtgagaccatctctcctatactaggtctgcattctcatacaacgactactgagatcacttcctacagagattgccaatatggcacgtctacatcaccctgttttgcctctactatacatgttgactctctcaactgcagacccgctcacagattcctgtcggccagtacaagagtatacagcaagaacagctctctccacgtctcatagtaccttagctcacataccaccaagaaccagctgccattactttaccgtctccctagtaccgacagcagccagcttcaactcctggttgacacggcgcatgcgaccggcataatcctccttgtcaggcaatcacctctctctcgtacacctcgagtcactcttgcgcctcagggcacactctccttccccctctgtagagtatcctctctaagcatcggctgctggaactagccgttcgcctctactgacctttttactgcctcccacttctctaaatcgcgctcaaacctggtccaacccaagccttttatatccccagaataacacacgacttaaacactattgtttctcaccaaccccttgccatccttccactcccaagcatctttctgccaagcatctccgcttggtgttccctcctcatcctcgcctaaatttccctacttcacgtagctcaacgctccccc

SEQ ID NO: 695932 - DNA, 356 bp, Homo sapiens
  misc_feature (52)..(52): n is a, c, g, or t
  misc_feature (353)..(353): n is a, c, g, or t
atggagtcccgctctgtcgcccagggtggagtacagtggtgcgatcttggcncactgcaacctccacatcctgggttcaagcgattctcctgtctcagcctcctgagtagctgggactacaggcagcaccaccatgcccagccactttttgtacatttagttgagacagggttttaccaagttggtcaggatggtcttgaactcctgacctaggtgatccacccacctcagattcccaaagtgctgggattataggcgtgacacctaaagtctggccagtgctgcacagtattaatgttccttattttacagattacatcattaaggtctcaaggggtaagtacaaaaagctnagg

SEQ ID NO: 695933 - DNA, 375 bp, Homo sapiens
tttaaaaatcaaactctactaaagtatataaaacaggccaggtgtggctcacgcctgtaattctagcactttgggagaccgagacgagaggattgcttgagcccaggagttcaagaccagcccgggcaacaaagcgagattctgtcttgagaaaaaatttaaaaactagccaggcatggtggtgtgccagccacttgggaggctgaggtgggaagatcccttgagcccaggagtttgaggttgccgtgagctatgatcacaccactgcactccctccagcctgggtgatagagggagaccctgcctccaaaatatatgtatctacacacatctttctaagaacgaaccggacgcgtgggctagttctagatcgcg

SEQ ID NO: 695934 - DNA, 351 bp, Homo sapiens
cgcacagcacggagagggaagagggctactaagtatgattcccaagtcaggagacacgatagacagctgtcctgattgagacatacccggccaaaacgcatgaaataaagaaacatagaataagaaaacatagaatgcccaccccacatcacaccctgacctaaccaaatagagaaataaaacggctctttaaggtcagggcatgacagtaccccccccccaaaaggtatggactccggccacaaaagctgaacctgtaggagagggtctgggtgggcatgtatccgcggtggcaggacgtagaacccgctccacctctggctcaccccaccttctccggtggcgtggtgc

SEQ ID NO: 695935 - DNA, 532 bp, Homo sapiens
gggccccatattgtgtttggggttccccccccccattttgggccccaagagtgcctttttcccaccaaaccgggagggggcctgtggttttccttttaccctgggagccccggagaggggggcccccttccccccccctttttttttttttgggcccgggaaaagttaaaccccccgggtttttcctgggttattttttttggggggtttgggggggggggaaacccaaatgggatttggggggggggggacccttttggattcccccccctgggggtaggggccgggggggggggccccccttttttcccaaaattcccccgggggtttttttggggggggggggccggggggtttttaaagggttttttaaaagaaagggccggggttggtaatttttgggcccccctttcccccccagggggggggacccccccccccccccttttttttttttttaaggggttttgggttttttaaatttgggcccccaaggcccctttttttttccaaaaaaaattgggaaggccca

SEQ ID NO: 695936 - DNA, 249 bp, Homo sapiens
attcgcggccgcgtcgaccgggcccgtcgaccttcttaaaataataatttgccctcactcctcctactttaccacctgacagttatttttatgaacagatattcaattttgtcagataattattttctgcatctaaaaagttatcatatgccttctcttttttagaatattgatatgggaaattattttgtttaattttgagtgatgaaccagtcttgcgtcgacgcggccgcgaatttagtagtagta

SEQ ID NO: 695937 - DNA, 886 bp, Homo sapiens
ggttcgagagtcagaccgcatcttcttttgcgtcgccagccgagccacatcgctcagacagcatggggaaggtgaaggtcggagtcaacggattcggtcgtattggcgcgcctggtcagcagggctgcttttagctctgggtaaagtggatatggttgccatcaatgagcccttcattgacctcaacatacatggtttacatgttcgctaatatgattccactccggcatggcaaagttcctaggtggcacgcgtcgagaggcgtgagaagggagaagcattgtgatcatgtggaaatcctcatcacacatcttgcaggtagcgagatccctccataatagcaaagtggggcgatgctggcggctgagtacgtcgtggagtcctactggcgtcgttccaccaccatggagaaggctggggctcatttgcaggtgggagccaaaagggtcatcatctctgccccgcatctgctgatgcccccatgttcgtcatgggtgtgaaccatgagaagtatgataagacagcctctagatcatcgagcaatgcctcctgcatcagcaactgcattagcgaccctggccaaggtcatccatgacgaacgttggtatcgtggaaggacgtcatgaccacagttccatgccatcactggcacccagaatgactgtggattggcccctccgggaaactgtggcgtgatggcccgcggtggctctccaagaacatcatccctgcctctactgggcgcttgccaagggctgtggggcaaggtcatcccctgagctgaacgggaagctcactggcatggccttccgggtcccactgcaagtttctgtgtggactcgaactggcgtaaaaaaactgccaatttatgacactcacacgggtg

SEQ ID NO: 695938 - DNA, 274 bp, Homo sapiens
caaatcagatggtcagtcccaccagtagaatcacggggacagctctgtcttacccggagaatagtttcccccaaaagatatctccaaatgcctagcatacagtaggcaaggacccaaatattttagcatgtgatgttcttagatcatcatgtatgaaatagtatcttactctttagtcagacctcataaccttcatcgacatgagtcaccacaaaggaggaaatacagatattgcctatatgtatactaacgactatgtatactaaagaccttg

SEQ ID NO: 695939 - DNA, 168 bp, Homo sapiens
acagacaagaaatggacagactgaagaaagagaagagactcacgaatactatttctacaatgtccacatattgaagtacattcaccgtctgctcttctgctcccttaacacttgaacagatccattactgcgatctctttctagaggacggtgacccagatttctgtg

SEQ ID NO: 695940 - DNA, 173 bp, Homo sapiens
ggcccggtcagtacggatgtggcacgaacctgcatcctgcatctaagcacctatttccagtgcgtgacgctatctggaaactcacttgcgtgggtgcagatagctgccatagactattgtgatgctcatgcttgagttcccaaggaacgtgcttcccaggaaaggctcagtat

SEQ ID NO: 695941 - DNA, 169 bp, Homo sapiens
gggtgactctacaggatctatattacagccaggtcacttagccagaggctgtaaaaaagatatgctgggcctgggagaaatatgggattatagatgtgagccactgcacccagccaatttatttcacgtctaaagaccctttggccactattctttacagagcccaggg

SEQ ID NO: 695942 - DNA, 104 bp, Homo sapiens
aagaaaaaaaacatcaagttgtgccaaattattctcctatgttggctgctagaacatggttaccatgtctttctctctcactccttccttctttctctttcttt

SEQ ID NO: 695943 - DNA, 1145 bp, Homo sapiens
cgcagccgcgctcccaccaccgcacacccaccgcgccctcgggtcgcctcttctccgggagccagtccgcgccaccgcacgccgccacagccgcatcgaccacccgtccggcagccaatgatccaaccaggatccgtgatccatcggtccatccataccggcaggaatgatatcggacgggcccggggcaccgacgagccggccgagactccagcacggagcatacagtgacgtacgtccacacacgcaccatacagcactgggcaagcgcgcatgcgccccaagcaccagccggcagccatcatacgccatcggtccccggggcggcagtgtatgcacacagcagctccatcatgccgttgctgccatgcaggagacagcgtgcccaggggatgcggcatccatgcaaggactcggatggacttcatcagcatggccagacagccaatcaacacacgagattcacagacacacccggacgaccaacgacgacaggtggagctgcatggagctgaattgaccggcttcgcacaactaacatcagacaagcgtgcgcgttccctggagcaggcgcagaatacaggatcctagctgagccgaagctcgcagcagctcaatgggccaaggccacgtcacgcgcctgggggacctcatacgaggacggagatgcagggagactgcgcacggacagtgtggaccagataaccaacgacaaaagcccgacgtcgacggatgggacgcagcggcaaacacgcgacgaggacactccatggcgcctacgggcagaacatggcaggagacagaatgctccagacacagaggaaggccgagaacacaccggcagaccatacaaaccaggctgtgcccaaggcgatcacagggaccgtcatggacgctggacgcacaggggcaactaggcaaaacagaataggcacatgcgagcaaaacctccgaacagggaaccaccacgcaggacggcccaaaagggcaacgccggtccaagctgcggacgataccaagaccgacccaaggtaaacacgcaagaacaaaaaacagaagagagggagaccacaaccgggcgtaaaagagagacaccagaagaacaaccagagaaaaagacagcaagtaagaaaaaccacaagata

SEQ ID NO: 695944 - DNA, 115 bp, Homo sapiens
aactcaggggcgagctgcagtcactgtcaccaccactgtctttgtgcatcatcgccaactaatatttcactttacatccaaacatcactttggcttcgcagctcgcccctgagtt

SEQ ID NO: 695945 - DNA, 135 bp, Homo sapiens
caaacccttaacccctccccacatcaagcccgaatgagtatttcctattcgcctacacaatgctccgatccgtccctaacaaactaggaggcgttcttggccctattattatccatcctcatcctagcaaatagt

SEQ ID NO: 695946 - DNA, 390 bp, Homo sapiens
aaaacattccctcctttggccctacaggtcaaaatgggggcaacaaagcattgtcatttttcaggattgccctgtgggccctccctcccagttgaaactttaaaaaacaggaggggcccccagccccctcttccaattcaacaacattttataattgataactccctgagcctcaagacacctggggagggtttgttttatccccttcccccctcaggggatgatattttcaaaacccctccgagggtttgttcattccccttccaccctaaggtccaccctcaggggatgatattttcaagacccctcccaagggggtttggtcactccccttcccccctcagtggatgatattttgaagaaactaccgaagaataaattaataattta

SEQ ID NO: 695947 - DNA, 176 bp, Homo sapiens
actgcattctagcctgggcaccactgcattccagcccgggcaacagagtgagactctgtccaaaaaaaaaaaaggttaactttcaaaagggtatcgccaatagtggttaaataagggccttaagaacaagacctatttactggggcaacaggaggtaaaagtttccagcagctagg

SEQ ID NO: 695948 - DNA, 143 bp, Homo sapiens
gatgtagttagagatctgacatgagcaagatgatgatgcatggggtcgagtgtattaccactgcggtgcatgactcctgtacaagtttcgtcgacaagtgagcagcgtgctgatctccaaatattgttaagctgagagctggt

SEQ ID NO: 695949 - DNA, 212 bp, Homo sapiens
  misc_feature (59)..(59): n is a, c, g, or t
  misc_feature (70)..(70): n is a, c, g, or t
  misc_feature (111)..(111): n is a, c, g, or t
ccctttttttttttggctggcccccttgtgcggggtttaaccccggggcttgccccccncccccaagggngggcccaagggcccgggtgggccctgaagcccgtggctgcnctgaggctgtggccctgagactgcatcggaggcggcgccccgttttagggccgtggcctttgccgagactgtagcagagaaaacgtatttattattccaga

SEQ ID NO: 695950 - DNA, 386 bp, Homo sapiens
gggcccccgggggcacaccgttcccctgccaattccgggggacccgaggtggccggactcccaaggggccccccgggagaaccgctccaggggttttttaaaattggtgggggcggccttcggagccccggcggcgggcgggattgcatggtttgctttgaaagcgaagtgaatgccgcccttgtgccctggggacacaacctgttttgcatggagtgtgcagtacgatttggaagagggcggacccaaagtgtcccgtttgccccatcacagccacgcaagccatccgaatattttcctaagccccgggccccaagcctccggggccccctccactgggccccccctggacctgttttcccctaaagccttttggaaagcggtga

SEQ ID NO: 695951 - DNA, 321 bp, Homo sapiens
ctgagcccttgtatgcgctgctgctcgagtgacattgtaggagaaggaattcatctacacttgtggttgagattagtgggcactacttccttttcatgtgaccggcttggctcactcctctcaggggtccctcttgcctgaagttgttagcctaatcgagttgtcgtttatttccttcctgtaagatagtctttcatcgcgtctaagagctgtgtttagacgatcgtaccttcaacattatctaatgacgccttgtcgaagttgctgtggaatggattcgttttattccagttccccttaatagggtttaaataatttttc

SEQ ID NO: 695952 - DNA, 191 bp, Homo sapiens
  misc_feature (101)..(101): n is a, c, g, or t
  misc_feature (130)..(130): n is a, c, g, or t
  misc_feature (166)..(166): n is a, c, g, or t
cgtgtgggacccctgctgatcctgtcgcagatcgtgctcatgcagacgtgtattacggctcgctgggcctgtggtggcgctggtggacgggctagtgcganagcccctcgctggaccagatgttcgacgncgagatcctgggcttttccacccctccaggccggtnttcatgatgtcctcatctcaaggcc

SEQ ID NO: 695953 - DNA, 349 bp, Homo sapiens
gagccagtgccatcccgtccactctgagtcctgctgcatctgagcgatgtatttcgcagatttgtggacagagcagcagtgggtggccgtccatgcttctgggtgtccactagtattgtccctcgtgtgctcaatcttgtgatagtgggcgctgaggtatttgaagtgtaccaaagcggacttggcagagacagatgatgatggtgatgaccaggatctctaatgtgatcatataggtggtgagctatgaaccccgtgctgcatggtgtgaatagaagagcatccagaagaggcagaggatgggcgcggtcatcatctggtctactgcccccgagtacagtgagcaggt

SEQ ID NO: 695954 - DNA, 319 bp, Homo sapiens
cagatatgtacagtcaaatctaatatgcatgtctcttaattataagaaagacttatttttcagagaagggttcgctttttccagaaatatctattaacataaattatactttggtgcccattggctctaaccaaatcttatctcaaattattttgcaaggtgttcccgttctcattcatatggtctactaaagtagaccacaatacccaaacctaaatatttccataaaataatttggtgattcacatttttaccattaacagctacatttttaccgttgacagcttttatacctatagtttgagcaatctgctaaatg

SEQ ID NO: 695955 - DNA, 291 bp, Homo sapiens
cagggactggctagggagttggtagggtgtcaggctgttcaagacaacgggaaggatgttgaataactatctatccaggtgagtccgtgcacgatttcaggctctactacctccagcagctcccgtgctgagcctggggcttggtgggtctgggtcttcttcctcttctgggtcctttttaattctgtccacgtcaagagccaagccaaggtactgttccctccaagtgagtaaacagcacgtgcgtgtagggcaacggcggagattgaggggagaccctcatagagtcga

SEQ ID NO: 695956 - DNA, 251 bp, Homo sapiens
  misc_feature (39)..(39): n is a, c, g, or t
  misc_feature (49)..(49): n is a, c, g, or t
  misc_feature (77)..(77): n is a, c, g, or t
  misc_feature (112)..(112): n is a, c, g, or t
  misc_feature (124)..(124): n is a, c, g, or t
  misc_feature (131)..(132): n is a, c, g, or t
  misc_feature (138)..(138): n is a, c, g, or t
  misc_feature (152)..(152): n is a, c, g, or t
  misc_feature (158)..(158): n is a, c, g, or t
  misc_feature (182)..(182): n is a, c, g, or t
  misc_feature (192)..(192): n is a, c, g, or t
  misc_feature (200)..(200): n is a, c, g, or t
  misc_feature (203)..(203): n is a, c, g, or t
  misc_feature (227)..(227): n is a, c, g, or t
  misc_feature (242)..(242): n is a, c, g, or t
  misc_feature (248)..(248): n is a, c, g, or t
gagatgacgaagggaacgtcatcgtttggaaagcgtcgnaataagacgnacacgttgtgccgcacgctgtaggctcnaaggacctaccacctttcagaagtcgacctgtggnaaatgtggttanccttgannaagggnaagagaaagtatanctgggngtgccaaggttaaaaggggaaatnccaccggaantaggtcgnatnaggcacctaaaaattgtataccgnagattcaggcatggnttccgntga

SEQ ID NO: 695957 - DNA, 205 bp, Homo sapiens
  misc_feature (75)..(75): n is a, c, g, or t
  misc_feature (189)..(189): n is a, c, g, or t
tcaggtgcgagatagttttagaggtcagtagagtaggggggagacccctaagttgaagtagtaaaaaaatagcgngtagtaagttaggataatataaaataagttaaattaagaatggttatagttagaggttagtacagagtaagaactagcctaattaattcaatcctatagtagagagtaattganggagtatagctaagat

SEQ ID NO: 695958 - DNA, 684 bp, Homo sapiens
gctcggccggctgctgttacctgcgtcgcccggcagcatggacaggctgttggtttgtgagctccaggcaggatggcatcctctccagaatgaagatcttcttgccgatggtgctgctggctgcccttctgggtgtggagcgagccagctcgttgatgtgcttctcctgcttgtaatccgagagatgagcaatctgtactgcctagcacagccgatcactctgctcctgagccagtgacatgctactgcgtgactgttttctgttatgtgccggctttgggaattgtctcgtgacatttggccacatgcctggggcacgacctggttccccggtctgccccattccagaaggcgtcaagtgttgttgtggcttccattggtgcatcaggctgtcgtgcccaaggacggcgttattctcgtgtctagtttatccatgtgggctgcgtccggactagggtctgggaggcctgcccgtgcgccatatggacggttcgatccccttggcttggggttgaccgggggcctgccttgtcgttggagcccttgtctggctccgtggcccgcttgccttggtcggctctctggggtccctgaacgcggcgcaggaccccttgttcacctcgtagttcccccagtcgcaggggactgtgagtgtccccagagtccgtttctagtagtcccaca

SEQ ID NO: 695959 - DNA, 1144 bp, Homo sapiens
cttttcttctttctttttttctctttcttctttttttttgcttttcttctctttcttcttctcccttcttctctcttttgtttttctgtgctttctgctgctctctcttttctttctctgcgcgttttttttttgtgtcttctgcggtctccttcttgctttgtcgttttcttgtggcggctttgtgggcgccttgtttgttcttgttttcccggttgtgtctgaaccgcattgtctgtctcttggtttctgtggtccttgttttggctccgccagtttgtgttgttcctgttttcggacctttttatttttttgtttttcgcttgtttcattgcggcccctctgtgcatttctttgtttctccagcatcccctctacacttgttcagcatttagcctggccaacattgatggtagaactttttatatttcaaacttattgtatcttccgtacgatatggtcttattcccgctcgatatgacgtggtccggcctaacgtatggttacgtccatgcctgcctcctggatgtcttggaggatcgccctcacaagccgttaaatggttgttaatagttcggacggtgattgccagtgaagatgattctgagtttccttgtgtccgtttcctcaggagacattagattctctatagcgcacttcttctctttaggagattctatttttctggatctttcaatagcacagctcgcgtagttgttcataccatattcttctaagttgcttgtgtgtctccatggcacgagcgacgatcggtttccagcgtgacgggtgcctggcccctcgtgtgcaaggttccgattgttattaagactgttacatagtttactatatatctactactatataatttattgagttatgacaagatgtatttgtggtagacattaacacttcttacgcaatgctctcctagagctgttgttactagcctggactgctaccatttcacagtcttggaggcgaacgctcgtgaattcagattggttcgttctgtactgttactgtgccctgactctagggcagctgtcccttgcattgcctgcagggccatggctcagggtggtctcttcttgggcccagtgcatggtggccagaggtgtcacaaacaccggcagtgacgatt

SEQ ID NO: 695960 - DNA, 1335 bp, Homo sapiens
ggagagagagagaactagtctcgagtttttattttttttttatacagaaagccagtcggagttaatggttccattggcccaaaaatacaccttgggggacctcaaattctttccaaaaatcactaccagcagcatattgatttggaagcatttcgaccacccagttcacaccatccagtttcctcgcaggaacgttcaagaataaaaagtggccagtcgtgcccccattcgtgggctccttcggtcatagtggcgtggtctcttcgtttctccagaggggcttgacagatctcgtgatgtggtgaagtgagtggggtgcgccaatctcccaggccattgtgggcccctctgtggcaaggggcgtgggaaatccacattgcagtggccaccaggcaactgaagaattatgtggttctcacggggacacgatctattacatacgagaaaggggtctctctagatcatgtgtgtgtgtctccccacacgaccaacacgttcgggagaattttggggggagcccaccgcgaaaagtgtacagatccatgacgagctttgctccttacgaacactgactctgctgttcctttaccagcgacgaaagaaagctttccacaagtggggtgtgtgtgtggggtgccaaggaaacagtggtaactttgatgaggggctccttcgaatgtcctataggagttagtgcgacgctcgatggacgcacctgtattagtaagcactctacgtgggggagaaatcttcgcaggagtgtacttctacttagaagtggggggagtctcagtggggaaataatctctattaaactgtggagaaggtggtgtttgaaacccccacttttcaccacagcgggggcattgtggtgggtacaaaacaaggcgggcggcaaatcgtgggaacaacacgccacacaggggcggggcatcatacccccctatcaactagtggtcggacccagaagtagagccactaacagtccccagtcagtggtcggcgacgacgaagatggacccctgcatggaggcacgagaacaacgtcggccaaacctgccagaatgaaggggacaaacaccgctatgtgcatatcggccaaggaagacaagcgaggtgggagaacaaaaacacgggcggcacaccacaacccagcaggcggacaaaaaagacggcgaggaatgaaagctacacgccagcttggtcggagctaaccaacgagacgcacaaccgatggacacacgcagcaaacaaacacgcccagtctgacagacagagagcaacacacataaacgactccagcacatgtcacccgccggtaggaacacacgggtt

SEQ ID NO: 695961 - DNA, 1392 bp, Homo sapiens
  misc_feature (422)..(422): n is a, c, g, or t
gattgtgctcatccctccagcttcacatgtcaatagcgctatagacgtcctcattggacgacttctgcgagtagacagactgattctgcatgtaatgccgacgtcagtcgaaagaacgagagaaagccggccctgagtgaatattcgaatgaagaaagacgaaatctctcgtgcaatagaggtcacgatatagaacagaaggggctaccctggcatgatagtgcgagtaggcgtgcatgatatgcatatccatccaaagtgtccgttctaaaaactagtacaacgccatactatacctaatcataggattcactctttgcgtgccaacgaaacctcaatagtttggtatcactaggtaccctattgcttccctacctaggcgcaataagcgcatttgaccacgtcggcttgggactttgtanaacacttgactttcgatgttacccgctattaggaaacaggtcgcattccaactttagcggtcttagggagaacctgtcatgaagcacctagcctagtgtggggcattactattggtccttggttaaactggggtagactaagttccaggtacaatccctccaggtttggtattagagattaaaccccacttttctgggaataacgaagagagcttttggtggtaggcctaattatagtccaacgtttccaatggatggaactttacgatttcaatgcaaacaacatgggcggctgcttacggaccgtctaatttttacctggattagcaatatagcccccattttaggggttagttccatgttcgaacctcagtgttgttcgaggactccatgtacctatggtgggaggtttatcacgattagctcacggcttttagaaagttaaccctgtgagagctcttcccctgtacattgttaggttctaactccgcacccatgtttaccattggccctttgggcgacgtttacgaaaattatgcaaaacgcagacgtacacatcttatcctttcagggcccccatagggaactccataaaaagccatttttttcacgagtactcggtccttataaatctctgggcagtgctagtagcgccagcgtcagcaccttgccctaattagaaaatcgctcatctatcccgaacagccttagtgccttgaggtgcgccccctgtctggcaaccatccccgtcggcgtgtcgtctctctcaccactacctttgtctcttacccgaagttgaggcatcacctccagaaggtttggattaaccacttatcgtctcacgctgggcagacgatccatccgcaactcagtcgttctagacacgtactatatgcccctccacaaagcggctgttttgttcacacgcgcgtttgaagcgtacgccgtagcctcgtgggactactcagac

SEQ ID NO: 695962 - DNA, 243 bp, Homo sapiens
caaatgtaaaagtaaagatgcaggaaaaatgaatggtgggtatcattacttcatgtatatcaagcacagcagtaaaacaaaaacccatgtatttaacttttttttaggattttggctttggtgattttttttttttttggaaactgtgcctaacttgcttgtgctgtaaaattatttcacgggaaaatacttggagatgagggctagcttggtgcagggtcttatgacatctccatgaacaat

SEQ ID NO: 695963 - DNA, 125 bp, Homo sapiens
ttgttttttgtgccttcttcgcataatggctcatttgggccacatcgccggttagcggggtgcaggcctcctagggcgaggagggtggatggccttacgggtgttagccctcttagcctgtgtct

SEQ ID NO: 695964 - DNA, 716 bp, Homo sapiens
agcggtctctgcctgcctccctccctcaccgaagggttagcggacacccatccttttctgcttggggagccgcaatcggatacattcacagcaacacataggagcagctggtctcattcttcaagcgttagtccgttcctcatagactcacgccctcaatatactttctcgtatacgtcattcttctatgtccctctttaaagtctgaactggacaccacagggacatacccacgatgaatgactggaagatggagacacatacatggaatgggatagctaggcgcagtgggaggtcatggaatttcaagattaatgaaaaccctctctcacgcaaaggcgagtaaatgaaaagaaaaaaaacagtaaaggtaaaaaccaaccagggcacaacgaccatagggatgagcacccgctgtacacacagaatagagaacattcccaagagacaacgagagaggagacccatacgcaaaaccacaacaactaaataaccacggcgcccaacaaggacaaagcaaatgaaaaacaaaccaccaaaacagaaccgaaacaacgacataaacaaaacaaccacaagcacagcaacaacacacagcaaagcacaaccgaaaatcagcacacaacacaaaccgccaccaacacacagaagaccaacaacacaaaagcaccacagaacagcacaaacaacaacaaacacacgcacaaccgagccga

SEQ ID NO: 695965 - DNA, 327 bp, Homo sapiens
gcactgattttgtttttcactattccttgcatttgcataatgaaggccgggtgtggtggctcatgcctgtaatcccagcactttggaaaggcccagtgggcggattcgcctgaggtcaggagtttgagaccagcctggtcaacatggggaaaccccatctctactaaaaatacaaaaattagccgggcgtggtggcgggcgcctgtaatcccagctacttgggaggcggaggcaggagaatcacttgactgcaggctgaggttgcagtgagccaaaatagtggcattgcactccagcctgggcaacaggagcgaaactctgtctcca

SEQ ID NO: 695966 - DNA, 891 bp, Homo sapiens
  misc_feature (405)..(405): n is a, c, g, or t
tggaaaaagtcatggaggccagggggtgggcttgaacccagcttgggggggttcgatccctccctttttggtctaaatttaatgtatacgggtcctccgaatggtggtggataggggtggggggccactccattaatagctcccctccgaggtttatagtgggagggtttcttctctacttatttagggaacttttctcgcttctcgaaagcgaaaggtcttctcctcaaatcttatttaaaatttattaattagtatacgtgcgtgtatagagaaaagtgaatgtggaccccataccagaatgtggatatagaggatgtgtttccatgtgtgtggggtgtatatgtgccatctgcggggtatacgctctccggagtatacagcgtctgcggggccatctcccgngaaatatagcgccccgcagacacagtgtgtgtctgtggtgtggcaaaaacagacgtctatacgaattttatacgccgcgaagtaagattattgatatgcgcgtgacagtgtgggattttgtgggcggccggatagggttgtgggcgcttcataagggggggtgtatacgcccccgtggagcaccatgtgggggcggaaacactccacgcgtggaaatgtgtaacgccccctcctatatgtgtgatgtggggccgaaataatcaccagggctcttcccatatgtggtgtatctgcggcacccatctgaggtggtgggcacaccgcgtggaacggccctaaccaaccgtgttagctaccgggtgtcttccggtgtgtagcacacccgaaagtgtttctatacaggggtggaaccgacaaggggtgttgtgcgcctaacctacccaaaggttgccccaggtcttgggaggccccccccctttccggggg

SEQ ID NO: 695967 - DNA, 102 bp, Homo sapiens
gcaggattggataagcctgcattaatacaaccttctctccattcacttcctatttacaattaggaagcaaccttttggttaatacatatattttaataccaa

SEQ ID NO: 695968 - DNA, 230 bp, Homo sapiens
gtcaatgtggagcaaggaagaaagcaggcccagatcatggcctaccgcaacagaaaaggctgaacaccataaatcaagcagacaggagaggccagatgccgttctggcgaccgccaacgctaatagctgaagcatatacgaatcctggctgccgctctgacacaccataatggagatgcaacagcttcactgactgtggccgagcagtatgtcagcgcgttctccaaact

SEQ ID NO: 695969 - DNA, 241 bp, Homo sapiens
ttattgtatttccagtagagacagggtttcgccatgctgaccaggctggccccaaactcccaacctcgggtgatccttccccctcagcctctcaaagtgttgggatcacaggtgctagctaccaagcccatgcccataattgtattctcatgtagagacagggattccgccatgctgaccaggctggccccaaactcccaacctcgggtgatccttccccctcagcctctcaaagtgtcgg

SEQ ID NO: 695970 - DNA, 284 bp, Homo sapiens
  misc_feature (13)..(13): n is a, c, g, or t
  misc_feature (79)..(79): n is a, c, g, or t
aggaccccagtgntgtcgggcaggctgcggcgtggctgatcgtgacgtattcgcgcacactgaaggcccccccatacgngcgggtaggggataacgaaggcacggtgaccgaggtgggcatgttcaacaccaccatccgcaccggtttgggcgaggtgttgacgctgtccaacttgatgatcaccgggtcggtgacgcgcaactattcacgggtggtgcagggtcaggggtacatctgcgatacggtgggcaccatcgggtttgacacgcccctgcgccagggg

SEQ ID NO: 695971 - DNA, 147 bp, Homo sapiens
cgcggtagctacagaacttctggagggagagcacactgccaatacccacttcatggaatacctgctccatacacatacaggaaaaggagtctagtcccagccgggacctcccgtgtccacagacaataacgcagacaactatggtaa

SEQ ID NO: 695972 - DNA, 1438 bp, Homo sapiens
gacacgcacgccgggacgtgccaggtttataacagggagagagcaagcagacgagtcttgaagctctgatagggatgcattgggatccatttccatcggtccttacagccgcatcgtaagacttccagacagccaagatggtgaagcagatcgagagcaaggagtgcttaccaggaagcctttgaacgctgcaggtgcataacaattgtagatagtatgaattcatcaggccaagatggtggtggagcctttgaaaaaagtgatacaaggcactatacattacatacccccatcttctgaagaaggtagtaccagagcgtgactaataccatatgaaggctacacatcgtggattggacgctcgcacagagactagtaagcatagcaggaaggttgtcgaagatccaaagagtgcaagtgccacaagacagttcacaagattctttccacagcacgggggaacaaaagaggtgtaggagattgacaagtgcactaggaagccccacataacaggcaaagaggctgtgacagccccaacccatttgactggaactatcaagtcatcaacgtccaagtagatagacacatggacaccacattattagacaccaaggacccaattcggacataattctaacacacacaatttgtataaaacttatacatcatatacacgtttatcacacacacaattttattaccacacttatgttgactaccacatataaaacaccaagatagcccatcttgcagatgaacaattacaacgaccacaatttaatgtgacaaaacaacaacttgtgggcttaaacagcacgaccaaaagaagcaaacgacacagacaggtcagacgcaaagaaacacaggatgatgacagagccgacgcagaccgagacaccagacagaagaacaacagacgataacagaacaacatacgatgaagaagcacgagcagccacaccaaagcaactcaacgagagcaaacagcgagcacaagaggagagaaaacacagagaaaaaacaaggagtgaacaaaaacaaagaaggtgcggggtaagaaattcacgacccacaaagtaccaaagcgaccagcggggaaacaagcgaagacgttattagcacaaaacacgcgaaaggagaaagaggagcacaccagagggacacactaaaagagacgaaccaggaagacgcaataaaaacaagaccccgacgcaggagaaacaaacaaagaagcaaagacaagcagaaacgaaccaagaaagagacagaagaagcaagaaggagacaagagcagtacagaagaagaagaaagacaaacagacaagcaaaaaaacgccaaacaggaatagcacagaccgagacgacaaagagcaagagaaaaagcacgaagacaacagacgaaaaggcacaagagacaacagcaacgaatcgacgaaaa

SEQ ID NO: 695973 - DNA, 213 bp, Homo sapiens
  misc_feature (155)..(155): n is a, c, g, or t
  misc_feature (179)..(179): n is a, c, g, or t
cagatgtagtagccaactcattgatgacaccaaaaagttgtcatcattagtgttttctagagaaagtctgtgtggattccctcatccttagaaaggaggaggagaaacacaagacctgtaaacatcagttgctttgggaacacacggaattctcnatcagatagttcagtataaaccangtaaaaagcgtatgtgttgaaaatactgaacgct

SEQ ID NO: 695974 - DNA, 796 bp, Homo sapiens
tggcttccttcggtatgggagccaggcctacatcccgaagcaatcatgttccaagggaccgtgcagtgggtatcgatctaggaggcagctactcttgtgtgggtgtttccagcacggaaaagtcgagatagtggccatgatcagggaaaccgaggccactccaagctatgtcgcctttaggggagcactgcacggtttgatcggtgatgccgcaaagaatcaagttgcaatgaagcccaccaacacagtttttgaatgccaaacgtctgattggacgcagcatttgatgatgctgtgtccagtcgtgatatgaaacattgggcctttatggccggtgaatgatgctggcaggcccaacggtccaagtagaatacaagggagagaccaaaagcttctatccagaggaggtgtcttctatggttctgacaaagatgaaggaaggatggcagaagcctaccttgggaagactgttaccagtgctgtggtcacagtgccagttactttagtgactctcagcgtcaggctaccatagatgctggaactatgctggtctcaaatgtactgagaattattaatgagcccagctgctgcgtgctatgcttacggttacgaacaaaaaggctggaagccggaaagagacgtgcacatctttgaactgggagggtgcacttctggttgtggcagcctcactaatggaggcagggatccttgacaggtaacagtttacagtgggaaaccccttggtgggggaacttttccacgggaggaccctgaagggaagaaaggcacttaaagg

SEQ ID NO: 695975 - DNA, 1337 bp, Homo sapiens
agcgtggtggcgagaccgctaccggtgcaaccagcgcgggttttacggaacttgggggtcgtgcagatctgtctggactctagtgtccagtggagtctcagtgatggtctgagcctggcctgcgccgaggttggggtgtcccagaagagccaggaatcgaaatgcttcatggaacaaccgaccctggccttcaagttccgccatggagctcatagttgcagctgactccagggactacagcgagttgcttacattgcctcccagacggtgaagaaggtgatagagatcaagcccatacctgctaggcaccatggctgggggcgcagcgggattgcagctaactgggaacgggctgttggatcgggaaaatgtcgaactctatgagcttcgaaataagcgaagcggcattgtctgtagcagctagacttccaaattgtttgcccaacatggtagtactccaagtaccaataggccatgggggcttgtcccatggggcacccgtggatcttgtgggcgtggggatacatgcaggaaggcccttggccttcttacttactgttgggacaggtgacaggggacaccgggatttccagggggccaaccattctcgtgccaggttcgtggctcatgtgtatgccatatgcgggtccatgggactcgggggcactattgcctatgaacctgcgcagttgtgagcaaggcctaatgatctgtggcccggtcagagccattttacccagggcacagcgtataagaagattgcctaactccagggaggagggcagggacaaacctcctaaccaaaagttgcgggaacaggaataagatagaagcaccagagattaccacgtgttggcacataggagcggagaagaccaaagagtggagcaaaagaacaggggcaggacacacaccctcgacacaaataggtggaaaatcaaccatgagagagagtaccacaggagatcaacagcaacaacaggaagatgattgtcggacagaagcgaacaccaccgccgcaccgcacaaaataaaatgagggacgagacggcacacaacacgagcaacgaccaagtcacccaacaatactcgtacgaagaagaaacacaaattagttagtaacacgacaacaacatacagccgccgaccaggcaaaaagacattagatgatcataaacgagtaggctaaaaaaaaaagccaccacagtcactgatcagacataaagaaaaacaaacgaacagcagcatctactcatacaagcagaggtggtgagtagctacacaccagacacgcaaccaaaaataactagaaacagcaacacaaagaccaaatgagt

SEQ ID NO: 695976 - DNA, 338 bp, Homo sapiens
taaatttggaaagggagtctccctctgttgcccaggtgggagtgcaggggtacgatctcagctcatggcaacctcggtctcccaggttccagcgattctcctccctcagcctccggggttagcgtgggaccacaggcgcacgccaaagtgcccagctaattttggtattttaagtaaagacggggttcaccagtgctagccaggtgggtctcaaactcctgacctcaggcgatccaccgcgcctcagcctctcagagtgcggggaatacagatgtgagccatggcgccgggccctcgttcacacttttttaagtggacacctagctgaataatctcag

SEQ ID NO: 695977 - DNA, 307 bp, Homo sapiens
gcgcacacgcacaccagacatacacgagcaccagcacacaaacgcacagcacacgcacacacatgcacacacagcacactggcacacagcacacacacctaagacacagcacacacatgcgacacacagcacacacagcgcgaacaccgcacacacgaacacagcacacacagcacacacacaaagacagcacacacatgcacacagcacatgcacacacagcacacacataaacacagcacacagcacacaaaagcacagcacacgcacacacatgcacacacagcacactggcacacagcacaca

SEQ ID NO: 695978 - DNA, 302 bp, Homo sapiens
  misc_feature (35)..(35): n is a, c, g, or t
  misc_feature (51)..(51): n is a, c, g, or t
  misc_feature (235)..(235): n is a, c, g, or t
  misc_feature (255)..(255): n is a, c, g, or t
ttttgggggcagccccgggccccccccgagtgacnccaaaaccctggtttncttttacaaccccgtgggtgtgtgggaggccgggcgctttggggtttgtctgtcagggcaatcgtttagtgttttttcagtggggcggggcgggaaacgggtgggaccgggcaaccagttttcaaaggctgtggggccgattggaggccccagcccctcccccctaaacgttgccaaccaaaantgacgtgtgacctcctgggngttgatgccattaaaaccaacgttggggcccggtgaaaaaaaaaaaa

SEQ ID NO: 695979 - DNA, 314 bp, Homo sapiens
atcagtaggcagatatagagtcactgtcaactgtactcctggagacatcaactacactgtgttgctataaagatatttcggccgggacatggtggcgcacgcctatatcccagcactttgggaggccaaggtgggtagatcacttgagatcaggagttcgagaccagcctgaccaacgtggtgaaaccccatctctattaaaaatacaaaaattagccgggtgtcgtggcaggcacctgtaatcccagctgctccggaggctgacgcaagagaatcacttgaacccaggaggcggaggttgcagcgatgctcga

SEQ ID NO: 695980 - DNA, 1011 bp, Homo sapiens
tccttgtgtcaatcctttatttgggggtaaaaacagaaaccgggaaaatacccggtttttaaaatttccttgggtcccccctctcacatttggtgggaccccccttccccccaagacgctaactctggtcacaaacctcaaattatttaaaaatttacaggcacgccaaaacaaaagcgcatggggggaaaaaaaacacaacaaacacaaaacaccaaggagtggagaaagaggtatacccgtgggccccagatagtgtgtctccacttgggcgtgtgtggacaccaactgtgagagggtggtgtacacaccgcggagagcctttgcgtgtgttctcgtgtgttttatcttctttctctcttctctctctctccttttctctctctctcgagagagagagggtgactctcgtgagagagtatcacccgtggtgtgtgtgtctccccagtcttctcgagtgaagaggcgtgtgctctccaaattgcggcgtggagcctgtagagagcgacatattgtgagacacacacactgtgtggccccacagagagacacaccacggcggctctgtgaaattcttactccactctctctctcccgcgtgatcgcactgttccccccacagaggggggccccagtgagcgagatacacttttacaccgtgtgtgtccctctcaatctatttgtctctctgtcgtgagagacacacaagtctttgtgtgggcgcccccaccacgaactctgtggccctattgtgggcctctttctcttctcaaaaaccctctcttcagagaccatacttgtgggcgccaacaggagcggaagacgcgcgaaagagcaggaagacagacctctctactactctttcacagagcaaactctcccccaaaacaagcccgcagacacaaaacgtgagcggcgacgccaccgttgccccccccgtgcccacccgacgcgccccccctgccccggcctcgtgccaaccagcagaagacgggcgtccactgcacacct

SEQ ID NO: 695981 - DNA, 662 bp, Homo sapiens
ggaatcattgagattgtatatgccctgagtattaaagctaggcttagcaaaatacttttagaaacatatggtaaatgatacccataaaattaaattagttatattttattttaacaatgcgagaatacattgatatttattgaactcattggatcctagggacagggacagatatggtgaacctgacttgtggcagatggtaaggaatatcataaaacatttggatgagaacaatcagggcgaactgcatcttttctgttccacactggtaatcatttgaacacattgatttacctcagtgttgaacagttattggtcttgttttgtgtttctaaataataactaattgtctgagcactgtatagagatgctagtattttggtggggggaggtggtgggggagatcatcacttcaccaactgcagtgcagtttgtgtgtcttaaccctcagagaactctgcagtttttagggtacttgaggctgacttaactagaagttttagaagtaagccttttttccatggtaaactatttctgtgaatactaccaattggacattagaacacgtagacgtacttcgtctgaatccgaattcctatttgtagtttatacagtatttctcagctgtgatcttttggagcaaaagccaacggcaggcaaaa

SEQ ID NO: 695982 - DNA, 87 bp, Homo sapiens
  misc_feature (51)..(51): n is a, c, g, or t
tgttccatgaccttcattgatcagtttaaagcacttcaccagtgtaacaantattggggagtggggggactaaaataccttcaaaac

SEQ ID NO: 695983 - DNA, 197 bp, Homo sapiens
gatcgagctcggtaccgatcagcacgatcccaggggctcctccgtctgaaattcagcacgcatattgaatcctccacgtcctctatggacaccacctcgtgttaaactggttcttgccactcttatttttattgcttgtctttgagtcagtgttctgtgtctttgctggtgaaatagccttcttggtttattccgta

SEQ ID NO: 695984 - DNA, 1621 bp, Homo sapiens
cagcagatagaatcgagccggtaccccactctagtcaagaagctctcatagagatttatttagtgtgagaaatatgagaacaatagttgtaaagaacaaatcaataacccgcagtgtgcattttggaaaaccaaataacttcttcaaatttctgagtacacagagggtacctgccttgaaatttaaatgtctaaggaaaatgggagatgattaagagttggtgtggcctagtcacaccaaaatgtatttattacatcctgctcctttctagttgacaggaaagaaagctgctgtggggaaaggagggataaatactgaagggatttactaaacaaatgtccatcacagagttttccttttttttttttttttttttttttttttttttttgagacagagtcttgctctgtcacccaggctggaatgaagtggtatgatctcagttgaatgcaacctccacctcctaggttcaagcgattctcatgcctcagcctcctgagcagctgggactataggcgcatgctaccatgccaggctaatttttatatttttattagagacggggtgttgccatgttggccaggcaggtctcgaactcctggcctcagatgatctgcccaccgtagcctcccaaagtgctgggattacaggtatgagccactccacccagcccagagttttcatttgttccttaaaataattaagctggaaaggcaaggacaattatgagcacaactgtagtcaagttgagaagacctcaaaaaagtcaagtttagaccttcggattttccatagaagagaaaaagatactaggttttagggtacagagagccagatctgaagagtagctgcagggggaaggtgctgttagaaggaggatatagacacattctctggggggaacatatggtgactgacccatgcacacaaagggggccttagcgaaactgcagaggactgatccttaaaccaatcacatctttgccaatctctgtcactgtggtgaccctgcagatttgacctttgaactcaggggaatagcaggccccactgagtggacacttttctactggctttccacggtagatgggccgatatgatgcagcacaaatgtcaaaggggttgtgcatgtcataattgagctggtaggcatctgtgggattcttctcacaggcagacaggatttttcgggtctgttgggccacctcaggcttgggcccgagttctagtaggcgccgagcaaaggtggcagctgtcttgaagttcttgagcttgaagaacagattgagggctgtacgcagcaccaggatcatgtgcacaggctgcaggtttgagtgggtgaaataggctgccatctcacagatgcgcttctgctgttctagagtctctttgggcagcttcttcctttctgtctccacggacaaacccacaatgtactcacggcaaatggtgatgagctgctgggcctctgcaatctcttgtttattgtccacaacaagaagtggcacactgagaaggatggaacggaatttttccacagcctcctcaaatttgccaactgtggtgagctggtagcacagctgcaaccgttggatgaggtcattaagcttcaggcccacag

SEQ ID NO: 695985 - DNA, 531 bp, Homo sapiens
cagcagatagaatcgagccggtaccccactctagtcaagaagctctcatagagatttatttagtgtgagaaatatgagaacaatagttgtaaagaacaaatcaataacccgcagtgtgcattttggaaaaccaaataacttcttcaaatttctgagtacacagagggtacctgccttgaaatttaaatgtctaaggaaaatgggagatgattaagagttggtgtggcctagtcacaccaaaatgtatttattacatcctgctcctttctagttgacaggaaagaaagctgctgtggggaaaggagggataaatactgaagggatttactaaacaaatgtccatcacagagttttccttttttttttttttggaaaaaaagttttgttttgtccccaagtttgaaagaaggggttttaatctaagtggatgccaccctcaacttcttagtttaaggcatttttaatgcttaagctttttgagaggtgggatttttgggcccatcctcccttccgggtttattttttattttt

SEQ ID NO: 695986 - DNA, 805 bp, Homo sapiens
ggcggctccaggagagcaaggacacaaggaagcagagatgccccgagcagcactgtggtccactgctcctgctgctgctcctatcctgggcgtcccgggacgaagcagctccggaccaggatgaaatcgattgcctcccgggcctggccaagcagccctctttccggcagtactccggctatctcaaagcatcggattccaagcacttccactactggtttgtggaatcgcagaacgaccctaagaacagccccgtggtgctttggctcaatgggggtcctggctgcagctccctagatgggttacttacagagcacggtcccttcctgatccagccagatggtgtcaccctggagtacaacccctattcttggaacctgattgccaacatgctgtatatcgagtccccagctggggtgggcttctcctactcggatgacaagatgtatgtgaccaatgacacagaggtggctgagaacaattatcaagcccttaaagacttctaccacctctttccggagtacaaggacaacaaacttttcctgaccggagagagctatgctggcatctacatccccaccttggctgtactggtcatgcaggatcccagcatgaaccttcaggggctggctgtgggcaatggactctcctcctatgagcagaatgacaactccctggtctactttgcctactaccatggtcttctggggaacaggcttttggacttcactccagaacccactgctgttctcagaacagtgtaacttctatgacaacaaaagatccagattgtgtaaacaatctc

SEQ ID NO: 695987 - DNA, 124 bp, Homo sapiens
actcatgctcggtaccggtggcggccaaggaaataagcagctgatcgaggtctgccagcaggtgaactgcggcgcggaacaggtgctgccaggcctggtcagaccatgcaggacatcatgggcg

SEQ ID NO: 695988 - DNA, 270 bp, Homo sapiens
gaactctagaggacccagctattcaagtagctggatacaggcaccgcgacatgccagctaattttttgtatatctagcagagacgggttttttgcatgttggccaggctagtctcaaactccttgcttggcctcccaaaatgctgagactacaggcataagccaatacgccccgcccagctctgatttattgatatagggctgacatgaaatcttgacaagcaggctgagggcccctcctgtggactccaactctgacatggttgttttt

SEQ ID NO: 695989 - DNA, 1470 bp, Homo sapiens
  misc_feature (223)..(223): n is a, c, g, or t
  misc_feature (566)..(566): n is a, c, g, or t
  misc_feature (655)..(655): n is a, c, g, or t
  misc_feature (1470)..(1470): n is a, c, g, or t
tgggatcaaaaaatgttaattctggaattctttaattttaaaaaaatcatacctatgaagggtgtgtgctacgggaattctcaaattacaaataaggtggcattattaaaacccgaccctcattgggcctcattgtggtggttaaagcaaggattgagtgaaaaaagtgccccttcgaggagcaaaaacacgtcttccagcggggcaacctcgcgggacaccncagagttccgcgagagaacaatttctcccagcgtgtgacaccttctctgtggaaagagacaccaccacgcggcccaacgcgtgaagtgtgcagcgaagcgggaactgtggtctccgagcctctccgcgggctctccctcgaggagagaggaagaagtggagtttctccataacaagagtgtggagtgtggcccacaagatgtgccaggaaacgaggcggtgtgttcgcgtggagagccgtgtggtgggggagacacccttgtggggaaagaacacaccacacttctattctgtggcacttctcagcatcttctctatagccctgtctacaagtgtgatctccnaaacatagctgtgacactgtgtgcagcgcactgtgtatatattttgtgggggccacaaaaatgtactattaacaccgccccatgtgtgnaccgcggggaagcgcgaggggttcccccagtgagagtggggctctctacacaggacaaataagcacgaggacccagcagtggcgctgtatctctttgtaccccaagagtggcgcagaaagagaggcccatgtgtcggtgttctaacccatgtggggcacacaaaaacagccgcgcccccgagggttttgccccgtgtggggcccccagggggcaccccattattgtgctcgtgtgcaaccacgttcaaaacagaacccattccaggctcttgttggttggacaaaacgcccaaatgccccgaaagcagaagaaacctccaaagtggtggcaccgtggggggggggtcccccaaatttccaagaaaacccccggggggcgcaacgggggagagggctatcccaacaagggagcttcaaggtgacaacattggccgcggcgggtcgggaccagtgggaaaaaggggcccccccaaagaaagaccctcctcccgggggagaacacgtcggggcccatacaggggaagccgagggaagaacaacgagtggtgaggacaagcccccccgagatttgtgtcggcgtccgtaggcaagaaaaacaaacaccacggggggctctttgcttgaaacaaaacgcacccatgaacccactggaggcgggtagacacgagtaaactatataatgaggcagagaagtacccccacgtagagagaagaaggacgccctagcttctggttgtgagtaaacaaccacgcgagggagaaatcatcaaaagacaggagcagtactcgctcccccacagagaagagcaagatan

SEQ ID NO: 695990 - DNA, 326 bp, Homo sapiens
ggagtgcgcactatactgtgaggggtgaagaaacctctatcgttacaggcctggtactgtggcgctccgtgaaattagagctgttatcagaagtccactgaacttctgattcgcaaatcttcccttccagcgtctggtgcgagaaattgctcgtgactggaaaaacaatctgcgcttccagagcgcaacatatcggtgctattgcagggaggcaagtgaggcctatctggttggcctttatgaaagacaccaacctgtgtgctatccatgccaaaggtgtaaacaattatgccaaaagacatccagctagcacgccgaatacgtgg

SEQ ID NO: 695991 - DNA, 616 bp, Homo sapiens
aaaactaacaaagaattttcgtgtgcttagatccggatgaaacagagcaagaaactgacaacctgtgacatatgtccatactgcatacatgctgctagattgtcatcagtatatcaatataaaattaagaggtgcaacgttccacactttatgcggcatcacaaagataaaaacaagttatgaactgaggtataggggtacagtacacaaaggcaatactaagactaacttataaacagaatcatgaaaagaaaaatccatcccttctgatttcataacatgaaaagaaccggtgtagaagtacagcaatggtagcatcttcattcagcccacagctatgtaatttgtatgcaaaagtgcttgtcttaattatgaaaaggaacatcctgaattgctgaaagtatatacaacgggcacacatccagaactaggaaagaggtaccactcccgcatgctacgaagacttgggtcaaaaaatttttctcatgtttggtactataactaaagtctgtgctaaaataacctcaattgatcctgaggagatgaacttctggaacaaacaaaactgtaaagagtcacagcattagactctacctgtccagccatctttttaaaa

SEQ ID NO: 695992 - DNA, 186 bp, Homo sapiens
cggtacccaggtgactaaccaggtagacctactgaatatattgtgtgctcacacgataaaccctaggatagcatattgatatcatagctcagaccatacctatgtatccaaatggttcttttttttccggagtagtaagttacaatatgggagattattccgaagcctggtgttaggtctacctgg

SEQ ID NO: 695993 - DNA, 1179 bp, Homo sapiens
caggtttctgtatgccggaagacactcaatgacagataatgaaaaaatagagaccccaagagaaaaaagatgatcaatatccaacacataagacaaaaacatagaaaacaaaaaaaacatagaaaaaagcaaaacaagacaacatacacaaacaacaaaacaaagataagacaacaaaggtagagcgcggcgtcccagcacctcgtgtatgtccttccttctagatgtcagcatgcgggatgcgacaggggacatactgagggactaaactgacaggtcccctgagagttaccgagaatgtctgcagtccaggccccctcacaagtggatagaggaacacccagcgcgagtgtaccctcgagagacgccgccacagggtgcctccgagagctgcctctacaagaggcctccgaccaagggagaccttccatccttcctaccaaccgtgttatccatgccgcgagaagagacagctagatttccaacacgtacgctaaaaagcctgcgctacttcaggactttaagaactcacaggtctatacagaccatggtataaatgactgtcttcatgttgagttttattagcatgactgtagaccttttaagaatccattctcattgctgataatgctgcagccctgctggtttgggcttgcctcgaagattttattaaggcacgaagaagtgaaaaactaagggcttcattcaccatcaccaagtatatcgaaccatatacttgtttgccaaaacggatgacgacttacatcgaaatacttaccctctaatttgacatatcagacagctaaaaagaatgatcataaatgttacttcaccagtgatttactgcaatgccctaaattacgctaatgtattgcaagttcagcccgttcagaagaggtctaaagagaacttgaagactcacgacgaaactgcactaaataacaaatactcacaccagaactacaaagcataaagcaagcggaccacacacacataacaaaataaacgaagaaaacacctcaaacaaaagaaacaagaacacacaaggacaaacaaaaacgcacacaggaaacccgccgaaacccgtccacaaccacaaacagccaccacaacacacaaaaaagagcccgaacaacacaaaaccaaagacacaaacgacacacagacagaacaaactag

SEQ ID NO: 695994 - DNA, 418 bp, Homo sapiens
ctttacgtgcccgaagtgtggcacagaagtgcacagtgtgcagcccttgaaatccaggaattgaaatgtcagaagtaaatgctctttagaaaccaagttgtttcctctgagaaaagtgtattgtatccagttccttggaattagtcatcctcagtgtcatctgtaggtggcttttaacaggagtgtgctgtacagccactctcttcctttacaagcacaactcagttctaatcactggaaaccaaatgatactagaaaatcttataaatgttcatgtaatttttttagatcatctaatataatttttaatgtcaagaatactggaaattttttgtcagatgaatactaagaatgactaagaattcttcttcatagaaaaaggtcagactctaaaaataaaagatttttgaggctctgg

SEQ ID NO: 695995 - DNA, 745 bp, Homo sapiens
agcggtctcgccctcccagccgccgccgccgccacggccgtcctcggacctcctcctcctcctcctacttccacgcggcagtaggagcagcgtgaggacgacaaaaagatcgaagaagcagactgcagaaggacaagcaggatctatccggggccaggcaccggctgctgctgctggttgtgctggagaatctggtaggaagacaccatggtgaacggaagatgaggatcgacttgacatttgattagaatggggagtttaaatagagaagaagggggcgtgcgaaagaagagaccaggcaaggctgaaaggaggaaagcaaacaagctgaatgagtgaagaagggaagagccaacaagttgcatggaacaatctaataaaaaagatgaatgagagggaggagtgggaacgcgccaatctgatggggtcacagcgcaatgtattaagagcgcatgagatgaaaccagccctgtgggacgaggtagggatccgaaacaccgccggaggaaaacgaacgatccaagaacgttggtatagtaaccgtatccactgacagttagttgaatggaaaaagcagtagccttggacctgatgtgaacctttcccactcacacagtagagttccgtattagcatccaatggtccgaaagtgaaatccatgccagaggaagaggaattggaatagagagagtgcgggtagacagtagggatggctaaagcgcgaacacaacaggaacgttaacag

SEQ ID NO: 695996 - DNA, 89 bp, Homo sapiens
tttcccagatcccggaccaagtgctcaccttgctcttctgcctgctttcctgcctgctccccagtctccaacccgtaagggcccacctg

SEQ ID NO: 695997 - DNA, 225 bp, Homo sapiens
cacagtgcaattactgtttcattaattatcctcatcaaactagagtatgcaagtccaagcataatttcccatagaagaaacctttttacctttccttcaggtaatggaaaggtgcatggtcgagactttagataacatcactaaggttactagttttaccaatctgtgcccagggtaacaggtgatgattatgctgtgtaggacggtctgttccaagtcgaacac

SEQ ID NO: 695998 - DNA, 998 bp, Homo sapiens
gagtttcactcggttgccaggctggagtgcaatggcagcttactgcaacctccacctcctggttcaagcgattctcctgcctcagcctcccaagtagctgggattacaggcacgcgcaccacacctggctaattctatttagtagaaatggagtctcaccatgttggtcaggctggtctcgaactcctgacctcaggtgatccacccaccttggcctcccagcgtgctgggattataggcatgagccaccaggccggccccaggattttatattaagccttcttgctctcaaacaaaacaaaaaaggtttcaactattcccatttcccagatgaatcccatgagcgctgcttactggtcgaataccaaggtctagggctctgcttccggtagacacgcacacgtggtctccatccaatgggcctttcctgaagttaccagaaaacaccaacatggcgagggagtcctatgacagcacaggcaacggcacaccgtcggctagctccaggatagcaccgcgaagacaatggcgccggccactcggacacgtgtgcacatgccggctcctgccaaagcacggctactcactcacacgggtcgcgcacacccccatggccgacaggcccacccaccgaccccagccgccacaccacacacccaccccccccccacacaccccaccccggaacgcgcgcacgaagcagaggccgggccgacggaaagagcggccggaccagcccggcccgccgcggaccggcgacggagagacgcccaacgccaggcgcgcccaacgcctttgccatagacgcgagcgctagtggcacacgagggccgtcctacgagcgcactactgaagccagaagatctatcggtcgtatctcacgtccgctgcgacgaaccacgacgcggacatgtcgtagtccactccatcaaggaagacaccatgaatcgaaactgaccaagccgcgcagacacgcgagagcctacgccctccccacc

SEQ ID NO: 695999 - DNA, 238 bp, Homo sapiens
tagccaaacagtattaaagttactttgcatttattttatttgatttcttttcttttttttgtattatatatagggtgtttcgtttttgtggcccaggtggatttgcattggcaaaacctcggcccacggaaccccccgcccccgggttccaagcatttctcctggcctcagctccccaagttacctggaattatacgggaccccaccgcaagtccccggattattttgtgtatatttt

SEQ ID NO: 696000 - DNA, 160 bp, Homo sapiens
catttccttctttcctgttcctcaccctgataacacttggtttattgatggcagttccaccaggcctaatcgccactcaccagcaaagggaggctatgctatagtatctttcacatctatcattgaggctaccactctgaccccctccaccacctcttca

SEQ ID NO: 696001 - DNA, 441 bp, Homo sapiens
  misc_feature (359)..(359): n is a, c, g, or t
  misc_feature (364)..(364): n is a, c, g, or t
  misc_feature (441)..(441): n is a, c, g, or t
catgtttactctttggctcatagctccttcatcttaaagccagcatcaatgggtcaagttctgtgtagcattgtttttctgttagttgcatctctctctgactctgaccttttctctctaggtagatttaaagttttctgattggcaactggttgaaagagctattatctaaaggtctggaatcaaatagggtgaagccttcaggtagcaggcttcagagagaatagattgtaaatgtttctaaccatacctaaagagtctgttctgtcagtcttaaagtctctgtattgatatttgtgaggcatgtctgattcccacttcccatcatggcctgaactagtcattcaggataatctggngaggngagggtgcatcagccagtttgggggtttagaattttatctttggcttacatcttttacagatatttcatttggcatn

SEQ ID NO: 696002 - DNA, 407 bp, Homo sapiens
  misc_feature (135)..(135): n is a, c, g, or t
  misc_feature (176)..(176): n is a, c, g, or t
  misc_feature (202)..(202): n is a, c, g, or t
  misc_feature (348)..(348): n is a, c, g, or t
aaagtggggaatgggagaaagaagcaatcacccgcggatgattcctgaggattttacccccttcccaccctctcaattccctgaagaccccatccccttcccttttaaaatcccaactctggcccgggccattgngttgtcacgccctgtaatccccagcactttggaaggccaanacgggcagatcacgaggtcaagagancgagacccatccctggcccaatgtggtgaaaccccatccctaccaaaaatacaaaaattagccgggcgcggtggtgcacacctgtagtcccagccactcaggaggctggggcaggagaatcactagaagctgggaggcagaagttncagtagccgaggttgagccattgcattccagcctggcgaacagagcaaggctccttctc

SEQ ID NO: 696003 - DNA, 274 bp, Homo sapiens
  misc_feature (28)..(28): n is a, c, g, or t
  misc_feature (142)..(142): n is a, c, g, or t
  misc_feature (237)..(237): n is a, c, g, or t
tgcggggataatagccatgagccatggnacccagcctaaagcacgattctttttaaggccctctcttaattagcccagtcatccctcaaccttagcgaaggggccagtgcagagagaggtggccttcacagattcccccggncgggtacaaagctcaggggacacaaagatgatcggatacggcctggggccctctctgcggatctcaatcaggttgcggcatggttttcaccaggncctaagcatgtgagaggacagagagtcgtataaaaat

SEQ ID NO: 696004 - DNA, 104 bp, Homo sapiens
atggagttagcccaggagggggctggtgtgggagggtgaggaggttggggcagtagggtttttctggtgctgttgttcggaaagttggttagaggggtattaaa

SEQ ID NO: 696005 - DNA, 738 bp, Homo sapiens
agcgggttcttctcgtggttccagtggggagagaaggaggaagtagggagcggtggtggcatggagggggacccgccgcgtgctgactgtccaccgccgccaacaccgactctgctcgtggcgtgtggaaaggaggtgtgagtcccgggcgcgagccggcggcggtcgcctgtctgcagggagggtcgtgctggtgggaaggcgatggcgtgatttatgataaacatcaacgatcgacagcattatccagacggctgcgtggaagtgagagggtccaagcctggtaagaatgtccagcttcaggacaatgagatcagaggactgtgcttaaagtctcgtgaaatctttctcagatcagcgttatcctactagacacttgaagcaccactcaaaatatgtggtgacatccatggacaatactatgatttgctgcgaactttttgagtacggtggtttcccaccagaaagcaagctacctgttgcttggtggactatgtggaccggggaaacgcgagtcatgggagacgatctgcctcattactggcctacacaaataacagatatcctgagaatttgtcctactatctacagagggaaccatgaatgtgccagcatcaaacgagaatttatggattttatgatgactgtaaaagaagatacaacattacaatctatggaaagatttcacatgactgtctttaggctgtgtaccgatagcaggcatcgtggatgagaaga

SEQ ID NO: 696006 - DNA, 182 bp, Homo sapiens
gaggtttccgtaggcggagattgtcacgcctgtatccagcactttgggagtgcgaggtgggcggatcattaggtcaggagattgagaccatcctggctaagatggtgaaaccctgtctctactaaaagtacaaaaaattatccgggtgtgggggcatgcacctgattatcccaggctactca

SEQ ID NO: 696007 - DNA, 147 bp, Homo sapiens
  misc_feature (21)..(21): n is a, c, g, or t
  misc_feature (36)..(37): n is a, c, g, or t
tagaggatccccccaggtccnttagccacagcaccnntagggtgcacggaattaatattctttatgatcctacaatttgctgtgaatattctaatggtagtgcattgaatttttacttgtgtcataaatctgctaaacgtaaatgct

SEQ ID NO: 696008 - DNA, 442 bp, Homo sapiens
agagattggagacagcagttcaggggccagtgacgaggagccctgcgtagcttgaggaaaccggctgtaagagccccagtctctcaaggatagggagttgtccatctactgatggactgtaggctctaggatactacgatatcgcttagcgtcatgtttgtgacgcaagtttagtacgctgagattgtgagagaaattatgacgacttagcagtgttgcatgaggaaggctgagatacagggcctctagaacatgacggcggttgagacgaagttactttatggagtgagagatgcctttaaccgccgtgagaccggactgcagagctcggagttattaccaagggaagggcagtgcttttagatggaaatgaaggtgacttcagctataagtttgagttcagagtcgtaggggattgactgaatttgaaggcgaacttctc

SEQ ID NO: 696009 - DNA, 136 bp, Homo sapiens
tccagcctaaagagcaaactcaagtgaaggttgcggtgagcaaagatcgtgccactgacttgcagtgagattgcaccactgtactgcacttggagtgagccgagatcatgccactgcactccagcctaaaagagca

SEQ ID NO: 696010 - DNA, 165 bp, Homo sapiens
ttccccacacctttaaagctgacagtctgtccctgaacagtccttagtttcctgtctgcctttattttcagtctctgcgttatcagaatctcatcggtcttgcatgactctgccctgacctgtagcactcctactgtacctggtatcatcaagcctttattccca

SEQ ID NO: 696011 - DNA, 239 bp, Homo sapiens
aggcctgtggggcagggtcctgcctggagccatctttagtccagtggaccctggaggagtaagtgaccctatgcagtgacccgtctacttctatacggatgcagtgctaatgcggccgacccttgctctccttagaaatggtaagtggcatttacatacttggtctaaactataatcgagttggctgcttttctgtgtcagaatccatcatcctgcttccctgcctttgctggctatat

SEQ ID NO: 696012 - DNA, 444 bp, Homo sapiens
gtgatgaatggggattagatgtagcagcagtctggctgggatcaacgatgcctgggggacatcttgatctatggaccttctcagggcaagtgggaggctagcaaggtggctaggaaagaacagcataacttcagagtaagggtatagacttgggatgtgaggcagttatgctgaaaggttctgtcacagaggggatcagaggacagtggggaacttgggtgggttatctacgcctgtactgtctgcaggtcctgaaattagatgctgtcatagtcttagccgtgaggtcggttggaatgattctgggggcagaagctcagagccccttagtaggactggaggcggaccttctgctgacactgctcagacccctccactgcatgacgaagggtggaggaaattcccagaaaaatatggaccaggacttgaagaagtgtggcaggt

SEQ ID NO: 696013 - DNA, 745 bp, Homo sapiens
gtgcagctggaagatggcgggtccgtggtctgtcgggccgctaccgtcggggcataagtgctattgcggcgcccgtcggtcgcacggccctgctgcggacgctcagccttgcggtgagtacggtaagcttcgttcaggcgctcctagttcgtgccggagactgcgaggttagccgtagcatggcacgaatcgtgccatgcagatgtggcctctcagagcagtccgtcttccatgctcacattgcgactgggtggagtagtcgtgagattgatcgtgggcgagcgcagattggagagcacctgcagaagcaagtaatgagggccaggcgtactttttcggtagctatctgtggcgtttcgaaggcgaaacaaagtagagtcggacactgtgccatgcttgaccctgtggaggatacggacggtgagatgacgcatgagggagcctcactctttatattagcctactagtgaaccctgggtatgcatcgagcgagacttaactacgatcgaaggacgcatgtccaagggatctggcctgaaagctgttggaagctccctgggtcgacattgtcgcagaagctgtaggtctggaaggacctcacacgattgatgaacggacacgtgactgtgagtccttgcgggacgcatgtcaggagaatgattgcatctcatgcgcagactgtgggtctctaacttatcctgggatgccaccaggagtacgcagggacaccagcctgttaggccca

SEQ ID NO: 696014 - DNA, 313 bp, Homo sapiens
gggggggtaaaaaaaaaatttcccccggtttttaaaaaaaaaaaaaacccttttttttggttaaaaaaaaaaaaaaattcccccccaaaaaaaaaaaaaaatttttttttaaaggccccaaaaaggccccaaattaaaaccccccccccccccgggtttttaaggccccttcccctttcccaaaaaaggcccttttcccccccccaaaaattttttttttccccccccacggggggtttaattttttttttcggggggggtttggaccccaaaaaaacccctttttggggccaaaaaaaaaaaatttttttta

SEQ ID NO: 696015 - DNA, 356 bp, Homo sapiens
ctagttaggctaaaaatacccgcccccccaatgggtttgttttacaaacaaaggaaagcagggttagccggtataaacatgcagctggaaagctagaagatttaatgcttccaaaaccctgcttaaagggtgtcaaatggccatccaagatataaaacgttagccagcttatgggctcaattgcttgctcattactctttttgttttttacatacctaccccatacttgttttttaaggggcccttcgggtttgccagagttgggtccccccaagaaattaaggttggaggggcccctcctgccagtttttggcctgaaagacccttccccccctctccctgcccgccaacccata

SEQ ID NO: 696016 - DNA, 229 bp, Homo sapiens
actccctatgtgacttcccgtcgacatggtcgagctcttcggagagatccccatgcccttcaggaaatcccaggctgccacttaccagaaccgactgcgaaaaactcccgcaataccttcaccacttgcccgacgcatgggctacacactgcgcggtgccttacgatccgttctgacttggaaacaccctcccgaccgtcagctaaggtcccaaagttatggttaagtg

SEQ ID NO: 696017 - DNA, 173 bp, Homo sapiens
tatgaactccagaggatgaagaagagaaaaagaagcaggaagagaaaaaaacaaagttgagaacctctgcaaaatcatgaaagacatataggagaaaaaagttgaaaaggtggttgtgtcaaaccagataggtgacatctaccatgctgtattgtcacaagcacatagtggct

SEQ ID NO: 696018 - DNA, 176 bp, Homo sapiens
ggctgcacgtacagcatccggcttgtatgcattcatgggcgtgatcagatcagtcagttcacggttgcacccatgttgttggtgtcatcatcatagtcaatgcagcatagctcgaggggcaatcaggttcatgtgcattcaggcagtcaggagttcaggcatgcagatgggcaagc

SEQ ID NO: 696019 - DNA, 404 bp, Homo sapiens
  misc_feature (15)..(15): n is a, c, g, or t
  misc_feature (69)..(69): n is a, c, g, or t
  misc_feature (74)..(74): n is a, c, g, or t
  misc_feature (121)..(121): n is a, c, g, or t
  misc_feature (146)..(146): n is a, c, g, or t
  misc_feature (224)..(224): n is a, c, g, or t
  misc_feature (248)..(248): n is a, c, g, or t
  misc_feature (266)..(266): n is a, c, g, or t
  misc_feature (268)..(268): n is a, c, g, or t
  misc_feature (278)..(278): n is a, c, g, or t
  misc_feature (297)..(297): n is a, c, g, or t
ggctgaaaatgcctnacacattaccaacagtagagagggaaaacccctaagacagaggaactcccaganatgantgtctggaacgcttcagttccagctttaaagccccaggacgggcganacgtggctggcggcctcgttcccantggcggcacgtccttgggcgtctctaatgtctgcagctcaagggctggcacttttttaaatataaaaaagggtgttanttttaattttttttgtaaagtganttttggtcttctgttganantcggggtgancctgttctgcgctgtgtanaatgtgagatcggtgcgttctcctgatgttttgccgtggcttggggattgtacacgggtccaggctcacggtaattgcattgcctgtaacaatgtaataaaaagcct

SEQ ID NO: 696020 - DNA, 219 bp, Homo sapiens
ctgcacggtgaacttgctctcaagaaaactgaaaaatctagaattgtgtagccggtgaatggagcgtatctgccataattttgagaaaaacttggctgcgaaacggttctctctgactgctgcttgtgttctggaggctgtgtcttatgtatgggtttgtttaatgtgccctctttgaatattaatggcttttccaaagaataaaatattttggacaat

SEQ ID NO: 696021 - DNA, 979 bp, Homo sapiens
  misc_feature (43)..(43): n is a, c, g, or t
  misc_feature (111)..(111): n is a, c, g, or t
  misc_feature (166)..(166): n is a, c, g, or t
  misc_feature (172)..(172): n is a, c, g, or t
  misc_feature (182)..(182): n is a, c, g, or t
  misc_feature (210)..(210): n is a, c, g, or t
  misc_feature (220)..(220): n is a, c, g, or t
  misc_feature (226)..(227): n is a, c, g, or t
  misc_feature (258)..(258): n is a, c, g, or t
  misc_feature (260)..(261): n is a, c, g, or t
  misc_feature (263)..(267): n is a, c, g, or t
  misc_feature (269)..(269): n is a, c, g, or t
  misc_feature (272)..(272): n is a, c, g, or t
  misc_feature (277)..(278): n is a, c, g, or t
  misc_feature (321)..(321): n is a, c, g, or t
  misc_feature (344)..(344): n is a, c, g, or t
  misc_feature (357)..(357): n is a, c, g, or t
  misc_feature (359)..(359): n is a, c, g, or t
  misc_feature (363)..(363): n is a, c, g, or t
  misc_feature (375)..(377): n is a, c, g, or t
  misc_feature (379)..(379): n is a, c, g, or t
  misc_feature (381)..(381): n is a, c, g, or t
  misc_feature (392)..(392): n is a, c, g, or t
  misc_feature (406)..(406): n is a, c, g, or t
  misc_feature (411)..(411): n is a, c, g, or t
  misc_feature (421)..(421): n is a, c, g, or t
  misc_feature (457)..(457): n is a, c, g, or t
  misc_feature (466)..(466): n is a, c, g, or t
  misc_feature (488)..(489): n is a, c, g, or t
  misc_feature (529)..(529): n is a, c, g, or t
  misc_feature (536)..(537): n is a, c, g, or t
  misc_feature (564)..(564): n is a, c, g, or t
  misc_feature (907)..(907): n is a, c, g, or t
  misc_feature (978)..(978): n is a, c, g, or t
actacttaacatttactcatagataaaaatatttccaattttncaccttcaggaaggctccaaaatataaacactgtacctctccctagagaaaaaaaaaattattcttcncttcaaaaacaggaatacattcattttttctcactgtgtgaatcaagtaattatncaaatnaacatctganacattttcctttttaatatatttatatnatatatattncccccnnctttacaaataagggcaacgccttaataccnanntnnnnncnggnaaagnnaaagttaaaacacgatcagcaatcaggcatagtgcattttganaagctgctgcggagctggctggncacatcgggaaancnagtnctctggaccaannntnanccttctttganggggacgggatccnttttngccatacggnccctccatatgccgttgggccagagggattagcctnccgacaggntctggcggtgccaaggcttggnncggcctttgagaagcgtaagcttggttaaccggcgttttnggctggnnttgacaactgagtctagttctgcttgncgggggcagctttttactcagctttgtgcactttggggtgctcgctcggggtgtccgcctttctcagaccttggtttggttccctgcacagtcagtactaatggttaggcctagacacaggtgccagaagcccagggaactcctccctccctccggggcagctcagcttgtacaaggggcccattttcagttccttagtaagctaatcactacgaaagcctgagtagggaactacattctctttattcctccgaggcaggggtggggagcagacctgcggaaacctccccaaaccactaccggtgctatgccagtgcctgctacctccccatgttagcagaanctcggtctgactgctctctctcccgacgtctggtgagtcagtcgacaataaagcaaagggtggggtcctana

SEQ ID NO: 696022 - DNA, 897 bp, Homo sapiens
  misc_feature (3)..(3): n is a, c, g, or t
  misc_feature (169)..(172): n is a, c, g, or t
  misc_feature (208)..(208): n is a, c, g, or t
  misc_feature (234)..(234): n is a, c, g, or t
  misc_feature (263)..(263): n is a, c, g, or t
  misc_feature (284)..(284): n is a, c, g, or t
  misc_feature (311)..(311): n is a, c, g, or t
  misc_feature (314)..(315): n is a, c, g, or t
  misc_feature (318)..(318): n is a, c, g, or t
  misc_feature (322)..(322): n is a, c, g, or t
  misc_feature (343)..(343): n is a, c, g, or t
  misc_feature (375)..(375): n is a, c, g, or t
  misc_feature (396)..(396): n is a, c, g, or t
  misc_feature (400)..(400): n is a, c, g, or t
  misc_feature (405)..(405): n is a, c, g, or t
  misc_feature (410)..(411): n is a, c, g, or t
  misc_feature (417)..(417): n is a, c, g, or t
  misc_feature (421)..(421): n is a, c, g, or t
  misc_feature (431)..(431): n is a, c, g, or t
  misc_feature (495)..(495): n is a, c, g, or t
  misc_feature (499)..(499): n is a, c, g, or t
  misc_feature (501)..(501): n is a, c, g, or t
  misc_feature (517)..(517): n is a, c, g, or t
  misc_feature (522)..(522): n is a, c, g, or t
  misc_feature (542)..(542): n is a, c, g, or t
  misc_feature (544)..(545): n is a, c, g, or t
  misc_feature (557)..(557): n is a, c, g, or t
  misc_feature (562)..(562): n is a, c, g, or t
  misc_feature (569)..(569): n is a, c, g, or t
  misc_feature (617)..(617): n is a, c, g, or t
  misc_feature (680)..(680): n is a, c, g, or t
  misc_feature (683)..(683): n is a, c, g, or t
  misc_feature (796)..(796): n is a, c, g, or t
  misc_feature (801)..(801): n is a, c, g, or t
  misc_feature (836)..(836): n is a, c, g, or t
  misc_feature (896)..(896): n is a, c, g, or t
gcnctcaattattgctgatggggatgtaaatcagttgaaacactttgcaaaacttttggcattacctattaaagctaaacacaatcctaccctataacccaataattttcctcttaatatacccaagagcaaagagctgtgtatgtccaccaaattacatgtacaaaannnnccatagcagctttgttcataataatcccaaactggnaacaaactaaatgtccatcaaaaggngacaagatgaacaaattgttgtatatttncataatggtattactactatncacaaatgagaagggtgggttactaanatnngtnacanaggtgggtctcattatgtgangttcaagagcacaatctatggtgatgaaaatnagggtagagtttacctctggngggnggggnactgnncggggngggncaagaggggntattctggaatgatgaaaatgttctgtatcttgatttaacagtggtggtttccgggtatatttntgtnanagttttccagtattanttctnagatttgtgtgctttacttntnncttatatctgtntgttnaatcccnacaatgcattgataaaattgactaaatggccttaaaataaactttatngccaggcacagtggctcacacctgtaatcccagcaccaaagtgggcagatcacttgaggccangantttgagaccagcctggccaacatggcaaaaccttgtcactactaaaaatacaaaaattagtcaggtgtggtggtgcacaccagtaatcccgctgaggcaaaacaatcacttgngcctngagaggcggagactgcagtgagctgagatggcgcnactgcactccagcctgcatggcagagtgagactatgtctcaaaaaataaaataaattatnt

SEQ ID NO: 696023 - DNA, 342 bp, Homo sapiens
tacgacatgatagaatcgagctcggtaccgggtcttactctgtcatccagtgctgagtgagtggtgcaatcacggctcactgcatcctcaacatcttgggctcaagcaatcctcctgcctcagcctcctgagtagctgggactacaggtgtgtgccaccacgtctggctaatttttgtagagatggggttttggggttttgccatgttgcccaggctcaggctggtcttaatctcctgagttcaagtgatctgcctacctcagcctcccagggtgatgggattacaggcatgagccactgtgcccgactaacatgaacaattttttttttttttttttttgg

SEQ ID NO: 696024 - DNA, 357 bp, Homo sapiens
ggtcagtcttgtctctattttggttttggtgggttttggccagctccttcactgcaacctgttttatcagcaaggtctttatgactggtattttgtgctgaccttctatgtcatcctgtgacttagaatgccttaaccatcagggaatgcagcccagtagtttcagcctcatttttcccggctcctatttaagatggagttgcttctggttcacacacctctgacatgatcgttgcccactgcggcttccacctcccgggttcaggagaatgggatgagcccgggaggcgaagcttgcagtgggccgagatcgcgccactgcactccagcctgggtgacagagggagactccatctc

SEQ ID NO: 696025 - DNA, 254 bp, Homo sapiens
agtattgtgtaatatctattgtatggtgacagatggtaactacgacttgtggtagactcattttgaaatgtatagaaatatcaaaccactatgttgtgtacccgaaactaccatagcattgtaggtccattatgcttcaaagacaaacaaaatcatacaaaaagagatccggtttgtggtttccaaaggccgggaatgagggggccaggggaattggatataaggcatgtcaattatgtgcaaaatccccagtt

SEQ ID NO: 696026 - DNA, 1175 bp, Homo sapiens
  misc_feature (404)..(404): n is a, c, g, or t
  misc_feature (839)..(839): n is a, c, g, or t
  misc_feature (1106)..(1106): n is a, c, g, or t
  misc_feature (1175)..(1175): n is a, c, g, or t
gaagaccttggctgagggtctaggtggactgtctgatgatctgaacgacagcatgtacacagtgcattccccagcagtggctctccattcccagggctcaggtgcatggatcctaggggcgctgcactgtcgtaggcggggctggacgaacgctgatacgccgagtgccttgtggccgcagagacgaagccatcggcgcagtctatctgttctcggaggtgacatccctaacctatgtggctgcatcagatggcaccacgaaggaggttgtcccattctagtcacctgctggtatagtgccgagcagttcgatcccggcgatggagccagtggtgggccttgtgccgtgtcttgtgcttgtggcggcctctagacgatcggctgtcttgggaagtagtcggtcnctgttgctagcaagccgccgagggtgcagagggcgacatcgcacgtacttgaccactcattcccattcgtatgccttacttttcccccagctggtgggccctcaaatgttaacgctagggtagaggcgcttgagttagtcgcgaggtccatgccacttttcccacagaaggcatctaccccacaagggcatgccccccagagctttgcaccaattcgaaaggcaaagacgtacgtcacccaaaggatgtcgctaaaggtgtgcggacaggcaaacggcaaacgtattcccaggtttggcaccaaattccgggaagggcctgggggggcacaccttgggaagaatcgctttgtgggggaaccgaagggcgcgtttctcggaaattcgtggaacccttggggggtgggaggaaccgtgtggggcccttttcacaagnataccccgataggggaaaggctccgcttgggggggcaccgaacggaagaaaccaaatttcgttataccacgcttcgattgggcgcattggtcttgacagttagaggcacaacacgggcttcaccgagagaccaaaatacgcgattgggcgaagaaaccataggccgaagagacgaccattggggcgcccgaattggggggaaccgcccagtgggggcgccgctattcggtgtctcccaatattcccctagaggagaaccaccaggtngtcggacgtgtcgcgcaacacacatgtgtggccacacaatggggacccccaacaggggctggagaaggn

SEQ ID NO: 696027 - DNA, 695 bp, Homo sapiens
  misc_feature (10)..(10): n is a, c, g, or t
  misc_feature (14)..(14): n is a, c, g, or t
  misc_feature (25)..(26): n is a, c, g, or t
  misc_feature (36)..(36): n is a, c, g, or t
  misc_feature (46)..(46): n is a, c, g, or t
  misc_feature (57)..(57): n is a, c, g, or t
  misc_feature (63)..(63): n is a, c, g, or t
  misc_feature (68)..(69): n is a, c, g, or t
  misc_feature (74)..(74): n is a, c, g, or t
  misc_feature (87)..(87): n is a, c, g, or t
  misc_feature (114)..(114): n is a, c, g, or t
  misc_feature (141)..(141): n is a, c, g, or t
  misc_feature (164)..(164): n is a, c, g, or t
  misc_feature (200)..(200): n is a, c, g, or t
  misc_feature (211)..(211): n is a, c, g, or t
  misc_feature (217)..(217): n is a, c, g, or t
  misc_feature (219)..(219): n is a, c, g, or t
  misc_feature (225)..(225): n is a, c, g, or t
  misc_feature (228)..(228): n is a, c, g, or t
  misc_feature (237)..(237): n is a, c, g, or t
  misc_feature (240)..(240): n is a, c, g, or t
  misc_feature (243)..(245): n is a, c, g, or t
  misc_feature (247)..(248): n is a, c, g, or t
  misc_feature (255)..(257): n is a, c, g, or t
  misc_feature (259)..(259): n is a, c, g, or t
  misc_feature (284)..(284): n is a, c, g, or t
  misc_feature (286)..(286): n is a, c, g, or t
  misc_feature (379)..(379): n is a, c, g, or t
  misc_feature (389)..(389): n is a, c, g, or t
  misc_feature (401)..(401): n is a, c, g, or t
  misc_feature (404)..(404): n is a, c, g, or t
  misc_feature (467)..(467): n is a, c, g, or t
  misc_feature (469)..(469): n is a, c, g, or t
  misc_feature (471)..(471): n is a, c, g, or t
  misc_feature (473)..(473): n is a, c, g, or t
  misc_feature (477)..(477): n is a, c, g, or t
  misc_feature (482)..(482): n is a, c, g, or t
  misc_feature (498)..(498): n is a, c, g, or t
  misc_feature (504)..(504): n is a, c, g, or t
  misc_feature (507)..(507): n is a, c, g, or t
  misc_feature (554)..(554): n is a, c, g, or t
  misc_feature (560)..(560): n is a, c, g, or t
  misc_feature (570)..(570): n is a, c, g, or t
  misc_feature (572)..(572): n is a, c, g, or t
  misc_feature (593)..(593): n is a, c, g, or t
  misc_feature (597)..(597): n is a, c, g, or t
  misc_feature (599)..(599): n is a, c, g, or t
  misc_feature (617)..(618): n is a, c, g, or t
  misc_feature (626)..(626): n is a, c, g, or t
  misc_feature (632)..(632): n is a, c, g, or t
  misc_feature (692)..(692): n is a, c, g, or t
tcggcgggcntganagggaacctcnntgaccgagcncacgtctccncacggccaganaaatcnccggnncggcncgcatcgccagcncccagacccggaggaacggcccgagcncaggagaaccacatcttcgtcccagcnccggaggctcctgtgggcaagancgtgagccaacgggttcctgaggcccctcctggccnttgattttttnccctcncntttccnagnatgcctgcnttnggnnngnngtttacnnncntttgagtttgattgtttgggaacgnangactacacctttacactactttttgactgggtgaggtgacctattaggcacagtagacctattttttaacacttacgtattagacgacggcgnctttttttgncttgaccttganagncgtgacggacgaacagcagacgaccagacacacgagttttacctgacgtggactttggactancnanancctnttggntggggacggtcttggntactangangtttggccggtgtctttgacgttttggtggacctcgacctttgggancacccnggcgtactanancactgttactacgacgttganctananctttttggtgtttgttannacgtgggnttttanctttttgacgttgtacgtgacgtactgggtttggttttacactttttggttacacttaancta

SEQ ID NO: 696028 - DNA, 898 bp, Homo sapiens
gccatataatcagcggtatcggtgagcggggtgttatctcccgtgagtaaagggctcgtgacatctcaggtctcagcggtctcccatctggaactatataaagttcagaaaacatgtctcgaagatatgacttccaggaacactatattttctccagaaggtcgcttataccaagttgaatatgccatgaagctatggacatgcaggcacctgttgggacttttcagcacatgatggtgtttgctgtgcgcagagaagacgcaaatccacaagcttctggatgaaggctctttttttctgaaaaaatttataacctcaattgagggaccatgtttgcgtgtgccagggcataaccttctgatgctaatgtctgactaatgaactaaggctcattgtgctcacaaggttcttctactaccagtattcaggagccaaaatacctttgtgagccaggttgtgttacagccgcctgtgttgatcatcaaccaaggcttataccacaattgtgaggaaaaacgtcccttttgggtgtccatggctgtcacattgcttggaataaccactaatggcttccacgctcctatcacgagtgcgcccttagtgaacattacgggcgggattgacgggcccatggcatgggaaatactaggcgctgcagtgtgtccactgtgacacccaggctataagaggagaatgacttgaagtcagcacttgctttagcactcaacgtctaatagacctgttagtaactcttgtgaaatggcatgctctacgcactggagacgtgactgttccacaacagggcgtgccacactgcgaacacactcgggcacaaacacaaggtcaacctttctggcgctgaacccacgcgttggggaacacgccaaagggctccaca

SEQ ID NO: 696029 - DNA, 363 bp, Homo sapiens
gttaaaaggaagaaatttaaatgagaagagagatccaaaacaaaagagttttcaggaatgaatgtatgtgtgtgaatattagcagcagaggtctactgcctgtctacaatggcttgagaggagactgcagaaataaatggaaaccagaccatggccaggcatgcaagccacgttaagaaaaatgaacttaatttcaacagtgtaatggtgagccattaaaaaattttaaataggaaactgagatgaaggatttatatttccgaaagattgctctagctactgaatgtagcacagattatagagggcacatagtagtcactcactattagtaagaagtaatttataataaccattactgccaag

SEQ ID NO: 696030 - DNA, 936 bp, Homo sapiens
gcattttcaagtattaaaaatgatgagttttttaatcattttcaagtattaaaaagcattctctttacatcatcctataaaagagtgactcattcttaaggtgtttccctaggttgccacctgttgcaaaagcacattgtaatcagaggcttcctgtctacctctctcagctaagtttcctaaaatcagtatgtgcttcctaaatctctgccttagctactaacacaagctgtcttcagaaccaaagcagaggagtgttgtttgtgggagccttctggaggcctgcattacaaactcagtgccagtgcccactggtagataaggccccacatgtctcctatggagtagcagtgaaggctatagtgccagtcctgggtacgcttcagagcactaagtactcagctttaaagatgtctcgtgtggtactgggtggtttcgtgagcgcacactttgtgccaacagatagtaattatacagaactcccaaacatttggacctatctgttccctatgaagtaaaaacagaacaggttaggatttactttagagaaccagtttgaaatgtcattagtcaccaaataccttgccttaagatgtttcaagaaagtgtattttcttacgatttaattctgattttatttgcattatataagccgttgctattagtgctgggtgcacctggttggggggtcggtgacttatggtctgctatgggagcgttttggtactctcgaacaggtctggtctggacttgggactggaatgtgtcccttaacagggaaggccgccggtaatccggtcccggcgggcccggattatgtcctctttcccgttaatctttttgccgattcggttccgcacacttgtaccgcctctccgccgggcggggccctgggggccacgtgttgggggcaccctcgccgcccgccgttgtcga

SEQ ID NO: 696031 - DNA, 192 bp, Homo sapiens
tcttgtcagcacgagggaacgcaatggcgcggccaaacatcagtttcaataatggctgcttcaagcgcgggcccgcgctgctgacggatacgatgggggtgaagcagcagttttccacgtttggccacgagctagtgaggggcgcgattgccgacgccaccacccaggaaatctccaccgctatgaatggcc

SEQ ID NO: 696032 - DNA, 399 bp, Homo sapiens
aaagtaactaaaagccttcctttcccagtttttggcatccctacccctactgattaaacaagaataagagaacattttatcatcatctgctttattcccaaaaaagaagttgtgatgaataaatctgcttttatgcaaacccaaggaattaagtgggtttgtcattgtccttttccctccaagataatttattcccaaaggtaagataaatggaagactcttgaacttgtgaactgatgtgaaaagcagaatctcttttgagtctttgctgtttggaagattgaaaaaaattgttcagcatgggtgcccccccaaaagtaattttaagccctttaaatgtccccattgaaaccaactggggagttggttgctattgtaaaataaaaaaaactgttttta

SEQ ID NO: 696033 - DNA, 996 bp, Homo sapiens
gctagcgtcgttgaatcctttatagagatggaacagtctgtattctctgatgctcatactagatgagtaacagactccatactctgttgttaaaatccattcgagaagctcggacacgagcacctgtcacattgtaaaatagttattcgggacggtaggacacttctgatacgtgatgaggactttacgtggtatgggtataaaagaacgggctcatctcagtaaagttcttgagctctgtgaagcgtcatctccagaaaagtaaagaccgagattctacgaacgtattcctgtcttgctcgattgatattgtcacaatcacttcattacccgacgatttatgatgcctccagttgcattgttgtcgtcgccttagatgtttctcctatcgtacattgtctgcatgtcaatatggtaatgcttttattcccgtgactttcctgccagattctaatcacatgaggctctcctcgctgcaatgctttcttgctgaaacctgtgttctatcaaacgttgtctacctttggagatctcgtaagctcatgatggaggagccaattaccgcctctgtgaatccctcttgctccttcatcacagaagaatgtctcgttctacaatcatcgatcattacaaggcatggtgtaactccctagtaattttcaatgggcaagcctgctcagatcagggttcaccttgctattatcaatgtccccttaccaaaatccaatacgcatttgagcacctttagggacctatcctggaaattccctgaacgctatcacttgtatacacaaaggggctttggccccttttgaattccaacagagtgcttgctcactgaagatgctgggccaaattcagcagagacagaggccctgccagggagacatctacgcttgtcaccacctgtacacacgcaacgaccacaatccaatcccaaaccctgtctgagtcagctcgaaccctatcatcaagactaccagttcggtgcctaat

SEQ ID NO: 696034 - DNA, 189 bp, Homo sapiens
  misc_feature (13)..(13): n is a, c, g, or t
attcaccgtgagntatactatgtatgagcagcaatacagtattttggcacaacaaaccgataatggataaatccagaactacttttatcttctgatatcatagaaacaatgtccttgtcaacttctttaggggcatccattgcccagataaagtcccagtgattgtaaaaaggaatctccttgtgataa

SEQ ID NO: 696035 - DNA, 127 bp, Homo sapiens
aacgccgctgtgaccttccgcctgtggcctgtcaaggttctccctactgtcttcctgcagtcgtgctgtctccccgagtgcattcgcagacacggggccgcccacttcccctttgcgccattgcact

SEQ ID NO: 696036 - DNA, 327 bp, Homo sapiens
cctgtgatctatatagtctgtgtcactgcatctgctctccgcactgttatctcaccattgcctttgtccccgtgtagatgtcccttaagcccttattgagctggattctggtccaggcctcatctcttcctattgcctatctctctcatgctccccttgtttctgggatttcgtccttgtcctcgtgccaggtatgtcttactttggtgctggcaagtggtagttgtatgaagcttcctctctctctctgttcccctggcgcagaggcaccgtgtgagactgagagagagagagagagagagagagagagagagagagagagagagt

SEQ ID NO: 696037 - DNA, 132 bp, Homo sapiens
gagaccttaataacaaataggcgtattaaaattttcacattgacaatgatagacacatttgatgtaataaaacttggtaggcttgatattttaaggaatagaaacctagcaatcttattggagagacaagaa

SEQ ID NO: 696038 - DNA, 426 bp, Homo sapiens
aaaattaaagggggaaagagaaatattctagttatcagatgcagaagcaaaaagagcaaaaatgtgcaataagaacaagccaagtaactttagttaacgaaactggagattaacaatggaattacaggtttgtgaggctatagtggtgcaccacatttaaaaccaggcaggaaagagctatttatattgaaaggtggaatgagggcatttttactaaagcaaattaacttcttgtcaaactggcaaaacaaaaaaaaaatggagcatatgagtgttagtatactgaaggcatgttataccagtttctgtgcagcatgctaaaagttagaacttcttcactggtgcttatcaatcattactagtcacgtttttgccccttcttgccaaatttcaggcatgtcttattttagatggagtatagctttt

SEQ ID NO: 696039 - DNA, 480 bp, Homo sapiens
  misc_feature (14)..(14): n is a, c, g, or t
  misc_feature (40)..(40): n is a, c, g, or t
  misc_feature (113)..(113): n is a, c, g, or t
  misc_feature (144)..(144): n is a, c, g, or t
  misc_feature (159)..(159): n is a, c, g, or t
  misc_feature (273)..(273): n is a, c, g, or t
ccaaaaacaacacncccaaggcaggtggcaaactacagcntgtctgtttctggtaagtaaagttctccctttctgtcgtcttctcgcagccctttacgggttgcgagaagacnacagaaagccgagtgtgtataagagtcattncttttcaccagaaantacagaatttctggtaggctttttctgaatattgaaattgattataggtaggtgtggtgcctcagcctataatccccagcatttgggaggctgaaggtgtgtgaatcacttganccccaggagtttgagaccagcctgggcaacacagtgcctgtctctacaaaaagttcaaaaaattagctgggcatgatggtgcatgcctatagtcccagctactcggaaggctgaggtgggaggatcacctgagctggggaggtcaaggctgttgtgagccattatcgtgccattgtactcctgtttggtgacagataccttgtctcc

SEQ ID NO: 696040 - DNA, 131 bp, Homo sapiens
acccaaaggctttatttttatttttctcaaatatagaagtacctttttttcttttattatacaagtacatacttacggtcaagtcagtcaaatattacagtaaatttatcatgcggaaagaggagagtggg

SEQ ID NO: 696041 - DNA, 445 bp, Homo sapiens
  misc_feature (12)..(12): n is a, c, g, or t
aactgaagaatntattgtctcaaactggtgtgctgtttatggcctcttttggagaaggagaagagggtgaagaagaagaaaaaaaagttgactccagtggagaagctgagaagagagatttcagagctgctcttaggaaacaacatgcagctgaactccatctaggggattttttagtttttcttcgcagagttgtgtcttcaaaagcaattcaatcaaaaatggcttcccccaaatggacagaagtgcttctaaacatagcatctcagaagtgttcttcaggtattcctctagttggtaacttaagaacgaggcttcttgctcttcacgtccttgaggctgtgctaccagcttgtgaatctggtgtagaagatgaccaaatggcccaggttgttgaacgcttattttcccttctgtcggattgtatgtgggagactcccattgc

SEQ ID NO: 696042 - DNA, 334 bp, Homo sapiens
  misc_feature (27)..(27): n is a, c, g, or t
gatcagttgtaatcagaatacaactgngtcttgtagttgtaatatgttctatcttaaccaccactttcgtaccaggaacctgctcaggtttgttctctagaagctcccaacatagatagtctacatttcagactactaagttattaacaaaccctttgggcccatgttcactttagggttgagcatagtgtgaggagatgtaaattaaattataatcctatatgtgtgtgtaataaatattaaagtgtataaattaaacagcagattctaagtatccaacaagagtcaaataaatgatacaaagtcaccaaataaataatatttaatctcatct

SEQ ID NO: 696043 - DNA, 108 bp, Homo sapiens
gtcggccagctgcgacagccttagagcatcttatccgaagtacggatcggttgcgattcccttactacattgtccaacatgcagaggtgtcacttggagactgctgcg

SEQ ID NO: 696044 - DNA, 882 bp, Homo sapiens
tgtcctgctaccgggattaaaagggaagcttttgggggtcgcggcccgaatcattggggcggggggtccgcgtccccagggaaaggttgaaccgatttccgtcgccattcccgattccttcaggtgatccggcgttctgctcttaagcagaggtccaaatcacgcggaccttaaaaccccagtgggtgttgaccgggaccttaagctacctcggggtcaattcacgagggcggaggggtgagtggcgcgcagaacagtgtggggatcctgagcggtatcctgggctcgtttccgaaacatctctcgcattatgcgagttcaacaggcagtaccagtgcggggtgcctcgtgggcgactacgcttgattcccagttatttggaagcatgtgtttctcggccagatgggtggattggatgaggatgcttcgggggagatgggacacagtctatagtcctagagctatcatccaggggctgaccagggccatgtacagccggcgctcgaagatgaccccttggtgggaacaccatgggtccatcggaggctatgctgatggagagacgtttcctcggttatgtgggacatggcttggggtacgcctatgagagccctttcgtggggccgacgggttatgggggcatcactggggcttcacgcctctgctgagagatgttctggaaaaagcgccagtgttaagcccagaaccgagggcccgcgactttaataaacgcttgcatgcgaattgctgtactacggaagatgccggttcttacaaccggttcaaccgccatgtcccgaaagggttgaatcgggcccttgtttccgcacccatgggtatgcccatgtcagtgtggaatgaaccgatgtttcgatgatgcca

SEQ ID NO: 696045 - DNA, 116 bp, Homo sapiens
gcagtaatgggcgaacaacagaagcacattaggatatggtgactttgtagcttgtgagctcagatcttgggactgagtcccaattcttattggtggatactataagttaaggtata

SEQ ID NO: 696046 - DNA, 555 bp, Homo sapiens
aaggtccccgtctcaccaccatggacttggggctcaggtgactccatgaggctccttcaacaggctttttggcccacaaatactttaagcaaatcatttaaattataacagttaatggttaaggggtgtataggctgtaactgctaactcctaggaaacagccttttccctggacacagatggtcccatacgctgagccacgtgaaactgctgatgtattgtttagatgcacacacaatggcagcgtttcatacaggtcagcaggttagaccggcttttgaccatattcatcgctatttaaaacctgtggcacaatgaacgcttattttacagactttctaatttgaccagatttcttaatgaatagacacagaattaactaaaaacagtctcaccccatgtagtgcgccgtgtcctgagagaggtgccctccctacgaggagggaagaacaggccctggggtgcagaggcccggcacgtagagaacccagatagacgccggtggtggaactggtcaaactccacgcccggcctggaggttgtcaggttgctgtg

SEQ ID NO: 696047 - DNA, 176 bp, Homo sapiens
agcagtagatatcattcacttggagggagactgcacatctgacactggataactagataaagatttggatattgattctatatccagacatgctgatttctggcaccagacataagccagtagtattcgatagtatgagaacgagctgtcctgacgtgaaaccttttaggacgctc

SEQ ID NO: 696048 - DNA, 219 bp, Homo sapiens
agctgaatatcttgtgatgcattttgggagttcagctatcaggacaatagactcttgtatctcccaggattactatcaagcatagcggcgctatcttgctctgttcgtaactcagcactctgtcgtggaaagctccacatccattacagtcaaagtctctgctccttcaggaaccgtacatcttcctggccttcatccattatagcactcgtgatttcg

SEQ ID NO: 696049 - DNA, 294 bp, Homo sapiens
gactatctggtaccgcgaccatgctcattaccgctatgttgctattggccactggcaggggcgcctgcatctatgcctgctgaaaaagccgcaactgcaccaagcatgcagccacaaacgacgacccaaattcgtcgtcatatatgaggcggtcaccgtacttgaagctgtgaatgccatgccatcacactgaccgtgcatcacccacatcgactcacgcccacggatgatcaggcggctagccgattgtatagcctggtctgcagaggtgcaatggcgctctgcattgagtgc

SEQ ID NO: 696050 - DNA, 672 bp, Homo sapiens
  misc_feature (529)..(529): n is a, c, g, or t
  misc_feature (636)..(636): n is a, c, g, or t
tcccccaaataattataacttaagcaatatatttctaaataacaaaagagtcaaaaatcacagtgggaattttaaaaatattttgagttaatctaaaactatggtattaaatcttgagctacatagcgatgcatagagagaaatcaatagacctaaatacatattttaagaaagataaaaaactggaaaataattatctaattatccagctcaaaaacagcaaattaatcctcacccacctctgtaaacagaaggaaggaaaaaaataagaaaagggagatcagttaaatagatagcagccataaaaatagtaatttacaaggtgttcttaaatactacaaattaataaactccacagactggtaaataaataaatgagaaacagagtcaaattatcaaaatcaaatgaaaagagaatgtaaagtcttacaggtcgttgaattataactcgagggtataaagcatctgtaagtgaaaaaactactattttaatagaaaggaacaaatcccttatgaaaaacatgacagnccaaaactaattagagagtaataatctcaatagtgtctatctattcaaggaaacaaatctattattaaaaaatctctccacaaagagaagcaaaagaagccacaacncaaaggagtacataggcaaagaacaggcgaagctca

SEQ ID NO: 696051 - DNA, 1071 bp, Homo sapiens
  misc_feature (255)..(255): n is a, c, g, or t
  misc_feature (462)..(462): n is a, c, g, or t
ctaaaaccgaacttccatacgtttctacgcagcacaacctttatgatcacatacccattatcttaaccgcactaataaaggtattgcgtcgattaatagaatgtgtaacactccatgtggcgctcaactacgtaccattatagcctacccgacacaggcgcaacatgcatgtacatataagattcataaactcagatgcacttaaatcagtacgcacaaaaggagctacatccgcctgatactcgctgtactggncatacagtgtgaggttacatctacgcacatatatagcttctgccaatggtacgaggccaaaatgacttagaggataccaacgacagataccaagtacagaacgtcataaccctaaccacacaagcgtcataagagcaacatccgctgcctcatatagatatgcataataatcgatgcgagagatgattttagtacgtgttaccaggngcagacaacagtcatatcctgaggtcatgggcatgaaatacgcactgcgcattgggtgccataagaattagtatacgtccatgtacggttctcacaccctattataattttgtgggcacacagcagaaaatgccacttacatacgaagtccacctttggtacataggtttttacaccgtggtcaaggttccacatacggaagggacaccacgtcatcctttttgcgcagcaccttacgtgaatagacatagcccttgctatgacgcaggaagttacacacacatactttaaagtccaactcgcagtaaggtaacgggccgtacaaaatgtcaatgcccaagccgagaattcaacgaaaatggccgttcaaacgacctcaaataagcccatttaactctaatagagatagttccccaaaaggatattatagcctgtagactttccttcgacatccgcaaatgtggggacccaaattcttaaattcaagcactagttaagaaggaaactaaactggttaagtactaacagttatacactgacacatgggttcgtgccatccgggcattaagggctgcggtccggatttagaaacgcttggaatgagcagat

SEQ ID NO: 696052 - DNA, 965 bp, Homo sapiens
aagcagccgtatcaatgctaaggggccattcacgggcggggtgcgcacgagtgacactgatctaaaatggtgaggagagagtcgcgacgagcactctaatgcctgtattttattgagttcttgatggagcggggtggaataatgctacagaagtttaccctatgtgggatcaagcatgaaccctgtggatgtacatgcttgcattatgagtggtggagatagattgtgatgatcgacgcatgcaagggtgtgttggtctatgaacaggttctggaggactcagggcatttgggtgattagtgctatctattgtcccaaagtatgagatagttagcgctaaggtaggtaactctgtattatgaatcgccttgaagaattcggtgccaggagtttggtgcagaaatcgtgtaagtggcctcgtgaggggcattgttaagcttctagagcagggtgggcgggaatcattataattcgtttggggaataaactactaagaggctgccttctgcattgtatttatactggaacgtaggctaatttcaaccagaaaagatggtgagatcatgccataaccgaggagttggtagatgataccatgaagcaagtgcaacggaggggcacgtagacaatgttgaaaaggtcctgaatctagaatatggcgggactctgattatttatcgtctggggatagatccacttggtggggtggactgtactgggcattgatgtctacaatgaagcagggagtctgcggaaagatgaacgtttagaagttaggaatagttaagtagagtcggatttaccagagggttgtactctgggaatggaggtgtgacctagaaaaaagggctttggagaggagatttgagacgcgggttgggtgcccccaaacagggggtgggtggaaaactccgaagagggggtttcaaattgtggatggaaaaatggggaaaataggcagagat

SEQ ID NO: 696053 - DNA, 605 bp, Homo sapiens
taagacggagtctcactccgtcacccaggctggggtgcaggggcgccatctcaactcacgggaacctctgcctcccgggttcaagtgattatccggcctcagcctcccgagtagcggggattacagggcgcgcacaccacgcggtggctaattttgggattttcaagtgggagacggggtttcaccatgtgggacaggctggtctcaaacacaccttcactttctccacgggaatttggggttatcaggtaaccagtaacaatattctcatattcccatgaggagcaagaggttgaggaagaaaagaattcacactagtaaggtagtatccatttctgagatgctacagcttggacattatgataacccaatttacaagaacaggagggtcattaaccaaaagggacaactatcgctaaagcggaacggtagtacaaattaacacttatgtccaaattgggagcatattcactaagggacttggcaaatcagataatgggcatggcggcacaatttcgggagtcgggcactcatactgggagcactgtaggaaaatatcctgggtctaggagcacaatgctgaagtatcaggggatgaactatcg

SEQ ID NO: 696054 - DNA, 644 bp, Homo sapiens
agagaaagggagagggtgaagaagtgggggagcgacagcaacagatccttggagagggaggctctgctcatgatttatccccagtgccttatttagttcacttggtgaggtcatgttttcctggatggtgttgatgctagcagatgttcttcagccgactggacattaaatttttggggggggggcaccatatgagacgttcaaaaaataaaatttaccgagagataagtgctggaatcgctgaatcacacgttgccaatagatgatcagtactggtgcccaatcatcagctagagtgaaagcgctcagcagagcttgataacaccaaaactctgagaccactgaccttcaaaaacttcaacagccctgagtgaaaagcccaaacacattgatctaccattctaagacgctgtattgtctgtcctctgcgcatggcagaagtctctttctaccacactggctatatactgcgtgagccatttatttgaaactatcctgcacttcaaggcatcttatactatatattaacccatgtatccctagtacctagcacagtcctggaatacagttacctactaaacttcacgaccgaaggtatcatcgcgcttcacttttcaagtttcacggcattcctccctaaaaaa

SEQ ID NO: 696055 - DNA, 389 bp, Homo sapiens
ggtcgacgattccatttatattaagttttttaaatgctctaaactgtaggctgggtaaggtggttcacatctgtaatcccagcatttgggaggccgaggcaggcagatcacttgaggccaggagtttgagaccagcctggccaacatagcgaaatcccatctctactaaaaatataaaaaattagctggtcatggtggcacgcacgtgtaatcccagctactcaggaggctgaggcaggtgaatcacttgaacccaggaggcaaaggttgcagtgagccaagtttgcaccactgaacttcagcttgggtgaccgagcagactctgtctcaaaaaaaattgttggaagaaaaagttttgccccataattggttctattacaatgttcacg

SEQ ID NO: 696056 - DNA, 265 bp, Homo sapiens
cttgaggaaccactaccagcgcgtcgttgccgtcatacatagtgtcagagctgagtcatgggagagagcacatatgttgttcctaggaaggggtagtggtgaggccgtgtattatactaatgtttgtgtattcggctatgaagaatagggcgaaggggcctgcgacgtattcgatgttgaagcctgagactagttcggactccccttcggcaaggtcgaagggggttcggttggtctctgctagtgtggagataaatcatattat

SEQ ID NO: 696057 - DNA, 1206 bp, Homo sapiens
  misc_feature (477)..(478): n is a, c, g, or t
  misc_feature (484)..(484): n is a, c, g, or t
  misc_feature (487)..(487): n is a, c, g, or t
  misc_feature (515)..(515): n is a, c, g, or t
  misc_feature (522)..(522): n is a, c, g, or t
  misc_feature (526)..(526): n is a, c, g, or t
  misc_feature (528)..(529): n is a, c, g, or t
  misc_feature (532)..(532): n is a, c, g, or t
  misc_feature (539)..(539): n is a, c, g, or t
  misc_feature (559)..(559): n is a, c, g, or t
  misc_feature (576)..(576): n is a, c, g, or t
  misc_feature (579)..(579): n is a, c, g, or t
  misc_feature (594)..(595): n is a, c, g, or t
  misc_feature (597)..(597): n is a, c, g, or t
  misc_feature (602)..(603): n is a, c, g, or t
  misc_feature (612)..(612): n is a, c, g, or t
  misc_feature (622)..(623): n is a, c, g, or t
  misc_feature (631)..(631): n is a, c, g, or t
  misc_feature (634)..(634): n is a, c, g, or t
  misc_feature (636)..(636): n is a, c, g, or t
  misc_feature (647)..(648): n is a, c, g, or t
  misc_feature (651)..(651): n is a, c, g, or t
  misc_feature (656)..(656): n is a, c, g, or t
  misc_feature (663)..(663): n is a, c, g, or t
  misc_feature (666)..(666): n is a, c, g, or t
  misc_feature (686)..(686): n is a, c, g, or t
  misc_feature (692)..(692): n is a, c, g, or t
  misc_feature (695)..(695): n is a, c, g, or t
  misc_feature (714)..(715): n is a, c, g, or t
  misc_feature (727)..(727): n is a, c, g, or t
  misc_feature (747)..(747): n is a, c, g, or t
  misc_feature (758)..(758): n is a, c, g, or t
  misc_feature (768)..(768): n is a, c, g, or t
  misc_feature (836)..(836): n is a, c, g, or t
  misc_feature (864)..(864): n is a, c, g, or t
  misc_feature (1075)..(1075): n is a, c, g, or t
  misc_feature (1080)..(1081): n is a, c, g, or t
  misc_feature (1084)..(1084): n is a, c, g, or t
  misc_feature (1086)..(1086): n is a, c, g, or t
  misc_feature (1106)..(1106): n is a, c, g, or t
  misc_feature (1112)..(1113): n is a, c, g, or t
  misc_feature (1135)..(1135): n is a, c, g, or t
  misc_feature (1186)..(1186): n is a, c, g, or t
ctatttgagacagtgttttccccccccctccgcggctcaaagaagaaatcgtggcttcccacagagtctcgccccccgtttctcggcccctccccaagggaggagaaggatttttcttccccctcggggaagggaaatttcccaggaaaggaaatttagagaacccttcccagggaagggaaaagaacccgccacaggtccccccactgagaagccttgaagggttccttttgaaaacccaaccttgggccttgaggaaaaaccggagggggccccccgggggaaaaaagaaagagtggctttctaaagaaagcggcccattatgagaaggagggacccccacccaaccctctcacagtagagaatggcgccagaaagagaggagaaaccgtggagccccccaccacagatatgggaaaagccttataaataaaaagaggggaccccgcagagagggggcacacacacaaatgggcnngccccncanactggggaacgctttgtccgcaagaganaaggagntaangnnacncacttgnagaagagaaagttcgcgganagagaccccacagagantcncccacaggagccccnngnctganncgagagagnctgagaagcnngagactanatntntgtgttttctnnagngagancttgagnctnttttcttccgccactccccntcttcntanaatatttcccaaagagccnngtatactcgggnccacgcggtgcacactttanattgtgttgtnccgctccctngagcacacaataattttatagagaagctataatgtataggagctcgtatataaggtatagaatcccangagtccacgagactcgtaaagaatgttngtgtttatagggggtataaaggggaggagaaactcgagaaagtgtgtttaacttctctttttctataaagtgttggtgtctctttctaaagtaaggctatttttttcttggtgcactcttttctaacttcacgacaccttggtgtactgggttaaatggctaagtactgtaattggcttctgtgaaaaacacatatattgtgaaaaagagntatanntangnggctttttttggaactgttnagaatnnctgaaaatctgttcacttttcnatccccattttgtccccattttacccagatgctactggacttgaatggttnataaaactgccccgtgctga

SEQ ID NO: 696058 - DNA, 101 bp, Homo sapiens
tgagctcggccccacttcatcgcagacttctggcagatggtgtggagagcggctgcacgtcatcgtcatgctgacccgctggtggaggatggtgtcagcag

SEQ ID NO: 696059 - DNA, 381 bp, Homo sapiens
  misc_feature (38)..(38): n is a, c, g, or t
  misc_feature (209)..(209): n is a, c, g, or t
gcctagcaggatctgcaaagtgactcttctatatctancacgcatcagatgacgatggcttccagaccaggagccgggcagagggatggctggtgtcgatggtgccaaaggaacttaggattcagatgctttggaaatgaacttttgctggtactgaaaaggaaagagcattctctccctttagagaatagaggtttgagtgctccggntctgcaaacagtgcctacggttggcacgttggtgtgtgcgaggggttcggaggccccagtacatctgatcacctcggctttttgtgagtttaggtgttcagttttaatcttgttattgccacaggaacatgtgactctttggggagtagatatagaagagtgcactttttgg

SEQ ID NO: 696060 - DNA, 189 bp, Homo sapiens
ccatggatgattccccaatatcaatgccacgccgtggaacccgactcatcgtctggctcgtacgattggttctcatcggttctggctgtcggaaaatccctggcgcttcctggccgtacacagatgatgacaggcctcccagacgaattgccgattaagacaggggaaactggcgtcatgcggatgatg

SEQ ID NO: 696061 - DNA, 294 bp, Homo sapiens
agattttccaaatagtgggcctagtgtaaaagacacccaacatgtataggaaatcaaacaaagctatgtgcacagaactgaaatgagtagggctgggaagccttttacagaaagaagctttcacattattttattcctttctaaacatgaatgggtcaatcaaagttttaaaagcaatagtaatttttccctttacagaacattaatgatgttacagaataatactgtcttgaaatgataaaacaagttgacaccgacgtatatgtttttcctgcatccaattctgctgggaag

SEQ ID NO: 696062 - DNA, 1734 bp, Homo sapiens
  misc_feature (371)..(371): n is a, c, g, or t
  misc_feature (641)..(641): n is a, c, g, or t
  misc_feature (1454)..(1454): n is a, c, g, or t
gagttgccttggcgcctctttcttcctggcatgcgctacgaccacattatggggggttgtctctgccttatgctgcctgcgccgccgcagctctactatttacgaccggggtgggtgctccgccgttgctttttcgtttgtacaccgcgctgcgtccgcttcccccggcgagacaccttttttctttgcccgggtcccccatagttttgtattcgtactgctactaatgtacaatgggggggggcgcccttccccacaaaaggtggtgtcgacctcccgcgtcttctccaatcgggtggtggtataaaatccttgtgagtcggtaacacgcccgttgcaccgggacaaatctgttgggggagacgagaaanttctgactaacaagagcagttgtttatgaggtgcgcccaccgcggcggtggaaattttccttcttgtggggggtgttctcccctctttctcggcggaaaaaagagaacccctcggtgtgttgtccccacacaaaagaacacaaccagcttgggggaaaataaaaacgcttctttttcgtgttggcgcccccctctttaatagggccttaatactccatcggcggaaggggaagatgaacacaaatagcggaaattctctttttgtggggntcctgtatcaccacagcatattaacttcctcctgcccaccagaaggtgtgtccgccacattgccgcgtgtgggttaaactcttcaccagcaggggaagccgtcttttccaacctagtggaagtgccccccaccagggggggcctgtggaagagaaccctcttttcaacaaccacacaaagggggggagagaaatatggggccaccaccacagaggaggggcgacaataaaggaggccgactatttcttctcaccccgtcttgtgaggagcccccgcgttgtgtcctccccctcggacttttgatgagagaacacttcttctcacaaccaagaccttcggagaagacgccaccgcttcatcacgcgagaggcctctttctggggtccttcttggggggttgtggaagaggccacatcgtgccgcccccaccaacaacccgccacaggcgccaccaacataagatgacacgccccaacactacgcgggcgttcgtccccaacacgtggtttcttgtggcaacattgtcaacacccgaacacaactggtctcaccacagaccaccaccccctctggggtctttagaatatggggcccaacagacactttgtgtgggtgtgttgttttgcgcccacaaagtgttctaacagagaggcgccactctgagagagtgtttggtgtgtccccgagagacagagtgttggagagagagacactctccacacagagcactgagcactccccccgcggagataataacccccctgtagaagagagatgtttgagatctacttctccaccagagcttgtctcggncacacagagattcgagaggctgtgagagagaagccccctttggccacatctcgccacacaggagagatatagggcacacacagggagacatcttttctcttctgagagtgaccacgtcttgtgcaaggcccctgtatgtcccgcccccagggctcttgaggcgtgccctggcccccggtgctggcaatcttggtggagagccggacccccctctcccctcacaattctcccaaggcccctggactcacttttgtaaccaactcctacccaccctgaccca

SEQ ID NO: 696063 - DNA, 386 bp, Homo sapiens
gaagtttacctctccctagtactatgtccaggtataccgtggaaaaacacagacgagacacacacacacacacacacacacacgcacacacgcatgcacttatctcccccaaggtcgtgtgccatgtgcttatcgctcggggacgtgctgtagaagtgtgccaccaagatctggggcctcttatacgcaacgctgtatctccccctggaggagtaagagcaggggacagagtcaggagacttgtcgctagctacatgatctgtggacacaccatcatccttttacagggcctctgtgtctagtcttagggcatctagcttcttccagtttctgaagccctctgatgagatgtctggaaagctttacccacctgtgcccaggtatct

SEQ ID NO: 696064 - DNA, 2023 bp, Homo sapiens
  misc_feature (1419)..(1419): n is a, c, g, or t
  misc_feature (1632)..(1632): n is a, c, g, or t
gttcgttgttgcttgttgtgtgtgaagtcattctcacgtgtgggttgttgtggctgtgagtgcatgcgtggtgtgttgtgttgtagcgtgttgtgatttgctacgtatgtgtgtggtcttggttgaggttcgttccctgtttgttagggtgtgttcgtcgtgtgtgtgcattttgttttgctggtgtgtcctctagcgtgggtgtgttcgtgcgctcgtgtgggggcacgggggtgggggggcttgttcgtgtgtggattgtcgtttcttagtttgtgcttgtggttgtaggtgtgtgtcgctcgtgtgtcgggtacttcgggtcgtttcccttggtgtcctggttgtaccagcgtggtcagggtctgttcgaggggtgtcccctcttgtgttggtgtgtcgtcaccgtcgtccgcatccgaggttgtttctttgtgttgtgtcttctgggtgtgtagtttggctcttccttttctattggtacttctgcggtatggttgctctctcgtgggggtcgtctggtttcgcgtgctgccctgcatggtctcctcgcgtttgttacgatggggcgcctacgggggggctgcccttcgtgggggatggatgtgtgttgatgaagtgggggcgctgtgtggtttcgctcacggaagaagatgtgctacgtttgcgtcacgtgttggtgctatgggctacagactgttgtcgcgcgtaggtgacctgggtgcgtgtttcattattggggggggcgcttggtgttggtatggtgcgtgtctcctgtgtgtccgcaagctgaggtgtggggtgcgttttctgcgggttagtgcctccccccgtagggggggcgcgccgccgatggctcgggttggtgggagccccactgttggtggggtgggagccaccgtcgcttcgggtgtgtcataaccgttgcgacggtgtttggaggggcccccctattgccacgagtgggggccgcttgtggtgcgcccgccaacgaggtgctgcttgtggtggggacacagcggggttctcccgtgcgcgccttggttcgccggctgtgcgcctggtgtgggggcgccgccacgcatggctgggaccaccgcagagggtgtggtgccccccctgtggggtgttagaggcgctgtttgcttttgtgtgtgggtttgtggtttggggggttataccaggggggatgtccactgcgtccgcacgaggggtgtgtaatggtacgtagttatcttctgtcgtgagaggttgtttcttgtggggggggcccccacaaccgtctgggttgctctgtgtgaaaccccgctgagccttgtgagcccccccgttgggcagagagagaggccgcccgcgatgtgtgatagtggtggtctggtccgttgttgttggcgttgtgttgttctgcattgccgcacnacgcggtgctgccccccgcggcgcacagcagtgggcggacttcgagagagggtgtctcccccccggggtgttgtgctgtgggtgcacaaagagtgcgcaccacatattggcttggtgtgtttgtctggggagaactctctgagactgtgttaagagtatgtttgtgtatgcgagattctcacagagagagtcctctcccgacacacacacggngtcacaggtgtcacacccgctcactgtatgtagacaccgctgcggctcacactggctcacaggggtgtgggtctctggcggaacttgtcttgtgtcacacacaagtgaattcccgggctcgctctcatggactcagctcagcgacatctccacgcgtgcgacaacaagacggccttaaggggtggcacgctctagacacccactcaccatacacgcgtctatttcttggaaaggcgccaaccacctgagttggtctacatggtctaagggccaatggccaagacctgctgtgtccttctctctccacaaggtctcccccccccgctccaatgtcaaccgggtgacagtgtgtttttttgagtcccttgtatgaattaaaggctgggaaacc

SEQ ID NO: 696065 - DNA, 137 bp, Homo sapiens
acaactgagcactagctgggccccatggcctcgcacagttacaatacagtgctgtcgctgtcacacttgccagagtgacactgattgtccactggtctatgtatacaagtgacatctgcatggtgagcacagccggg

SEQ ID NO: 696066 - DNA, 367 bp, Homo sapiens
  misc_feature (161)..(161): n is a, c, g, or t
  misc_feature (187)..(188): n is a, c, g, or t
  misc_feature (192)..(193): n is a, c, g, or t
  misc_feature (199)..(200): n is a, c, g, or t
  misc_feature (268)..(268): n is a, c, g, or t
  misc_feature (286)..(289): n is a, c, g, or t
  misc_feature (291)..(291): n is a, c, g, or t
  misc_feature (293)..(293): n is a, c, g, or t
  misc_feature (300)..(300): n is a, c, g, or t
  misc_feature (317)..(317): n is a, c, g, or t
gcattttcatcacagaaaagagttgcatttgtattaacaagaaatttgtatacccacgcttcagctactatctaatcatcacccgaagatttaagatacaccaaatttcagtttgtttgtaacattgttcatctttagtgcactttgttttatataatacngtatgcctgttatattattttatttnnttanngcaatnngcgatatagcatacccaaacaaagatgttctcgatacagtctggcaaagactatcccaaggttatttnaatgaattcagacatttnnnncngnggatatnctccatcctaaaaaagnggcaaccaaggaaatatttagatgcaacttactagagtgatgatgtgaaa

SEQ ID NO: 696067 - DNA, 421 bp, Homo sapiens
gggctactgagaggcactggccagacagcacgagccaggatgtagtgtccctgggtatggactggaaatcctcggccctcgcttgcctacccccgccctggtcagtgcacagagccaaacttgcggatgaacttggtgaacaggttccgaagcttcatgcggaagttgcgccgcatgtcatctgagagcttcccaatggtttccatcttgcggacagagcaccaggctttcagggaggcgagccttccatgctgtgccccctttaatgctgtccagcccagggacgcagcgtgatcaagcccagctgaggggagggttagcgcgggcctgatcctgggccacaccctgggccagtcatgcttccctcgggtgggcagggcccatcttttcccttgagcctccttaagaacccatgcctgcc

SEQ ID NO: 696068 - DNA, 417 bp, Homo sapiens
gtaagtggcctggctgcagcgggggtgctcctcccagcacagacaccggatttggaggagactccccctgtagatgctctgggcaggagcctcctccctgccctaccacagggcaccagaatgcaagccgtgttgggcatcaggcaagaggagtcaggtctggtctcatgtcctgttccttctgtgtgacactgaactcaacttccttatctgataactggatgcaactgcaaaatcaagcatttgcctccacccccattctgcaggcagcctctcatctgtctggagcagcagcatcaggctccctgtcactcactcccaaccgccttggtgcctgcagagggggcaagtcccgtgaccacccttcagagcagagtgggtgttatgcccaggttgggcaggcaggacctgggtctc

SEQ ID NO: 696069 - DNA, 202 bp, Homo sapiens
  misc_feature (83)..(83): n is a, c, g, or t
  misc_feature (181)..(181): n is a, c, g, or t
gtggtgtaccgtaagactctgaaagttgataatgtatccctcccaatccctgtatcacatttcttatgtcatacagcattgcnagtacaataatgttgaggatttggggcaagaacaggtgttatgtccagttcctgacattaataaaatgctgctaatgttaccctattaagtatgatgnttgctatacatttaaaaacac

SEQ ID NO: 696070 - DNA, 103 bp, Homo sapiens
caccccccacacacacacgcacagcatgctgtgccaggccctaaaccctctacactgggtctcctctgaacccaggaaataaaaagtctgatcccgtcgacgc

SEQ ID NO: 696071 - DNA, 297 bp, Homo sapiens
actatatatatccaacagacagcagaaactcggacctatagtaccacaaccacaggaaatgaattctgccagaaaccaacgaggacgagagggctggagctccagatggaactctagcccatagcaagaccttgcagtgcaactgcagcacatggatttcagccttgtgagaccctgagtagaggacccagctactccatgccctgacttctgacccagcaaactgtgagatcctgagttaaatgattttaaggtcactctagtaacactcaatacaaagttcaaatttattaatca

SEQ ID NO: 696072 - DNA, 469 bp, Homo sapiens
gaactttaatggttggcaaagtgtgattaaaaaacaaagtgagctgaggttaaaacacaggacagcaattataacctcataaatgccacctagacatcatgatgtggaacccagaatggaacagagctacaaaagggtctgctttatgggagggaaacagacctgttaggaggtggccagccctggagataaagaattatgaagctaggccaggtgtggtggctcatgcctgtaatcccagtactttgggaggctgaggagactggatcacttgaggtcaggagtttgaggtcagcctggccaacatagtgaaaccccatctctactaaaacatacaaaaattagccaggcatggtggtacacacttgtagtccagctacttgggagactgagacatgagaattgcttgaacctgggaggtggaggttgcagtgagccgagtatcgtgccactgcactccagcctggga

SEQ ID NO: 696073 - DNA, 217 bp, Homo sapiens
gctgtccatccaccttcgtgtgtcataccccttcgtgtgtccatcccccttcgtgtgtcatcccccttcgtacaactttttttgagacagagccttgcttttgcgcccaggttgtagtgcagtggcgtgatctcggctcactgcaacttctgcctcccaggttcaagtaattctcctgcctcagcctcccaagtagctgggatcacaggcgcccgcc

SEQ ID NO: 696074 - DNA, 299 bp, Homo sapiens
gcacgatcttcaagtaaccttcttctcctggcaacagtcggggaatgcgttgctggcgctaccactggctccccagcagaaaagtcgttgatgttggaagtttcatggaatccagttagacgtcgggcattgtccaggcctcccttgggatcataggctccgatgttgtactggtgccgcttgcttagtttctcaatggcctggtggatgttcctggagttaactgaaaagattgcagtccaaccttgtctccaggtatggagcctagaatgaagttgcacaaaatatgataccagttg

SEQ ID NO: 696075 - DNA, 173 bp, Homo sapiens
gatcgagctcggcccatcttgtcgctgacttctgctgacttactcccatttcattgtcgtcataagacttgccccccatgtgtctatttgatgtttgagcgagagctgacttttcccaggcagtcgtcactcactttatattcacggagaatctttcttgtcgtcgctccctg

SEQ ID NO: 696076 - DNA, 488 bp, Homo sapiens
gtcatctgcatgtataacattatgttataatattcttagagccaggtgtggtggcatatgcctgtaatcccagcacttcgggaggctgaggtgggcggatcacctgaggttggaggttcaagactagcctgaccaacatggagaaacctcatctctactaaaaatacaaaataagccaagcatggtggcgcatgcctataatcccagctacttgggaggctgaggcaggagaatcacttgaacccaggaggcggaggttgaggtgagctgagatcatgccattgcactccagccggggcgacggagtgagactccatctccaaaaaacaaaacaaaaaaacgacggtgaaccggcgcattgactcgaatggctggaaacatttggagaatacagacaaatcttacacttatttaaacctagaacaactctctagaaatgggcttcgagtacttaagccatagactataatatgcaggactggacgtct

SEQ ID NO: 696077 - DNA, 218 bp, Homo sapiens
gatataaatacttaatatgcacatatacaatacatacagataatatgataagataaactaagatacagaaacatagtgaaccattctagaaaagaaatagaagaggtctaacagaggctcagtcccagcagctccatgactagatacattgtagtctttttcctgaccataccaccgtatgtgggggatgccaaccccacattttgggcgtacgggga

SEQ ID NO: 696078 - DNA, 116 bp, Homo sapiens
tcattcttcagctactatggatatgagagactaagttatgttctacagctacaatagaaatgagagagttagttagttactacagctacaatagatatgagagagttagttagtta

SEQ ID NO: 696079 - DNA, 316 bp, Homo sapiens
acagttttcccatagggataagtgttatgtaacagaaaacagtccaggcgctgtggctcacacctgtaatcccagcactttgggaggccgaggcgggtggatcacgagatcaggagattgagaccatcctggctaacatggtgaaaccccatctctactaaaaatacaaaaattagctgggcgtggtggcacgcccctgtagtcccagctgcttgggaggctgaggcagaattgcttgaacctgggaggcggaggttgcagtgagctgagatcgcgccacagcactccaacctgacaacagagcgagacttcgttt

SEQ ID NO: 696080 - DNA, 133 bp, Homo sapiens
  misc_feature (6)..(6): n is a, c, g, or t
ctcggnaccctcaaacaccggaataggggtgagccccaggtgttctcttgtctcggctgaaaaatcgggtgccatcagctcttgaggcggcatacaggtgccaacaatcgagagggtttcgggtggggcatag

SEQ ID NO: 696081 - DNA, 210 bp, Homo sapiens
cacgaggcgggggggttctttcgcccccgtggtggagggcccctgagaggcggatactggcgtgcctttgggggtgatgtggcgtgtggggggaaaggtccgagctcccctgccagggggagggtttttcccttaagtcatccctcacacgacatgttttttctgctctgacccggacgccggaatggattttgacgaagagattcttcg

SEQ ID NO: 696082 - DNA, 245 bp, Homo sapiens
acttttataaacactccaatttattaactgttcctgctgagttggagctgtaagaatatgaccaagatggagagatatctagtacaagccccactgggggttacctgctttacattaaaaaaaagacaggctcagttcttttccctgtacccacatctgtaggacttatattatacagcaccagtctttaatggtgttctgcttcagattcgtgtcatccttaatgggttgtaatgaccagtctg

SEQ ID NO: 696083 - DNA, 264 bp, Homo sapiens
tgatctagaggatcccaatctactctatccgaagctgaaaaattacatgggcttcaacttaagaaaaccttagtgaaatcgctcacagtaagcatgcaaaaggaaacagtatccttttgcaaaaaaaaaaaaaaaaaaaaagggttgaaaaaaggttctttataattcgggaatagcccttttattgtattaaaaaggcctaaattttggtttccagtcaagggtgggtgtggaagggtgtgttaaaggagcaattttcccaaa

SEQ ID NO: 696084 - DNA, 221 bp, Homo sapiens
  misc_feature (22)..(22): n is a, c, g, or t
  misc_feature (33)..(33): n is a, c, g, or t
  misc_feature (56)..(56): n is a, c, g, or t
  misc_feature (79)..(79): n is a, c, g, or t
aagcagggctcctttcactatnttgatgcaagncgctagtgaactggactttgccnccccaaagaaatgcatttcattntagtaaatggtgagtagattccattctagagcaaacaaagcaagtaatgtagagtcagcccacagcaaaaagaacaagaagaattgtgttgtgacaagttgccatgtttttaacctcacactgcacagcatcaggcccgaat

SEQ ID NO: 696085 - DNA, 245 bp, Homo sapiens
cggcactggtttactgcagtgcacagaagtcactatttcatgaggatgttaaaacgcctggatattcaggcagaagtttgctgcaggggtggggctctcatggagaacctctgctagggcagtgcagaaaagaaatgtggagttggagcccacacacagagtccctactggggcactgcctcatggacctgtgagaatagggccaccatccttcagaccccagaatggtagatctactgacagct

SEQ ID NO: 696086 - DNA, 152 bp, Homo sapiens
ttctgatttctcagtaatctcttgaaagaaagttgattttttaaaagaatcacttttgtgaacataaatttctaaggaccaggtcctggaaaagactgcacccattatgtacttaaagcttccagagggtttcctctttgcatctcctagct

SEQ ID NO: 696087 - DNA, 110 bp, Homo sapiens
ctgaaaggcttcagaaaactcttttttaaaatcttcctcttttccggaatcttttcccttatcttggcggccttcctaacttcttggtggggggaggtataaaggataga

SEQ ID NO: 696088 - DNA, 487 bp, Homo sapiens
ggaggaggggggggtctccaaattgtataaaaaaaaaaggggtctcaagggttaaaaaagtatttttgggttcccccccccccaagggggcaaacccccttttagcctggggcctcctggggccccccccccccccccccggggggtggggggcgccccccaaaaaaaaaaaaggggttttttttggggggccgggaaaacccccccccctgggggccccccccccttttttttttttttttacccccccctttttttttccccttttccccggggggggggggggccccccccaagggggggtttaaaaaaaaagggggggggggtttttcccccggaaaaaaaaaggggggcagggtttttcccctttaaaaaaaaaaaaaaggcccccggggtttaaaggggccccccaaaacccccccccttttttttggaaaaattttttcccccccccaaaaaaaaaagttttttttttttccccccccca

SEQ ID NO: 696089 - DNA, 118 bp, Homo sapiens
  misc_feature (13)..(13): n is a, c, g, or t
  misc_feature (117)..(118): n is a, c, g, or t
tgagcaggacagnctatacaatagaatgcaagctgtaatgtaattttatattttcttatagccaccgttgaagtaaaaacaaacacggtaccacgtgttttttaccaccgctttatnn

SEQ ID NO: 696090 - DNA, 167 bp, Homo sapiens
tatcacaaacagtgtatagccagtggaataagtgtgtctgtgtgtgtccgtgtgatctgtgtgtgtgactgtgtgtgtccgtgtgatctgtaaagtgatgactctgagagtgtgactgagatcaatatgtatgacagagtgtgacagtgatgtatatctagatcagt

SEQ ID NO: 696091 - DNA, 122 bp, Homo sapiens
  misc_feature (15)..(15): n is a, c, g, or t
  misc_feature (63)..(63): n is a, c, g, or t
  misc_feature (104)..(104): n is a, c, g, or t
gctacatgccctgtnctccaccatcaatacaaggtctccataagtgtcagcaatgccctgggncacaatgccacagctatcacctttgacgagtcaccattgtnaagcctgatcctccagaa

SEQ ID NO: 696092 - DNA, 343 bp, Homo sapiens
tcaaggatatacccaaacagctaagcaccagcccacttttgatctgtgatgtctacaactccaggccaaatcatcatacagattgtgtgtgtgtgtgtgtgtgtgtgtatgtgtgtgtgtgtgtgtgtgttttgtcattattttttaatagaaagaaaactgttatattaagtgtcacgctaattttggcctaaaagtcacagtttcattttaaatcccaacaactgggagaggtgtgtacatgtgctcactagagacaccatttttattaagtttcactcaattaaacagaaacagatggaatgtcgacgcggccgcgaatttagtagtagtaggcggccgc

SEQ ID NO: 696093 - DNA, 325 bp, Homo sapiens
tctggatgccagtgtccaagaagggataatatatcggatataaagaactatacgtacattgtttgtgacctctgtggacatttgcctgaattctcacctgggagtgaatggagcagtggggcgaaggtcattggaggaggttgtgttttgtggtgtatgtggcagtgtctctggggttggggagtgtatggataagaaagcaaatgaaacaggatggagaaaaaaagaacgatcaagattaatgggtctctaactggattcatttcactgtagttcccccaggtcttcaacagtcacatttgagacctcagtaatgcaccacaga

SEQ ID NO: 696094 - DNA, 217 bp, Homo sapiens
cacgaggcatttttatatcacattgccctagcccagggattacacatgatggcctgaggatcagaagttgttgcaaggatttgatgagacgcttccaactacagccactgctgcttaccacagtgggacccaccggtcatccctcacccatgcggtgcatgtggaagtttcagatgccaggttgatcatgccagccttacatcctggccttgaacgc

SEQ ID NO: 696095 - DNA, 364 bp, Homo sapiens
cgacgtgtgtgtgtgtgtgtgtgtgtgctgtgctgtgctgtgctgtgctgtgctgtgctgtgctgtgctgtgctgtgatgtctgtgctgtgctgtgctgtctgtgctgtgctgagctgtctgtgctgtgctatgctgtgctgtgctgtgctgtctgtgcagtctgtgctgtgctgtgttgtctgtgctgcgctgtgctgtctgtgctgtgctgtgctgcctgtgctgtgatgtctgtgatgtggtgtgttgtctgtgctgttctgtctgtgctgtgctgtgctgtgctgtctgtgctgtgctgtctgtgctgtgctgtgctctgctgtatgttctggcagtgctggtgtttgctttgtcgcccc

SEQ ID NO: 696096 - DNA, 127 bp, Homo sapiens
ctacggagcatggtgcaggtccctgcggagaggcacttctggcctgactgacagctccattgagccccatgcagtacaggtgtagtgccttggaccacagcccacagcctggtacatgggcgcctgc

SEQ ID NO: 696097 - DNA, 404 bp, Homo sapiens
gatcccccggggctgcaggaattcggcacgagtaaaacacacagcctcccttcactggcaaaaactcccacacgagagtagtcgattttttacaattgatgaaccctacatcgacacatcattggctggatgttggtcgcacgcctgtaatccccagcactttgggaggctaaggtgggtggatcacctcaggtcaggagttcgagaccagcctgtccaacatggcaaaacctcgtctctactaaaaatacaaatattagccaagtgtgatggcaggcacctgtaattccaattacttgggaggtgagagaattgcttgaacctgggaggcagaggttgcagtgagcccagatcgtgacactatactctagcctgggcaacagagcaagactctcctacaaaaa

SEQ ID NO: 696098 - DNA, 209 bp, Homo sapiens
ctgcctggctgtttggggtcctgcacggctttcccaccacctgtagctcttgttgacctgcctgttcacctcatgagtgaagcgtctgcctggcagtgggccatgaactgaggggtctctgtgtagagtagaagcttcctgtgctccggttgccaggagacagcctgtgcagttaaatggacctagattttgttttgcactaaagtttc

SEQ ID NO: 696099 - DNA, 112 bp, Homo sapiens
gtaaatatatcgatctgaaaacaaggaagggacactctgcagacctgaaaaggaatatacttccatatcatgccatctcttacactggcatacctatgcctatgcatgtgca

SEQ ID NO: 696100 - DNA, 131 bp, Homo sapiens
cttagaggatccccccttgtatcccacccaggttgcttatcgcacatctacattcacatttgcatacggcttagatatctgtattagatagatgcttctaatttgtgtaaagggttaaaggccaggtcccc

SEQ ID NO: 696101 - DNA, 156 bp, Homo sapiens
gttgacgaatcagtatgaacacattagttgtatgaaccacttgttacatgactcgctgatcataaacaaccctgtgtgtaatattttttccccaaaaaacgtagcacccttcagcaggaccctataaaactttcctccagcccttgcctctttgca

SEQ ID NO: 696102 - DNA, 155 bp, Homo sapiens
ggacgtcaagctagatgccgacgagtgatggcactgaaggggctggggaaacctgctgagaccttccaaggacagccgtgttggtcggactctgaattttgaattgttattctattttttattttccatgaactcattttttaccttcagtgggg

SEQ ID NO: 696103 - DNA, 419 bp, Homo sapiens
aggacggaggttgtactgtcacgatcatagctcactgcagctcgaacctcctgggcccaaggaaccctcccatttcagctccctgagatagctgggactacaggcatgacgccaagcacgtggaagaatctcctttctggcttggttgacactttgtacaaagtgaggttgcccatagtgaagtctttccctgggccctgttttgttctcagtaaggaaggcccgtacaccctcccttccactagacagaggttggcctcacctttcgatacctccttcttgccaggaatcctcggctgtaggcctgcattgtgatggtggccatgcgaaatcaactgatacaggctgcgaacaaagatacccacggcagtgcttctgaatgattatggctgcccaagattctttttaaggccactgca

SEQ ID NO: 696104 - DNA, 252 bp, Homo sapiens
tcacacataaatataaataccctccatgtatattacatacaaacaatcacatcatccttaatctcggtatcccatccaactatcttctactagtatgagggtaaaacatagtaagagagttggaaacatcgtgttgcaagtggctgaacagagacagctgcagctaaagctgaagcttcagtctgcagggaaaagtctagtatcgcaaatctgacaaagaaccaaatgccaaaaagccactcaactgtagag

SEQ ID NO: 696105 - DNA, 145 bp, Homo sapiens
gtgggttgaccgtggcttgtgggttgaccgtggcttacccctgatcccacacccagccttcccctgagaatcattccctgtattcctcaactttgttctcgtctccctgttcacatgcaaaaatcctcccacatcatgccacggt

SEQ ID NO: 696106 - DNA, 298 bp, Homo sapiens
gaaacgcgctctgaaagagggggcgcccatactcaggacactgactctaagccctgtagcatcaaggcgtcacagattcagcacaaagtgccaaagggctggatgttcttctggaagaaagcctttcaaatatgccaacaacttggtcttaaggggccttcctgaatttggagggagggggtctttcagcttccaagtcactcgtgacttctttctggtcacaccaagccctataaccagaaccgtccacacagcttcacgctgaccccagtagccagccctccatgccccaatggtg

SEQ ID NO: 696107 - DNA, 140 bp, Homo sapiens
gtgatttggaggtgtggagaaggggaagggagggacagctcactggttcttctgcagtacctctgtgggttaaaaaattggaacttttcttcttcccagccccacttcctgttccctacccatataggccctaaatttgg

SEQ ID NO: 696108 - DNA, 260 bp, Homo sapiens
  misc_feature (58)..(58): n is a, c, g, or t
attttgtattccagtagcgcgatttggaccctttccaagtttagcctcctgggttcangccattccatcctccagcctcccatcatttggagttgcaagaagtggtggtgcaaacttgtaatcccacccacttgtgaggcttaggcaggattatcgcttgaacccaggaggtgtaggttgcggttagccgagatcccgccattgcactccagcctgggtgacagagtgagaccatgtctcaaaaacaaacaaaaaaagca

SEQ ID NO: 696109 - DNA, 381 bp, Homo sapiens
attcgcggccgcgtcgacttcccataaaaataccaccatcattcttcacagaactagaaaaaacatatggaaccataaaagagcccacatagccaaagcaaggctaagcaaaaagaacaaacctgaaggcattacattactggacttcaaactaaactataaggctatagtcatcaaaacagcatggtactagtttaagaatagacacatagaccaatggaacagaatagagaacccagaaataaagccaaatacttacagccaactgatctttggcaaagtaaacaaaaacaaagtggagaaagggcaccctattcaacaaattgtgctgggattaattgctagccaccaggcaaggaatgaaactggattctcatctct

SEQ ID NO: 696110 - DNA, 888 bp, Homo sapiens
  misc_feature (276)..(276): n is a, c, g, or t
  misc_feature (297)..(297): n is a, c, g, or t
  misc_feature (318)..(318): n is a, c, g, or t
  misc_feature (324)..(324): n is a, c, g, or t
  misc_feature (337)..(337): n is a, c, g, or t
  misc_feature (347)..(347): n is a, c, g, or t
  misc_feature (390)..(390): n is a, c, g, or t
  misc_feature (401)..(402): n is a, c, g, or t
  misc_feature (417)..(417): n is a, c, g, or t
  misc_feature (430)..(430): n is a, c, g, or t
  misc_feature (550)..(550): n is a, c, g, or t
aacaggcaatcctggctcgggtcacctccaggccacctatgggtgaggaggttaaaaacctcttacaggaataacagtgtccacagaaagtgcctgagctcagcccatgttccgataacctcatggaagcgaccacaattaaaaaaaagtgctgctgacacctctcagaatctggtggacatgaagctctcagctggacaaggccctgaaaacatttactattagcagagccatgcgctcttgagcttcacctgctgtggtcccctggaggaaaangctagcaattctaagaaaccnacacgagattcttggttcctnaaaacntgaggtcacaagntgtgggaccncacccaggtgaggaagacactggccttcactcatcggataggncaccgcccctnngcatctggcccaggnacctgggctactnttggaaagcacgaagcacgagcacgctgtagtgatatggttgatattggtcacatgaagaagaaggaaaacggtaggggaaccttcattcagcaagacataggccgttcaatggtgcttngtaccaatcgagagtgagaggatctgtgacaacaagagtgcagcaccttccgctctgggggccacacattcttagacttggaaaaccccacttgggcccacctgctcactgtggcctcctacaccaccacactgggatccagcagctccagtccctccacaggcattaagaggtagctgaagtgtgagtcaggcaattatgtgggccactgtaggcctttcccctctcttcaagggggaaggtgcatacctctgcctcttccctgcacctctctcgcctagcaaacactctgtgaggttggcagctcttgtaccagcttagccctagttctagatcgc

SEQ ID NO: 696111 - DNA, 1817 bp, Homo sapiens
  misc_feature (1)..(1): n is a, c, g, or t
ngtcagtgtattgatactcggccttgtgtggttgcgcattgccgcatcgtgcggatttttggggtgtcgacgcttggttgagtggccgtccgacggggtgctccatccgacagggtgttgtgttccgccattatatgagtcgcacgcgtcgttgtgtttgttataatacgtgtcggcgtccactgggttgtgcatatttgtacccggtgtcgcgttgtataatggtgtgtagtccgaggggccctgtggggggttgccggaaatttgttgcagtgatctacctgagaggcgtccgtggcgccctacataccaggcgctcgtcctcacgtgtgcttctctgtgcgccgccgttcgggaagtggccggcgggcggtggagataccacgtagttgtgggctgcccatagaggggtgtctcgttgggtgggtgggagtctgctctcttgtctgctggtggagtgtatttgtcgtggcgctggctgtcctgttgtgtcgtgcggtgtcacattaccttcacgctggtggatgtgtgtagtggggggttgtttgtgtgctcgctgtcgggggtgttctaccatagtttgtgtcgtcctcgcaggggtgctttttcactaactgcgggggtgggggaattatttggtgggggctagcgagcgtagcctccaaaagtgggctgccctgtctcttactctctctcggcttgtggttggtgtgcccgcccccctgttgtgtggtgtctgtcttgatgttgtgtggttattatctttgggatgtgggtgatggtgtctccatctgaccgttgttgttttttattgggggggccatcgtagccatcatcgcccctgcgtcgtttttgtttcttgatttggtgtgggattcctccacagctgggttccgtcttggtaaagtggtatatggtgggggtcatctgtctgtcgcctctcggaggtgtttgttgcgcggcggagacgccttgttcttgtgtttgttgcgtgttccctctcgggggtctcttcgtggagttttctctcactcatgtcttggtgcgctcgctgagtactgctgctccgcgccactcgttgtttctacacctcgcatgatctcccgcgggtccacacgcatgacctcgctttgtgctccggcgggaaagggggtcttttttcttctcgggagacactcccgcgcttgtgtggggtgtcgttcgcactccgggggcccccgggggcgcgccgagcgctgtgacacgtggcgcgcgcgagatgccgcttgggggcgccgtgtctttgtcgccgcgttgtgagcctctgtgctcttgtaggtgagacttctgtgggcgcccttcgtgcccgagatgttctcgcgaccggtgtacactgcggcgacgggctttctcggggggccacaccagaagagccagatgaaccacatagccccgcgcataaggatagctccctcggtaagggtctccctctcagaaacatctccccggatgtgtaaatagaaacaccagatagaagagcttttgagagaacctccgggataacatttagatgccatccagtgcaaccgaaggttcctaccagggcccaccaactgcgcccccgcccaccaaccccaccccgcgttttcgtgagtgttgtccattttagaaaatatagagctttttgaaaatgtcctgccttttaacgtagatataagccttccccccctaccgttaatggcccgattagatccgtttttatatatgtcttattaaaatgttaaaataagataaggaaaaatactcgagcattaagtcgggcgagtaggtatgtagct

SEQ ID NO: 696112 - DNA, 86 bp, Homo sapiens
gcggccgcctactactactactgctcgaattcaagcttctaacgatgtacggggacatgttgaagaattgtctatgaaagtcgtgg

SEQ ID NO: 696113 - DNA, 380 bp, Homo sapiens
cgccccgtattatggagatgaaccaagtggattcaagaatcaacaccgatgagattatgatttcactctaagtctgtgtaatggactaaatatgaacgcctcattagtacctgatggttctcgtttaaatctcgttagaaactgcatagaactgaaattctgccatcctgaactctagggtggagaatactgtgttgacccttcaccaaagggatggcaaatcggatgctatcacggtattctgctaattactggacatactggtcgaaacatgcataagtgccaatcctttgaatgttccacggatatactggtggacagattctaatgtctgtgaacaaacatgtctggtttggagagtccatggatggtgcgttttc

SEQ ID NO: 696114 - DNA, 610 bp, Homo sapiens
tgcaggatctcgaggctgaagaatgtcggtactcagagacttctctagctcaaggaggatgttcaaacccatcgcaaggaagctaaaaaccttgaaaaaagattagaccaatggctaactacaataaacagtgtagagaagaccttaaatgacctgatggagctgaaaaccatggcatgagaactacaggacgcatgcacaagcttcactagccgacttgatcaagtggaagaaagggtatcagtgattgaagatcaaattaatgaaataaagcgagaggagaagtttagagaaaaaagagtaaaaagcaacaagataaagcctacaagaaatacaggactatgtgaaaggaccaaatctacatttgattgttgtacctgaaagtgacggggagaatggaaccaagctggaaaacactcttcaggatattatccaggagaacttccccgaactaccaaggcaggccaacattcaaattcaggaaatacagagaactccacaaagatactcctcgagaagagcaaacccaagacacgtaattgtcatattcaccaaggttgaaatgaaggaaaaaaatgttagggcagccagagagaaatgtcgggttgcc

SEQ ID NO: 696115 - DNA, 129 bp, Homo sapiens
agccatggacaaagagagaaactggaaggaaagacaatcagaaacttcaacccaaagccaatctgactggtccagaaattttttactgtgatatataatctttaataaagtttcttttcccaccaaaaa

SEQ ID NO: 696116 - DNA, 341 bp, Homo sapiens
  misc_feature (124)..(124): n is a, c, g, or t
  misc_feature (136)..(136): n is a, c, g, or t
  misc_feature (222)..(222): n is a, c, g, or t
  misc_feature (244)..(244): n is a, c, g, or t
  misc_feature (306)..(307): n is a, c, g, or t
  misc_feature (318)..(318): n is a, c, g, or t
cgtgacttgtgtggtgttatggatgaatattattgagagagagagagagggagtcatttctttatttttataaagtcgaaaaaggtgggaataggattaggatcttccaagcatatgcttctcnaagaccattatnataaactttacctttacctttcttccatcttctatttttctattttttttctctccaatattccacgttttctctgcactattttncaatcctttacatatctaaatngcatactttaacttcttcaattcttcctaaagagctaagcttttgacgcttggaaagaaganntcacataacancacacattccaggagtcctgtgt

SEQ ID NO: 696117 - DNA, 100 bp, Homo sapiens
acggtttgccagttagcggcatctacggctcaacatttttgtagccacaggcttccacggacttcacgtcattatggctcaactttcctcaactggcaaa

SEQ ID NO: 696118 - DNA, 446 bp, Homo sapiens
attagtaccgagggaaagatgaaatatcaccaagcatatatcgcacgtactaacccctatcccttctgcataatgacttacctcgaaataactatgcaaggagagctaaagctaagacccccgaaaccagacgagctacctacgaacagctataagagcacacccgtctctgtagcaaactagtgggcagatcaataggtagaggcgccaaacctcacgagcctggtgatagctggttgtccacgctagaatcttagatcaactttaaatttgcccacagaaccctctaaatccccttgtaaatttaactgttagtccaaagaggaacagctctttggacactaggaaaacaacttgtagagagagtaaaaaatataccacccatagaaggcctaacagcagccaccaattcagaaagcgttcaagctcaagaaccactacctaaa

SEQ ID NO: 696119 - DNA, 353 bp, Homo sapiens
gaagcaatggatggtgtgtctgtgggtgttgggtagggccaggtgattgtttagagggtcagaagtccagggccggcgccggtggcttatgcccctaatcccagcactttgggaagctgaggcgggcggatcaccttgaggtcaggagttcgagaccagcctggccaacatggtgaaaccccgtctctaataaaaatacaaaaatcagccgggcgttggtggcacatgccggtaatcccagctactcaggaggctgaggcaggagaatcgcttgaacctgggaggcagaggttgcagtgagccgagatcgcaccactgccctccagcctgggtgacagagtgagactccatct

SEQ ID NO: 696120 - DNA, 206 bp, Homo sapiens
ggtcggtacctcctcagctgagttcatgctgccggcggacagcagtatcccttctcagttggaccgcatcgacgtggtggtggccagcaccctttccattacggtgatctctgggcagttcctgtcagtaacgcaggtgtgcgctcctatgtagaagtggtgctgtttggccttcctggtgaccccaagaggcgctatcgaactaa

SEQ ID NO: 696121 - DNA, 196 bp, Homo sapiens
agatgctgctgccttgagcgtgccctaaagagccacccaaggagctggacacggcctcctcggaggagaacaatgaggacggagacttcacggtgtacgagtgccctggcctggccccgacgagtgcaaatggatggtgcgcaacccctcttttcgaccacgcggcactgtccgcgcgtaatcgccttatgcgagc

SEQ ID NO: 696122 - DNA, 123 bp, Homo sapiens
ctcgcccagtgtcagccccatgactgggcagcactcttggtttcatcagcacacacgcacaggaaggacccttccacgttttcacagaaggcttcacaacacacccagtgcacaacgcagtag

SEQ ID NO: 696123 - DNA, 223 bp, Homo sapiens
gtgattagaggatcccgatggcagtgggattggtgtcctaagaggcataggaagtggagtgtgaataccatgggtgatgggtccaggagaactagactatggttcttgaatatctggtccacaaagaatatactaacttttggtcaactttctcagaaactcccaactgggagtcgggtgagaccataggattttctggcacttccacacattgcctggttcc

SEQ ID NO: 696124 - DNA, 223 bp, Homo sapiens
agactgagcacaggtttgcactggcatgctctgagaataggaatagaagcatgcacactgaaccatcctatgtctgggctccaaatggaactatagtttcattcaaatcttcaggcggctataggttctggctgcaggaatgacacctctcggcttagtaagggctgcttattgtgggaatatgactcccatctggaagagcagatagaggacctgaccaccg

SEQ ID NO: 696125 - DNA, 147 bp, Homo sapiens
tagttaatcgctctcccccctgtctctccgtgcagctcgtgacgactccctggtaacatgtttggggcttcgacctagggccacttagtggtctctctgggtctttactttgtcagatgtttattctacattgtaccccaggaacag

SEQ ID NO: 696126 - DNA, 812 bp, Homo sapiens
  misc_feature (175)..(175): n is a, c, g, or t
gggctccgtgctgcggtgcgctggtgcctgtgaggcgcggagcttgggagcggagcccaggccgtgccgcgctggcgccatgaagggcaaggaggagaaggagggctggcgcactgtgttgtggcgctggcgtgcggaagcccctgagaatgagcccgagctgctgcaggagctncaaggatgcatgggcaaatctgtctgttctgtgggcctgaaatgtacccggagtgcggctggccttgctacggccgcgctgatcaccctggaacccgctgggtggccgtgtattacaccaaccgggccttgtgctacctgaagatgcagcagcactgagcagtgccctggccgacttgccggcgcgccctggagcttggactggggcaagttctgttgaaagggcggcacttcttccttgggccggtggccaggttgggaaattggaaaaacgtatattagcagtaaggcgccatctcggccaaatcttgtggcgagggagaacgcttatcacagctcgtggcgccaagggagaacacaggcgggtcgtgaaatctgcggggagacagaatattcccacgaggcgctcttcgatattcgcgacaagagagaacgctcgttggaaacgagtatttcggaaagagctggcagtattccaatcagggaggaaggcggatgcttgaatctctacttactctcttccgaggcttcagtttggcccggaggaagcggttcaggacgggatgctagggaaataggtgccatacggaaaacccacgaggggtgatgaaggacggacaagcaacgttccggggccc

SEQ ID NO: 696127 - DNA, 104 bp, Homo sapiens
gaatagcaggtagaagaagaagaaaataaaagaaagggaaagaactgatgaaggaggaactgggtactagaagtggttgaatgaaataatcctgcttatctcct

SEQ ID NO: 696128 - DNA, 405 bp, Homo sapiens
tggtccttggtttctgcccaatgtatcggtaatgcgtgttcaacccctccaggacaacccagtttcgctgccgaacgacttggactactttgccttgcttcccagcatccttgccttctaagatttctaccatgtctccacagaataggtgccagtcttcatcagagatgggctctaccactacctggcgccgcctgctccatggaggattcttccttttgtctgctatggaacctggacggctcattccatagcggtagaagggggaggaagtggctttggatgccaaggccagcagggctgagagccgcatagctagattcaagaaatctcaccagggaaacactcaaaaactttgccagcggatttttgggagatgtagtcaaattgcggaaaggaaggctc

SEQ ID NO: 696129 - DNA, 292 bp, Homo sapiens
  misc_feature (279)..(279): n is a, c, g, or t
caaactttgatgctccagttctggttcatacatgcagacctgaaaactctgcctgatttaggcagagatctttatctgaccctcagcttccctctgtagatatatagatatataaatataaatatgaatataagtatgttttacagcacagcatctgacctgtagatggaggttttgttggttgtttattttcccctcttgcaagtgctacccatgtgagtgtgtgaagtttctctactaagtaaaacacaggcccttttccttgtttgctttgtgttngcttattgtaaac

SEQ ID NO: 696130 - DNA, 227 bp, Homo sapiens
  misc_feature (82)..(82): n is a, c, g, or t
gctctaaaaaagaactaaataaaccaggcatggtgatgtatgactgcagtcccagccactcaggaggctgaggcaggaggantgcttgagcccagaaggttgaggctgcagtgagccatgtttgcgccactgcactccagcctgggagacagagcaagactctgtctgggaaaaaaaaaaaaggcttctggggagggctgacctccaatacggagacagcattatca

SEQ ID NO: 696131 - DNA, 508 bp, Homo sapiens
gtgaataggcagcacagaaagacgaacatcgccatgtacacttagagtgagatctaaaaatcaaaacaaatgaaatcatgggcagagagtagaaggaaggtaccagaggctgggaagggtagtcagggatgggaatagttaatgggtaaaaaaaaattagaataagatctactattgattgcacaacaggatgactatagtcagtaataatagcatatttttaaataaagaacgtaaaaattagccaggtgtggtggcacacctgtagtcccagctacttgagaggctgagacatgagaatcgctagaacctgggaggtggaggttgcagtgagctgagactgcaccactgcactccagcctgggtgacagagcaagactccgtttaaaaaaataaataaaataaaaaataaaataaaagtgtaattggattgtttgtaacttaaaggataaatgcttaaggggatggatatctcattctccataatgtgcagttccgccccagcgag

SEQ ID NO: 696132 - DNA, 255 bp, Homo sapiens
gtgtacaggcaaaacaggaggattgcttgaggcaggagtttgagaccagcctgaccaacataatgaaaccccgtctctactaacaatacaaaaattagcctggcgtggtggcacatgcctgtaatcccagctactcaggaggctgaggccggagaatcgcttgaccctgggacgtggaggtttcagtgggctgagatcacaccactgcatttcggcctgagccgacagagggcgactacatctcaaaacacaaaa

SEQ ID NO: 696133 - DNA, 354 bp, Homo sapiens
agattgttgctcatctgagtatgatggaaacaaactgacagtgttttatatcattttgaagacagtataagcaaatgcatgcatatgctaaatggaaaatgaatttagaactattggctgttgggaattattcccagctctaaaatatagtgcaccccacatattataagagaatgcggtgtctatactggcttgaattggtgaaattaggattgaccgggaaggactgtctctgaaatctggttagtaagcgttcctgttcaggtagcacatgcatttcagttgtcaactgggaccattaaccgcggctatgccaatgacaacctgtccattccctgggatacagtagggaga

SEQ ID NO: 696134 - DNA, 116 bp, Homo sapiens
ccatgcagcatacatgatcaggttattggcctgctcgctgcctacggtggaattgtgtgtcaaagaagggaaatggccgtcgtaggcgccttcgccgcccaggcggtggcaactgg

SEQ ID NO: 696135 - DNA, 477 bp, Homo sapiens
  misc_feature (322)..(322): n is a, c, g, or t
  misc_feature (369)..(369): n is a, c, g, or t
  misc_feature (377)..(377): n is a, c, g, or t
  misc_feature (433)..(433): n is a, c, g, or t
  misc_feature (459)..(459): n is a, c, g, or t
gcgcggggggcgggttataaatttcacctaaaggaaatgtaggaaaactgaggctttcctacaagggagggtctgtggctcacaaaggcctgcatcactttcatgagcgacacctggcgttcctcttggcacatgatcatctcgataggtagcaggtttatgactgctttgcttttataagtgctgttgcataaaggttacctgaatgaggatgaacacaacgacgtgtacaaaacaaatataataaataattaaataaggtggaaaaaaactgaatggttcaaatgaacaaactcctactgctccgcaaagaaaacacgangagcttcagaaacatctcctctgagagatgcaagagatatgagtaantacaacantaaagaccttgataggataattgaggataccgtttaggtaacaagactttcttgantgcctcataacagaggtctatttttncactttttgcccttgcat

SEQ ID NO: 696136 - DNA, 1462 bp, Homo sapiens
  misc_feature (59)..(59): n is a, c, g, or t
ggcctgatccgggcccgtgtggcggcggtcgactgacacttcagtgtccggatcctcgnggagtcccgagtcgcggggatgtgcgagacctgatctgtgagccttgcgttgatccacgcgatctcgtgtcgtgacagtacctggtgagaacatcgagatgactccgttccgtgagttgacactcgagggcatttgcgattggagacgtccaaggtaaccatcgagcttttcactactcgttctggcaacactcatggacttctggacccccattggccaaagaaatacctagagacggaaaaccgtctagacgtggctccgaggaacccagtggagatcgttggggctacatttgcggattggggagaaatttgcgccgattccaaggcgattgcgtgtgctcacagccgattccaatataggagttccctcgtggcctaacaccagattgcaatagggttccgttcggtggcgggcatattccccctttgggggccggcgactaagaggatgcctccatcatgctttctcggaaattgggggaaagcttcgccgagtcctttgggggccagctacggggctaccatagggccccaaaacacacttaagcggttacgggataaccgcggaactatgccgggaagcgctaacggaaatgtaagtgtggcacagacgcccgtagaagcggatgtgtaggcgcccacgaggagcaccgcagacagttgtgcccaagtaattcacctttcggatacgatggttcgccaacggaacattacacgttgcgcccttttggaaaaaaccgtcggcagtcgcctgcgtcgagaaataggcggctctcctcgggctaccgcgaactgttggcggtactagccggttggagacacaacgcgcaccattggcaaaggtatcacggcgctgacggttggcaatttcaacggacacaccacagccgaagcccgtttacgcacagggcgttaacccttttccaccacgcttccaaaggcggccaacaacacatctgtagcaaccgctccatctgttggggggccattgcgagccacatttccatgtaggaaccttggcacccgttgttaaagacggcaaaccgcagccaacgcccttggcggcacggcacaaacgctgggaatatccgacgttccggcgggaatgttggggaacccacgagacgcagttgtgcatcctggcgagagttaacgattcgtccgtattgggtaggtaacacaccgataggaacgcgtgtccatggaggtgaggaaattccggcttgagaccaaagcggatcgccctatagatagtgcccccggagcgatcacgcaagccagcgttgtgcagacgaatagcgccccccacaagaaacggcggaaaacacacttgggtctagagagcaagtttgcggtagcacgccaaccttatcagcctgggggggggggcaagaacaact

SEQ ID NO: 696137 - DNA, 314 bp, Homo sapiens
  misc_feature (67)..(67): n is a, c, g, or t
ctgcacactgacttaggagagtgtactcgtaggcggacagctttagtggccggccgcccctctcatnccccgtaaggggcagagtcctttgtactgaccagatgagcacatttacatccaggagcctccacgaattggaagggtttattgaaaactacagctggagagttgacatagagtgtgtccaagagctcctaaagcttgcagaatttatccacttagttggagctatatgacatacattttcatagagtgtcctggttcatagtccaggccggatcctactggccaggagtgtgggatttatcaggagc

SEQ ID NO: 696138 - DNA, 920 bp, Homo sapiens
  misc_feature (833)..(833): n is a, c, g, or t
gataacagactgttctctagtttccttaggacttatcccactatttgggatactattaaatgcaacttgggctcgttcattttagggaaggcgttcacttgtgttttacaaaatgtgtttaggaatagtcaacaggattcataggacaaaaaaagggcagtcctggaatcacattcgttagcacaccgtacacctcttgggcagatagaacaacttggcagaattgagagtgattccgtgtcctaaaagtgtaagataagcatagagatttgttcgtatttagaatgggatcacgagggaaagagaaggaaagtgatgtgtttattccacaagatctgtaatgttatttccacttataaaggacaataaaaaatgcaaaacattatgttggatatcaaaagcaaataaaaacccaattcagtctcttctaagcaaaacttgctaaagagagatgaaccacattatcaaagtaatctgttggctgtaaggcattttcatctttccttcgggttggcaaaatatttctaaaggctaaaacatgctggtgaaccaggggtgttgatggtgataagggaggaatatagatatgaacaagactgaatcttcctttgttgcacaaatagaggtcctggataataagccctgctgaaaggtgtcttattgtgacttaatgtcttttgcaagtgatccagagatactacaatattaacataagtaaagattatatattatttctgaatcgagatgtccacagtcaaatttgtaaatcttattcttttgtaatatttatttatatttatttatgacagtgaacattctgattttacatgtanacaagtaaagttgaagaagaactagtgcgatagggaaagaaatgttaaaactgccgcgcctataatagggaattaatatccctttct

SEQ ID NO: 696139 - DNA, 376 bp, Homo sapiens
  misc_feature (13)..(13): n is a, c, g, or t
  misc_feature (16)..(16): n is a, c, g, or t
  misc_feature (79)..(79): n is a, c, g, or t
  misc_feature (190)..(190): n is a, c, g, or t
  misc_feature (368)..(368): n is a, c, g, or t
  misc_feature (372)..(372): n is a, c, g, or t
attaggcttgtcnatnaactacacccctgccatattgtgcttagcctattacagcatgtgttggttttactatacgtgncattgccctccatggcggccaaacctggtgccagcttatccatgttatcattaattaatgaccaggctgctgctggcgagggaggtcttgttaagcaaccaggttgccacntattacaggtgccaatgggtgccaattaaataggggttttacatgcctgataaccaataagtccttgtgccatgcgaccgcgccattgctacaccagttccgaccctgtttacacagtaacgccatttacatttggtccagtcttgcttttccgttgaggcagttgtggatgttgtgntttnccta

SEQ ID NO: 696140 - DNA, 1343 bp, Homo sapiens
  misc_feature (1101)..(1101): n is a, c, g, or t
cgctagccgcgctcccaccacccacacccaccgtgccctcggttcgcctcttctccgggagccagtccgtgccaccgtctgccgcccaggccatcgccaccctccgtctgcctatgcttctactcaggttccgtggtccttcggtccatcctacctgcaggatgttgcggcggttccgtggcactcgctgagccgtgccgatgctccagctcggagcttacgtgatctactgtccagccctggagccgtacagtggcgtgggcatgctgctgctgcggcccctaggcatccaagtacagcgaggtcctcgtacggccttccagtccccggtggctgagcagtagtacgttgctcagcgctgcttccttcatgtctctgaatgcctgtcgcatgacgagtagtctcagagcgagtgtctctcgtgagcgagtgacgagtgctctcagtgcctaagtgtaactatcgtggtgagtactctgtcggtcgcacagtgggggctcgagaacagaccctagtcccaatggatcgcgggatgatatcgaaatgtaagcaccaacactcggctcaatctcgatacgcagattcagaacgtgctgggaaggccctttgccagtgtggaggactctagaataattaggaccccgtgtcgtgtcaggccactacatactaaaccaggtacaagaactaaacgtggatagcaagacttgtcccatcgggaatgcccaatgtgcgaagcaaactacataaggtacttccccttgtacttctgtggcccaggaggcccttccgaaaaagcccaatagtgattccagagacccggggccccaaatggggccaacagggtctcgtcagaccccgttgtgacgggtggaaaccaatccataaccggaagttggaacgcagaaagcaactggccgaagggaaagaccttgggccgacccctgaggactagagcgcttgcagaaccccaagggcgttatatacgctagaagcggaagtcaaaaaggtcgctcggaaagattccgaagaggtttgggacagacaggccagaaacaataaccccttaggagtaccctcagatagggaagccacttcagttgngctgcgcccttccacgagggggggagcacacaaattcggccaagcggcacatgaaagaaatggcttttctggagaaagaaagaaaacaggaataagagccaggcagaaatacaccgccgtagggagagatctctctttccacaaaacaaccagggagtcgtctgttgacacacatatggcagatctgtctcacttgtgaccaacacggttgtctttgaaccctttcagaacacagcacaaga

SEQ ID NO: 696141 - DNA, 909 bp, Homo sapiens
  misc_feature (833)..(833): n is a, c, g, or t
  misc_feature (863)..(863): n is a, c, g, or t
  misc_feature (866)..(866): n is a, c, g, or t
gataacagactgttctctagtttccttaggacttatcccactatttgggatactattaaatgcaacttgggctcgttcattttagggaaggcgttcacttgtgttttacaaaatgtgtttaggaatagtcaacaggattcataggacaaaaaaagggcagtcctggaatcacattcgttagcacaccgtacacctcttgggcagatagaacaacttggcagaattgagagtgattccgtgtcctaaaagtgtaagataagcatagagatttgttcgtatttagaatgggatcacgagggaaagagaaggaaagtgatgtgtttattccacaagatctgtaatgttatttccacttataaaggacaataaaaaatgcaaaacattatgttggatatcaaaagcaaataaaaacccaattcagtctcttctaagcaaaacttgctaaagagagatgaaccacattatcaaagtaatctgttggctgtaaggcattttcatctttccttcgggttggcaaaatatttctaaaggctaaaacatgctggtgaaccaggggtgttgatggtgataagggaggaatatagatatgaacaagactgaatcttcctttgttgcacaaatagaggtcctggataataagccctgctgaaaggtgtcttattgtgacttaatgtcttttgcaagtgatccagagatactacaatattaacataagtaaagattatatattatttctgaatcgagatgtccacagtcaaatttgtaaatcttattcttttgtaatatttatttatatttatttatgacagtgaacattctgattttacatgtanacaagtaaagttgaagaagatatgtgaagnaanatgtatttttcctaaatagaaataaatgatcccattttttggt

SEQ ID NO: 696142 - DNA, 157 bp, Homo sapiens
tcgagcggtacctactgcggttgctctactccctgctacatttcccagcctctggtagcatcattctactttctagttccatgagttccattgttttaatttttagctcccaaatatgtatgagaagatgcaaaatttgtctttctgtgcctgacgc

SEQ ID NO: 696143 - DNA, 305 bp, Homo sapiens
attaggttggtgcaaaagtaattgcagttcttgcctttagtaatggcaactcaaatagtattttggcctcatgcagtgtggtggactagagcttacttaaccttgggctcttagaatcttacgttggggactgtgggcccagggcccttgttcttataaagctctattggacataccatgccattcatctgcatgttgactttggctgcttttgcataaaaagtcccaagggtaaatattgcttcaaccattaagaaaggtgcccactccgaggtaggagtaggcactcacatccctgtaagaga

SEQ ID NO: 696144 - DNA, 1221 bp, Homo sapiens
gtgtcttctttcttctctggtttgctggttgtgttatttcttttattttttcttggttgtgggtctcgctcttttgctgtgctttcttttgtgtgccctcgtttgtctgtctgttgtgtgtctatttcttttttttctcttttttgttcctcttgtgtttatggtgtttcttgtttcttgtccctcgcctctttgtgtttgttctcccactttgtcgtgcctgggtggcgcgtcttgcttctgtcttctactctgtcccttctctgttctcgtgttgtttcttcttgtgttttattgttctttgtgttggatttctttggtggtgtcggccctcctcctttcatcccctttgtcctttttgttctttgtgttttttcaattgttgtcattctcgctaactctcatttccttctttgtggtctttttgttgctgggtgtgtgtgtgtctcgtgttgttgtgtttatgctcttctctgtcgacgcgttggttcgttcatgttctttgttcctcttctccctacctctctcgcttttgtttgtgtgttcgccttccccgctggttggtggtggtgtttctccttggtgctgtctattttacttgtctttctttcctctccgctctccctcgttgtgctgtcgtgtctgtctgggcgccgatttctctggtgtcgttccgtacggcgttgtctcactgtttatattgtcgtgctcgcgcgcgctcgcgcgcaccgtctcccatttcttctccttctcgcgttgtgcgtcggctgcccgcctctgtgtctgtcgggtggtgtgtgtctaggcctcgtcacctctcctccgttcacatgttgttttgccgacgatgccgaccctccccccaccctccggtgtgtgtgtgtgtgttggtttctttttgtctgtggtgtttatgttgtgttgttttccggcactttctctatgtgtgttgtgcgtgggtgtgtgttgtctcttggcagtatgttgtttcttagtcagtcaccccccctctcctgtggatgcgactgactgcgcctccaccacgcacaagcagagacaagcagcagcacatgagtgtcatagcagggatggtggcatgcaggcgcactcacatcaagagcaagaagagtgaacgcactcaacccgtccctgggtgggggggcgcgccgcccccccccccgcgtcgggcgtcgccgccccaagagccccccccccccacca

SEQ ID NO: 696145 - DNA, 320 bp, Homo sapiens
  misc_feature (20)..(20): n is a, c, g, or t
  misc_feature (194)..(194): n is a, c, g, or t
  misc_feature (237)..(237): n is a, c, g, or t
  misc_feature (298)..(298): n is a, c, g, or t
  misc_feature (302)..(302): n is a, c, g, or t
  misc_feature (317)..(317): n is a, c, g, or t
tcagcattatccccggcgcnaactttcctgccgctgagaaaggcggggagcacagtctgcgggttcgcggccgaggcagtgggggccgcccggattcttggagagggcgcactgtgaccacccgctccgtgcagcaaggaacaacaaggcggtgcgcgccccagcccccgattggggcccctcagctcggatcncgagacctcaggggaccaggcccgccttttctgcctccttgtnccacgcgcgctcacctggctaaggcgcccggcatacgccctggccggaggggccttggcgntctngtccccagggcaagncgc

SEQ ID NO: 696146 - DNA, 134 bp, Homo sapiens
atcgcaatcatgcaatctaacgtaccacgcataagctgacagtactatccgccaacccaatactattcgccatcttttggttcgggaaaaaggactgcgccaccagagcccccgattatagcgcatcgttactg

SEQ ID NO: 696147 - DNA, 305 bp, Homo sapiens
cccgtcatgaggctccggtgcggcttctcagctgacctgccgttggaggttccaaacggatccacccaagggcatttccgttcgaccttaggcagttccttcttttaccttggggtccaagttttattccccgtttcaattacatttaactttcaaggttcccttattggagttaaggaaccttgggtttaaatagggtttttttcaggggaccttcatatatttattcttaagatacatccagccctagtatccttcatcaagttccagcgcatcctcatccagcatatgaccacctcttggcc

SEQ ID NO: 696148 - DNA, 1106 bp, Homo sapiens
ttcggttggtgggagtggaggggacggggggggcggcgtggggtgtgttgccgctgcgtgcggggggggggggggaagatggtcggggggggtttggtgtggggcccggggagggctcgtgtggcggcagcgcgccccgtgtggtgtttggcgcccggcgagcccggcgcggcaatggcctgtgtggtgggcggtcgttgttgcggccatgtattcttcggcggggccgttggcgcccggtccccatgcggcccccggcgcgtggggtccgggcggtggggggtccatagtggggtgtttggccatgtactgtgggatggcccccgtgagtgtggggtccccgggggtacccagggcaccccttgggcatccgggcctggtgcttggtcagcagggcccgaggttgccccagtggcgaggcgtggtgcccgagtctgtcgtcccgcggctgagcgtaaccttgtccgtcactgtttcaaatcgtatccctcattgcagcccattgaggtggatttaacccaacccaggtacgccgaatcttagcatactcctccattgacccccataggatgaataatagccagttttgaccgtacaacccttacatggcccattcttaatgttgaactatttatatgtatcctgactagctgcccgcattcctactactccactttaaactcccagccccccgaccctactacttatttccccacctgacaccaagctaacatggactgcaccacccttaattcccatcccaccctcctttcccttaggaggcctgcccccgctaaccggctttttgccccaaatgggcccattatcggaagaattccaccaaaaacaccaatagcctctatctatctccccacccatcatagcccacccatctcaccctcccttaacctctacttctacctacgcccgaatttactcccacctccaatccaccactactccccctaatctaaccaacgtggaaaataaaaatgaccagtttgaacaatacaccaaaaccccacccccattcctcccccacacactcatcgcccttaccacgctactcctacctatttcccctttctatcactaataattttata

SEQ ID NO: 696149 - DNA, 220 bp, Homo sapiens
cctgagtgtcccaagcttttaccgctgcatttggaagtttttgataactgattaaatctctttattaattattggtctgttcatgtattattcatgatacagtcttagaaagttgtatgtttctaagaatttaagcattccttctggttatccaatttgttggcatataattatttatagtagtcttttatgatgcggtaaaagcttgggatcctctaga

SEQ ID NO: 696150 - DNA, 330 bp, Homo sapiens
  misc_feature (17)..(17): n is a, c, g, or t
  misc_feature (26)..(26): n is a, c, g, or t
actaacattacagcagngtgttggtngctggtaggtaggcacggagtaacgctataacgacgcccaatcgttatgaatgttctactaactgctttttctctctctgctgttctagcgttcaccataaatataagacatcttcttcttctttcttcttctatggtgtctacgtgtagagcaagagtaagtagtgtactactacaccactagagagagatatagaactggctgaaagacaacaccttgttggaaccccccccccaaataaactgaagaaaatcaaaacaagagaatatactcaacaaaaacaataaataaaaaaaacataca

SEQ ID NO: 696151 - DNA, 1150 bp, Homo sapiens
gctgcccctcatttacataaactacttatactacgcactttaccatctcactttcttacggagctactagcctactactcgctcacacctcatatcctcccttacctatgccctagcacacggacactacactacttactctgctgtcttcactctactacgcctacctcttcataaccccctcaacaccccactccctcttagccaactattgtgcctatcgccatactacgtctttgccgcctgcgaaagcacgcggtgggcctagccctactagtctcaatctccaacacactactggcctagactacgtacataaccttaaaccttactccaactgcttacaaacctaatcgtcccaacaacttatacttactaccactgcacattgacttttccaccacacaaacacataactttgaactcaacacaaaccacccacacgcctaacttattcacgcatcactccctctactacttcttttacaccaaatcaaacaaccaacctatttagccctgttccccaacccttttccttccgaccccctaacaacctcccctcctaactactaacctaactgaactcctaccccctcaccaatccatggccaagccaacgccacttatccagctgaaccactactcacgcactcaaccctctacctctctatactaactctccctacaacactttccctttactttctaaccactctcacggcccacaagacattaacttactacttcaacactcttcctttcgacaccccacccttacatccccaccctgtgcgtcattcacccccgcatacagtcaaccagccataaacgccctaaccgccgcgcacaactctccaatctaaccccctattatcctccccttcccctccctccttcccacttactttccctttcacacccccctatgccaccctaccactcttatcacccccatctcactgccccgacatctcaacacttctaccccacttctcctctcgctctccccacacctctctcttcacccccccctcaccctcccttatcctaacccctataatcccacctgcacacattcttcccctctcacacccctctcatccccactacgcaacaaacccacacctacatctcactcctcacaatacat

SEQ ID NO: 696152 - DNA, 1003 bp, Homo sapiens
  misc_feature (178)..(178): n is a, c, g, or t
  misc_feature (180)..(180): n is a, c, g, or t
  misc_feature (193)..(193): n is a, c, g, or t
  misc_feature (227)..(227): n is a, c, g, or t
  misc_feature (724)..(724): n is a, c, g, or t
gcgtctttcgttctttcgttctttcgtctttctttctttctttctttctttctttctctttctttctttgctttccttctttcatctctttttgtaattgtgttgcaaatcatgtgaggccaattttctttccccttccttccttcctttttttctgtttttttttttttcccagagncntgcactccagccngggtgacagagaaagactctgtctccaaaacaanaaaattaaacacggtatgattccacttatctatcaagtgtctagagtagttaaactcatagagttgcaaactagaaaggtggcccccaggggtgggcaagagagaggagtggagagcttggtgaatgggtgccatttccattttgaaagataaaactgttccggagacgatgacggtgatggttgctaaacaatgtgaacgtacttaatgtcatgaaactgtaaactgaaaaacagtggaaattgtaaatgtttatactggccattctatatgaactgatatatatttataatttttaaacaaaaaaaaaaaaaaaaaacttgggggcttattgtcgggggggggaaaaaggggtttgaaagtggcactttggccaatacgtggttcctggccacgttttttttgtcacaagcggggaaactggggcgccccccaaatagggaggcgaataaaattcgaaacccgggtacctgttggcttctccccaaaacaaaaanccgaacacaacaaagaccacagtcaaagaacacaggaggggaacaacacgtttacaaaaaacctgcgtacacaacactatacactcagcacatactcaccatcatcacacaacaaaacgacgaacactatccatacacacaaaaacaaaatatttaaatacaagcgggacaaaagacaccaaaacaaccaacataacaagaacataaaaccaacgcaagcagatcaaaagaacgcacactaataacagaaataatcaaccaaaaacacaaggacacgaa

SEQ ID NO: 696153 - DNA, 878 bp, Homo sapiens
ccaatttttgcatcttttagtagagacggggtttcaccgtgttagccaggatggtctcgatctcctgacctcgtgatccgcccgcctcggcctcccaaagtgctgggattacaggcgtgagccaccgcgcccggccttggtgtgattttatatatagactttgacatgaatagcctcatactctctgagcaatcacacattcgacaaggtgcctgtgagcaggctgctggtctgacaccgaggcccgtggggacggcggatgtagcctgcatgcaggagggaaggctcgactgtccaccagtgacacatgctcagcaggatcgacatgtggctcctgagacaactgctgagagaatctgatccaggttgtgtgcaaaatagaagaggctggtatcaagaattagagtcactttactgcgaggcagtctggtatgcaggtaaaaggtgaaattaggaccaaagacggagaacatttgacaatttctattaacagtttaaaaagttgatctttatctttattgggaagctgatgtccagagaacgagccaagggattattgggaaattccctctatattttaacaatatataatggtgcgtgtgtgagcatggagtctacgctctggtaccccagactgtaagtgcagtggcacagaccttgggccagctgcaaacgtccaaactgcccagagttgcaagaggcattcatcacccgcgcctcaggcgtccaccaagtacgctggggaaccacagggggtgagccaacccaggcctggagtaaataggcggggcatgccaacagaagcgggtcgaaccaagcatggggaccaggcggaacaggaatacctggaatcaacggaacggacgcgataggcccgc

SEQ ID NO: 696154 - DNA, 370 bp, Homo sapiens
agcgggattgatggtccagagcgtcctcctccgagtaaccgaggccccagcgtcggttcgaccaccgggagacccgcggtcctctcagtggcacatccgggcggccatttctttctgtaaagagcaagcaagacattcagctcccaccagccactcctaaaaggggtgatgccaacagcatacacacggagacgcacaggcagagaaacgggcagctgggggcttccctgaacacccaaacaacaaaaaccacacagtgcaatggcacacctgagaccaggggcagcaggctaccccatgaggccagagagtcagcattttcagatctgtgggccagacggtccctgtcatgctggctcaactctgtctt

SEQ ID NO: 696155 - DNA, 601 bp, Homo sapiens
  misc_feature (178)..(178): n is a, c, g, or t
  misc_feature (180)..(180): n is a, c, g, or t
  misc_feature (193)..(193): n is a, c, g, or t
  misc_feature (227)..(227): n is a, c, g, or t
gcgtctttcgttctttcgttctttcgtctttctttctttctttctttctttctttctctttctttctttgctttccttctttcatctctttttgtaattgtgttgcaaatcatgtgaggccaattttctttccccttccttccttcctttttttctgtttttttttttttcccagagncntgcactccagccngggtgacagagaaagactctgtctccaaaacaanaaaattaaacacggtatgattccacttatctatcaagtgtctagagtagttaaactcatagagttgcaaactagaaaggtggcccccaggggtgggcaagagagaggagtggagagcttggtgaatgggtgccatttccattttgaaagataaaactgttccggagacgatgacggtgatggttgctaaacaatgtgaacgtacttaatgtcatgaaactgtaaactgaaaaacagtggaaattgtaaatgtttatactggccattctatatgaactgatatatatttataatttttaatatttatacatggtatattttcccacaataaagatgaaaattaaagcagttggatgtttaaaaagaaaaaaaaaa

SEQ ID NO: 696156 - DNA, 377 bp, Homo sapiens
cttcctcataatattttatactgagagtatcatttatatgagagctgtcccccgtgctcacagaagtgggttctctgaatcttggaagacagcagcgacaggattccccgaacccgtgtttgatgaagctctgactgaggagcaagcgagcaagcagcagttcgtggtgaagatatggaaaagagtccctgagcccctgcgatttggtgaaggaagctacgaagaaggaaggagcgctaacgatttggtggtgaagctaggaaaaaggattcccggaaggagcgagtgcaatatggtgatgaaggtagcaggcggcttggcttgtcaaccacacggaggaggcgagcaggcgttgtgcgtagaggatcctacaccag

SEQ ID NO: 696157 - DNA, 400 bp, Homo sapiens
taccagagtgaatgtcacagcaatgaaaataccaggtccattcatgcagtccttgtccacgtggagcttagagtctagtgcaggatacagataacacccactaaatgcacagttcacaatgtcttcacatttggctctgccactgccccaggcagacaggttgctgaactgactgggagcatctgataaagatggaaggaccctgcttcttaaagatctagcctctgatatttggcagtcctaatacattacagcctactagatcattttagacctttcttgaggacctattcttataatagccttattgaggctttgggtgtccctatatgcaaaggccgatcaaaatacactcttctcatttaaaaaaagaggaggggaaggaaaatctacagaggaa

SEQ ID NO: 696158 - DNA, 317 bp, Homo sapiens
tatgttacagaaatcagaggagagatagtgaagggagccccttggagaacaccagactcccaggccccctacatctatcgagtttgcaatgtcacaacctctctgatgttgtgctcagcatgagtctttaatagaagttatatatgtacgtgcactctgctaatcattgtgggtgaaccagtggaacagcgggaaaactttgctattattcacagattgcctcctaatgacgcgactcaaaaggaaaccaagtggtcaggagttgtttctgacccactgatctctacttacacaaagaaaatagtttggggagaaca

SEQ ID NO: 696159 - DNA, 752 bp, Homo sapiens
ttcctccacggttctgtgcagcgtgtaacaactcaggcctgtacgacagcagtaggttggagccatcaagcatgtatccgtatgctctacatgtgggatattaatcggtggagactacattttctcagtgatatactttgtagggttaaatacctgcacggcagggggctcgagatattccatttaaacacggagcagcctagttctaacctgaaactctgtgggtgaagaagacatctgtggttggatagcgaagaggctaaagagtctgcagcaggacttggagactgacggagtgactgcgggctgggggggcattacccagtaggaatgtgaagccagaggttccggattccgggacatccacccctgggcaagtgagagcatctgcaaaacgcaaagagaacgtacctcatagggacaggatgagccaatggcagtctcaagaaactgtactcgggcgaacaccttacctgtggaaagcacatcttttcaagataagccactgggactcggtaggtggagccccagctgctcttctagggactatgggcccttcgtggcatctctgtgcagtgtgctggggtaggaggcttgatgtcaatcggtgactctttgcagatccagcacgttggcggtgattcccaaggtcctagaccaaagcagagggccagttgtttcagtttaaacagacatgtctctagtctaatagattagtaacgccagtaaagtataactccgctggtgaagta

SEQ ID NO: 696160 - DNA, 221 bp, Homo sapiens
gcggtccttgatgatagcacgcacagagcgtaagagagctctgtaagagatttgaattcatcagtgaagttaaaagtcactggccgggtgccgtggctcacgcctgtaatcctagcattttgggagcccgaggcgggcagatcacttgaggtcaggagttccagaccaacctggccaacatggtgaaaccccatctttactacaaatgcaaaaattagctg

SEQ ID NO: 696161 - DNA, 394 bp, Homo sapiens
  misc_feature (8)..(8): n is a, c, g, or t
  misc_feature (20)..(20): n is a, c, g, or t
aatgtccnaaatgcaagtcnacactggggtttaaggggttttaaataaaatgaattttggggggacacaagtttaagtcccataacattctgtccttgacctgcccaaaatgtatgtccttctccccatacaagataaatttattcccatccccagccgggcatggtggctcacacgtgtaatcccagcactttgggaagccaaggcaggcggatcagaaggtcaagagatcgagaccattctggctaacacggtgaaaccccatctctactaaaataaaaaaaaaattagccaggcgtggtgcgggcgcctgtagtcccagctactctggaggctgagacatgagaatggcataaacccgggaggcagagcttgcagtgagccaagatgggcc

SEQ ID NO: 696162 - DNA, 633 bp, Homo sapiens
ggctcggtggtggccgtgcggctggatccgctcccgcaaggtttgtggactggcgccgtcgtttcggaacatctatcgtggcctggttctgtgaccgtccctgtgggtgggctgatcagtcgcatgcatgtctactggtctcattctcatgatatgggactccttccagtagtggtgttgagtttgtcattcgttccaggctgcaaacagcgtaaagggactggttcgtggtgttgagcgatgtgggagacatgtgtgactcgttgccagagacgatacagcgaatccatgagtccagtgcaacggccgtcttcgtcagtgaccgagcgtcgtcgtgccatcgcctttcacgaggaaggctcgctatcaccaaaacgtgttcaacccaaggctgccgggagtactcaaccatatggccgagacgtagaggtgtgaaaggtgacatggtacgattaaagtaaactaatggtagttgagaaactgggtaatcgctgggacggaatgaatagagtggtgaggtgacaggtgagagcgtatagtagtaattgtgaaaaagtaagtgcttaatttgggtaagtcaccaatttagcacacagtagagggaaggggagatgaatttaagagaaacattat

SEQ ID NO: 696163 - DNA, 589 bp, Homo sapiens
  misc_feature (1)..(1): n is a, c, g, or t
  misc_feature (111)..(111): n is a, c, g, or t
  misc_feature (135)..(135): n is a, c, g, or t
  misc_feature (149)..(149): n is a, c, g, or t
  misc_feature (173)..(174): n is a, c, g, or t
  misc_feature (183)..(184): n is a, c, g, or t
  misc_feature (187)..(188): n is a, c, g, or t
  misc_feature (193)..(194): n is a, c, g, or t
  misc_feature (237)..(237): n is a, c, g, or t
  misc_feature (267)..(267): n is a, c, g, or t
  misc_feature (278)..(278): n is a, c, g, or t
  misc_feature (284)..(285): n is a, c, g, or t
  misc_feature (290)..(290): n is a, c, g, or t
  misc_feature (298)..(298): n is a, c, g, or t
  misc_feature (306)..(306): n is a, c, g, or t
  misc_feature (310)..(311): n is a, c, g, or t
  misc_feature (328)..(328): n is a, c, g, or t
  misc_feature (333)..(333): n is a, c, g, or t
  misc_feature (340)..(340): n is a, c, g, or t
  misc_feature (343)..(343): n is a, c, g, or t
  misc_feature (345)..(348): n is a, c, g, or t
  misc_feature (351)..(355): n is a, c, g, or t
  misc_feature (357)..(357): n is a, c, g, or t
  misc_feature (360)..(360): n is a, c, g, or t
  misc_feature (362)..(362): n is a, c, g, or t
  misc_feature (405)..(405): n is a, c, g, or t
  misc_feature (424)..(424): n is a, c, g, or t
  misc_feature (435)..(436): n is a, c, g, or t
  misc_feature (450)..(450): n is a, c, g, or t
  misc_feature (464)..(464): n is a, c, g, or t
  misc_feature (468)..(468): n is a, c, g, or t
  misc_feature (471)..(471): n is a, c, g, or t
  misc_feature (478)..(478): n is a, c, g, or t
  misc_feature (484)..(484): n is a, c, g, or t
  misc_feature (490)..(490): n is a, c, g, or t
  misc_feature (519)..(519): n is a, c, g, or t
  misc_feature (522)..(524): n is a, c, g, or t
  misc_feature (563)..(563): n is a, c, g, or t
ntggggtttttcttacaaaataatttacagtatgaaaatgatataatgaaaaataaacccaaaagtgtaattcccttgaaagattcagtgttcccttgtttaatgtaaaangagggggggggggattcggggggngggggtgggggtgnggagggggagatgggggggggggnntgggttggnnggnngtggnngttcatgctgtgtggcctgtcactgtagaaagcctggtcaggnttaaccctcattaagtattaatctgctgtnccctcaaagtnatatcnngcccngtatgggntccgtggntttnnttgcaccaatgtatccntaagngtctcgngtngnnnnggnnnnngnggngngggcctcgttctgctgtttctggtatgttctcagttccaaatnatactatcttatcttaggngggaggggtgnngagtgggggggtgnctgggtgttatggnttcnggnatggganagggtngggggnttcataagcactgctgggtggggggggtngtnnngggggtggggtttcccatatgggcttttttttttttttngggctgggctgggctaggtggatagt

SEQ ID NO: 696164 - DNA, 526 bp, Homo sapiens
tgctgatggtagtctagagatcccgtgagtgtcactgtgtgctaatggaaagtattctgagcaagttgaagggaggctaggtgagctatgatgttcagtaggttaggtgtagtaaatgcattttggttaccatgtttcagcttatggtgggcttatcagggcataatcccaccatgagtcaaggagcatctgtggtactatgatatccaagtggttttacaccattcacgggcagtgcttaaacaaaataggtgggccgggtgttggcggctcatgcctgtaatcccagcactttgggaggccgaggcaggtggatcacttgaggtcaagagtttgagaccagcttggtcaacacagtgaagacccatctctactaaaaacacaaaaaattagctggatgtggtggtgggcatttgtaatccctgctactcaggagactgagggaggagaatccgggaggcagaggttgcagtgagcagagatggcaccactgcactccagtctgggtgacaagagcgaaactctg

SEQ ID NO: 696165 - DNA, 199 bp, Homo sapiens
tctgataatcccagacactattgggggccaaggaaggcagatcacgaggatcaccagtatcgagatcagcctggcaatatggtgaaaccccatctctactataaatataaaaattaaccaggcatactggcgagcgtttgtaactcccaactactcgggaggctgacgagcaaggagaatggcgtgaacccgggaaggt

SEQ ID NO: 696166 - DNA, 544 bp, Homo sapiens
  misc_feature (18)..(18): n is a, c, g, or t
  misc_feature (96)..(96): n is a, c, g, or t
  misc_feature (165)..(165): n is a, c, g, or t
  misc_feature (169)..(169): n is a, c, g, or t
  misc_feature (181)..(181): n is a, c, g, or t
  misc_feature (183)..(183): n is a, c, g, or t
  misc_feature (230)..(230): n is a, c, g, or t
  misc_feature (264)..(264): n is a, c, g, or t
  misc_feature (287)..(287): n is a, c, g, or t
  misc_feature (320)..(320): n is a, c, g, or t
  misc_feature (373)..(373): n is a, c, g, or t
  misc_feature (448)..(448): n is a, c, g, or t
  misc_feature (475)..(475): n is a, c, g, or t
  misc_feature (521)..(521): n is a, c, g, or t
  misc_feature (537)..(537): n is a, c, g, or t
ggccttgaggcggtggangcaggaggcttgctctgctggaactgctcctccaggggattgctggttttggcattttttttcctttcatcatatttnttctgattttttttagttcgttttttgtttaaaatctcttcttcctcaggggttagcttggctcccttnttgnggcccaggggcngngcatagtgggattggtaccattgtgggtagcggtgtgctgtggatgngcacgatgcaatttttcaccaggcgttttggtangaaccagctcgttattagatgcnttgtggaaaacatcgatgatccttgttttacgngttcaacactttgagccccaggggaaattccccacgtccaacctcaggcgcangcgtatttcttgttacctccccgcacacgcgactgtgtggatgcggcgggggcgaatgttgcgtgtggcgcagcngggcgccccaactcatacttccgcttnttgtggtagggctttctcttgcccccggttttgcggcgcttgttcnagttgttccgagaaangcccatg

SEQ ID NO: 696167 - DNA, 132 bp, Homo sapiens
tgtgtcgcgggcggacttcctcacccgcttctacaacagcctgcagctggcggcgctgtcggccaccctggcgacgctgatcgcggtgccggcggggctggccatcacccgctaccgctttcccggccaggg

SEQ ID NO: 696168 - DNA, 202 bp, Homo sapiens
cgcatagtcatgcgccggcaagccttgttaatgtatgcattacaactctaccctgctgtttaagatgaataggcagagttgccaggaaaagatagttgcccaatattattgcggagggactattattcatcatgcagaaatgtatgatgtaattccacctgtgtttatagtggggacatattgtcaggggtgcttggttgta

SEQ ID NO: 696169 - DNA, 848 bp, Homo sapiens
  misc_feature (113)..(113): n is a, c, g, or t
  misc_feature (773)..(773): n is a, c, g, or t
tggtgctagatttctctaagccatccagtgccatcctcgtcgctgcagagagacacgctctcgccgacgccatgactgatgcaagtatgcatccctatcgatggcgaccctcnaagggtccacaacggggtggcgttaaccacctaggatcggtcactgaccctcggcagagttcccaggtaccatggatcctcatcctgcgctctcagcagtagtaaggaccccatcaatccatgtgagaaactgaccaagggagatgcatggaccaacttatggatattccgacgagcgtgctctcgcggggtcgactcccacctctatgtgagtcgatgtggtggtctctcccgtcaggatggcccagtgtttgcccgtcctcaggctcctgcggcatggcaccctcgtgcgaccctcttggcgcatcgtctgctaaacggggtacccagcaacggcaaggcgcatcttggtcgggcccacttactccatagggaatgtgcttggagctggtgcgcctctctcatccttcattgcagtaaactcgggcccacgtaattgtccgtctgcggactccctccagcacgtagtgagaataagcattcgaacgctaattgcggtaataacgccctggcgattgtggtggccaagaattacagcgtggtaccccagggcttgggatggacgcccacctccatgcaggtggggggtggtacttgtggtttttccccggctttgctacagcccccgaaacaagaccagcataagccgttataccatcnggtcgtgcctagtgggctggggacgaaagcgtggtccacggttcttggaaccatgagtcaacttgggagcttgaa

SEQ ID NO: 696170 - DNA, 169 bp, Homo sapiens
atgatgcgagaaccccaggattgatgtagtgcaaaaatgacagatgctctccatatggcccttgaatatatttcaggtcagatagaacaagtaggggaggggaggagcattccaagatctacaggatcagagttgtgccttaggcctggtcagaacatttgtggggccc

SEQ ID NO: 696171 - DNA, 136 bp, Homo sapiens
aataacattgtctgatttactggtcagactgcttcaaggaaatccatgtagtacaaaatgcttgctcgcagttgctccataccaaatggttgcttaacccaaatatctagagcagcaaattgagctgatccttctg

SEQ ID NO: 696172 - DNA, 594 bp, Homo sapiens
  misc_feature (215)..(215): n is a, c, g, or t
  misc_feature (267)..(267): n is a, c, g, or t
  misc_feature (446)..(446): n is a, c, g, or t
  misc_feature (450)..(450): n is a, c, g, or t
ccaaagtcaccctgaagggttttgacttagcccccctgtggttgggaacagcaaaaagccttcgccagtctttcttttctacccgtcctacccagaaaaggtccgtggggtttttgctgtggggaatgaaaagaacaaggctcacttttcacccagggttctgcccacagtgataccactgcagaccctgcctgccacgcctccagttttttgantgttcatgagcccccgttgctttatgacctgtccaaggaccctggtgaaaantacaacctgttggggggtgtggccggggccaccccaaaggtgctgcaagccctgaaacagcttcagttgctcaaggcccagttaaacgcagttgtgacctttggccccagccaggtggcccggggggaggacccccccctgcaaatttgttgttattttgggtgcaccccccgcccagnttgntgccattgcccaaatccccatgcctgagggcccctcggttggcctgggcatgtaatggctcctcactgggagcctgtgggggaggctcaggtgtttggagggggtttgtgcctgataacgtaataacaccagtggagacttgca

SEQ ID NO: 696173 - DNA, 573 bp, Homo sapiens
agaggagacggggagtcacatttcagaagcacctatgctttaaataccatatatcttttcttcctcacaactcctcggagccagaacttatggtccccattttctaccaatggaaaatgaagccctaaaagagtcagtctcctcctgcacccaaaggcagggcatgaagggtgctgctggggcctgactgccagccctgggcctgcccctaggtggaagagcagctgatccgctacgtgcatgacgggagcgagacactgacagacagttttgtcctgatggctaatgcctccgagatggatcgccagagccatcctgtggccttcactgtcactgtcctgcctgtcaatgaccaaccccccatcctcactacaaacacaggcctgcaggtgagagcatccctgggaacacccccatgtctgcttcgagaaagaggccagcgtcccctacttcgcggctcagagctcccccagctctgatcctcagtttcctcctctgcaaaatggggacgctgccacatgcctcacggggttgttggaaggagagaagtgagattgtgctgaaatagaaaaa

SEQ ID NO: 696174 - DNA, 237 bp, Homo sapiens
aggtgatcgagctcgtaccggcatgtgctgtaggccagcggaccaatttaaattatgtaccgggagttcccattgtgactcagtaggttgagaacctgatgcagtctctgtgaggatgtgggttcaatccctggccttgctcagtgggttaaaagagctgacattgctgcaagctgtggtgcagatctggttggcatctggtgctgcgctggcctacagcacatgccggtaccgagc

SEQ ID NO: 696175 - DNA, 153 bp, Homo sapiens
actcttcagtcctcgagatgcccagtatttatatttaaaaggtactaaatcagaagtactgaatatagataacccagacttggctaaatatccacttttttccaaggctagaagatatgaatgttcccttgaagctggtgatgtattattcat

SEQ ID NO: 696176 - DNA, 614 bp, Homo sapiens
ttctcggccgcgtgaaacccccgcggctgcttcctgggcaaggtcgtgagtcccgctgagctgtccccggtgccgccgacccgggccgtgccgtgtgcccgtggctccagccgctgccgcctcgatctcctcgtctcccgctccgcccgtcccttttccctggatgaacttgcgtcctttctcttctccgcctatggaattctgctccgtgcttttagcccgtccgtgagccaaagaaacccctaggacaacgagatagcgccgatacgcaggcgctagtagtcagctagacgtcctccagactcgagtttctggtgccagtagtttacagctacttataagttttactataactactactacttactgttattatagcagtttttgataccgtcatagttctgtgttacacatcttgaaaggcgctcagtagttctcttactaaacaaccactactccagagcaatgggaacgctgattaccagtactacagctgctaccgccgcttctggtccttctggtggactaccctatggatgctcatcctgggcttcattattgcatttgtcttggcattctccggtgggagccaatgactgtagcaacattctttg

SEQ ID NO: 696177 - DNA, 186 bp, Homo sapiens
gtacaatttctacaccatggagttgttcctttggccacatatatgcgaatctataagaaaggtgatattgtagacatcaagggaatgggtactgttcaaaaaggaatgccccacaagttgttaccagtggcaaagacgtggaatgagtctacaagtgttaccacagcatgctgtttggctattgtt

SEQ ID NO: 696178 - DNA, 110 bp, Homo sapiens
tgactctgaggattctcacactagtcacagcaaacacataaaacacactagtttatcacagcatcgaactgattaaatattaccatttttcctgggccaccttcagacct

SEQ ID NO: 696179 - DNA, 115 bp, Homo sapiens
acaggtgatgtatgcacctctcctcccggggctggcggaagagatgcagtagctttcaactccagaaactggaatctggagcccatgagcgcggcgaatgcatcccccgcgcccg

SEQ ID NO: 696180 - DNA, 161 bp, Homo sapiens
gagaaaagtgaaaactcatatctgaaagattataaatatacttcatatcaatttcccagagaacttaaacttctaataatattggtgatattctcatggttactattttatattatttcctgcctttgtaggtactggtgtactatgacagtatataaggt

SEQ ID NO: 696181 - DNA, 339 bp, Homo sapiens
agccaaggttacttttatatgggtaggatgactgcagaaggaatggctacacatagcttccagaaccttgccatgcagtagtgctctccagaaggatgcgccaggtgtatacagattatgcatgcacaaagacaggtgtgcgccccacccaccctgggctgggcagcaagaggtctgctcacctactgcaccagacttcctagcctccttccacactccgaagtcttcaagcaggatgaaaagagaccacagaaactgaagcaagactaggatgctgcaaagaaagatgctctgatacacaaaagccaacacataagcacacaggcagggcaacagcag

SEQ ID NO: 696182 - DNA, 1185 bp, Homo sapiens
agaaaaaacaaaattcttccttctaatctacctgggcgtggtgatatgaggttatatagcgccagctactctgaaggctgacgtgcgaggatcagtagagcccaggagttggttaagtccaatcctatgagatttttaaggattttggatagatttttccctccagaatgtttgcatctcattccaccatgtgcgatcagccagtgccattcggtcagttaacatgtgtcagttacacagtccatggtttcctaacaactatcacaaatagtaagggccaggcgcccagggtatcctgcctagtaatcccaagaccacttaggggcaggctagaggcgggtggcatccacttgcaggtccaggagttcgagaaccgaccctgcaccaaactatggtgcacaaccctggtctctcactgcaacaatcaccaacacaatatagctcaggcgtaggtaggcacaagcctggtacagtcccaagctcactgggcaaggcctgaggccaggcagcaatccaccatgaaccccaggcaagtggagggtagcagcgcagccgagactcactaccagtaggcactcccaggctgggcgaacagcacgggacgaacatctctccaacaacaacacatacacaacacaccgtacgcaactgacggtgaataggagcgccagaacggaaggtccctccaacatccacaataagtccacgtcctataccattctcccactgcataaatgacgccttggacgtctcaagagcacggccacgctactccatcgcacgtacaaacgagcacaattatacaggacctcttcgtgcaagacgctgaggtgcatcttactcctcaaccttcttgggacatgtgcctggctaatccatacacacctgtgcgggcaagcacacgggatgggaaagaactggacacgcgtacacaactcacgggtgacaacatcagctcccgagggccaccaggctacgacaaaacgcagagaaccaataagagaggtgaatatagcaaaagaaacgccaccatagagagagcatacgccccaacacggactgagaaaatggaacacacaccaaacaagcagaaaacacaggcacaccagccggcaaagtcaagaacgacgcagaccaacaaacacacagagataaacccataccgaccggccgccaaaaacaaaa

SEQ ID NO: 696183 - DNA, 880 bp, Homo sapiens
acgcgtacgccggagtatgggatatcgtcgaccacgctcgattcaccttggacacgatatagtatttaatatatttttcactatctgagatacaaataaagctttattgataaaatatggaatgaaaacaccaatgtgtgttggcatatatagtgaggcagtgtgccttctacaatagtatatgttaatctttttaaagcatggatttttcatatatgccagtatgtctactattgtagaagattatgtttttaatgcctattaaaaaaataagtataatccaaatcttacctcttcaaacatcactaattctctaacctaaacccaatttctcagccacgccacccaaatgttaatttctggagaagtggtgtctttctgtcttagagttataggttcttttcttatttagaggttattgtaaggctagttggatttcttatctcatttgtcaatgatggcatattaatatttgttaaacttttcagtaatacatgaaggtaaaatttcaacagaacagtaaatcaaactgactttggtaacattacccaacaacctattcttcctccagagtaattttcctattggctgtagaaaatactactttttcttgtaattcgagaaattatgcttgcaactaatataatagcaaatcaaagatctgtattttcctgtatgtcagttgttgtcgactttttaagcaaaccacatcaaatttatgtgtcctaattggggtattcagcatccaactttacattttatacttcattcaacatcgtcgtgccctgtgtttctcagccaaaaggatattgacccttattcaccacaatgtacaggcttttccatggacctgaggtataatccctatactttgtggccc

SEQ ID NO: 696184 - DNA, 927 bp, Homo sapiens
tggaaacaaggtctcactctgtcacccaaggggggtgcagtgacgaattcacagttcattgcagcctcaaccggggttcaagtgatcctctaacctcagcctcccaagtatttgtgcctcctaggcacaaaaaattatgcccggcaaatttttggtatttggtatttttggtagaaacaggatttcgccagtgttgggccaggcgggtctcgaacaccgtgggctcaactttgatccgccgtgcctcggcctcccaaagtgcggggatcacagggtgtgagccacccgtgctcaaccaggtttatatatttaagctagtaaaacttgggatagatggtataatatatagtaagtgtaatcaatgcgccatattttttaaaggtaaattaaaacatttattaaaaaaaaaaaaagaaaaacctctggagggacacttatattgctggggggcgcggcgaacaaaagagggtaattgaaggtgccactgggccattagcgtgtttcttgtgacccaagttttttgtgttacaaggggggaaaaatcggcccggggcccccaaaaataggaagggcggaatataaattcggagaaaagcgccggcgttaacccttgcttagctgtccgtccggaaaaacgaatgaaacaaaacaaaacaccgacaccaacaacacaaaaaaagcaaaagagaaacaaaaccaaacgagaaaaaaaacaaggacagcacaaaacaaacaaaacgaacaccaacaagaacaacaacaaacaaaacaccaaagaatacggacaaaactaagaacaaagaaaaagaacaaacaaacacaaaagaaacacacacaaaaaaaccacacaaacaccaccaacaacaaaacaaaaagaataaaagacaacaaataaaaaaaaagacaaagcacgaagcaaagaaacag

SEQ ID NO: 696185 - DNA, 113 bp, Homo sapiens
tcaagcttctaacgatgtacggggacatgtgaaactgatctgttggtaactggaagaaaactcagcatctgtatttatacaataaaattgattagtatttaaaaaacaaaaaa

SEQ ID NO: 696186 - DNA, 177 bp, Homo sapiens
gcggccgcctactactactactgctcgaattcaagcttctaacgatgtacggggacatgtacttgggaggctgaggcaggaaaattcttgaacccaggagacggaagttgcagtgagctgagatcacaccactgcactccagcctggtgacagagcaagactccggctcttaaaaaa

SEQ ID NO: 696187 - DNA, 958 bp, Homo sapiens
gctgcttggaaagatggcgtccgcaaggagaggtaccggctctactgccatctcttccagctccaccgtgcgtgcgtcagtcagggcaaaggcaagaggcaaaggcggctcgggagattcagccgtgaagcaagtgcgagatagatggccttgtggatattcagagataatcacatagctattatcaagaagaaggacaaggaactgaacgttgttcaaggagtgctttggggtctggcttgtagaagatcggcgttgtaacattaccagctgcctttccttaccctcaggcatcacagaggatgatgctgactgttgatgaagtccgaatatcacgcatggaagatagatagcggagaccttacgccgatgtaaacattggatcatcttgcacggtgggctggtatcagtccacatactatggcctcattcgtacacccgggactactcctggatctctcagattatagttacgcagccatggcattcgaagaatctgtcgtactcatgaatgatcccatctgaactggccaaggatctctctcactaaaggcatagcagcaatgactcctaaactgatggaagttagtacaggacgcggcattgatcccctgagagcatcgacaagaacggccgaatatcagctttgagtacatgtactgacgcaagtgccgcatgtaatcaagacaatgcacatctgatcaatgtcctcactgtgggaactcggacacacgaagccagctgtctgcacataacccctgaattgctcaggccgtgggccaggcaggcaaatcacttgggggaagaaatcctaacaagttgccgaattggacagcatggcatgaaaccgcagcccgcatcatagttcaaatacacacacatacccttaggaatcactacccaaacaacagcaagccgagccagatcaatctcaccaagagtaccccaccacgaaaac

SEQ ID NO: 696188 - DNA, 136 bp, Homo sapiens
gttgtcagtgggttatgtttttattctacgttagttgttaggacagggaacagggccaagacctccacactcccctgggtaggaacagtcaggagaattagatatatctaaagtgggcactgacaacggcctgaga

SEQ ID NO: 696189 - DNA, 1597 bp, Homo sapiens
ctggcgctatattctgactgtgctcagaagtccatgattccactactgagtccttttggcctacattactgctaatcttgtgaagtcgtgtccgacgcttgtaatctgcgctgtcaaattgtgccaagtccgaaatctggtgccgcgactttaagggtctcaatgtccataactgttacatcgtgtgttgttcgtaatattgcggcctctacaggggactcggctcctcaaactggtgggaattactcagtctgcctccgttactatatttcacatcgttggagtggtatcacctcgtgcctatggcggtctggcataaatggggccactcgcgcgtataccacacggtgaacatacgtttgtggtgtgtacacttttgacacaactggggggctccttgttatatctgagcgccgccaagatgttcgtagtatgtaacgtgtattggccaaacgcttatgggttcctgcccaaacagctttatctgcaaatatgtgtagttacgggacactgtcgcggcgtgccaaggttaaaaggcattatcggaggcgccaccatgtaagcgcggttagtaactgccattcgagatgtcctaatccgaagcccggtgtaagaagcgcttcaagttgtagttgaatggcggacattatgttgggaatttctggggggtcctgtgtcaggagtcgtcggtttcttaatgccaatctcctgatattagtaacgatcatcggttcaatgtaagtattttctccacacatattggggccccaatgtctctaacccagtttcagtactgcaactccctactttggtctcgccatgtttaattagagcgggcccaccttgttccgcaacatacgcccgggcggaaattatatgtgctctgtaaattgtcttacgctttaacgcgccagttgcaaaggatgacgcttttttctgtatttttgcatcttgcgttcatagggaattgtatggtgtgttgcatcgtaaaggcccgcgtgtttgcaatacgcaaggcgtttcgcaactgttcgtcattatgggcccccacgtaaacgctcgcgcgcagaagtgtgatgcgatgttggtcaacacttgggtctccgccgagaggcatagttcagtcgatcgcctgcagctagaaatgtcccgctcttaagataaggtctccatcttgccctatatagcaccatctcgtacttaactcgcatgcatgggagtattcataatcagcgctgagactgcaaccattatgtcgtagagtaggaaagagcaagccgagagatccagagatatagattccaatgcgaactgcgtccattacaatatttaactagggtcgtcctatttattagccctacacgtagcaagcctgcaagagtagctgtgcgagtcatcaccgttcagccatttgccgatcggcatctaacggctcaagcattttgtacgtagccagcaggcttcgcatcggacttgcacgtgcactgtaatggctcaactttccatcactatctgcttcatcacgccaactaatatttcactttacatccaaacatcactttggcttcgaagccaatcgcctgatagctggcatttt

SEQ ID NO: 696190 - DNA, 120 bp, Homo sapiens
tggggcagatcacttgaagtcagtagtcaagactagccgggtcaatatggcaaaacccccctcggtactaaaaatacaaaattagctggggtggccagggcggggtgtctggtaatccca

SEQ ID NO: 696191 - DNA, 487 bp, Homo sapiens
gtaatatagaccagaaatggcaaaacacaaagagaacagaaacgccccatcgcgggaggatgactaaaagacatgtcttgataagatattgtacaggcctaggccaggcacagtggctcatgcctgttatcctagaactttaggaggctgaggtaggtggatcacctgaggttaggaggcgaacgttgcagtgagcctggatcgtgccgttgctctccagcctgggcaacagagtaagactccatctcaaacaaataaataagaaataaagaagcagcatgtcgagggtggtgctatgtagagttgtcgggtgtgattggcatccagcatccggaagcaaggtggggtagggtgcagagttgactgacagcagagtctactgaagcagatgggaagctggttatggagctaataagtaaattgattgagcaaataagtaaacatatggatagtaacacaagccaggctttgcacttctggagacggt

SEQ ID NO: 696192 - DNA, 133 bp, Homo sapiens
tagctcgagactatgcatataatccactcatcacaggcaatgatagcattgagggactcggggatatctacacagccatacctgatcactcacttcgcactaactttctccggtactcatgcatatatgtcca

SEQ ID NO: 696193 - DNA, 403 bp, Homo sapiens
  misc_feature (33)..(33): n is a, c, g, or t
  misc_feature (392)..(392): n is a, c, g, or t
gttattgttgtttgagatggagtttcacttttnttgcccaggctggagtgcagtagcatgatctcagctcactgcaacctctgcctcccgggcccaagcgattctcctccctcagcctcctgaatagctgggactacaggtgcccaacagcacacccggccaattgttgtatttctagtagagatggggcttcttcacgttggccaggctggtctcgaactcctgaccccaggcgattcccccacctcagcctccaaaagcgctaggaccacaggcgtgaaccactgcgcccagtcggaagtaatagttattaaccaatgtgatggccgggtgtagggaccctcgcctgtaatcccagcactttgggaggccaaggagggaggaccgcccgngaccaagagtt

SEQ ID NO: 696194 - DNA, 369 bp, Homo sapiens
atcccacccgacgggccaacaagagcaggtatgttcattgaattcgttgtgtatcccatgccatacgccatagcagcttgtggtccttttaaccttgctacaagctcctctagttcctcatgcttgtccaggtttccaatttcctgccgagtactgcacactccagctccatactcctcaaggactttggcggctgcttcttgacatgatccagtattccgtgcaaatccaagatagttgtaggaacccatgtttataacaccctttattatattccctgtatacttgaaggaccagttataatcatgagactgtctctccatgatgtccaccctggctccaggcacactacagattggccttatcgag

SEQ ID NO: 696195 - DNA, 1180 bp, Homo sapiens
tcttactacaagtgccagtcttcacttagtacctctaggcgcgcggtaggggttaccagattcctccagcttgtgcgttcttcgatggataacagtggaggcgaggccaccgggctgtcaggctgaagctccgtggcggccgggtcctgcacgcaagaagaccccagcgcctggtgcggctcagggctgggcccacgggactcgcggacgcgccgtggaaagcgttgtcgctcccggtaggcgtccgcagctgctggctgctcatttgctgcggtgacccggaggctcggggccagcatggcccccactgcctgcaaccaggcgtaccggagcgccgctgctggatggcctgcagcgggcttgtgctggaaggaaccttctttctcactcctgctgtacctccttgagggacctgggggcatcccctggttgcatccatctctgatggcaaccgaagggcattctacttccagcacagttgacacagcttgcagcagcaggctatccaaaaacgaccccagggcatgaagccaatccgtccaggtgggcccagagcctgttgacccagccagcgtaccgagaatgcttctaccccttggtacgcttacaacccaattggcgtatcctattcgtgccttcaaggtcgccacaacacacactccatgacccacatgggggcgaactcccatccatatgaaccacggccttttagggcatccccgccaggggaagccacagaaaagataggtggcaattaggggcatatggggagcaagagttggcccacttagcgtctcttacatacagttcgccgggttacgcaatagccaaaaccgccttcatcatttgcgggcccccattgtgacgacattcacccggcagcgaacactgcaggagaaacgcctactctttgtagtacttttctggtttgaaacttactttcccgttgtgtccagcccttgtgtctctcccgtatgacaagtctggtccattctgtgcggactacgacgaactttctagtgagcccttcaaaatagctattccaactctgtatgtctgcgttatccaacccgtctggttccccaacccccagttgaattacgtagcgaaaacaccgtcgcatagcctccccagcggttacgacatcgtgggcgctcttctctcagttgtcagtattagc

SEQ ID NO: 696196 - DNA, 952 bp, Homo sapiens
ggccgcaccgtggctggctcatttacagatgaggcttctgctgcttctcctagtggcggcgtctgcgactggtccggacgcgaggcctcggccaatctgggcggcatgcccagcaagagattaacagatgcagtacgccacggggccgctgctcaagttccagattctgctgttacctagagcgttactaaggcgggtgtttgacggagtacactgcgggcttatcacgccagcggaaacccacgacatccgccatcgacaggagacgaattacctccctcaaccaactatatagacacatagccatcttacctgtcagatctctcaagactagtattaataggccttaactaatcgctcggcaaggatcctatcatgctatcacttcggccatgcaacgcctcctagccatcatggcagctgagggcccaaagacaacacttacggtacactgcactgtactgaactggctacccccttcatcgcacccacccactgactcgcacaacccacccgtactgcctcacacagcgagtgcccatactgacgaataaccttttcacatgcattgttaccctggtgctggctcctacagcctgcgcaaccctgcaccacctttccaatccatgccaaacaaacattgccccaaactacctcgcacaactgaaacttgaacgctccacaagctgccctaatgcgcattcaattcctaaccacccatccggatcataagcaaccaccctaaataaagcccactctgcaataccactcctcacgcccattctaacggcgacctcaactctcccaccgaaccacccgatccactataacacatgaaacaacggcccagcatacccatgaacgcaaccagacaacaggcataacgcacacgacaccaaaaccctcctgagacaaggccaagaagcaacctcgtggcaacaccccccagtca

SEQ ID NO: 696197 - DNA, 609 bp, Homo sapiens
  misc_feature (61)..(61): n is a, c, g, or t
  misc_feature (179)..(179): n is a, c, g, or t
  misc_feature (239)..(239): n is a, c, g, or t
ggtatttagagaggttttttgcgggaaaaaccgcgctaaaaaggtgtttctgggggggganaataggaagaaaccccaaacgcgccacggggcgcgcgggatagagttggggggccctcgcgggcctaaacacaattttcccaagagggtgtttaaaaaagagggagaggtaaaaaatnaaaaaattgtggcggtctccggggccgagaaggaggggtgtgtttttctcccaaaaaaanaaaaaaaaaaaaagatgcgggggggggtgccgcgggggggtgtttttaaaaaaaaaaaatttttttccggggggggccctattaaaaaacagggggggtgggtgtaaacccccccctcctaaaaaaaatttggacaaaaagggggggttcggagggggggtttcaaaaataaatcccctttccatttaagaggggcccgggccccggggaaaaattccccttttcgggagggggaaaaaaagggggcgtaatttttttcccggggtttttaaaacaaaaggggtttttttaaaacccggggggaagaggggaaaaaaaaggcttgggagaaaggggtttaaaaaaaataaaaaaccctttttgggggcca

SEQ ID NO: 696198 - DNA, 592 bp, Homo sapiens
ctaggccagcctgggcaacatagcaagacctcatctctacgaaaacatgcaaaaaatagctactcaggaggctgaggtgggaggatcactggagcccaggaggtcaaggccatgatcgctgcactgtactccagcctgtgtgacagagcgagaccctgtcaaaaaaaattttttccttgcttttacatactggttaagaaggtggccttgctagtaaggtccaaacattcttgtcctttttttcttttttttttttttggccgcttattgaggacttcaaccccttttgttccctttttttgacgttttggtggtggtgttggtggtaagttctttttaatttacgcacttttaggcctctcttaaaggtttttgtgttttaccggctcttccaactagattccttcggccggggattccattattcatagagcgccaccaccgggtaggccaccacttttggtcctttaagggaggtaaatgaagcttgggtactcatggctagtttcctgttattttctcctacaaatgtaacatcataagtcaacattacaaacccaacccttataactcacaagcatacactctatat

SEQ ID NO: 696199 - DNA, 782 bp, Homo sapiens
cctcccatccctacggcactctttacatcacagacgaggtcaacgaatccctcccttaccatcaaatcaattggccaccaatggtactgaacctacgagtacaccgactacggcgcgactacagtcttcaactcctacattacttgccccgcattattcctagcaaccaggcgacctgcgactccttgacgttgacaatcgagtactactcccgattgaacgcccgccattgcgtactaactaattacgatcacaacgacgtcttgcatctcatgcaggctgtcccctacattaggcttaacaatatcagatgcaagttcccgcgagcgtctaaaccaataccactttcatccgctacacgaccgggggtacctactacggccaagtgctctgaaagtctgtggagcaaaccacagattctcatgcccatcgtcctagaacttaaattgcccctacatacaagtctttctgaaactacgggccccgtattttagcccgtataagcacgccaccttcgtaaccacccctactatggaagccagaaacagagaacaatggcccacagtacccagacaagaccgagtcctaatataaaaaaggaacaccaagctatccgaaaggtacaatcaaaatagtaaggagaaacgaaggacagggcaacttctccaaaaaagccgcagttcccgccgtaaggcaccatccccgagtcagtagcggccacacaggttggccccacacgcgcgcccacggtgctatcagttgcacgagaccagatatacgtg

SEQ ID NO: 696200 - DNA, 1437 bp, Homo sapiens
gagacagagccagtggaccctggaaggaagcaggatggcagcctggaacagcagttggatgcctggttgctggtcctcagtctgtggggggcagtagtaggtgctcaaaacatcaacagtccggattggctgagccacttggtgctgaacgtgtaacggtgtggcccccaaagaaagcaccccagcgtgctggacatggaaacttgaacacatgtgccggacagaagcttggaaggtcctgtttcccacagtgacggatggcccctggtgacacgtgtgggctcgttgtcctatccacaaatggactacctctttccttccgggattgtcgggcgcattccagcgcattgcacgggggacacatatcccgtgttgcgccaggtgcaacatgtacaccagctgcaattggtcaaagtgtatgagacaaaggtccgatgactaactgccatatcccggtgctctacctaggaattccctgtgtgtataggcacagcacaccattggtcagaattctggcctgctggaagttccaccgggactgggtaggtacccccaaccttaaaggtgtggggcggccacattagtagttgtaccacgaaaaggggcaactgcttaaacgcctgggcatgaggacactcctcttacagcgtggtgcacaccttgtgcgattctgagaaagcccgccttgcgatgggcttacacttggagaaagggggcagtaaatctaggatacaaagggcaagccaagacccgatcggaagaacatgcgctgcagacgatggcgctcttccgtacagaagccctggaaggacaggaagaaaaaacgggacttacaccccatagcccggacaaaggcacaagacacgcggacaaaacacgtatcaccatggaacgccaacaagcccccatgggcaaatcaccacgataaaaccgagcggcaacagagcggcgagagacgcccaaacagacaacgaccaggacagcagagagacaacctgacgcaatcagtgcaaggaagaggcaccaagcagggagaggtcgaccaccaggtgtgagcgaacaaacaaaccgaggcgaggacagcaacacgcgcgagagagaacgagcgagagcagcaagaagagcagacagccaggagcgagaaggagggagaacgagggaacaagcaacaccaacacaaacagcgaacgacacacaagagccacgagagaggaggaggcacaaccagaggacggagccgaagtaactggaacgcaaagaagacagaggaacaaagagatagggaagcgagatgcaacaaagaagcgacaaagagcagagaaaaaagcgaaaggaaagacgacagaagaacagagaacacagaccagggcagagccaaggactagccagagcgagagaggacgggaagcgagaacgcgcgacacgcacggctcactg

SEQ ID NO: 696201 - DNA, 1179 bp, Homo sapiens
gaatccaggaactggcttattgaaaagatcaacaaaattaataaaccactagtcagactaatgaagaagaacacgagagaagaatcaaatagatgcaataaaaaatgatacaggggatatcaccactgatcccacagaaatacaaactaccatcagagaatactataaagcccactacacaagataccctagaaaatctagaagaaatggatacattcctggacatatacagcctgccaagactcaaccaggaagacacttgaatctctgacataccaaataaggtcaactcccaacccaaataacagtccaggacccgcaaggattcacagcccgaatactaccgagaggtacaacagcagcaagctggcaccataaccttctgaacatcatacccaatcaatagcaaaaacacaggcagtaccctaacctaacctacatcaccatgacggaccccaccaatccaaattctgcactacccacaagcccatgaccagggcacacacaactcacacacaccacacccaccacctacataaagaacaatcatacccatgacttggcaccaatccgactagtagaacacgatcccttaccacattagggtacacctagggcccacaacacaaaaagcccaggccaggcgaacactcgaaaagaccagcataaattcgcaacccaaaaccaaaattcaaaaaatacaaacacttatctccatatacccataatcaaacaatacacaaaacaccacacaaatatcaaaacaaacatacacaacccaacacaatccaacaaaaacaacacttaacaatcacaaacccccacactctacatacaacaaaaaaacccacaaattctaaaaaaaaataactataattaccaaagaaaccataacacacactacaccatccacaacacgatattcaaacacctcacaacaacaacaccaagataccattaccacaatttaacaaaatacccaaagcaaaaccaaaagagaaaaaaacacacagcacgaaagccacaagaaaaacacataaacaaggccgacaacaaactacagagattagacaagcaaaaaatcagagccaacagacaaagacgacacaagaataccaaaacagcagactcgcaccgacacaaaaaccacacaaaacacaacaaacgaaccaacaacca

SEQ ID NO: 696202 - DNA, 118 bp, Homo sapiens
  misc_feature (3)..(3): n is a, c, g, or t
tcngggtgctgcaagtttccacccatggacctccctctaccccgttaaccaggctccccccgcccctccgggccccccatctcacactcgtcctcgccgaagccgtccctccccgggg

SEQ ID NO: 696203 - DNA, 157 bp, Homo sapiens
acattcagctcggtacccagcgccctagcctatataactctaaaattaaaatgaaagaaaaatcaaatatcaggatttagatgggccttaaaagctatttagttcgacgactgactcaattcctgtttttttgtttttgcttttgtttttttttttt

SEQ ID NO: 696204 - DNA, 278 bp, Homo sapiens
aggcctccggggggccggggtttcccatgtaggggaggggagatttatccacaaacctcaggtaacagggaggtgggcgggtggggggagggctggccggcccaaaggcccgaggggttgggccttggggaaaacaaaaggctttaaaatgggcccccttgggggagggaaaaggcaccccggcgaggggcaaacgggggacccacccggggtgggcccctgggccccgggtttgtacaaaacggtttgttataaaactcaaaattttccccccggga

SEQ ID NO: 696205 - DNA, 386 bp, Homo sapiens
acagggggaaaaaatgggggttttttgggggggggaaggggggtggaaaaaggggggtaaacccccggggcggggggggggggaaaaaaaaaagggggggggggggagacacgcctttttttttttatttattggggggggggggtcccccgccccccccgggggggggaaggggggaactttttggctcaaaaacaccccccccccgggggataaaaagggccaccgggttgccaccgggagaggcggaggaaaaagagcccaggcgcactaaaaaggaaattctttgggtccttccaaggggggggggggctaacactaggggaaggggggggacctcctaccttagggacattttggggagccaggtctcaaaaggaggggcg

SEQ ID NO: 696206 - DNA, 331 bp, Homo sapiens
aggtaatgaccagcaggctggtaatagcctggcatttttgggacgggaaaataattatcagcatgtgaaagactagatatcatactacaacaaagccgagaccatgatgaacacagatgagattattaaaaatgggcctgacgaaggagatagcaggagagaacacgcaggttccagattctcaatgatgagatcatcaccatcctggatcagtacctgaagtcagacgacgggtaggacacgccagtggtgcatgtgcgctgcttccagccgtccatacaccagtccctcgccagcagctgatggcacgcgctgcactcagaaactcaac

SEQ ID NO: 696207 - DNA, 650 bp, Homo sapiens
cgcagaggctcatgcctgtaatcctagcactttgggagcccaaggcgagcggatcacttaaggtcaggagtttgagaccagcctggccaacatggtgaaaccccatctccactgaaaatacaaaaattagccggtcatggtggcatgtgcctgtagtcccagtgactcaggaagctgaggcaagagaattgctggaacccgggaggcggaggttgcagtgagccaagatcgcgccactgcactccagcctgggcaacagaaagagactccgtctcaaaaaaaaaaaaaaaaacagaggagaaaagaggagactcccgacagaagagagatgccgtatcttgggatggtcacaaagtccttttccaacagattttaggaatcagggagcaagctgaagaggagaaggggaagccctgtcacggctctcccacaacaaagcaagatgggggtgccggcccccgcaaggagctcccatgatgtgggcttggtgcaccgccgtgacgttgccccgggggtggtcccgggcattactcaagggcaaactcagcaattgcgctggctcgccccctcggtgatgagcttgatactctgcgattccttcaaattcacttgctcaatccacggtattctcccttctggggttctctcga

SEQ ID NO: 696208 - DNA, 448 bp, Homo sapiens
ccacgcattgccagcaaccaggcaaataacattacttatatagacccggtgcatccaaacaaggcacggcttctaacagcttcccataatctgcatgctacagagccaggaaaccaggaatcaagatatatcaggctaaaatacagccgcctcatctttgaggcccaccagctgattctgagaacctcctgcaccaccatggaaaagggattccctagccttctactaaccaaataccccagaagatacgatttcagctaaaaaagatagtggttccattaaccttaggagccaggaggcgagaccctgatccggggcgctctctgccacctaccgccagagccaacctccctgcctccctcggaacccccaacaccccagaacctcatgacccttgcagagccagcctgctgcctcctttgaagagaaccataagagaagcttcagg

SEQ ID NO: 696209 - DNA, 681 bp, Homo sapiens
  misc_feature (59)..(59): n is a, c, g, or t
  misc_feature (75)..(75): n is a, c, g, or t
  misc_feature (78)..(78): n is a, c, g, or t
  misc_feature (81)..(82): n is a, c, g, or t
  misc_feature (151)..(151): n is a, c, g, or t
  misc_feature (166)..(168): n is a, c, g, or t
  misc_feature (172)..(172): n is a, c, g, or t
  misc_feature (180)..(180): n is a, c, g, or t
  misc_feature (202)..(202): n is a, c, g, or t
  misc_feature (205)..(205): n is a, c, g, or t
  misc_feature (209)..(209): n is a, c, g, or t
  misc_feature (223)..(223): n is a, c, g, or t
  misc_feature (238)..(238): n is a, c, g, or t
  misc_feature (262)..(262): n is a, c, g, or t
  misc_feature (264)..(264): n is a, c, g, or t
  misc_feature (269)..(269): n is a, c, g, or t
  misc_feature (271)..(271): n is a, c, g, or t
  misc_feature (279)..(279): n is a, c, g, or t
  misc_feature (281)..(281): n is a, c, g, or t
  misc_feature (291)..(291): n is a, c, g, or t
  misc_feature (298)..(298): n is a, c, g, or t
  misc_feature (301)..(301): n is a, c, g, or t
  misc_feature (312)..(312): n is a, c, g, or t
  misc_feature (317)..(317): n is a, c, g, or t
  misc_feature (328)..(329): n is a, c, g, or t
  misc_feature (401)..(401): n is a, c, g, or t
  misc_feature (407)..(407): n is a, c, g, or t
  misc_feature (422)..(423): n is a, c, g, or t
  misc_feature (439)..(439): n is a, c, g, or t
  misc_feature (444)..(444): n is a, c, g, or t
  misc_feature (465)..(466): n is a, c, g, or t
  misc_feature (475)..(475): n is a, c, g, or t
  misc_feature (480)..(480): n is a, c, g, or t
  misc_feature (517)..(517): n is a, c, g, or t
  misc_feature (520)..(520): n is a, c, g, or t
  misc_feature (523)..(523): n is a, c, g, or t
  misc_feature (542)..(542): n is a, c, g, or t
  misc_feature (561)..(561): n is a, c, g, or t
  misc_feature (583)..(583): n is a, c, g, or t
  misc_feature (587)..(587): n is a, c, g, or t
  misc_feature (593)..(593): n is a, c, g, or t
  misc_feature (599)..(599): n is a, c, g, or t
  misc_feature (604)..(604): n is a, c, g, or t
  misc_feature (607)..(608): n is a, c, g, or t
  misc_feature (616)..(616): n is a, c, g, or t
  misc_feature (621)..(621): n is a, c, g, or t
  misc_feature (636)..(636): n is a, c, g, or t
gggcggagtgaacatcccgcacacgcctgtgaggttcaggcaggtgatggcgcataggnttgggagccctacggnggngcnntcagtcagtgatgtctctccaagtccgcagagacctgagggacgggagcgaagtgagcgccctcaagtngcagggccagggcannncagngaggggtnacggggcccggaaggcattggnagnggcnccagcggctgcggntggcagcgggcggtncggaccgcagggtgtggagaaganancagcngnaaatgctngnggggcctccngagagcnggnacctgtccggnggtanaaggagtgganncgtttcagcatgacaatccctagcacagcaatgccagtgaagagcagggcgaccagcagcatgagcacgganactgcngtgttgcccttcggnnccaccagagcagaganccagnaactgaatccccaacctgggnnaccaatggnctggnggacaaagagcacatcctggacgaagaaaatgaaganganaangaagaaattgaatgaactntcactccggaaagccttanacatggggcggtaccagcaganaaangagcanggagtnaaaangannacccagangatanaaagcccaaagcctncgccattttttggtttccacacagaagctggccaggcaggcgagg

SEQ ID NO: 696210 - DNA, 92 bp, Homo sapiens
catgttggttcttagtcaacatatactataaatgttacattttattacttgatggaaaatgtctaaatatggtacccttctgtcgtcttctc

SEQ ID NO: 696211 - DNA, 315 bp, Homo sapiens
tagcctaacatatcccctgatacaggagtgacgggagagagatataagcatgagaaagagcaggaaggctggtttgaagctggaggggaccacataatacggaatgcaggcggccttgaggtgagagaggggcctcctgcttgagagccagtcaagaactgaattccgtcgacgacctgaatgaacttggaagcagattcttccccagagcctccatgaaggaatgttgtcctgccaacccttatttcagcctttaagaccctgagcagagaatccagccacactgtgccagactcatgagcgaactggactggt

SEQ ID NO: 696212 - DNA, 199 bp, Homo sapiens
tcgttctttgatagggtgaagctgtaatctttcaaaacagtaaaagctggtttctcctaaactattttccttgtggtagtggagatcagtgggtcagaaacaactcctggacacttggttttcctctttgagccgcgtccattaggaggcaatctgtaaaactagcacaggtctcccgctgttccactggggtcacccc

SEQ ID NO: 696213 - DNA, 762 bp, Homo sapiens
cccatctaggtcctggctggccgcatgaccacccctctcgcctcattactgtgaggagtctgggtccatcctggtcagctgccccaatgtgacctggggcagataaaatgccagtctcattggttccaccttccggttgaacccttcttgtgtccgagggctctctcttctcttccacagagtgtagtgactcctcagtccctcttgctggtcttccctattatttccttctactatccttctcctttggggggagtacctgtccaagacagggctcattttgcacttatctcgaatttgaagagattgctgacgcccgagagcctcgctttttcatccttctttccttgttcagcaggctagacagaaacatgtcttgactgttagtggtccacaaatcttcagtattttctccacttcatttttaagaaaggaagcaacagatagatgttgctctttcacctgggtgtctgggctcaagctttcccgcccagctcactttcctttgcccttcctcctgcctttctcaaactgtcccaagggagggggcctcattgtgtctccgtgcatgctctggaagcattgaagtatggtgtgtccacgtagttctagcagtccccagctgaatgagtgggaaagtactgatgtgtcgtaacggctgatcccgtgatacatgtcgcatatttggggtgcccgtgtgttgttgtctcccaccccctgtgttattccttaaaaaagtaccaacgggccgcttgggtacaa

SEQ ID NO: 696214 - DNA, 442 bp, Homo sapiens
  misc_feature (50)..(51): n is a, c, g, or t
  misc_feature (57)..(57): n is a, c, g, or t
  misc_feature (60)..(61): n is a, c, g, or t
  misc_feature (68)..(68): n is a, c, g, or t
  misc_feature (70)..(70): n is a, c, g, or t
  misc_feature (76)..(78): n is a, c, g, or t
  misc_feature (80)..(80): n is a, c, g, or t
  misc_feature (82)..(82): n is a, c, g, or t
  misc_feature (87)..(87): n is a, c, g, or t
  misc_feature (109)..(109): n is a, c, g, or t
  misc_feature (133)..(133): n is a, c, g, or t
  misc_feature (135)..(135): n is a, c, g, or t
  misc_feature (140)..(140): n is a, c, g, or t
  misc_feature (156)..(156): n is a, c, g, or t
  misc_feature (164)..(165): n is a, c, g, or t
  misc_feature (173)..(173): n is a, c, g, or t
  misc_feature (175)..(175): n is a, c, g, or t
  misc_feature (177)..(177): n is a, c, g, or t
  misc_feature (179)..(179): n is a, c, g, or t
  misc_feature (186)..(187): n is a, c, g, or t
  misc_feature (191)..(191): n is a, c, g, or t
  misc_feature (193)..(193): n is a, c, g, or t
  misc_feature (199)..(199): n is a, c, g, or t
  misc_feature (206)..(206): n is a, c, g, or t
  misc_feature (212)..(212): n is a, c, g, or t
  misc_feature (215)..(216): n is a, c, g, or t
  misc_feature (225)..(225): n is a, c, g, or t
  misc_feature (227)..(227): n is a, c, g, or t
  misc_feature (238)..(239): n is a, c, g, or t
  misc_feature (242)..(243): n is a, c, g, or t
  misc_feature (246)..(246): n is a, c, g, or t
  misc_feature (250)..(250): n is a, c, g, or t
  misc_feature (255)..(255): n is a, c, g, or t
  misc_feature (259)..(260): n is a, c, g, or t
  misc_feature (266)..(266): n is a, c, g, or t
  misc_feature (275)..(277): n is a, c, g, or t
  misc_feature (286)..(286): n is a, c, g, or t
  misc_feature (303)..(303): n is a, c, g, or t
  misc_feature (328)..(328): n is a, c, g, or t
  misc_feature (377)..(377): n is a, c, g, or t
  misc_feature (419)..(419): n is a, c, g, or t
cacatttctttctacagtctcattattatttccaaaaattacacagtaanntaaatnatnnataaaananataaannnantntattntttattagatccatccccaganttatatgtacatgtacatactttnanatgtnttttgttctttaattntattttannttattttnantnanttaaatnngagnangatttntaatatntcttanctnncaagaaaanantgtatcaagannttnnacncganaaaanctcnnctaatngaagaaccnnnaggcaggtntaaagtgccagtaaaancttcaacaaaaaagcaggaactctnaaacctcttaattaataactggccgaaaagcccgcccaaagctcctganaaataacctataattcgctgtacagtcatatcaaccccctcnggaatcccataatcagccgaagt

SEQ ID NO: 696215 - DNA, 147 bp, Homo sapiens
  misc_feature (3)..(3): n is a, c, g, or t
tanctactgccaggtggggtggtcacgtgatgtgtgttctgcatcccccactggcttctgagcgcgacctccattgtgtgttcacctctatgcctcagggaacgtgactggccccgtggacacaagggctgggttgaggggctgtcc

SEQ ID NO: 696216 - DNA, 353 bp, Homo sapiens
  misc_feature (85)..(85): n is a, c, g, or t
  misc_feature (87)..(87): n is a, c, g, or t
cacctggctaatttttttgcagtttttagtagagacgaggtttcaccatcttggccaggctggtcttgagctcctgacctcatgnantcaccccacttggggtggctgaggtgggagaatcgcttgaggccaggagttcgagaccagcctgggaaacatagcaagaccctcatctctaaaaaaagtttttttcaaattagctgggtgttgtggtatatgcatgtagtcccagctcttgggaggctgaggtgggaggatcatttgagctgaagagttcaagctgtgatcatactatggtggtgctgttgcattccagtctgggtgacaaagtgagattctgtctcaaaaaaaaa

SEQ ID NO: 696217 - DNA, 858 bp, Homo sapiens
tatctactctctcccagcacagtgttcttgcctggttcccccagctctgggtacccggctctgcatcgtgtcgccatgatgtgtgccatcgtccagtgctctgtgctcagccagaacacaaagctgtgaatcctggaagaaaagttcaatcttgtgcaaaccatcaaatgctagccaaagcacatatatgcagatatcagtcctgacacatgtaatgggacccaagtcccatgattgaacatgctattagtgaccccaatgtggcagagccatatgttgatgacccaatgcatggcaaattgccatacttcgcagcagatacaagtacaagcatccagacggaccaatgatccactgatcgacacatacagcccggaccccagtgatgacagacggtatggaagcttgttcgaaccacaatcatgtacaaacatactatgacattgggaacaactggcttgacctgtcagcatgaagcaacattcaacttggaagccaatccagaattcccaccaccaaacaagcaggatgaaacactgtgcatttaacctgcacgtgcatttggatgaaattgaaacaaaaaaccctcaacagaacaataagatataccaagatcagaacatcaacgatgaccagactaacttatgatcccttgacacccatcaaatcaaacaatcatcaataataaagaaaaccaaaaaagacaaaacaagctcagaacgagacaaacctattggggcaattgcaaccaaatatacgcccctgtcaattagtatagccacagaacatgcacaccgcgatagagtacacaaatgtgactgtacaacacaatatcgaacaccacacacatatactcaa

SEQ ID NO: 696218 - DNA, 512 bp, Homo sapiens
taagattgggaatagggaaagatgtctgttctcatcatttctacttaacattatgccaaaagtcctaaccagtgcaagaaggcaagaagaaagaaaggacataaagattggaaaagaagaagtaaaacattatttgaagaccatattattttttatgtagaaagttctaagaaattgaaacaaaaattaatagaactaaaacataagtttagcaagatctcaggatatgaggtcaacatgcaaaaatcaattgtacagtatttctatatactaacagcaagcaatcggaaacatttttatccatttgtaatagtgtcaaaaataaaatgctcaggaataaatttgacaaaagacatgcaaaatatgttgaaaactacaaaacatgggctgggtgtggtggctcacacctgtaatcccagcactttgggaggctgaggcaggaggatcgtttgaactcaggagttgtagaccagcctgggcaacatggtgaaaccctgtgtcttgcaaacata

SEQ ID NO: 696219 - DNA, 811 bp, Homo sapiens
gagattttaatcagttttctaggcacaacctttgggatcgctagttagtgacccagttcctgcttagtctttcctctcagggcctaatgatcagagaacgttactttccctgaatggataatcttttaacttcttgaagcctattttaaaagcttttctcaatcttctcaaataatttcaccttgatccttcttttcctttgggtttttcctctgtcagttctcttcccctcactgtggtagcaccaacctctctcctcatattgcttgtgttccctccagcttctcctcagctatgatgtcagatttttaaattatccattttatactctgctttttaatttcatttttagctctgagaccttaaagcagtaatggtcttagagttcattttctttctctgttaaagaaatggatttctaagtttcagcaatcagtcatagcaaccctttaatattatatactcaatacagagctaggtattctgtggaaagtatagttgaagaaatgacaacagtcctcaggtgcttgactgacttatggtgaaagtataaaagtattcttggtaattccagtaaagcagaaatagcttggtttagggggtggggagggactaaaatttacaaagaggcagaatctcagttctaaggggagagcttgtggaaaacacaatagattctttgcacaaattgggttttcccctccaagggtcttttctgatgtggtggttcttcacttaggaacaggtattgtttcctgagtcttcctgattttccagggaacagcatcgggtttctattaaaggtagccga

SEQ ID NO: 696220 - DNA, 519 bp, Homo sapiens
tagtcggaccagaatgtgtacaacgacggcaaatcttgcttgtttaggatcacatcaacatctagaaccacacaagaggcatcagaaaatacttgaacgggctgggcgcggtggctcatgcctgcaatcccagcactttgggaggccgaggcgggcagatcatgaggtcaggagatcgagaccatcctggccaacatgatgaaaccctgtctctactaaaaatacaaaaaattagctgggcatcatggcgggcgcctgtagtcccagctactcaggaggctgaggcaggagaatggtgtgaacctgggaggcagaggttgtagtgagccaagattgtgccactgtatttctgcctgggtgacagaatgagaccctgtctcaaaaaaaaacaaaaaaaaaaaaaatttcgggcctcgtgatcctaaagcaggggcagcataattttttcccggaccccggttgggccgtttgttccacattcggggggaacccctataaagttcaacctggcgggctttc

SEQ ID NO: 696221 - DNA, 311 bp, Homo sapiens
ctcgagcggccgttataattattgcatagaatatttcaagaagtcccaggtcaaaaggacacatctggtgagggccttcttgctactgggaactctctacagggtcccaatggcctggggcatcacatggcaggagggctgtgtatgctaacttgctaggtcaggtctctcttcttatcaagccaccagtgccattcccatgatagtgcattcatccattaactcattaatcaattagggcagaactttcatgatccaagtgcctcttaaagggatcgagtctcaatactgccacactgggggttaaattt

SEQ ID NO: 696222 - DNA, 242 bp, Homo sapiens
  misc_feature (81)..(81): n is a, c, g, or t
  misc_feature (193)..(193): n is a, c, g, or t
  misc_feature (210)..(211): n is a, c, g, or t
ctcaatggcgccactctggataaccgcgatggcggtacggtaggcagcacaaaagcgctgacactcgaagtggccgaggtngacaaccgcggcggggaaatctccagctccgaagggctgagccttctgggcacacgcctggataacagcgacagcggcaagctgcttgccggcaccgacttgggcctgaganaggcgcaggtcatcaannagaatcggggcctgctgtttggcaaaggcag

SEQ ID NO: 696223 - DNA, 186 bp, Homo sapiens
  misc_feature (150)..(150): n is a, c, g, or t
  misc_feature (160)..(160): n is a, c, g, or t
atgcgggctttcagtctgtgaaatgctgtaaagagtcttcatcccagatatcatgtttttttattttagtgtgtccatatgactctttttagagtttacatttctctgctgaaattccccaactgttcatgcatgagggcctattttttnctacttgttncctgtcacatatatcaatcataatta

SEQ ID NO: 696224 - DNA, 1541 bp, Homo sapiens
  misc_feature (284)..(284): n is a, c, g, or t
  misc_feature (302)..(302): n is a, c, g, or t
  misc_feature (334)..(334): n is a, c, g, or t
  misc_feature (357)..(357): n is a, c, g, or t
  misc_feature (453)..(453): n is a, c, g, or t
  misc_feature (474)..(474): n is a, c, g, or t
  misc_feature (508)..(508): n is a, c, g, or t
  misc_feature (532)..(532): n is a, c, g, or t
  misc_feature (625)..(625): n is a, c, g, or t
gataatgccggggccgacaggtgccatcatccctggagcgtctcccgatcctaccacttagcgtcatgcgtctgcctctgatcgatatgaatggctcactttccactgagggcctcactctctaagtaaggccactaagttacacccaacgagtattccaaggtagttcaagcctcgagatggagatgtcggatacgagtctaggaagcaaagcaagcttaattgaagagtggcacagttaccacacaggcctgcttcaagatagaggccttgacgggttcctnggaccctaacatcgctantgaaacctcatctcgtcgaaagacgtcttttntcccttgcccaacgaacagcatngatgtggtcgaacacaccttatctagtcgagcctctctatagatctctagagactcgcgatagacacacgcactgaaattgacgtttcgagcgcanaccttgggaaaccccaaagcnttgtgccaatcagatcgcccgtcctaataaatcntcggtggacccataggtcactcgnttgctcgctgtgagaaacaccaaatcccgggtgcttcatcgtcggcaagctactatggtgaagtctagtgcaaagacaagaaatcgcaacgtnttccctgcgagtagggtcgtgagggtgttcacccgtgacatattccgccccattacctccatgatagtataacgaaggcaccatcgccttccattgttacaacactctctataatttttggcgcttgtgcatgactctattcaccccccatacacgggaacgagaagggcgacgacgcacctaaaggtaagtccgccacttatgtaaacacatgtaccaattcgaatgtaaccttgcacttgcgcagtggatcccctggtctgcgcagggactttggggggttaatctgggttggtcaacccccccgcatggtgtctagggggtgaaagtctccctattgctcctttccaatttcgctgtgttccgagtcttttttctgtttcaagcactcagcctgtgggtaaagcgagggggcccctgggcgaggaccttaccccttttgtgtttccaactttatatcacttggtccgcaccgttctcaattcttacacttaaaggggtccctcacaccgggggccccggggcgtttccctcggatgtgctttgcggaatttccccggggtgacccccgttggaggttagaaaccaggctctttctttgggattttgggtcttccccctctgttttggggacggaagagcgccgttgtaacagaagcgttaccccttgggcgaaaaattacacttttcaaggagaggcccttataaaaggtcgaattccttggcgccctttggagattacacccccacactgtgctgccccaagggcgcctgaagaccaagaaaatctcataacaccctatatttttggggtcggcgccacgagggggtcgctctgaaaaacgagtgccccaacacatgggagggaggggcaggaaaatctattagggacgatgcaactgcgatgcgaagatag

SEQ ID NO: 696225 - DNA, 554 bp, Homo sapiens
gcccaccccagcagagtgtggacctcccacgctgtcctgtgggtgcctgtgtcttcacagctctggcgacggcgcttgacgtgggcttgtccaactggagcttcctgtatgtcaccgtatcgctgtgagtactggccatgccctgctgcctcccttcaggctgaagctgtctgtctgtccatcgaagctgattgcacacccggctgctaggccagccactccaccactctgggaccagcccttgttctctcagcctctccctggcacccagcagctctccgggaagtcgccagtctcttccgtaagcccagcgcataggagatgctgtgcccacctgccaggcatcgtggggaagccaaggagctctcccagaaccccatcatcagagcagggtaaggcagactgttaggccacattcaggtggccacaggtgggtgagtcacgcacctgcaatacatacctatgtgagctgtgggctacacaagaattttttctttgcattttgaagtaacagctttcacagagccacttgttcctggcacttttaatgtttt

SEQ ID NO: 696226 - DNA, 161 bp, Homo sapiens
aattaaaaaaataagaagtcagtcaggaaagccttccttggagtgacatttgagcaagaaaccgagaaacagcaaagagagtcctggtacagggaaaagcacaaactaaggccctaagggcagaaggaaatacaatgagtacaagggactagaagaatgaa

SEQ ID NO: 696227 - DNA, 946 bp, Homo sapiens
gccggaaacctgccattcttcgctgctgatcgcgggattcttttggatagggtgacgtcgtggatagactcatatctgtgaccagtgtccgccaccgggatggcaagagacctgatcggaccggccctgccggccccggttcaagacccgcggaacagcggaggacgaaaagcgggacccgagcctgtttgcaggaccaagctctgcccccctaattataaacagcagtagttcagattcatcagacccagcggtgaaggacaagtagttctttgtacgaagaagggacacatcaacgaatctgagagaacgatgacatgtgtgcccaacgtgcaagaaaacagaggaaacactcaggatgctgccgatagcatgatgactggatgggtaatatggaccccaagccatatccctccctgaattctacaacacgccggatgattcttcctccaaggcccaattaaatagggtcctgattggccaccttggtttccattaaaatctacacaaggaatacgtggcaaggggcagagattgatcccaggacaaacagggacacaggaacaagcaggtgacagatgacggatcatatgggaccaatgcctggcacaaggaccagtttaacttataatgtgacgacggagttgacaaaaaagggcccagaggatggaaagaaaaagtggaccaaggaggatgctgatcatctaacacatggtaagaaagtcatgggtgatgaaattgctccagaaaggaaagatgggtctgggcccaggatttaagaaagggttgtgacccttgggatcgaacattggagaactccagtgtaggaaggaagtagaaaacaagagaggacgtccgagagaggaactttgtggagagagagaagggagtttccagaaaacacttggcatacaggagggtgcgcacacaaaacaggagacaagta

SEQ ID NO: 696228 - DNA, 270 bp, Homo sapiens
catacatccgggtgactagcattctgccgggtgactacatacttgcgggtgattacatacttccgggtgactacatacttccggactacatacttcctgagctacatccttccggcctacatacttccatgattacatactaccggactacatagttcctgaatacatacttccggaatacatccttcctgactacatacttccggactacatacttcctgactacctacttccggactacatccttcctgactacatacttccggggaa

SEQ ID NO: 696229 - DNA, 151 bp, Homo sapiens
acatcaaccctacaacaatttaaaacagctactatgaaacccatataaatacgatcagttaatgcacaaactactaaaaaacaggaaggtgcaggtgatatatacgaaggtgcgcagaaacagctggaaacatgcaaaactaatttctgga

SEQ ID NO: 696230 - DNA, 988 bp, Homo sapiens
ggtggtccactcgtttaccataacggctctaacatcctccgtagtacgtccggacttcggctgtacctacccctacgcgccgtaacgacagacctgccccaggggccccagggacccggtgcggatcccctccaaagagcgcagatttctacatccaggatctcatgacgtcgtcaggctttcttggtataagccttgaggtttcaacgccgactctcctgcgctagtgcagtgcagctaggtctaaccagtcctacactactaggcgcggccagttctattcctcttcgtcagtgatgctcctcttgttggatattcgggaccgaaataatcgcctggcccctcctgtggccccggggaaacccgcagctggtacttgttctccttgtattgctgtaaagcaccgcctgagaactgaccaacagcgagatcatcagggtgaaccacgccttggacctgtacgacacggagatcctcaaacagtcggagccagatgactagccaatacctgctgcttaagcccgggtactcctctggccatggacttttcctgttgttagtacacacagcaacagaacaatcatgaagcgaaaactaagaacaagattaaacccgactcaagatttgtaaaatgtaattaatattcaaagaaaaggaggaaaatcttcagtttgttggatatgaacagcgtgtctagcaatcggtataacacagtcgttgggcatcgttgtgttactgtgctactacgtgcattctcgtgcatgaagagagggtcctcagcctgtttgtggagcattagacgggagttgtcttctgtacggcctcacggtcgctgtattgggggagaagggagatgaagcagtatgcaatgaaattgtacagatctttgctgtgcaggtgctaagagttaaacactcctatgaaagagagatatatgtaagtgtacaactgacactgccatgtgttcatactcggagggaatgacata

SEQ ID NO: 696231 - DNA, 159 bp, Homo sapiens
  misc_feature (38)..(38): n is a, c, g, or t
  misc_feature (56)..(56): n is a, c, g, or t
  misc_feature (81)..(81): n is a, c, g, or t
  misc_feature (111)..(111): n is a, c, g, or t
  misc_feature (154)..(154): n is a, c, g, or t
aagtgaaccagggtctcatccgcatgtataaggccgantgcctggagaagttcccngtgatccagcacttcaagttcgggngcctgctgcccatccatcctgtcacgtcgngctaggaggcgccaagccgaagagccacccaggcccacagttnctgtg

SEQ ID NO: 696232 - DNA, 153 bp, Homo sapiens
tgcggaagaagaggcgacagtccaacaataagatcactgtagtgggtgttggacaagttggtatggcgtgtgctatcagcattctggatagtctctggctgatgaacttgctcttgaggagttttggagataagcttaaagggaaaatgatgg

SEQ ID NO: 696233 - DNA, 315 bp, Homo sapiens
gtatgtattatcaggtttcaggaataaaactttggcccatcaacttcagtcatgacaatggccctttctcaaagggagaaattgttttccccttgcctgggcctgcggagaggcggtctgtgtggtgagatgtgatcatgggggggcacggatcatgtatgaacgtgggatgacaacccccttgcatctggcaggcagtcatggacaccggtgatattgtacagaaggtacgtacaaactccttcgtcatccacatcacatacatgccatgagggtcagtcacaggcactggtaacatacagtagaaagcatgtg

SEQ ID NO: 696234 - DNA, 270 bp, Homo sapiens
ctacctagaggatccgctgaccgcttaggtgtgtgcataagtcttgtatctgcttagtcagtttccatctggaagcatttgttcgcaaacgccacagttacagactacagcagtttagaaaccagactaccacctgaatatactacacattgcttcacctggcttttggtgattggtatgtagttgctgattctttccacaaaaggtacttctttcttggttttctctttagggcttaagcggatccaggggtatcgagcctccaattcg

SEQ ID NO: 696235 - DNA, 450 bp, Homo sapiens
  misc_feature (22)..(22): n is a, c, g, or t
gaatgggccatcatggtgcctnccgagagggccttgtacagggatgtgatgctggaaaactatgaggctgtggcctttgtagggccacccccttccaaaccagctttggtttttcatttggagcaagggaaaaagtcctgtttcccccacccccagggagtcctaaacaggaattcttggaaagcaggctggataggatccttggaactaaaaagatatcctttcttagctaaaccagtgttcggtagaataggatcaaaaatttttcgaaatcgtcaatgctgggaagacaggaaaaaagcttaattcttgccatttaaaaaccagttttccaagtaaggagttgatgtaaaagcccccttaaacgatgtcaaaaaccccttttctttttttggagacggggaaatttaatgtttttcattcattaaaaaaaccccttttgatggccca

SEQ ID NO: 696236 - DNA, 425 bp, Homo sapiens
tatcagtatcctatggaggactgactcactggtactgcgtcccactcctacaagactactccatctcctcggataaaaaaagtgattcttcaggtcatgagtacagttgtgaaaactccacccaaatgaataattgttcggtacctttagattaaagttaaactttactgaatttcagtacattagtttttacactaaaactttacaagataaaattggacttcatttagtatctttttaacagaattacttggaataatgagatacaataatcatatctcttttgacattttggaaatttttttaattttacaagtacatttaacagatcatttataaagcaggagtccattttaacacttaccgactttttttggtttggaaacatattaccacgtcttaataggatggtgcccatataggtg

SEQ ID NO: 696237 - DNA, 424 bp, Homo sapiens
atctttttccccgtttgcccatttgcccatttttaattggattgttcatctttttcctgttgagatgtttgagttactggtatattctggatattggccattcttttgaataaagccgtttacactggggttagagttgtggtttgcatttgcatttccctgatgattagtgctgttgagctttattgatttactttagacagagatcttgggtcatggtgcgcaggggtggaattgatgtggcgtagatcacgtgtccacttataagctacgacatacctgggattaggcaatctctcctaatcagcagggatgagggtgggagcgatcacctgagaccgggagagcagagggttccagtagagccagagattgtaccactgtactcccacatgagcaacagagcaagaccctgtctccaaaa

SEQ ID NO: 696238 - DNA, 916 bp, Homo sapiens
  misc_feature (552)..(552): n is a, c, g, or t
ggggcttgtcagtcggcgccgcgtgcgggctggtgtgctctgtgtggcagtggcgggggcatgggactccggtcactatgaactggttgtcagcaccgaggagcgcgccgcgcccttctccctgagagtaccagaggtcttcctcagaaatgagaagggacaatatatatctccatttcatgatattccaatttatgcgagataaggatgtgttcacatggtcagttgaagtaccacgcgtggtctaggtgcgaaaaggtggggattgctaacaaagtgaccctttaaccctatagacaagatgtgatacaaggaaaaacttcgctattttgcgaattggttcccgtataaatggatatatctggaactatggtgccatccctcagacttgggaagacccaggcacaatgataaacatactggctgtgtgtggtgcaccaatgacccaattgatgtgtgtgacattggaagcaaggtatgtgcacgaggtgaaataattggcgtgaaagttctaggcatatgggctatgattgacgaaggggaaccgactgnaaggtcattgccattaatgtggatgatcctgatgcagcccaattataatgctatcaactgatgtcaaacgggctgaaacctggctacttagaagctactgggactgcttagacggtttaggtgctgatggaaacccgaatgaggttgcgttactgccgaattcacgatagggcttgcccttgtttttacagcgctctgcctggagcctgtgcctaaaccgtgagggccgtgtgctccactgttggaccttagtgtctgtgtgcgccttggtttccccctgttctgcgcaccggttgtgcccaaattcttacacttttgctcgtagaccgcgcacgtccccctttccctttgtgttcttctcccg

SEQ ID NO: 696239 - DNA, 318 bp, Homo sapiens
gaggagtgagtggaggtggtaagcgagtcaaacccaggacttcagttggtgggctggattgggaggtcaggagggcagtattccctgcatttcatgcgccttgcttggatgctggcttatggcagtggctgtttggtgatgatgcagcggatgtggtctgagaagatgaaggtgtgctggaggatggggaagggcttggaatgggggctggacgcaggcttgtggatggtgatgtatccagggcacggctgacgacctctcacgccagtcaccttgcatgtcctgcacatattcctgcacaactatgaccactcccca

SEQ ID NO: 696240 - DNA, 147 bp, Homo sapiens
tgtttgccaggttgtcttgaacttctgggcctccagcagtcctcctgccttgacctcccaaagtgctggtattacatggtgtgagccatcatgcctggcctgttaaagattttttaaaattagcagccttgtgccatgtgcatgtgg

SEQ ID NO: 696241 - DNA, 447 bp, Homo sapiens
agtgtctaagactgtcttcatttgaaaacaaaaagtctgataattttgcttaggcaaccagctttatcaacattatcaaaggggagaatcccccggtctctgggatttatctaaaaattgggaaaaatcttccggtttttttctctttgcctttaagaatgttaaaacaaaaattttggattttcaactgggctctttaaaaggggaaaaaaaaaaccccaaaatgtataaaaattttatccccaaatgttttttaaacctttttggaaaaataaggaaaattttggccccggcggtaaaataactaaagaatgatgaaaaagtgttttttttcccaattgcatcaaggtgggagggttgggcttttccccccagaagcccctaaccatgggggcctgttgagccctttaaatgtggagtagtttaaattttaaagccataggcccc

SEQ ID NO: 696242 - DNA, 539 bp, Homo sapiens
tgtattgcaacagtttcttaaaaagcgccacgccgtcctcgcatggaaggcctgacccagctcacatgaatctgatgctgtgttgcttttcctgagcacgtgtcctgaagacagagccatttttgactgcgtgctgtgtgttttctggggtggcccctactatctgtctggtccctgtcactgtgtcccccaggaaccaggtcacccttggctgttcaccccagaaaatagcagttgttccccctcttggttgtggacccctctctagctggagctggagctcctcgggggatttgcagaggacagtttctggaggtgggaacatgtgaggaagatgtcatcgcagaggtcttctaggataatgtgtggccttaggtactgccacccaagccagaggagaggttttattctctgcatccagagagctcctggctttacccttgagtccagaaacgggcccaagcagcccgagtctgccaagtagctcagctggctaagtggctccaggcatgggcaacagagcgagactctgtctcaaa

SEQ ID NO: 696243 - DNA, 688 bp, Homo sapiens
atttaattattcatttttaactgtgtggactcaagtgttactagtttttttttaaaaaaaagaagcagcttgtggtttgtttatcctatttgtttcttattccattggctttgctttaatcttttatttccttaggtgtttgttatagagagacggggtctcagtgttgcccaggctggtctcaagtgatccatgcaagtctcaactcccgacctcaagtgatcctccttcccaggcctcccaaagtgctgggattacaagtgtaagcacccggcccttagttttgtttctttaggatcattctgttttctttaattttggagttgaagctttacctcactggttttcattctttttttttttttgggagacagagtctctctcgttgtcgcccaggctggagtgcagtggcgcgatctgggctcactgaacctctgccccccaggttcaaattttggtattttacagtagggaaagggttcactcgtgtgggccaggctggtcttgaactcctgacctcaggtgatcctcccgcctccgtctcccaaagtgctgggactaacaggagtgaccactgtgcctgggcaccattctttcctcttggataacttgcagatatctcccactccacccttaatcctctcaagcacattgaaaccaccttggcaaagatcatgacaccgagaga

SEQ ID NO: 696244 - DNA, 227 bp, Homo sapiens
atgctgaccaggtttcatggttcccaggctcaacctgcagttctcagccctcattcaggaggggcctcggcaaggatggggggtgccgtctttcccttgccggtagccccaaggactctgccggctccctcgccttgtgcagcagtactgcccaccctgtctctggaggttcccccgtcctcatatccacccagactaccccgtaaaggcacaatcatatggccttt

SEQ ID NO: 696245 - DNA, 443 bp, Homo sapiens
gcacgagggtgaaattctgcgatactttacctgcactggacaataaaaaaatattaaaagacaaaaacaaatttagaaaaaaatttaagccacaaaaaaaggctcatatggaattatgtcctatgtgtaagggcccttaggcaaagctggtggatatttgaaatgtcacagtagtcaaaatacaaatactttttgacaagttcttttactttgaaggaacactgaattcttctgtgcatatgtacatatgaatacaaatcgaaggcctctacctcctggagttatacaacttggcttgtttacctccacatgctgatcatgactatttgatatttttgagttcagtgtggagacttgaaacataagcgttctttgaaattgctatatccaaaataaattgacaagaaaattgaagatcatttttcacctgtacaaggaatact

SEQ ID NO: 696246 - DNA, 335 bp, Homo sapiens
tacgcctggcgcaagtccaagctgagtgatcctggcgggcctgtcgccctctccagggaggagcggtggagaggacccctgctgcccccgaatgcctaccaggtggggccaacagcctaagcaccgccatggacaagtgggggttggtccaccctcctggagatctgctttgacgagagacccctctgcagagccgcagccctccgagagtagcatttctaccagaggcagcaccggctgcccgagccctctgccacagtggcacactcaccagccagtgtctgacctatgagccaacccagaggccatattctgaccatcctgcgtgaccttac

SEQ ID NO: 696247 - DNA, 229 bp, Homo sapiens
  misc_feature (56)..(56): n is a, c, g, or t
  misc_feature (141)..(141): n is a, c, g, or t
  misc_feature (181)..(181): n is a, c, g, or t
  misc_feature (191)..(191): n is a, c, g, or t
  misc_feature (224)..(225): n is a, c, g, or t
taaatgaaatccggcccaacgccccggggggaagagggcggttttggcgttatttngggccgctctttccgctttccttcgcttaacttgaactccgcttgcgcttccggtccgttccggcttgccggccgaagccggtantcaagccttcactcaaaagggccggtaaatacccggtttntcccaccagnaattcaaggggggattaaccgccagggaaaaannaacc

SEQ ID NO: 696248 - DNA, 293 bp, Homo sapiens
ttagcataatatatgggttacttagaaccaaagctagctcaacatattacagcaaatacaaaatatacagcaaacataaaataaaatcattcacctaacattaaagtataggagatataaattggatcctgacgctatagagatagtaccgtaagggaaagatgaaagaataaaatagaagtatcaaaaagcaaagattaccccttctaccttttgcataattggtttaaccagagataaatctaacaaagagaacttgagctagataccccgtaaaccagacgagctaccta

SEQ ID NO: 696249 - DNA, 884 bp, Homo sapiens
aggaggagaaggttgccgggtgccgggtgcgatttgaaagatcaaagtgaggaaaatggacagtgaggttcagagagatggcaggatcttggattgattgatgatgctgtgcgagaagacaagctgccttatgaggatgtcgcaataccactgaatgagcttcctgaacctgaacaagaccaatgtgtggcaccacagaatctgtcagagaacaagacatgacgtggaacagacttagccttacagtacctccatgagaatgtcccccccatttgacaactgactgctgtggtcctttcttgtggatggattttctcaaagtacacagatcacagcatggtttgtgttcagtctccaaattcaaacctttgagtactcaactcaggcacccaaaaattgtaccacccatttagtttgtggtagcacaagtgcactgcgacattgcctgagcaacacgcaggattctcagtcgtgggcgcactatttgcgctctttaaacctaaaacttcttcccttgcgtaggctcatattttgcacctgcttggtcaaaacatttgcctctacctctggatttgttggtggtcaagtttaacaccttccactaatatgtgttgtcctgtaacacaggtgatggacgtatgaacggaacggcatgaacagggagcagcactatgggactattaccttctcatcttcccaattgagacgctccgaggatcagcgcactgtggtatccacaccaatcctggatggcgccacatctcacgatttcccccggccccacaccacgtctgagagaaccgcccacaactcgcggaaatcgcaagacgacaacctcactctacccaggcgaatgtgccaacactacagcactcagagaacaa

SEQ ID NO: 696250 - DNA, 530 bp, Homo sapiens
ggagcacccccgggacctcaagttcagcatcgactacatcctgtcctccccagaccccttccctgggctcaagccgccctgcctcgcacaagagggcagatacccgcggctggagaacgtgggactccacttttggacaatgtgatgtggagccaccctggaggcccctgcagttcagtctggggtcttccccggaccctccctggaaagacgattccagccccaccttgagccaggaagccagggttcggcaaatcctacaatttctcctgcagacagaaggtcaggtgccacaccaggcctggactggggggacaggcggaggtggagctccttaaagatggaagcaggacagcggcagatttgagagcaaccaccaggtccctgagtgcaaactgaccacagatgagcccctcctccccactgctgacttgctgggtatagcggagcagcacccctccagagacgctcctgggctgacacctgccctttgcacccagctgaaataaaactcttggaatctgctgtca

SEQ ID NO: 696251 - DNA, 629 bp, Homo sapiens
  misc_feature (14)..(14): n is a, c, g, or t
  misc_feature (71)..(71): n is a, c, g, or t
  misc_feature (75)..(75): n is a, c, g, or t
  misc_feature (79)..(79): n is a, c, g, or t
  misc_feature (125)..(126): n is a, c, g, or t
  misc_feature (128)..(129): n is a, c, g, or t
  misc_feature (131)..(131): n is a, c, g, or t
  misc_feature (134)..(134): n is a, c, g, or t
  misc_feature (141)..(141): n is a, c, g, or t
  misc_feature (149)..(149): n is a, c, g, or t
  misc_feature (153)..(153): n is a, c, g, or t
  misc_feature (155)..(155): n is a, c, g, or t
  misc_feature (158)..(159): n is a, c, g, or t
  misc_feature (161)..(161): n is a, c, g, or t
  misc_feature (165)..(165): n is a, c, g, or t
  misc_feature (174)..(174): n is a, c, g, or t
  misc_feature (182)..(183): n is a, c, g, or t
  misc_feature (185)..(185): n is a, c, g, or t
  misc_feature (218)..(218): n is a, c, g, or t
  misc_feature (221)..(222): n is a, c, g, or t
  misc_feature (224)..(224): n is a, c, g, or t
  misc_feature (233)..(233): n is a, c, g, or t
  misc_feature (237)..(237): n is a, c, g, or t
  misc_feature (239)..(239): n is a, c, g, or t
  misc_feature (242)..(242): n is a, c, g, or t
  misc_feature (261)..(261): n is a, c, g, or t
  misc_feature (267)..(267): n is a, c, g, or t
  misc_feature (321)..(321): n is a, c, g, or t
  misc_feature (363)..(363): n is a, c, g, or t
  misc_feature (391)..(391): n is a, c, g, or t
  misc_feature (399)..(399): n is a, c, g, or t
  misc_feature (401)..(401): n is a, c, g, or t
  misc_feature (457)..(458): n is a, c, g, or t
  misc_feature (522)..(522): n is a, c, g, or t
  misc_feature (539)..(539): n is a, c, g, or t
  misc_feature (563)..(563): n is a, c, g, or t
  misc_feature (601)..(601): n is a, c, g, or t
gaaagcagggtgtngggagcgagatggctccgggggtttagacactgctggcttcggtcccggccgccacntgcntttnattccagttgcgagcagcttcacttggggccctgggcctccgattnntnntngtngtttttntatatttngccntnttnntnggcngtggcgtcntggtattnntnttactcggacaccaggtcgttcattttgctctnggnntnggtgaattncatntngtncatgcccttgcccgtgtanaagtgnaggaaggctttgcaccggaaaatggccgtgaattgttcggagatgcgcttgaanagctcctggatggccgtgctgttcccgatgaaggtggagganattttgaggccgcggggggggatgttanaaacggcnantttcacgttgttggggatccactccacgaagtagctgttgttcttgttctggatgnncagtatctgctcgtccacctccttcatggacatgcggccccggaacacggtggccaccgtcagnagcggccgtggcgcggntcgcaggcggccatcatgttcttngcatcgaacatctgctgggtgagctcgggcacggtcancccccggtactgctggctgccccgggct

SEQ ID NO: 696252 - DNA, 126 bp, Homo sapiens
ggtgctcagacctgagctgacttggcaggtgtcaaggacaggctccttgttggagcacagaagtgctatgggccagaagcctcccttcaagatctcaccttcacaggtgagagtgagctgcagtct

SEQ ID NO: 696253 - DNA, 384 bp, Homo sapiens
  misc_feature (26)..(26): n is a, c, g, or t
  misc_feature (37)..(37): n is a, c, g, or t
  misc_feature (203)..(203): n is a, c, g, or t
  misc_feature (325)..(325): n is a, c, g, or t
  misc_feature (333)..(333): n is a, c, g, or t
  misc_feature (355)..(355): n is a, c, g, or t
gaggatcgcttgagcccgggggattnaggctgcagtnagccatgcagtgagccatgatagcaccactgcactccagcctgagcgacagagcgggaccctgtctcaaaaagaaaaaaaatggaaaatgtggtgtgtatatatacacaatgggctactattcagtcataaaaaagatgacatcatgtcatttgcagtaacatgantggaactggaagacactatgttaagtgaaataagccaggaacagaaagttaaacaccacatgttctcactccatgtgggaaactaaaaaaagttgatcttgccaggcatggttggctcacgnctgtaatnccccagcacttttgggaggccnaggtgggtgggacccttgaggtcgggagt

SEQ ID NO: 696254 - DNA, 103 bp, Homo sapiens
cgtccgtcacacggcacaggagaatccacaccgggaagaagccttacgagtgcagcgactgctggaaagccttcaacgacccttcagcccttaggagccatcg

SEQ ID NO: 696255 - DNA, 338 bp, Homo sapiens
  misc_feature (35)..(35): n is a, c, g, or t
gttggccaggctggtctcaaactcctgaccttgtnatccacttgcctgcgcctcccaaagtgctgggattacaggcgtgcatcgcgccaggccttagctgttgttttaagagcagggactgtcttgccatttatgctgatcattttctgtgtcctttattagagttttaaatttattaccacaggagtcttatgtggtgttaggtaagttaattcctatgaacttttatcattttttcgctgctgaaaatgtatgttacttcagtatattttctaagttggttgtgctgggataaaaaaacattattgtttttaaaaggaaattgttttattgaagta

SEQ ID NO: 696256 - DNA, 763 bp, Homo sapiens
gcagcagcctcgctgcttgagccccctcgtgtgccgagcgtaccgttcccccctgcccgtcttctcccgtcagcgcgcgccgcttccgcaggccgtttccaccgaggaacaaggaactcgtatcgtatgatccagaatatccagaaccatccactctttcgacccctattgctgatgcaagtaagggtgatgacctgcgttcctgcatggccactgaggattatatccatatacagaacttcaccagagacaacggcaggaagacccttactactgtccacagggctcgctgcacttgcattacgataaaacacgacaactagctgaacgcgttcaacggcaacacagctttgccctgctaactggtacctgtacctctagacgcattcccgggaactcttggacgcaacgtaacttcccagcatacaagcgggtgaccccaaacgccaagaaccatattgtccagatcacctcgctaccagaaatatgggacacctgcccttacgtgacacgcacttccaagccgtgcaaaaagcctaccactgcccgcctctaaaacaggtgactatggctagcgaagtcacactgcacaacgccctttcacagcctttaacgccccttcacacccttgctcccaacacgcacagctagaaaacaattctctcaccgctttgctaatacccccttcgtgcttccgacaggggctcatccacaaacacccgttcccccagcactctgccaacttacaactcgctacagccca

SEQ ID NO: 696257 - DNA, 274 bp, Homo sapiens
cctcacagtgcctggggcttcaaaggcactcgcattctgtttgagctgtcagccagcacaggacgacatcttgtgatgcggatgacgtgaaggggtggagctgcacccggatatggaagcatctttgcacaacttttaccatgtacttattggcacaaattcgggcagcctccagggcttcagaggacagctgctcatattcatctgacaccatgtggccacagagcggaaactcatccacttttgcctttttccgccccaggtcaaaaatgcg

SEQ ID NO: 696258 - DNA, 369 bp, Homo sapiens
cgtgagcgctagcgtgctctgtgagactggggaaagtagtctgagcaagctctgcgggctgtattttagagctctgtatcgtgaggacatgtgcagagcacagaccctgatgatacgtgtatatgacagctagggtccttctgtactgtggccctaactctctggccggactttccagatctctgagagcttcaactatatgggaacgaattggataccaataggtcaccgtgagggcccaagtggctcaaagacctaacagggatacttttcaatcagtgctggaaggatgcgttatacctgtctgaagctacgtcatcctttggcattgatgtctcattgggtgtggaacatgtcacgctcatggtc

SEQ ID NO: 696259 - DNA, 546 bp, Homo sapiens
gggcagtacggattgtgtcctctgatacagattaatagttcagatcatctacttgacatctcaacctcaacaagtcgcaaaaaaaaaaaagagaagaattcggattcttctaaaaatatttctatggttatgggggggcattcgagccaggtctcatcggactggctggtcagtcttcagcaatcattggggactatttcgagatgggatgacctcatgtttcaggcttaaggccacattccccctcaggctaggggcctatgtggccaaaaggactagatgactagaaggggataatctaagaggcacggttgccagttcttctccggtcatttctctgggacccatccttggtggccttcaatccctccagtccacagaactcgggtccgggtcacagatgattccaggggttacccagggttggcttctctggagggccaacacatcacgtggtagaccatgtcccatctttaggagacaccggtctcttggcttctggaagatctcttccatctcacaagcttccttatgagctcagtgggt

SEQ ID NO: 696260 - DNA, 997 bp, Homo sapiens
ggcggcgggggcatgaatatgctcaggcttcacgtaagaggctcgtcctctagtgtcctccgcttgtggcaagaaaaagcgtctggatttagcacgcccatagtgacgacccaatgagaatcgaacgcgaactgccaatttccgcgtcagcagatcctggaatgctcatcaaagatgggctgatcgatcctgcaagtcctgattggacggtccacttcccgggcctcggatgtcgcgagaggaagatatcttggtccgtcgtgagagggcatgcacatgggcatagagttcagcgggaagggctacaggtcaaatgcccgaatggcagtattaaggctcacatggatgatggagaatgagggattttggggcgcgaagcttgcgtcaggagagattgcggtggaagtcgttgtaatagtcgaatcgccaaatgtatcgccgggacgggttgccgtggaagggtggaacgggagacatgtcgtctccagaacaaaccaagaagtcgcgtatgctcatggtaaacaccatccgaacaccagtcggaggcgggagactaaggcaaccagcgctcaagctcgctggtcgtgaaccgaggcatgatggcccgacaagggatctaagaccaaagggaaggcactgcaaagcgccgttgaagagcgcctccaggccaagaaggaggagatccatcaagactttatcccaagtggaggaacgaagaccaagaggattaaaaacctccccacttggtcgtgtacatactgggctctgtgattacatagatgcagcattacacataaacaagccttaatctgcaaaggagggaaaaacaaaactggaggtttggagggagagcagtcagttgcaggttatgtgcaaaatttatgaccgaggagaggggaccggaaaaacacgcgggccaggagcagggtcgcacacacaagggaccagagaggggccaccggggggggcctccacccccgagaaaaaatgggggcct

SEQ ID NO: 696261 - DNA, 205 bp, Homo sapiens
aagactaataggatgtccatgtaggtgtatgcatcgagggtcagtccgcgtaacgtcggtgtcataccggataggccgcgcaagtgttgtgggaagacagttagatttacgccgatgaatctgctagtgacattggcttatggcgtaggtctggtctagggtagtacctgaagcaatcggggaaatcaatttttatgaagcctcc

SEQ ID NO: 696262 - DNA, 193 bp, Homo sapiens
tcggtacccgctcgccctctctgtatagtcattctgagacggagtttcgtcagcccctcagcctcccaagtagctgggactataggctagcaccaccatgcccggctaatttttgtatctttagtagagacggggtttcaccatgttggccaggcttgtcttgaactcctgaccttgtgatccgcctggctca

SEQ ID NO: 696263 - DNA, 908 bp, Homo sapiens
tccccctgggttccacctctgcctttacccgcctgttggggttaacaaagccaaaggaaaagagaggagaaaaaaaagaaaaacaaaaccagccgtttctcacccggtgttgtgtcccacgtcaggaatgtttcagcagaggtggtgaagaggatcttctgctggacccttctatcctctctggctgaggcagcgtgcctacctgatctctggccagcccaccttctcctgtggtccccgcggttgccccaagttctcttacatctgggacggggccccaggtgttccctcaggggtccagtccttcctgtggggggccccaggctccgggaacaattaactgcaaccggatgtgataatggagttgtccgggtgtggtgaaaaagcgatgtgccccaagactcttgttctcagggccatctgatttggtgtcgactgcccccagtgaactctcctccaggattgggggccgtgtgtgccccctcaccctacggggtaactatccccccgttgcaccacgctacaagtgtgccctctcagctaaagttcacccgaggggctgcaagtgggcttcctgtggggcaccccgtctcagggagaattcccctcataacaaggtggcttcacaaagacgattgttatctcaacaaacggaacagggctccttgggaacccccctccgcgaaaaattcgccccttatcatcaatttcggggtgcgggaggacaaccacataaaaaccaccaagtacgaggacaacatacttggtttctgtggagccccgttggaactcctgaggtgtacatccgaataacatgtgggtcgggaacccctatgcatattagcaatatatcattaaccaacacaggggtggagcaaaatttgctcccaataaaataattggccccc

SEQ ID NO: 696264 - DNA, 108 bp, Homo sapiens
  misc_feature (1)..(1): n is a, c, g, or t
nttcttctggtcgtctctgaggtatccccggtactgcgctcgactctatctgtctgcttttcctgttgacaaccctggcgaccctagcgggtcgtgactgggacaccc

SEQ ID NO: 696265 - DNA, 394 bp, Homo sapiens
  misc_feature (258)..(258): n is a, c, g, or t
  misc_feature (282)..(282): n is a, c, g, or t
  misc_feature (309)..(309): n is a, c, g, or t
  misc_feature (373)..(373): n is a, c, g, or t
  misc_feature (389)..(389): n is a, c, g, or t
gtcgaccaaacttcctatctggctttatttttctacacagaatgtgtgtaagatacccacagacagatatgtgtctacacatctgtctgtatcccacttcccagttgattttatctctgtgtgaacacaatcaaggtccattttgttccttatcatccctgagcctctaagaagtatcatatttccgaagtacttaaaaacaaaacttactaagtaaatgacagagtggatgtcagctaaatgtgagtatggcacagnaacaaatggccctgaaacatcagnctttacgggattccttcctagctccgngaaaagattagcatgctctctcctttgcatgttggcacatccacagccaacaggcacacaaagnatacttgcactgtctncgtcg

SEQ ID NO: 696266 - DNA, 412 bp, Homo sapiens
cggggccaggaattgaagtgatgggctcacgcaagcatggttaacgtccctaaaacccgccggactttctgtaagaagtgtggcaagcaccaaccccataaagtgacacagtacaagaagggcaaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcagatctaagagaatgctggctattaaaagatgcaagcattttgaactgggaggagataagaagagaaagggccaagtgatccagttctaagtgtcatcttttattatgaagacaataaaatcttgagtttatgttcaaaaaaaaa

SEQ ID NO: 696267 - DNA, 851 bp, Homo sapiens
cggggccaggaattgaagtgatgggctcacgcaagcatggttaacgtccctaaaacccgccggactttctgtaagaagtgtggcaagcaccaaccccataaagtgacacagtacaagaagggcaaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcagatctaagagaatgctggctattaaaagatgcaagcattttgaactgggaggagataagaagagaaagggccaagtgatccagttctaagtgtcatcttttattatgaagacaataaaatcttgagtttatgttcaaaaaaaaacacaaaaggggccgccgctcgcagatctgagaaactagtcgaactaaccctggggtccccgtgggcatgggacaagcttatcggtagatgggcagaggcaaccgcaacaatttctaatggatgggggccacaattcttgaaacttcttggatgttggtccatcctgcagcaaagacttgggtagactttggccaaatcccaagaatgctgaggtgggtgatggccccacctcagtgaccttgctgggcttgcagagttttctgaagcagggtgaaaacccttatggtggggggagggtttacacccccagatcataattccgagctttccgcacagccaaccagctgggcggtttacccagatcaaggagatggtggtgaccgtgaagaaggcgaataccgtgggcaaaggaacctgcttgaaagttgtgccatagccc

SEQ ID NO: 696268 - DNA, 495 bp, Homo sapiens
cggggccaggaattgaagtgatgggctcacgcaagcatggttaacgtccctaaaacccgccggactttctgtaagaagtgtggcaagcaccaaccccataaagtgacacagtacaagaagggcaaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcagatctaagagaatgctggctattaaaagatgcaagcattttgaactgggaggagataagaagagaaagggccaagtgatccagttctaagtgtcatcttttattatgaagacaataaaatcttgagtttatgttcaaaaaaaaataaaaaagataaaactccagggggtggcccggttacccaatttcgccctaatatgaaagtcgtaattaccaatctcactgggc

SEQ ID NO: 696269 - DNA, 664 bp, Homo sapiens
  misc_feature (347)..(347): n is a, c, g, or t
  misc_feature (353)..(353): n is a, c, g, or t
  misc_feature (358)..(358): n is a, c, g, or t
  misc_feature (375)..(375): n is a, c, g, or t
  misc_feature (379)..(379): n is a, c, g, or t
  misc_feature (450)..(450): n is a, c, g, or t
  misc_feature (466)..(466): n is a, c, g, or t
  misc_feature (477)..(478): n is a, c, g, or t
  misc_feature (537)..(537): n is a, c, g, or t
  misc_feature (629)..(629): n is a, c, g, or t
  misc_feature (633)..(633): n is a, c, g, or t
cggggccaggaattgaagtgatgggctcacgcaagcatggttaacgtccctaaaacccgccggactttctgtaagaagtgtggcaagcaccaaccccataaagtgacacagtacaagaagggcaaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcagatctaagagaatgctggctattaaaagatgcaagcattttgaactgggaggagataaaaaaaaaaaaaaaaaaccaanactagngcctntctctcctcctcgcggngggnagaaggaacgcgcagccagcctttgggaagcccaggcccggcaagccatggcggtggaaggaggaatgaanttgtgtgaagttctgnctctacgtccnncctgcgggcctttggcccctgtgcagggggactgattgccgtgggtgtcggggcacagnttgtcctgagtcagaccataatccaggggctacccctggctctctgttgccagtggtcatcatcgcagggggtgtctcctcttccgggaggnctangagggcagctgcgggcctgcacggagaactt

SEQ ID NO: 696270 - DNA, 110 bp, Homo sapiens
gatgctcaccgctcccactgttgccagactcgacgaccgttggtacaccactggtgggaccgatgacgtcactgcctcatctgcctctgtgccgtgtgcacccgtgtggg

SEQ ID NO: 696271 - DNA, 319 bp, Homo sapiens
  misc_feature (51)..(51): n is a, c, g, or t
gaggcctattggactcacttgatgtaacagcctcaggcttataagacggtngactactgatcagaatagctcgaggcgtctgctgtcagggcttagctaccggggttgtatcggctaaaggctaaaactacaaagaagattgtgctaaggcttgagtgcgttgagcccaactgcagatctaagagaatgctggctattaaaagatgcaagcattttgaactgggaggagataagaagagaaagggccaagtgatccagttctaagtgtcatcttttattatgaagacaataaaatcttgagtttatgttcaaaaaaaaa

SEQ ID NO: 696272 - DNA, 448 bp, Homo sapiens
gggcttcccctctgagggacgaggaggaggaggaggaggagatggtggtgtcggaggaggaagaagagaaagggccaagtgatccagttctaagtgtcatcttttattatgaagacaataaaatcttgagtttatgttcaaaaaaaaaaaaaaaaaaaaaaaaaaaaaaaaaaaaaaaattaaaaaaaaaaaaaaaaaaaaaaaaaaaacaacaaaagggtgcgtgggcgcgcgcaccacgcggcgcccccacgaggaagaaggtcttcccagaaacaacaacgtcgtggtgggcggcgcggggggggcccaccagtaggggagcaatggagacacaccgggggcgacaaaacacgagcggtgtcccccaagagagaggagacctgctggggggcgacgacgagaacgaggggggggggggggggcttctccccccccaaataacagc

SEQ ID NO: 696273 - DNA, 712 bp, Homo sapiens
cggggccaggaattgaagtgatgggctcacgcaagcatggttaacgtccctaaaacccgccggactttctgtaagaagtgtggcaagcaccaaccccataaagtgacacagtacaagaagggcaaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcagatctaagagaatgctggctattaaaagatgcaagcattttgaactgggaggagataagaagagaaagggccaagtgatccagttctaagtgtcatcttttattatgaagacaataaaatcttgagtttatgttcaaaaaaaaaaaaaaaaaaaaaaaaaaaaaaaaaaaaaaaattaaaaaaaaaaaaaaaaaaaaaaaaaaaacaacaaaagggtgcgtgggcgcgcgcaccacgcggcgcccccacgaggaagaaggtcttcccagaaacaacaacgtcgtggtgggcggcgcggggggggcccaccagtaggggagcaatggagacacaccgggggcgacaaaacacgagcggtgtcccccaagagagaggagacctgctggggggcgacgacgagaacgaggggggggggggggggcttctccccccccaaataacagc

SEQ ID NO: 696274 - DNA, 498 bp, Homo sapiens
cggggccaggaattgaagtgatgggctcacgcaagcatggttaacgtccctaaaacccgccggactttctgtaagaagtgtggcaagcaccaaccccataaagtgacacagtacaagaagggcaaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcagatctaagagaatgctggctattaaaagatgcaagcattttgaactgggaggagataagaagagaaagggccaagtgatccagttctaagtgtcatcttttattatgaagacaataaaatcttgagtttatgttcaaaaaaaaaaacaaacacgcgacaaaaaacaacacaaacacacaaccacaaaccccaacaaccaaccacaacctgcgcccgttggggctttggcc

SEQ ID NO: 696275 - DNA, 426 bp, Homo sapiens
agctgcagtttgctcagctgtgaaatggggagaataataatgcctatttcatgggggtattgtgaggagtatgttaagtgtctctctggctcatgctgagagctgaataagtgatgattagatagttttaacatgaaggccaggctctgttggatgaaaaatgtacgctgggctcatccctgtaatcccagcactttgggaggctgaggcgggcagatcacttgaggtcaggagtttgagaccagcatggccaacatggtgaaaccccgtctctactaaaaatacaaaaactagctgggtgtggtggtgcgcacctgtagtcacagctatttgaaaggctgaggcacaagaattgcttgaaccagtgagccaagattgcatcactcccctacagtctgggtgacagagcaagactctgtctcaaaa

SEQ ID NO: 696276 - DNA, 655 bp, Homo sapiens
cggggccaggaattgaagtgatgggctcacgcaagcatggttaacgtccctaaaacccgccggactttctgtaagaagtgtggcaagcaccaaccccataaagtgacacagtacaagaagggcaaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcagatctaagagaatgctggctattaaaagatgcaagcattttgaactgggaggagataagaagagaaagggccaagtgatccagttctaagtgtcatcttttattgtcttcataataaaagatgacacttagaactggatcattgcctttctcttcttatctctccattcaaaatgctgtgcgatctttcttaagtgagccgaggcagttcgtactgtaagattgctagcaagattctgagacttcatactgccaacttcgaaggcccttttaagcaacaaactcttttcctctttggtaaggtttgtggagcccttgtttgccgcgtgagaaaatacggcgcttaagtttgtgcggcgtgcagtaggctgcagtgcgggttatcccg

SEQ ID NO: 696277 - DNA, 242 bp, Homo sapiens
actgtgtcactttatggggttggtgcttgccacacttcttacagaaagtccggcgggttttagggacgttaaccatgcctgcgttgagcccaactgcagatctaagagaatgctggctattaaaagatgcaagcattttgaactgggaggagataagaagagaaagggccaagtgatccagttctaagtgtcatcttttattatgaagacaataaaatcttgagtttatgttcaaaaaaaaa

SEQ ID NO: 696278 - DNA, 446 bp, Homo sapiens
  misc_feature (352)..(352): n is a, c, g, or t
  misc_feature (446)..(446): n is a, c, g, or t
ggtgagccctcattttgagttatcaccttaataaacatttccaagccctttagttagaagacttgaaacatgtttttcaaggcctagtgaacgctgtacaggagaacctgaaaagcaaattccgtgaaatgatttttagttttaagatttgggttctggcccagacgtggtggctcctgcttgtaatcccagcactttgggaggctgagacaaggcggatcacttgagtcccaggagttcgagaccagcctgggcaacatggcgaaaccccgtctctacaaaaatacaaatattagctgggcatagtggcccacctgtagtcacagctactcgggagactgaggcagaaggntcacttgagcccaggaagtcgaggctgcagtgagctgagattgcaccactgcactttaacgtgggcgacagagtaagaccctgtctcaactccn

SEQ ID NO: 696279 - DNA, 115 bp, Homo sapiens
cctcgctaggccatcagagagaggaagaagatttcatagggcgcttttggcaggatgcctgatgactgttttttcttctgactggacactcccctgctggctgcagtgcaggttc

SEQ ID NO: 696280 - DNA, 744 bp, Homo sapiens
  misc_feature (482)..(482): n is a, c, g, or t
cgtggtgactcactcctgtaatcccagcactctgggaggccaagacgggtgaatcacctgaggtcaggagttcaacaccagcctggccaacacgttgaaaccccgtctgtattaaaaatacaaaaaattagctgggcgtggtggtggatgcttgtaattccagctactcggaagtctgaggcaggagaatcgcttgagcccgggaggcagaggtccgaagatagcgcgagatggacgtccatgctgtgcagacagtgagcgatacagtgactgtctgtagcaaagaaaaaaagattaaatctaggctgggcactgtgggctcaagccggtcaatcccagcactttgggaggctacaggtaggctgacgtgtgttcgcattgtgaatagatactttggacagccttggtatcgctctcgagtaacgcacgagatgtcctaaattcaagtcctttcgcaggagttaagaagacaacaccttggngcctgagtaatcattaacctaaaaatgagtctcgatagggttggacgagatactgtgacgagcaaaatcctgtctcgtacacgaagagtgcgacataaattacgctggactgtcgcgtgggtgggtggtgccttgttgtccccagttaacggggaggctgaggcaacaaagatcgacaaaagaccaggcagggtaagaaggctgcagtgagcctgggataaggccacctgcaatccaatcttggggcgacaggaggcaagac

SEQ ID NO: 696281 - DNA, 745 bp, Homo sapiens
agcctgacggttgccatagggtcttcctcccctgactgggtttgggaagcagttagggagatagcgaaccggagtttccccagaagcggggtgggagggtgtgcatgctagtgttggcgcgtatgcaatgtgcatgaggtgtgcaccgttcctaaggaaggggcctctgggagctgcccaccctacctgccctgcctgacctgctgcccctcccatgacctgtcaaagaaaatcgagtatggaggagcattgatgggtgcctttgagggcagtggttcagcagggacaagactcacgactttatgatgcaccattctgttcccattctgcgcctgctgctgtgacccgatttttgtgaaaactgtgtgttgtaccgaggcgctgacttgtcacggctgacctgcctgctcgtgccttcattctgcatgcggcatggtccctcccattctgtgctccacctgcagcctccctgggtggcctatggctcccccgatctatgagacctccctctcatgatcactggtacctgggggcctgaattctggcccccggttccccatacagactgggacttggctggatggctgtcctgtggagccgctgcccaccctgacagagggatgctgggcatcccctcatcctctgtaactccctgtcttcaccagactcaaggacaccctggccctgctgaggaatacatgagcttcagaccagacagaagcaagacaaatatcagttgctctag

SEQ ID NO: 696282 - DNA, 364 bp, Homo sapiens
cctatgaggctgcagtgcacagagacagtgccactgcacatcagcctgagtgacagagagactttgtctcaaaaaaaaaaaaaaaaaaatattaatttaaatggtagacagtttaatttatctggtcctggcagtgggtggcttttggatggctaatttaataaagtggttacaatatttaacatcttctccggtaagctggtccagtttttcctttcatatggaaaacactaacacagtggctgaagtccagcgtgtacacacgggggtgacccctgggctgcatcggtcctcaccagtcagacatttcttctaatgggtggatggcggggctgaaccgggtggcaacatatggcccgtcatt

SEQ ID NO: 696283 - DNA, 320 bp, Homo sapiens
tgaggatcttgcgggacatcgtggaaggacacacccaggttacacggggcattgtggaatgacacacccaggttcacacggaacgtcgtgaagggcacacccaggttcacacggaacgtcgtggaagggcacaccccaggttcacacacacatgcatcgtggaacgacacacccagggttcacacggaaccatcatggaaagggcacacccggtgttcacattggaacgcctgtggaaagcacacacctcaggttcacacgggaattgtcttagaaagcacggagaaccagtttactccgggtaccgaggctcgaaattc

SEQ ID NO: 696284 - DNA, 342 bp, Homo sapiens
tgcgattgtgaatagtgctgtgatgaacatatgtgtacatgtgtctttatggtagaatgatttatattactttgggtatatactcagtaagggggtcctgggtcaaatgatacttctgtttttcacttctttgagaaattgccatactgctttccacaatggctaaactaatttacattcccaccagcactctttttcctgcagcttctaaaacaatgaatattttaattttttcctgacaataggcaaatatgatatctcaccactttatttgcatttctttgattacttttgaggttcagccctttcatatttattataacttgcctgttctgtcaattt

SEQ ID NO: 696285 - DNA, 493 bp, Homo sapiens
ggggatagagcagactgctcgttaggtgtcattgagtgcatcatagtagttatctaattataagaatgtatgtatgagttggaggaggtggctggtggcccatcacgtgtatctgtaaaggtttcagctgtgaggtagggccgatgtatggcaatcctgaagaatgacgatgctccactgccgccattctgacccggttgcaaagaggctttcttgcagaaggggtgattttgcatctgtagtagtcctctgcccgccgccgcaacgcttgcgcacgttgaaacatttccatgtaggtgtgtatttctttcatatccaatttcccattttcctctgcctctgacacctgcctctccttttctccgtgctcacgttctttcatgcttagtttcctcagatgttctttggcggtcttcctctttccattgattttgtcatgacggttgacttttgttgtcaccttcatcttacggattttagctcgaactttggt

SEQ ID NO: 696286 - DNA, 254 bp, Homo sapiens
  misc_feature (6)..(6): n is a, c, g, or t
  misc_feature (67)..(67): n is a, c, g, or t
  misc_feature (248)..(248): n is a, c, g, or t
ggtggntgggggcggtggatcacctgaggtcaacggttcgagaccagccctggtcagccctggtganccctggtgaaacccagtctctactaaaaatacaaaaattagcagggcgtggtgttaggctcctgtaatcccggctactcgggcggctgagacaggaaatcgcttgaacccgggagtcggaggttgcagtaggccgagatcctgccatcgcactccagcctgggccacagagtgagactccntttcaa

SEQ ID NO: 696287 - DNA, 946 bp, Homo sapiens
  misc_feature (68)..(69): n is a, c, g, or t
ttgttgtttttgagtatttttgattatatatctattacaatgttttcctctctggcgcgcgaacagcnncaccgtatgtttgtctatcgaggctcacaggtatattacaaagcttcttttacagaaacgctcagtacattaatttaaactggaatgacaaacgttatgattacagttttgggcaaaggctgtgccttgcttttttaaaaaatgggtacatcgaatgttcattttaacatcctggcataaaatcccactaattggctaataaaatcagatgcatatatttaacatttaaagttattgcacttcattttctgttcattttacaacaaaggggtgatacggaaagaaattacaattcaccgcatagcactttgcttaactcatatgttcatgtttactggcgtataacataaaaaacaaaaacagaagaataagttacctatttttaggttgccaatttttaacaactaattacgtctattttatttccccccccttttctttttttattattttataaagggacaaaaacgtcactattgtctatcccgcatctttttattagtttttctttcccatcaaagctcttttaataaacaaaaaattaaacatcatttcatacctcacactcgttctatacttccaatatgttttgtaagtttcttcttatatatcatctagttattgacgattctttattattttgctctcattcttttttcccatgtggttcataatccattttctcctctctaccaattcgcttgtcattacataatgaattgtatcttttctttattgtatgtttatgcagattacgttttctcatatccgtgaattattaatttcttttggtatcatttacacattggaaattattatgaataagggattgaactttatatcatcgtaagcattatcattaatgagtatgaaggag

SEQ ID NO: 696288 - DNA, 180 bp, Homo sapiens
  misc_feature (20)..(20): n is a, c, g, or t
ggggggggggaaaaaacccnttttttttttttgggggccccgggggggggtttttttaatttttccggcggggggccccaaaagcccccctttgaattttttttttttggggggggggggggttttcccccctttttaaaatttttaaatttttaaaaaaaggggggcctttttttttta

SEQ ID NO: 696289 - DNA, 683 bp, Homo sapiens
ccggctggagggaattagtaccaggcccggagttgtttgaaaaagcaatttttggcaaaccttgccagctgacacaaaggtggtggaagacttccttggggagcggaaaagtcaacatgcttgccagggactggagaattaatgaaggcgtttcaagaatacacacccaaacaatatgtcagcttccctttggccctgagattggaccaaaatccctaattttttcctgatgagcacgcttttcttaaaagatgctctctagtcatttggtctcatggcagaagcctcatgatactaaggagagtcttcaggtgtgacaatcagtatatagacaaacgtagtgttgtgatctggttggagactgggatgggaacaagttcatttacttaggggtcagagagtcttgaccagagggggccattcccagccctaatcagcaccttccagagacaaggctgcaggccctgtgaaatgaaagcaagcaggagccttggctctgagcatcccaaagtgtaacgagaaagcctgcatctttttttgtgtaagcatttatttttggaaattgaaggaacattaggccccagtgcgtgaaatatcttacagctataaatgaagggcctttcgatatagagcggttgtgatccacgccctcgaaggccgggctaggttatttttcctttttt

SEQ ID NO: 696290 - DNA, 219 bp, Homo sapiens
ccaggtcctgtacagcgctactgcaagagcagctcaccaccattgagaagcgctttgggctctccagttcttcatcgggtctcatttccagcttgaatgagatcagcaatgccatcctcatcatcttggtcagctactttggcagccgggtgcaccgtccacgtctgattggcatcggaggtctcttcctggctgcaggtgcattcatcctcacccatc

SEQ ID NO: 696291 - DNA, 170 bp, Homo sapiens
gcatctctcacttcgctcatgcattcccaggtaactgctaaaccctagttccgttgcacctgggcacgtgtcctgatagcaaccggcaacttatacagcctctggctagttcaagcagccagcatgtgctgcctgaacagcctaccggttgtcaccgtcctccagtctcc

SEQ ID NO: 696292 - DNA, 530 bp, Homo sapiens
  misc_feature (224)..(224): n is a, c, g, or t
  misc_feature (226)..(226): n is a, c, g, or t
acgcacccgttacttaagaaccttctttcccagagaaaaaagaggatttcttaaagaggttgcaccaagaggtattcccggaagcacacaagaatacccctggagtggcgctcttctttagagtcccaccattcttgttccacctttggtataataaacatggcctgtgaagaaagacactctctcgagagtgtgtgtaaataataatcaccgcgcggatgtgngnttttcttatcacgcgttctcacacataagaggaacccacactcattgggagtagttaaacactctggaggaagactctttgggggtccaaattcttctggaaacaatccacagggtggatggaagaccgcaccacttcttttttaaaatccacacatggacccctctctatttcctttttcagcaaatttcactcccacttttaatttaaaagaaacataaattgtaattttgctttattttttgatcatgaaactggttgtaaagactttttggccaaaaaaaaaagttttgggaatttctta

SEQ ID NO: 696293 - DNA, 1972 bp, Homo sapiens
  misc_feature (775)..(775): n is a, c, g, or t
ggtcacgacctaaaacattgacttctttaaatcttagccacgtgctttacctactcacttcgtagagaggctaatacaaataacatctacataacacacccattcaattgattaaaaaaatcccactctgtccgataatcccacacatttatcactaaatcgacgctccttctttccgctccatcgaaatcacagttactcttcaattgctagccacgtaggatcccataagatatgttcactttagtgcgttctgcacaccatggtaccatcatggcatggcctagcgaaactcccaacataactaaacctcacattacatccatgcaaccctgaacagactcttccaacaacaatcacgaacctaatccttttcctgcacaaactcacagtacctgtgccagtgaccgtgaggaggccactattgtctcagttaatcaccaaatgaggtcctcatttccatttgaagatatttttcctgcgatcctagctcgcattgaataagtttatataacttacttaatgacatctcactacacatcactctaagagtctatggctgtgcatatatcaaagatacttattccctaatccttctagttcatattctcgtaacaattatcatccacagtgacactagagtccatggcaggctctaatctctgggggtaataaccaatcacgtgattattcgcgatactggaatgtccaaatcggagtcattgcaagcaaagtgggggccggtttaacgccgtaaacgttggggactttattnactcctagttccgttgtggaacgtccaactacaacgatctagtaaattggaataaacacagggctcacggagaaggaactcaggaattcggcttcaaagaacaacccaagcggaaaggccaactatttcacaagaaccaacattcgccgtaaattaaccccaaatgcaccagttacatacccggggctggaatttacgctcccgaaggatctggtgacagtttccccttcacgaggctcattttacgaacggcctgggaaatcttgtcagtccccataaaacaatacttacacaagaggcataacgatggaagtgattgcaacagacctagaatctttttttgttatagtgaccacttattgcattaccataggcaggaacttcaacatttacgcacgagaagacacacgtatccataacaccccgtaacataaacgcataacaggggacgtgcactgttgccatatggacacatcggagcgacatgtgtccaaatagaatcgaacagaccccatacaattaaagggcgtacttgcaccacaccaccggataggacaaattcacgcagagtgacaagcggcatcaatatagaacagttgggtcaccacgaaaccacaccagaaggtacatcaaagagagcggctacacatacacacaggtacagaggaggactgagataagatgcgacaaagcaagagagaaagcgaacgcgaattaaagattacaagtccggagatgatcccacccacacacttaaagcaagagagaaaaatggagcccattacagataaatttacctcacgaccactagaatccctaaggcagaagttacgtctagatgttcaaatgaggtgtagcaacagtatttaaattagatagcaacaacgcaatagtatcactgtggccaatatggcgaaattgcgaccagagcaagaaaacaaagacaatacgcacagtaaatcatagagactagcagtaaacgaggtataagatacagtgcagaaggcgacataagtttttagagagcaaagaaataatagacgtagagagattggcagcaccgattatagacggtaaatacaatagagacacaccgcacagaagagtgaatatagcgcgaaccacacataaagaagagtaaaataaaagagcgacatgtaacacagtataaacacacgtgagaacgacgagatataa

SEQ ID NO: 696294 - DNA, 345 bp, Homo sapiens
  misc_feature (93)..(93): n is a, c, g, or t
  misc_feature (102)..(102): n is a, c, g, or t
tctttccccttcagtgtctcagaggaggggacggcagcaccatggacccccgcttgtccactgtccgccagacctgcagaaacccctccgtcncggttttanccaccgccctggccatctaccatgtgatcatgcccgtcttgttgttcatcgagcactcagtagaggtggcccatggcaaggcgtcctgcaagctctcccagatgggctacctcaggatcgctgacctgatctccagcttcctgctcatcaccatgctcttcatcatcagcctgagcctactgatcggcgttgtcacgaacccggagaagtacctgctgcccttcctgtccctgccaatcatgg

SEQ ID NO: 696295 - DNA, 360 bp, Homo sapiens
  misc_feature (17)..(17): n is a, c, g, or t
  misc_feature (32)..(32): n is a, c, g, or t
  misc_feature (43)..(43): n is a, c, g, or t
  misc_feature (54)..(55): n is a, c, g, or t
  misc_feature (64)..(64): n is a, c, g, or t
  misc_feature (66)..(66): n is a, c, g, or t
  misc_feature (81)..(81): n is a, c, g, or t
  misc_feature (84)..(84): n is a, c, g, or t
  misc_feature (97)..(97): n is a, c, g, or t
  misc_feature (101)..(101): n is a, c, g, or t
  misc_feature (132)..(132): n is a, c, g, or t
  misc_feature (135)..(135): n is a, c, g, or t
  misc_feature (138)..(139): n is a, c, g, or t
  misc_feature (142)..(142): n is a, c, g, or t
  misc_feature (151)..(151): n is a, c, g, or t
  misc_feature (153)..(153): n is a, c, g, or t
  misc_feature (159)..(159): n is a, c, g, or t
agtcgtccagcgcagtntgctcgtgctggtanagacttatcgnctaccgaccgnntgacgatancntatctgttggagccntgnctctctataatgntctntcatttccaatgtgtcgcctatcgctctggnacnggnntgnccgccagtntnacaganctcactgaccagtacaggcatggttatttcaacattaatagcatgtcaactggactcctatttgtaaatgttatcaatctaagcaatccagctcatcagtctactagtttgcttctttccgagagatgtcaagtcctcaagaatttgatggcttcttctgcagctataaccacaaggaacctacacattgtaactcaagtc

SEQ ID NO: 696296 - DNA, 131 bp, Homo sapiens
gcggccgcctactactactactactgctcgaattcaagcttctaacgatgtacggggacatggggggtggatgactccactttggttccctgtgttttgatttctcattaaagttcctttcctacaaaaaa

SEQ ID NO: 696297 - DNA, 298 bp, Homo sapiens
agacgaagcacttaaagcgtgcttgcagcaccgaagcattggatgcttgacaaactaacgggtgtatttgcacctcgtccatcgccaggtcccacaagctgagggtaatgtcttccactgatcgcttcctaggactagctcaagtatgcgttgactggagatgaggtaaagaagatatgtattcaacgtttcatcaaaattgatgcaaggtcgagttgatttcaatacctctgttcatggatgtcatcagcatcgagaggcaggtcacatttcgcatggatttaccaaggccggtttt

SEQ ID NO: 696298 - DNA, 704 bp, Homo sapiens
  misc_feature (47)..(47): n is a, c, g, or t
  misc_feature (54)..(54): n is a, c, g, or t
gcctatttcatgaggttgatttgaaggtagtatataggaaaacattntgaaaantgatgtattatatagatgtaagatcatggttttattttattttttaaaattaaaaaaaaatttttttccccaggttggtaacttgcccaagatcgtgcttttatgggcaaagatacttttccagttgattcctaaacacagaaaataagtatcacataggaacatggcatgctttgaattgaatttagggtggagataaatttttgcagaatttcagtcagtatgatggtattaataaatgaaaacattcactaataatacattgaaaaacattttaaactacaaaattaattatttgagggaatagcttcctagagggatatctcaggtttaaaaccatccaattaaaatattaaagcacactattgttattatttaagggatatttatttagtgtctgcatatttatgcacgtctggccttttaagcattttgaaaggaaggtatggtgctatggctcttctaaatattagctgaatctagtcagtagtaacttagtaaagttgaaaatatttagagtatattatttgactgttaactgtttggtttcagagaaatacactaacaaaaatgtcgaaaatgtacgacatgtctttgtgttgaacatatcataatccgtggggtttttgaatgacagaaaacccagagat

SEQ ID NO: 696299 - DNA, 615 bp, Homo sapiens
  misc_feature (30)..(30): n is a, c, g, or t
  misc_feature (36)..(36): n is a, c, g, or t
  misc_feature (57)..(57): n is a, c, g, or t
  misc_feature (91)..(91): n is a, c, g, or t
  misc_feature (116)..(116): n is a, c, g, or t
  misc_feature (123)..(123): n is a, c, g, or t
  misc_feature (247)..(247): n is a, c, g, or t
  misc_feature (323)..(323): n is a, c, g, or t
ccagctccagttaggtggggttggggcccnaagaanaaccttaaacggcccattaanccggtaagatttgaaaaagtcctcagaccattangaatggtcttgaaggctcagtcctngtgtganctgtactatcaggtgctggagccccatccagaggccctcttcttgtgggccgccagcaaagaaggttcctggagaggacgttggatggggagcctagatatgggccaagataaggcttggaagnagaaaggcttttccaagaccagaagtctgaaggtgacttttctccagggctttgcaaagacctgcagatccttgtnaatggttccctgttttcaccctcttgcaattttttatggaataaggactcaaatgggtcttctcttcagctttgtttgctctcatggtgtatgactgtgttttgtaaaaatatatataggcgcaacgatgctgcctttcaccacttctattcaacatggtattggaaattgtagccagagcagttagggaagaaaaagaaataaaaggcatctcaatgggaaaggaaggagtaaaattatctctgttccctgatgacatgactttacatgtagaaaaccttgaagataccac

SEQ ID NO: 696300 - DNA, 213 bp, Homo sapiens
  misc_feature (153)..(153): n is a, c, g, or t
aaaggctgccccgcctactgagacagtccacatgtattgttcctgcccaacttaactgagtgattaagcctgggaaggtccttctcctggctcagaagctcccccactgagcaccttgtgacccccgccccttgccaccatgagaacaacccncctttgactgtaattttccattaccttcccaaatcctataaaacgtgcccctctcccccg

SEQ ID NO: 696301 - DNA, 121 bp, Homo sapiens
tgcaggtttgcgggaactcgatctgccttgcgctaaatctgctggactacaatgggcgctcaagcttcatggctgtatcagatcgccgccgccgggatgcgtacgtgcagcctagccggcc

SEQ ID NO: 696302 - DNA, 731 bp, Homo sapiens
  misc_feature (421)..(421): n is a, c, g, or t
tggaagagggtggggaaaagatttcctcccaaaattcacagcttctattctccatccaaagagtgcacccgggagaaaaagccatacaatatgtgatggagtgtggggaagggctttcagctgtggtctccctcaactctcgtctgtgacccatctaggagaaagcccaccagcaagaagaaaacaccctctctcaaatgtgtgtgacgcagcatgtggagaagaccacttgtgtcacagaaattcaattcgtcctaaagggctgccagcaaaaaagcgctcccccgagcgtgttgaaaagacgccattaccaatatgtgttgcaggcccgggtgcggacaggggctacaaacgggggcgctgtgaaatctcgtgtgaatatgtgactctcaagagggggctccccctttgggggcagagnaaaaccaccttggacacgttgttacgggcacgggggtgacataagtgggtgccctttagactcgaggggccctcaaaagaccttttcggaactttttccactccgaggagagtggttccccgtgttgggcagaaaaaacacccttttagtgtgcactggtgcatgggggtcgccaatttaaagagtgtcttttcacctccaggtcctctcacgtgaaatgtgcaggtcctcacctcattatgagattttagccaaaacttttatattccttccaaaaaccggggggtctttctcgcctgggtgtcccctt

SEQ ID NO: 696303 - DNA, 111 bp, Homo sapiens
gggaaggcttcggaacagcaggaagcctgagacgaaggtcagccacatttgcatgccccaggcacctgacaagagcagtagatggaccatcttaatcaggcctcctaggtt

SEQ ID NO: 696304 - DNA, 770 bp, Homo sapiens
  misc_feature (638)..(638): n is a, c, g, or t
gggctgcttcggtgtgcaggagatgatggcggtctccagcaggagttaagagttcctcgtaaagttggcgcttgtcgtcaggaactttgataggaatgtgacagcacagagcgagatagtgcgacggctcacagattagcgtggggcccttggaagatgcactgaagatttgacacttacaacggtgtgacaggcatgcttgatgggccagcaaggacgacttatgagaacagaatatatagccctgaaatgtagaatgtggacctagattacccagaagctcctccgtcagggagatgtgtaccgaaagaattaagtatgaccggagataatgtaattccatgggggactggtgggtgcccgggagcataccagtgttagctgcactgggcaaaattcatactcgcataactcggtggtacttcaagagctaagcggtctacctgatgtccactgaagttagtgagggctttccagcagccaccacgaaggacaaaggatacaaacacttgatttttagtggctctcaaactgtgtcgtttaaattcagacaaccttctacgtcatgttaatgtctgtgatttcaagtatcaccagatgccagaattacacgtttaggtaaaatgaattccagcttntgaaacatgacctggaccatttgtcacgaatatatttactatatgttcacccattatgtgtccgggtaacagggggaaacctgcggcggaattctttctcttgaacggctgtcatttaacgtagctggggac

SEQ ID NO: 696305 - DNA, 664 bp, Homo sapiens
  misc_feature (531)..(532): n is a, c, g, or t
tgtggtggctcacctgaggtcgggagttcgagacaagcctgaccaacatggaaaaaacctatctctactaaaaatacaaaattagcagggcgtggtggcacatccctgtaatcccagctactcggtgggctgaggcaggagaattgcttgaacccgagaggcagaggtcgcagtaagtggagattgctccactgcactccagcctgggtgacaggtcgagactacgtctcaaaaaaacaaacaaaggctgggcgaggtggctcacacctgtaatcccagcactttggggggccaaggcaggtggatcacctgaggtcaggagctcaagaccagcctgaccaacatggagaaaccccatctctactaaaaatacaaaattagtcaggtgtggtggcacatgcctgtaatcccagctacttgggaggctgaggcaggagaatcccttgaacctaggaggcagatgttgcggtgaaccaagatcacatcattgcactccagcctgggcaacaagagcctgactcggtctcaaannaaaatagaaaaatacagtgattcaagggcctaggtgaaataaaactatctataactgagcagaatcccattcagattttagcccaaagaaaaaactatgttgaaaggacccattctttcatatggctctcgg

SEQ ID NO: 696306 - DNA, 185 bp, Homo sapiens
gtggattatggagttagcctaaagacaaataatctggcataaattaagagtaagagagaagagttaatagaatttcacttcacataacttaaaacatggctatttcaataaaggctaaaggttctcctggatccagaagttcactgtatttataaatgtataatgtatttgctactttttggctt

SEQ ID NO: 696307 - DNA, 457 bp, Homo sapiens
ccactgcgaggtgcagcagaagaagatgacctgcaagcaaacatgtggccactttccgccaaatgcagcttgagaacgtgtcggtggcgctcgagttcctgtgacctgtgagagcatcaaactggtgtccatcgacagcaaggccatctgtgtgacgtgaacctagaagctgatacctgggcctcatctgtgaccctagatcctgcactactaccatactccatgcccatagtgggacgaggatggaggatgagtgaggccaatgaagcagacccccaatgcagaggctcctgtggctggatccatgaacaagctgcctgcagctgcccatacaccaagcatcagcctgggactggcatgagcggcctgggccctggtgcgccctggttggacagctagtgccccgggcctagtgtcctgactagggactctatgggacgccaacattgcgcctggg

SEQ ID NO: 696308 - DNA, 482 bp, Homo sapiens
  misc_feature (33)..(33): n is a, c, g, or t
  misc_feature (85)..(85): n is a, c, g, or t
  misc_feature (92)..(92): n is a, c, g, or t
  misc_feature (115)..(115): n is a, c, g, or t
  misc_feature (151)..(151): n is a, c, g, or t
  misc_feature (210)..(210): n is a, c, g, or t
  misc_feature (220)..(220): n is a, c, g, or t
  misc_feature (226)..(226): n is a, c, g, or t
  misc_feature (231)..(231): n is a, c, g, or t
  misc_feature (253)..(253): n is a, c, g, or t
  misc_feature (324)..(324): n is a, c, g, or t
  misc_feature (334)..(334): n is a, c, g, or t
  misc_feature (337)..(337): n is a, c, g, or t
  misc_feature (345)..(345): n is a, c, g, or t
  misc_feature (350)..(350): n is a, c, g, or t
  misc_feature (359)..(359): n is a, c, g, or t
  misc_feature (363)..(363): n is a, c, g, or t
  misc_feature (382)..(382): n is a, c, g, or t
  misc_feature (384)..(384): n is a, c, g, or t
  misc_feature (402)..(402): n is a, c, g, or t
  misc_feature (405)..(405): n is a, c, g, or t
  misc_feature (414)..(414): n is a, c, g, or t
  misc_feature (476)..(476): n is a, c, g, or t
tctctgcctgcagagatacaaagaaagtaactntccccctcatgaaaagcaaccaggaaccccaccccagtaatgagggccaccnagggggngggagagccatcaagaagattcnccccagacggggggcaaagacaggaagaacccaggnaaacacacccacgggacactggcccccaccgccaccaccccccaccccaccccaacccnggccccaccnaacccnacganaaacaaaagaagggaaaaacanggagaaaatcaaagggaatgggaaggtgggggggggaacataaaagaagaaattgaaaacaatcaaaaggntctcagttcngcnttcccgcnctgtnatagaaatntctnatccaattcttcatatgtntnaattccaaggagcgggcnaanagcacaganataggatccaagggatttttggtgcggagatctaagtagtgggcccccccttatatggttanttcaac

SEQ ID NO: 696309 - DNA, 689 bp, Homo sapiens
  misc_feature (8)..(8): n is a, c, g, or t
  misc_feature (126)..(126): n is a, c, g, or t
  misc_feature (214)..(214): n is a, c, g, or t
  misc_feature (289)..(289): n is a, c, g, or t
  misc_feature (463)..(463): n is a, c, g, or t
  misc_feature (467)..(467): n is a, c, g, or t
  misc_feature (496)..(497): n is a, c, g, or t
  misc_feature (522)..(522): n is a, c, g, or t
  misc_feature (557)..(557): n is a, c, g, or t
  misc_feature (559)..(559): n is a, c, g, or t
  misc_feature (683)..(683): n is a, c, g, or t
tctgcggngacgcagtcccgtgctccatctcctccgaagggaatgaactcctcgtccagttcgtctcagatctcagtgtctaccgctgatggcttttcagcctcctacaagaccctgccgcggggnactgccaaagaagggcaagggcccggccccaaacggggaactgagcctaaagtcaagctgccctcccaagtcccaacctccggagaanacagaggaatctccttcagcccctgatgcacccacctgcccaaagcagtgccgccggacagcaccttgcagagcnacttctgtgccagcagccttgtggtgactgtcgacagtgtatagtccatggttcgggtagtctcaggtgagggccttgccgtttactgtcagttctttattggtgcttataataactgtgaggtactggacctgccttctccacccactggtgctctccctgaagttttacgtncctngcaagcagtgcccctctccatgaagaaannagtcatttttctgctgatgggccangtagaagagaacagaggccccgtctcttcctccananagctttttggtttctccaccggcccaatccaggaccagatctctctatccaacctaagcaagaggaagtgcccctctctatactctgtgcgggctgctgcgtccctatgtactgagtacgcagnccagcc

SEQ ID NO: 696310 - DNA, 978 bp, Homo sapiens
agcggagttgccgtttgctccgcaccaaatcgcctggaccgccgatgcgaactaaatgcatggcgctatctaaactggtgctgtttgcgtgcctcgctattcctcctcgcagttctgcattctgtcgggcggtgaaagtactggagatccctagcttatgtgatgaagtgtccgacaaaggtttgtgtagcacgcgcggccgtgtcaggactgtatagactagcatcagaccaacatatctccatggtaacctatgcggaagcctgtcactttcgattgtgcagtgaaaccatctgttacctgtgtggatcaagcacttcacatccgaaacaagaagcttcatcatgaacatgacttgcagatgtgctggcagcttcctgaaacagattacgagtgtaccaacatccaccgcagctgaaatgacggtgtcctgtcctcggcagtgctacccatgccaacttgcacggtgcgggaccacgtgcactgcttgggtaaccgtacttttcccaaaatgctatattgcaatggactggaggctataagtggtctacgtggtctggctctacagcatcaccctcggtgggttgtggagcagaccgtttctacctgggcagtggctgggaaggcctcggcaagctcttcaagcttcgcgtgggcctgggaattatggaccgccgattagaaggttcgtgctccttggggggtggctaggtaaggaccaggcagcatggacgcttggtacatttagctggggagatgtgctgtcgacaagtgaccaggcttaaaacaaaccgctggcccaccgacattgcagttgaggaaggtggatattctaggtatacgggggacccccgctcacttgtcgccgaacagcccaaataggacccacacgccacatcaatataactagcacatgtttccgcacagatagcacaacgaaaaatcgagagaaataacacctctatttaaaaacaatct

SEQ ID NO: 696311 - DNA, 159 bp, Homo sapiens
ctccatctaccctcactaaagggcgaagagtgtggtgaggaatgatgtgggtttcgcttgttcaaactgtcattttattttcacgctgttcgatatctatagtagcgtgactgaggtgcattcgattaggcgtagatagaagtagagattaagtaggcc

SEQ ID NO: 696312 - DNA, 282 bp, Homo sapiens
gttttttttttttcccccgggggggggggggggaaaggtggggggggccggtttttttccccccccccgttttggttttttccgggggggggggaaggggccgggggggggggggggtttttttcccccccccggggaggttttggccccggggcccccccttggcccccccggggcccggtcccccctttccctttttttttttttttttcctgggggcccccttttgggccccagaattgccccaaaaaaaacctaaaaatatatatataaatataagga

SEQ ID NO: 696313 - DNA, 217 bp, Homo sapiens
aaaaaaaaatttttagggggggggtaaagggggccccccggttaaccccccccggccttcccaggttccccggtttcaaaattaaaagggggggggggggggccccccttgggaaaattggggggggggcaaaggttgggggggcccccctaaacaagggggttggtttggtttttttttttgggggggtaataaaaaaaagggctttttttcccca

SEQ ID NO: 696314 - DNA, 838 bp, Homo sapiens
agtagcgctagggagaatccctgaaggtaatacttgacttttgcttcatattaatctagagatggaaaataccaagtggaccctcttctcctctcgcttccctgcctgggcacgtgcgtcccagtgtgtcggagagctcgtcgtgccgagctgggctgtcctgccggatgacgcgcgatcgcgtcagcggcgctgtgaccggctcctcgtcgcccggtgggcttgactctgggcccgcgagcttctcgaactatccgggcccttcagtacgccccaggcgttggcgcctcagcccgagctgcgcggctgaccgtagcttctccggcttgactgggctcgccggcttcaaggtgtccctgcatgacggctgctgctccagactccatggctgcggattcgttgactgcggtgcctggtactgtgctggcccccgcgtgggccgtgggcctgctggggtggccatggcctatgtgcgtcccgatggaatgccggcctagccgtgcctgcgtagccggtgccccaagtcgcccaactctattactcgagccgctcttggcgacgatacgggcgcattgtgcagcgtaccttgctgttcgagtaacccctcgtagagggcgaacgggggcgtcgctagatacacgtggatgacgatgacccagcaggacattactttaatgcccctaagggtagcaatgcatccctcacattgatggggggctgccattgacttgttgccgatggtgcttgagatgacctcttaagccatggcggattactggagtgtgacaaccttttgctcgttaatcgaacggtcagccagaagattaattaggacgga

SEQ ID NO: 696315 - DNA, 945 bp, Homo sapiens
  misc_feature (945)..(945): n is a, c, g, or t
atccatgtcttacctaattaagcaacatcatagtgccataactcaaggaagttgaatgaggtgaacatagatacagctctttccccttccccgcgttttgaaatgtagcaagatactttttatgttcccgcttccgccccattccctgtgccctttcccctttcgggaaacgtgtcaggaaccaaatagttacaagatgagcagttgagggcgactgagtagagtgatcgtacacagaacactggcttcttcgtgcttctatcataagtcgtgctgccggccaggttacttaagcacccttttaacaaggaaaccttgtgggagatccagctggcgactcagagttcagaaacaggaccacagaggtgacactctgggatcctggccactgaggttgcgatgtcctcaccttacctgaaaggagacactggacctaaatggctgcaccatgatttgttcctgatatggctaaatttctcaagacacagtcagataagtacatctactgccaccttcgaaaaacacagagagcacctacccagaggagaacgtagattaggagtaaagcagcgcgaaataattcctcagatggtattagtcacaatggtccctaacgaagtgaggagattcttggcaccagacctacctgtaccgcatgatctgtggactccggagtcaaggagcataagtgactcaggagaccaactggaagaaagcctccaagggctgaaggaaaacaagacaggaggcgacggacacacacatgaaagagaccaacccgcaaaggtgaagagaagcctgttgtggtctcgacgccgggcgcacatcaagaagaacaaagaacggagagacacacaggaagcagagaggagaccagcaacacgaacacgagcggcgcaccacaagagacgacgacacccgacacacccaaccaccccacacagn

SEQ ID NO: 696316 - DNA, 321 bp, Homo sapiens
  misc_feature (18)..(18): n is a, c, g, or t
  misc_feature (180)..(180): n is a, c, g, or t
  misc_feature (286)..(286): n is a, c, g, or t
tgtataaatatgttattngtgtatgttccaaaattatgtgaaactcctataattctaatataacttagtgtacattatcagtaataatcataattgttatattaaaattattgtgtgccacagaggtaaaaaatttccttgtcagttttgtcttttgactatggctgccttaaaactttnttcttccatgcacaattgttgttttggtcctcttttttaaatatatttgtattatttttgagatggggactcactctgttgcccaggctggagtgcagcggcaganacttgggctcactggcaactgccacctcccaggtt

SEQ ID NO: 696317 - DNA, 1548 bp, Homo sapiens
  misc_feature (136)..(136): n is a, c, g, or t
  misc_feature (165)..(165): n is a, c, g, or t
  misc_feature (171)..(171): n is a, c, g, or t
  misc_feature (184)..(184): n is a, c, g, or t
  misc_feature (210)..(211): n is a, c, g, or t
  misc_feature (214)..(214): n is a, c, g, or t
  misc_feature (251)..(251): n is a, c, g, or t
  misc_feature (258)..(258): n is a, c, g, or t
  misc_feature (264)..(264): n is a, c, g, or t
  misc_feature (271)..(271): n is a, c, g, or t
  misc_feature (274)..(275): n is a, c, g, or t
  misc_feature (280)..(280): n is a, c, g, or t
  misc_feature (283)..(283): n is a, c, g, or t
  misc_feature (289)..(289): n is a, c, g, or t
  misc_feature (293)..(293): n is a, c, g, or t
  misc_feature (298)..(299): n is a, c, g, or t
  misc_feature (304)..(305): n is a, c, g, or t
  misc_feature (325)..(325): n is a, c, g, or t
  misc_feature (329)..(329): n is a, c, g, or t
  misc_feature (335)..(335): n is a, c, g, or t
  misc_feature (344)..(344): n is a, c, g, or t
  misc_feature (359)..(359): n is a, c, g, or t
  misc_feature (499)..(499): n is a, c, g, or t
  misc_feature (519)..(519): n is a, c, g, or t
  misc_feature (547)..(547): n is a, c, g, or t
  misc_feature (549)..(549): n is a, c, g, or t
  misc_feature (553)..(553): n is a, c, g, or t
  misc_feature (1072)..(1072): n is a, c, g, or t
  misc_feature (1093)..(1093): n is a, c, g, or t
  misc_feature (1118)..(1118): n is a, c, g, or t
  misc_feature (1202)..(1202): n is a, c, g, or t
  misc_feature (1288)..(1288): n is a, c, g, or t
  misc_feature (1290)..(1290): n is a, c, g, or t
  misc_feature (1373)..(1373): n is a, c, g, or t
  misc_feature (1421)..(1421): n is a, c, g, or t
  misc_feature (1424)..(1424): n is a, c, g, or t
  misc_feature (1427)..(1427): n is a, c, g, or t
  misc_feature (1432)..(1433): n is a, c, g, or t
  misc_feature (1452)..(1452): n is a, c, g, or t
  misc_feature (1527)..(1527): n is a, c, g, or t
gcgcgggccgcgcgggcgggaagcgaagaggctgggcgggccagcgagtgagcgcggagagaacaaggctgctgagctggccaggagggctcagtgccgagacaccttgcagctgccgccgccgccaccgagccgncgctgtgctcactgatccgcctccagggncaccgncatgtcgagccgnggtgggaagaagaagtccaccaaganngtncaggtctgccaaagcaggagtcatctttcccgtgggngcggatncgtgcnggtactntcnnagaanggncacccncagngtacnnggatnnggagtgggggcacccgtgtncatngccgcngtcctggantacctgacagcgganattctggagctggctggcaatgcagcgagagacaacaagaagggacgggtcacaccccggcacatcctgctggctgtggccaatgatgaagagctgaatcagctgctaaaaggagtcaccatagccagtgggggtgtgtnacccaacatccacccgagtngctagcgaagaagcggggatccaaaggnanagtnggaagccatcatcacaccacccccagccaaaaaggccaagtctccatcccagaagaagcctgtatctaaaaaagcaggaggcaagacaaggggcccggaaatccaagaagaagcagggtgaagtcagtaaggcagcagcgccgacagcacaaccgagggcacacctgccgacggcttcacagtcctctccaccaagagcctcttccctgggcgagaagttgccagttgtacaggctgacattgcctcgatcgacagtgatgctgtcgttcacccgacaaacactgacttctacatcggtggtgaagtaggaaacacgctggagaagaaggtggcaaggagtttgtggaagctgtctggaactccggaaaaagaacgggcccttggaagtagctggagctgctgtcagcgcaggccatggctgctgccaagtttgtgatccactgtaatagtccagtttggggtgcagacaagtgtgaagaacttctggaaaagacagtgaaaaactgcttggccctggntgatgataagaagctgaaatncattgcatttccatccatcggcagnggcaggaacggttttccaaagcagacagcagctcagctgattctgaaggcatctccagttacttcgtgtctacaatgtcctctncatcaaaacggtgtactccgtgctttttgacagcgagatatagacatctatcgtgcaagaaatggccaagcagcacgccaactagncngagcaaccacagaaccagcagcaccatgtaccccaccatcagtttaaaagaaaaaaaaaaaccccttcactcccactgggagntgggacccctttcattaccagtcttgctcaactagggaaaaaaaggcnttngtntccannttaattgttttatgacctnctaaaatcgtttttatgttagcactgatagatggcatcactgttgttaacgcactgagtctccagaccgtgtctnacttagcgtaaccaaggagat

SEQ ID NO: 696318 - DNA, 240 bp, Homo sapiens
ctagaggatccccgtggtgtattataatccctgagacattggaaaattatagtgcaaatcaccctaaagtattttggtgtttaattaagaaaaaacctttttttggaggggggggggtctggctatgtggctcaggcggtactcgaactccggggctcaagcaatcttccggtctcagcttccagagtagctgggataaaagactggtcccacggcaccggccagcacaagaaccacagg

SEQ ID NO: 696319 - DNA, 158 bp, Homo sapiens
tgctgggattacaggcgtgagccactgtgcctggccctggtaacttttaatgttcctttgaaggtgtttcctagtatgaggatgggcagcttctgagtcgttgtgtgtctgcttacacacaaacggtttcacaaagctgaaacacttacaaaatggtt

SEQ ID NO: 696320 - DNA, 1536 bp, Homo sapiens
  misc_feature (136)..(136): n is a, c, g, or t
  misc_feature (165)..(165): n is a, c, g, or t
  misc_feature (171)..(171): n is a, c, g, or t
  misc_feature (184)..(184): n is a, c, g, or t
  misc_feature (210)..(211): n is a, c, g, or t
  misc_feature (214)..(214): n is a, c, g, or t
  misc_feature (251)..(251): n is a, c, g, or t
  misc_feature (258)..(258): n is a, c, g, or t
  misc_feature (264)..(264): n is a, c, g, or t
  misc_feature (271)..(271): n is a, c, g, or t
  misc_feature (274)..(275): n is a, c, g, or t
  misc_feature (280)..(280): n is a, c, g, or t
  misc_feature (283)..(283): n is a, c, g, or t
  misc_feature (289)..(289): n is a, c, g, or t
  misc_feature (293)..(293): n is a, c, g, or t
  misc_feature (298)..(299): n is a, c, g, or t
  misc_feature (304)..(305): n is a, c, g, or t
  misc_feature (325)..(325): n is a, c, g, or t
  misc_feature (329)..(329): n is a, c, g, or t
  misc_feature (335)..(335): n is a, c, g, or t
  misc_feature (344)..(344): n is a, c, g, or t
  misc_feature (359)..(359): n is a, c, g, or t
  misc_feature (499)..(499): n is a, c, g, or t
  misc_feature (519)..(519): n is a, c, g, or t
  misc_feature (547)..(547): n is a, c, g, or t
  misc_feature (549)..(549): n is a, c, g, or t
  misc_feature (553)..(553): n is a, c, g, or t
  misc_feature (1060)..(1060): n is a, c, g, or t
  misc_feature (1081)..(1081): n is a, c, g, or t
  misc_feature (1106)..(1106): n is a, c, g, or t
  misc_feature (1190)..(1190): n is a, c, g, or t
  misc_feature (1276)..(1276): n is a, c, g, or t
  misc_feature (1278)..(1278): n is a, c, g, or t
  misc_feature (1361)..(1361): n is a, c, g, or t
  misc_feature (1409)..(1409): n is a, c, g, or t
  misc_feature (1412)..(1412): n is a, c, g, or t
  misc_feature (1415)..(1415): n is a, c, g, or t
  misc_feature (1420)..(1421): n is a, c, g, or t
  misc_feature (1440)..(1440): n is a, c, g, or t
  misc_feature (1515)..(1515): n is a, c, g, or t
gcgcgggccgcgcgggcgggaagcgaagaggctgggcgggccagcgagtgagcgcggagagaacaaggctgctgagctggccaggagggctcagtgccgagacaccttgcagctgccgccgccgccaccgagccgncgctgtgctcactgatccgcctccagggncaccgncatgtcgagccgnggtgggaagaagaagtccaccaaganngtncaggtctgccaaagcaggagtcatctttcccgtgggngcggatncgtgcnggtactntcnnagaanggncacccncagngtacnnggatnnggagtgggggcacccgtgtncatngccgcngtcctggantacctgacagcgganattctggagctggctggcaatgcagcgagagacaacaagaagggacgggtcacaccccggcacatcctgctggctgtggccaatgatgaagagctgaatcagctgctaaaaggagtcaccatagccagtgggggtgtgtnacccaacatccacccgagtngctagcgaagaagcggggatccaaaggnanagtnggaagccatcatcacaccacccccagccaaaaaggccaagtctccatcccagaagaagcctgtatctaaaaaagcaggaggcaagacaaggggcccggaaatccaagaagaagcagggtgaagtcagtaaggcagcagcgccgacagcacaaccgagggcacacctgccgacggcttcacagtcctctccaccaagagctctccttggcagaactgaacttattccagtgaacagtattagcggctttgaggtgaggcataatcaatctaccaatgctgacattgacttaagatgactaggaaacctggagaagaaggtggcaaggagtttgtggaagctgtctggaactccggaaaaagaacgggcccttggaagtagctggagctgctgtcagcgcaggccatggctgctgccaagtttgtgatccactgtaatagtccagtttggggtgcagacaagtgtgaagaacttctggaaaagacagtgaaaaactgcttggccctggntgatgataagaagctgaaatncattgcatttccatccatcggcagnggcaggaacggttttccaaagcagacagcagctcagctgattctgaaggcatctccagttacttcgtgtctacaatgtcctctncatcaaaacggtgtactccgtgctttttgacagcgagatatagacatctatcgtgcaagaaatggccaagcagcacgccaactagncngagcaaccacagaaccagcagcaccatgtaccccaccatcagtttaaaagaaaaaaaaaaaccccttcactcccactgggagntgggacccctttcattaccagtcttgctcaactagggaaaaaaaggcnttngtntccannttaattgttttatgacctnctaaaatcgtttttatgttagcactgatagatggcatcactgttgttaacgcactgagtctccagaccgtgtctnacttagcgtaaccaaggagat

SEQ ID NO: 696321 - DNA, 364 bp, Homo sapiens
tgagacgcattcactcgtcttttagctaccataggcaggctttcaatgtatcctgttggtgtttctaccagtccatcaagtctttcttgaaggaccgcaagagtctgaggatttggcttcatgtgaacagtgatctcacgtgctttcagttgtgtttcttcaccagtttcctcttgttctacttcttcaccttcatccaaatcttgatcaggttcagcctgttccttgtgtgtcaatgtctgccatgttgtaagaactccaaatatcggcgattagtatgggtatccaggcgaccggagctgcgcagtcagtgactcagggcgtcagcgacagcaacagcggcagtagcaggaggcggcgtcgt

SEQ ID NO: 696322 - DNA, 167 bp, Homo sapiens
atggacactcggaagactacgaacagcacggaacactgatgaccatacttcgtcttcacctcggagcctgaattccaagtaaaagccattggctatctaccaggccaactggctgctcaatagaagcagtggtaacacgaagaactcgtcccctttacttcaaaact

SEQ ID NO: 696323 - DNA, 114 bp, Homo sapiens
taagatcataatatgagctgcctctacaaccgatgtttcattttttacatcccttaaactgttttacggcaccttttctatgtttagatacacaaacactttaacgctattatt

SEQ ID NO: 696324 - DNA, 655 bp, Homo sapiens
ggtctggtctgtatttcgatgtccggataccgatggacaaagccaggactacctgaacgcagagtagcacagtaccatgacagctgagaatcggactcagatatcgtgagcgttgctgcttcttgcccagcttcgagtgctgacctcgatgctaccactctacaacttttgattcgtgagcgtgtcgctctaaactgacgcttgccatgattagctcaatggactattattcatcccagtggctctattgagggaacgataggtggcgtcgttatcgtattcgggtttaatgggtatatctctgtataatactgcagcccagcatgatctcacaaagtttgagaatcgcttacttgtcctctatgtcgatcagcacaagcacaccatcgcctatgttcgggcacatatcagcggctgaatggaaagagtctcagagatcaagtgcaggattgcgcaagctggcaatgatatttgtctcggcatttcttggcttggattatgaggcttacaactcctgtgagattcacgtccatataccatttcagtcttgtgtcactatgtgtctattaaattgagttccactttgtataaagggttactctcatactccttatgtacagaaatcacatgaacaaataaaggttccataatgcgt

SEQ ID NO: 696325 - DNA, 359 bp, Homo sapiens
aaggatctattgcctccctcgtttacttttaccgcctggtgaatttgcagtccattagaaaatgtggatgttgtgggccgggtgcggtggctcacgcctttaatcccagcactttgggaggccgaggcaggcggatcacaaggtcaggagattgagaccatcctggctaacacggtgaaaccctgtctctactaaaaatccaaaaggatttggccgggcatggtggcggacgcctgcggttccagctactcgggaggctgaggcaggaggatggtgtgagcccgggaggcggagctggcagtgagcggagatcatgccactgcactccagcctgggcgacagagactccgtctcaaaaa

SEQ ID NO: 696326 - DNA, 171 bp, Homo sapiens
ccatatctataatggattgctacgacatgttcatcccaatatacatgtgccagtgtcactgctacactaattgaattactataaatgtataaatgttttcctatatgttcgtggtacatttattatttgcaacgttctcccaaggatctgcaggaacacatatgtcaaggc

SEQ ID NO: 696327 - DNA, 341 bp, Homo sapiens
  misc_feature (196)..(196): n is a, c, g, or t
  misc_feature (201)..(201): n is a, c, g, or t
  misc_feature (266)..(266): n is a, c, g, or t
  misc_feature (280)..(280): n is a, c, g, or t
  misc_feature (295)..(295): n is a, c, g, or t
  misc_feature (319)..(319): n is a, c, g, or t
ggagggcaagaaacccccaccccttctccgtgtctctactcttttctctggacttgcctccttcactatgggcaagcttccaccttccattcctccttcttctcccttagcctatattcttaagaacttaaaacctcttcaactctcacctgacctaaaatctgagcatcttattttcttctgcaatgcgcttgancccangtacaaactcgacaggtaagttccaaaatagcccgggaaaatggcacttttgaaattttttccantccctaacaaaggnttctaaaattaaatncctttgtcattaaaattgggggcnaaatggggtcttgaagggtggc

SEQ ID NO: 696328 - DNA, 993 bp, Homo sapiens
  misc_feature (820)..(820): n is a, c, g, or t
gtgcaagctcagcttgtgagggtgatcactcgttacaccccccaagtgcatatgggtctgtcacagcctatactaatctttgatgctgagcgggatgcttcgaacatgaaacagccatcgaagaccaaaggtgtggatgaggtcaccagtgtcaacagttctggaccaaccgacagcgaatgcacagagacaggatatgccttcgccgtaccagagaaggaccaaaaaggaacttgcatcagcactgaagtcagccttatctggccacctggagacggtgattttgggcctatgaagacacctgctcagtatgacgcttctgagctaaagagctttccatgaacggggctgggaaccgacgaggactctctcgatgagatcatcgtgcgtccagaaccataccaggagctgcaggaaattagacgagagtctacaaggaaatgtacaagactgatctggagagaggacattatttcggacacatctggtgacttgcgaaggtgatggttgcgctggcaaagggtagaagagcagaggagggtctgtcattgagtatgaagtgattgatcaagatgctcgggatctctatgagctggagtgaagaggaaaggaactgatgttcccaagtggatcaggatcgatgaccgagcggaggtgggcactggcagaaagtatatgctgaggtacaagagttatagccctgatgacatgtgcgaagctcaggcaagaggttagggggacctggaaaaggttcctgaacctggtgcagtgcttcagacagccggtattatgctgtcgggtgttgaactcctgatggcangggagcgagaaaggctgatcgagaggtccgcggaatggcagtggatccggcgatcaaaaaacggagccgcaataccaagactggggtccaaacgggccggggggaaacccggaaacaaggggcgcccagaaaggaacagccgggggggcccaaggcgctctgcacagaacacg

SEQ ID NO: 696329 - DNA, 288 bp, Homo sapiens
tggtgtattgaattcatcgctattcatcggcaccccccctaccctaggctaggctgtgagggaggtcagtgcgacttcctgggttctctccttggctccactcacgcacttagcagtttcagtcctggacttcccctggagatgcactaaacctgttgcttgcggtgccgatgaagcgaggtgccgatgaatagcgaggtgccgatgaatagcgaggtgccgatcaatagcgaggtgccgataaatagcgaggtgccgataaatagcgagatagccgatgaataggga

SEQ ID NO: 696330 - DNA, 1010 bp, Homo sapiens
gtggctcactgaagtgttgaccctgggctcaagctatccttccacctcagcctcccacgtagctgggactgcaggtgcatgccaccatgcccaactaatttttaaattttttgtagacacaaggtcttgctgtgttgcccaaggtggtcttgaattcctgggctggagatcctcccaccttggcctcccaaagtgctgggattacaagcatgagccaccgtgctggccctggaatcttttttttttttttcaagaaccaggtcttaacttgggttgcccaggctggaagcgcagtgggcacaatctgggctcactacagcctcgaacctcccgggctcaggtgattctcccacatcaagcctcccgagttagctgggactatagggtgtgcaccatcacgcccgtgcataatttggaatttataagtagagaaggggtttggccagttggcccaggcgtggtctcgaactcctgagctcaagtgataccatccacctccgcctcccaaagtgctgggatcaccggtgtgagccaccatgccgtggcccacggggaattcttggatcataaggatattggggccttgaaccgggattggggcagagacttagaaactagtggcaatcacaatgggactggcagtaggtatactcaggtgatggcagtgatacagttggcggcccagccaggattttctaaatcttgggactggggccctccatccactttgccaaactgtcgggacacattgtctttggcgcaaaccaaaaccgttttaaaaaaaaacccaacctcctctctgtggtcacccggcgtgtgcctgcacgggacaggaaattgccgaagaacgttttaacaagttcaccctataattccggtggccccatggtcttagtggtcacaagaggaggaggtccaacaagtattttgattaacccgtagtgatgtgggttccctagaaacagcagcagggggatagaactcagaggcaattacgcctttcaacgaag

SEQ ID NO: 696331 - DNA, 683 bp, Homo sapiens
taaattaacaaaaggtaggctccggttataaaagtcacacacaacggactatctcagtgtgactcaagaccacaaaaaacccatttctccttacattctgagtccgggggttaatacctagaaccagcaagtgtactgctgggggtccattcacaggtttacaagttttccattgagtgcaatctggtgactggttgtgaggtgggccaggtaggtcaccatcaaagaggtcatggatgtggctgtttgagcagtggtctcaacaggtcatcgggaacacctatttccggtcactggtggttaaccgaggctcatcaggaaagcggcccacagtatgtgtcagctgaacacctttccagaacagtcacatcctctgccaattaatggcaacccctgtccctcgagggcatccgggatgcaagctgatgcccctcctattggctggcaagtccattgtgagaaagtccattcactctgtgggggctaaagcaggtcttcatgatcgaggtcacactccgatgcgtccagcgtccgtaaaacgcgtatcccacggtccaaaggcgtgaacatcactcccatggtccctccacaggactcccataaaagtgtgccgtaggttgcgatcgctcatgcggcggtcggggaactggtgtccccggggacgggtgaatgaggtagggggc

SEQ ID NO: 696332 - DNA, 182 bp, Homo sapiens
  misc_feature (44)..(45): n is a, c, g, or t
gtcgagggacgcactctacttcagctggacaacacatgtgaganncctgtttcaaagaaaaaaaaaaaaaaaggtagaccctgaagattgaactgtggattggttggaaatttggtggttcctcttttttaggtttattctttctttctttttttttttcaaccgggccccttatttaaaag

SEQ ID NO: 696333 - DNA, 391 bp, Homo sapiens
  misc_feature (192)..(192): n is a, c, g, or t
aaaggtggccccccttttttgacctcctcctccttcaaggtcaaacaccacctcccttattcaggaccggcactttttaatgtttgtggctttttttccagccttttttaggaggggtaatggtggagttggcattttggaactctcctttttccttttttcccctttttttgcccgcctttcccatccggntggagactttttgattgtcagtttgtgttcccatccagggattgttttggtttttgttccctttttgactgcccaaggggtttagaaccccagcaatcccttcctttcactacctttttttttgggggtagttggaagggactgaaattgtggggggaaggtaggaggcccatcaataaagagggaaccccccaggtga

SEQ ID NO: 696334 - DNA, 197 bp, Homo sapiens
aattgcccagttgaaatagcacaaagagatccgtggagacttgtgaaaggaacaattttgatactgtgaggatgaaaactcggatcaaagagcaaaaaaggaagtggagacattacctataggtgacttggagagttccacgtgtacagggagacgctgagcaaatggcagtgggactctgacaggagacaagtagg

SEQ ID NO: 696335 - DNA, 315 bp, Homo sapiens
  misc_feature (6)..(6): n is a, c, g, or t
acaccntttaaaatatttaagttctcggccgggtgcctggatcacgcctgtaatcccaacactttgggaggccgaggtgggcagctcacgaggtcaggagaccgagaccatcctggctaacgcggtgaaaccccatctctactaaaaatacaaaaaattagccaggcgtggtgatgggtgcctgtggtcccggctactcgggaggctgaggcgggaaaattgcatgggacccgggaggcagagtttgcagttgagcttgagattcgcaccactgcactccagcctgggggtgacggagcgggggtcctttcttca

SEQ ID NO: 696336 - DNA, 177 bp, Homo sapiens
ggaagacacaaatgcagtcaagctctttcaggaatcttacatgtgacggcagcacagttagctcacacctgcaatcccagcacgttagggaggccaagatgggtggatcacttagcggtcaggtgttcaacgaccagcctggccaacatggtgaaaccccgtctctactaaaaatac

SEQ ID NO: 696337 - DNA, 145 bp, Homo sapiens
gccaatccagtggctctcctccgcggtcgctcaataggccgaacaaccaaacagaaaagtttaataaacagcggacggaggggcccgccggtggcggacgaggcaaagcaggggtttcggcggcattacctgtacccattaaccg

SEQ ID NO: 696338 - DNA, 937 bp, Homo sapiens
gtcagcatagtcagccttgtctagtgtacattcaaaaagaacaaagatcttttatatggatatcttataaatatataatcattgctaagtaagaagttaagttgttgctatcgcaacaatcctggcagcacacattgagtaatattcttgatgatttattttgttcgtaattagttattataagaagatctagatcctagatattcagccaataaaatttattctctacgtgtatccatttcaaatgttaaaatattgttctaatacttctttcgataatccctgcagttatcgaggccttgttataaataagctgcataatcaatacatagaacaagggactttttgttgataagtccacatactcaaagttgtacgtaatgaaacatctatatccgtgtgtgcaaactcttgagggttgcattatgctgcaattcacgccatcgtctggaaccgtctacgggaacgacccggttcgaccctctttatgcatcttcttgtactttagtcagacaagagagaaacctgtataccctagtacacgatcttattttgaactaaaaacgtctatacaacttacacaccgagtttggtgaaggctaatacaatgacagaactgagcataattgcttgctactgtggcacagagttaggcattccataccccttcaaagatgtcgctttgctttcttgtggacagcttgtagttagccaggatttattcagctggaaaagatacgccatcctttcaaaccctcatgattgactaaaaacttccatggggccaaatctgcctgaagatcattaccaaaaatagccggtaatgtctaccattaagggtggaaatcatggatcagatattccttacattttcacaacttaatgcatgtttaaacactttacctataagacgagagcaagactaaactagacctta

SEQ ID NO: 696339 - DNA, 410 bp, Homo sapiens
aactccgcttctatgtacaatctgaagaatcactcctcaggaacacttcaatcctgcttctatgcaaggtattaggtcgtcattgtatggattatacctcaaaatgacacttcacaaatacctgtagaggagtaatggtatctctataacttggtaagatatcaagggtgacacttccactaatatatttacagtaattcttgtaattcctttggattatatccaacctcatggccattgacttcttataattatatctcccacatgaagtagaccttgtcgatctatcattcccccatggaggattcgggcaattaccagatcattattttcaaccctaaatgtcacacccagtggtaccccagctcttttgtgaataccaagaatacgaatggcatctactggtcata

SEQ ID NO: 696340 - DNA, 325 bp, Homo sapiens
gggtttataaagggagctaagctctctttagtcattcaccaagcatatgtattcagcagctgccctgtcccaggtactcctttggcatgaacaaaacctcccatccccatcctattggagcttgcatttttagaggggaggaggcagacatataaaataagtacagggctgggcaacatacaaaaaatttaaaaattagctgagtgggccgggcacggtggctcacacctgtaatcacagcactttgggaggccgatgtgggcagatcatgaggttaagagatcgagaccatcctggctaacacggtgaaaccctgacttactaa

SEQ ID NO: 696341 - DNA, 328 bp, Homo sapiens
aaaaaaaaaaaaaaaaaaaaaaaaaatgggtttttttaaaaaaccaaacaaaattttttcccggtttgggggcaaccctggttggattttcaaaaaaccccctggtcctggaaaaaaattttttttaaaaaaaaaacctcggagggggggataaaaaggggagagccccggttttttgccggcccaagggcgtttaaaaagggggggccttttgttggaaatggtcccccccggggcagggggggttttattttggggaaacaaaccctgttggaggctttttttagggccctgcttgtgggaaaagcggccccggggaataaggggg

SEQ ID NO: 696342 - DNA, 104 bp, Homo sapiens
acagaaatggagaacactctggcccagaaagggtaaaaacacagaactctgagccaagttgcacttcattcttccatgattcgccatgtcacatttagattaaa

SEQ ID NO: 696343 - DNA, 1217 bp, Homo sapiens
gctgttcatcgtgtctgccggcgacgctctcagcttgtgcatatggggtcttgcctttcgctccacctggccgtgactgacttgtgtttgattatacgacctgcacgaggatgttgtttctggccatagcgtacatttgttgcataacgtttttgcctctcttgttcgaactcctcgggatgactcccagattggtttggcttgaagtacaatggtatttgttggacaatatctggttcttaaaactccctgtgctcttctcggaggggcggacacgagtatgataagaaaccacgtgggtgggtttctctgtcgggtggttgttcgcccgccccccgtgccaatggtgttccacctggggtgaggcccctcgcagaatttgttgggagcggttttttttgtagagaaaaatagcatccctatgggggacaccctttgttttcttgttgccggagttattccgcgcccctcccctcgatcccctgcagttctgactacttcccttcttgttctcaagcctcccccccccgacttttgaggccacaggttggcccagaatttagccaaacccaaacacgagtgtctgaagttaaaccccaatttccaggtaaaaccaaagataatgtttctagccttaaatatgcccccccgcccaataatttggaaccaccctaatgtgaaaaatgagtttgtttttctgaaaattcaccgctttctctctgagtcccgtaaactggtccccgaaggggattgagccgaaaactcgcggtaatgaagcccctgaaggttgaactcgccgcgtatttttttctgtcctcgggaaccacgccctgaacccaccctcgccccgttctcccactgtagcccacctgaaggggaagggggaagaacaccacgagacccaccaccacgcccggggcgtccccctggcgactgtggcccggcccctcctcttcttgcctgaactctccttcttcttgcctgagactttaagaccacctataacttagttccacggttcggtgccctgttggtgctcctgtttcccactagcttaggtcccactggtgggggaggacctcccggggctatgcacgccccccccacgctgccctcgaatcccctccacggcccacttcccgagtttttaactgatttttttcatgatattgtccaaaccgtgaggaaaccattataaaaaaagccccttaagccca

SEQ ID NO: 696344 - DNA, 199 bp, Homo sapiens
  misc_feature (173)..(173): n is a, c, g, or t
  misc_feature (176)..(177): n is a, c, g, or t
  misc_feature (179)..(179): n is a, c, g, or t
ataccacctctatcccctctgataccactagctataccaccaactaagaacggccatgcaccaccacccctgataccaccctataccacacgtgaattctcatggaggtagtgcttttcttatactgtaaaatggtgaaggtggggagttttaagtgtggtatgagtggtatngtnngngtatagcaagatcctgtaga

SEQ ID NO: 696345 - DNA, 204 bp, Homo sapiens
  misc_feature (178)..(178): n is a, c, g, or t
  misc_feature (181)..(182): n is a, c, g, or t
  misc_feature (184)..(184): n is a, c, g, or t
acaactatacactcacgtagctttctatactgtaatagatgggtactggtcagtgagtttaaaagtgtggtatagctataccaccctataccacacgtgaattctcatggaggtagtgcttttcttatactgtaaaatggtgaaggtggggagttttaagtgtggtatgagtggtatngtnngngtatagcaagatcctgtaga

SEQ ID NO: 696346 - DNA, 420 bp, Homo sapiens
  misc_feature (100)..(100): n is a, c, g, or t
  misc_feature (164)..(165): n is a, c, g, or t
gcaacagagtgataccctgtctcaaaaaaaaaaaggacttttttgggacttgatgtggccccaggcggcaaccagtgggacccacaaggcaaacaggganattctctaaagggacagacgcaagagaaccctttccttccttccagaactttcatagtctcccnntttagagcccggcttgcttgacagagaaccttgagcaaaggaggccattccggattcacagcaggatttacaaggttccccaaaggccaggaattcctggtgtcacaaagcaaaattgagagaggtgcgcttggacgctgaaaaattaatagcttagtaaactggcacagggaacattcacagtcttggtttggtttttagaagaaggagtctctgtcgcccaggctggagtgcaatggcgtgatctcctgctca

SEQ ID NO: 696347 - DNA, 365 bp, Homo sapiens
aatattataaattgggtcacagaggtcacccagaattactttaatgttagtgaagtctgtagaggagggacgagtgtatgtatgtgcgtaattttttagggagtagaagcttactgatggaattctttttagttgttatcagcttcctagggttgaatgattttactcttaatgatttggcttccgtgcctttcttaaactaataaataatagttgcatcaaaattctttcttcctcctaggcttttgtcagttatgttctcttttttcctcccactttttccaggtgtttattgttttacagcagtacttttaaaagtcaaaaggggagattttggtcagttgttttaaaatttcaattgagaa

SEQ ID NO: 696348 - DNA, 90 bp, Homo sapiens
atttcccggggggttttttttcccattttttaatgtggttttaaaaagtgaaaaattaggctatgggtttttttaaaaaatggggcctta

SEQ ID NO: 696349 - DNA, 1282 bp, Homo sapiens
  misc_feature (1)..(1): n is a, c, g, or t
  misc_feature (543)..(543): n is a, c, g, or t
  misc_feature (642)..(642): n is a, c, g, or t
nagtcgtgggatgtgttatctctcacccaccccatctggtgtgaagtgcccctgggggaggatattctttcgggccccccctttctgggggggtacgctccccccacgaaggggatggggccctcctagggagaaacctttgtgtccggcccgttgttgagtaaaccactgtcgttggcccgccacacacctcatagcgaaaccccatggtgggggtgatttttttatcgaaccctgtttcgtcccgtcgtcgtgtagtaacctccttgtgcttagggccctcccttgtccccgcggagggtggtaaagaaaaatttgtctgtttccgtatgcaacaacccccccacggggggggttgtctcccctggtaaggggaacaactatcaagtggtggccccacccgcggaggggcccaccaatggtggaccctctctctcgtcgcgtgtgaaagatgctctctcgtgtgcaaagacatattctcggcgttgttatcttctcccccggcgggcttgtgattgtgccccaccaaacgggtagggctgntttctctgtcgcgatattgtgtggtgaggggcccacaactggtttttggggaggagccctcccctctctcacacacgagctgtgggagcgagagaggcnccctccacactgtgtatattatggccccgcatattgggggaagggttgtgtagaagtaagcgatctgtggtctgttcttgtgttctggtgcacctccacgcgcttcctataccacgggtcaagaaaacactcgggggcccgagtcttttcgcccctgggagagcctctggggggaagagaacaatcggagtgctcaaggatggacggccgcgtcacactcggcttttcgttttttgcgcttcggacatgcacttttgcacacacagctctttgagggcccacactcaccttgcacaccccacactgcccacggcccacggaacttccacgaatgcccctggcacacctcttatggggaccacacactgggagactcacttatggaaagaatggggtgagaggagacactgaggtaagaccctctgtattttgtgaattactctgtgttctatgtttgctgctgttataatttgctggaaaatgggggagccaatccccctgtgttcaccccggtgtcctctgtgcaccgttcccctcaattcaatgtggcctgtaacttaaccttttccaacaaaacaatccggcattacaagaatggattattccctaataaattaataaaaaggtattttttttacta

SEQ ID NO: 696350 - DNA, 173 bp, Homo sapiens
ggcctgcgggaagccaagatggcgcataggggttctccaggctgcaagttggcgccttatcagtatctaagcggagtgtttttgggaaggagttaaggggcctgttgcaaaccgcccttccgccgtcatggcccgccatcggaattgttcgagcctattacctaccattgagg

SEQ ID NO: 696351 - DNA, 866 bp, Homo sapiens
ttttttaaccccccagggggttattggggagtgagattataggccataaagaatgggattggttgggaccaaaataattgggaaaatcgtggttggaaaagaagctttggggaagtgatgagtcatttggcaccggggtaataggggaaagtggtgtgacctccagcaaacacatgaagggttgatttccgggagccggaagcactggggggtcgtggtaatccccagtgtttcggtgtcctagtttgaccctttctagacacggtcctttttggaaagtttcgggaatatatccactttctatggaaagccttgaaactaagaagattgtagactcttatcgtcatctgaagttcttcaggctattcttaacctcccaaagagcagtatctaagtcacatacatgatgtctggggcatttcctggagccatggagaacttctgaagggaagaatcggctgtttctcaagcaaatgggttcttgaggtcttggggttctcctgtgctgtcctgatgtttggaccccttttattgatcagagtgctctagaataatgatggtctggctgcatggatcacatagggacgggcaggtaaggggagccttctacacctggaggggatttccccccaagtcctgtccaggaatgccaacaacgggtgggcctcagaggggcagacagggtgttggggaggatttaaaggcctaaaataaggaggggaagacattacacggcggttctggacaaagcaacaggcgggtatagaggaggcaggtggagttggacagttgggggcctcaacaaatcgcacaggggagtggggcatacacaggcaatggtgaggagataaaagggtacacatata

SEQ ID NO: 696352 - DNA, 480 bp, Homo sapiens
gcatggggtctgtaccgtgagcgcgaggacaggcggcggcgagcgctctaagatgatcgacaagaacctgcggaggacggagagaaggcggcgtggacggtgaaagttgctgctgttgggcgctggggagtcaggaaagagcaccatcgtcaagcagatgaagatcatccacgaggatggctactccgaggagggatgccggcagtaccgggcggttgtctacagcaacaccatccagtccatcatggccattgtcaaagccatgggcaacctgcagatcgactttgccgacccctccagagcggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctactacctgaacgacct

SEQ ID NO: 696353 - DNA, 604 bp, Homo sapiens
cgggcgattctttctccgctcttggcgccatttactacaatgctgtcttgacctgttatccttccagtggagactccagttcggccgatgccgcgtttgtcttgctgctccggtgagagttgtctatggcatcggccgtggtccgagtggcactcaagggcccgtctaccagagtacatccagcgcgtaagtgattacttgccaaggagggactttcctctggtaatttcctgataatgaccagagaaagcttgctttgatcaaaaagaagcaacaagttgcctggtccggttacgctcgatgatctacgtgcgagtcatacagaaagatcgaggaatgccaaccattgacctagtatcggacttgtgtccaccaaggctaaagtctggacctcttgaagtctgcacttccagacttccaatagagaagtcatgttacaagtggaatttgactgtctaccttgggtccattccttctcgtctcataatcatttatctgtgtcctcaaagaagttgtctacattacccatcgcctcttattgcctctgagaaagagtatataagcttctgtacccaattcggcgttgggtaatagtgttcgggtg

SEQ ID NO: 696354 - DNA, 364 bp, Homo sapiens
  misc_feature (22)..(22): n is a, c, g, or t
  misc_feature (40)..(40): n is a, c, g, or t
  misc_feature (55)..(55): n is a, c, g, or t
  misc_feature (260)..(260): n is a, c, g, or t
  misc_feature (326)..(326): n is a, c, g, or t
  misc_feature (354)..(354): n is a, c, g, or t
gtttaattggctgatggttctncaggctacacaggaagcntggtgctggcatctnctcagcttctggggaggcctcgggaaactttaaatcacagcagaaagtgaagggggagctggcacttcacatggccggagcaagaggaagagagagagggggcaggtgccccacacctttaaacaaccagatctcatgatgacttaactcactcactgactatcatgagaacagtactaaagggggtaatgccattatgatcgantcacctctcaccaggccccacattcaacatttgggattacaatccagcatgaaatttgagcggggncacagatccaaaccaaatcactcccttnttcctagttt

SEQ ID NO: 696355 - DNA, 593 bp, Homo sapiens
ccccccttttctccccaataagggcccatcctcgttacagattcaaaaggtaggggacctctccccgccgttaaaaatttatcttaaaagctgtgtgtggcacaaacaattttaaacgccgattcttttaaaaacgaggtgataccccaaggcggcggttcaaaagccccgtttaatccccagcccaccggagaaaattattgctcctctcacttccaacgccgtttgttatcacgcctctatcttcacctccctgccgctaaattgccaacaccattcattttgcgagagtcgtgcagggagtagcgtacccctcttgtagggcagaataaaaactctttagaaattgcgggaaagcttcggaagaccccaactttccgcgagacggcgccactaaaccaatattagtaacataatatcgtgggtaaatctataagatgttaaaacctcactctttatggaggctaataatgcagatataatttgtaaccccccaacagattagggcggccccaaggcaaaatagcccccgttttgggcaccccccagagtcgaaggcccaaagccacaattaaaaaaacaattacaaaaca

SEQ ID NO: 696356 - DNA, 401 bp, Homo sapiens
ggcaagtaacatttggctccttgttacttatgcaaatttctgctgcaggcttgaatttctccttataaaatgggtttttcttttctgtcacattgtcagactgcaaattttcccaacttttatgctgtacttcccttttaaacataaggttcaattccaaaccatatctttgtgaatatataaaactgaatgcttttaacagcacccaagtcaccacttgaatgctttgctgcttagaaatttcttccactagatatgctaaatcatctctctcaaattcaaaggtccacaaatctctagggcagggacaaaatgccgccagtctctttgcatatcaagagtgaccttttgggcccccccaaagaaaaagggtttttttttccccccccccccccccccaa

SEQ ID NO: 696357 - DNA, 868 bp, Homo sapiens
aggtgtcgtgaaaactacccctaaaagccaaaatgggaacaggacacagactcatatcaacattgtcgtcattggacacgtacgattcgggcaagtccaccacgtactggtccatcctgatcctataacatgcgcgtggccatcgacacaacagaagccacttgacaaacacttcgacgcacagcgaggcctgcatgacgatgcggcaacagggactccatatcaacggtactgccctggcgatcttgcgcactcacaaccctgaacaagcatgcacgcagctgaacagctgggtaaatacaacaccaatctgactactcatcccttgctgcgcaaaaatcattgacgcacaccacgccacacgctcacctactgctagacctactcacattgacctgacccccaaggcaccaccagcacgcaccttctactcacatacacaccacttgcactctaccaaggggcaacactcatccagagccatgccacctgtatgccctgctcccctgcactaagcatatgccctggccttgagcctgaatcatggcctgcacacctatctggcacagcacacatggcaatacactccctccccacacgccacacctggtggcccacgcaccccaccgtatcaaagtccacttggccccccacatatccatggggcgcccatataaaccaacccacacccatggagccagacaatgtgattgaacaaacaatccaaaaacaccataaaaaccttcatggcgtaccggcgaccatggactatacacaaatctaaatataacactatggcgggccaccatactcccaccataacacctatggcaaattaacacccaaaacatccacaccctcttatatc

SEQ ID NO: 696358 - DNA, 436 bp, Homo sapiens
  misc_feature (75)..(75): n is a, c, g, or t
  misc_feature (287)..(287): n is a, c, g, or t
atttgaaatcatcctaactcatctatgtattttgcactagtgctttgctatgggcaggcacagtcttccctcatnttctgccaaacttatcatgcatgcaatggcagaatggtacatgagaggggagcagtatgatcaggccaaattgtctcgaatacttgatgtggcccaggacttgaaggccttgtcaatgctgctaaatggtactccatttgcctttgttattgaccttgctgcacttgcttcacgtcgtgaatacctcaaacttgataagtggctcacagatnaaattcgagagcatggggagccttttatccaggcgtgtatgacttttttaaagagacggtgtccttctattttgggcggacttgccccagaaaaagaccagcccaaaagtgctcaacttcctccagaaactttggcgacaatgttggcc

SEQ ID NO: 696359 - DNA, 108 bp, Homo sapiens
tctagaggtccacgagtcaacacacagaagaagattcatcaaaaggagtgtcgtgtgtgtggataacaccagctgttgtacacttgccataatcttcaatggattttt

SEQ ID NO: 696360 - DNA, 222 bp, Homo sapiens
gctgcacatctcctaagcaggtaccagcgggctgcctgtgcaacttgatgggaacctctcgtgtgaccaccctccgtgttcttgcctgcccatcttctccgcttttgggatggagctgatagccagggctgttgtatcgggtgcccttcaaggcaaaagaccaggctgcactggaagatggaaagccacaggacaggcaagcggcacctgtaggtgtgatct

SEQ ID NO: 696361 - DNA, 380 bp, Homo sapiens
  misc_feature (3)..(3): n is a, c, g, or t
  misc_feature (68)..(68): n is a, c, g, or t
  misc_feature (73)..(73): n is a, c, g, or t
  misc_feature (82)..(83): n is a, c, g, or t
  misc_feature (85)..(85): n is a, c, g, or t
  misc_feature (89)..(89): n is a, c, g, or t
  misc_feature (106)..(106): n is a, c, g, or t
  misc_feature (132)..(132): n is a, c, g, or t
  misc_feature (136)..(136): n is a, c, g, or t
  misc_feature (144)..(144): n is a, c, g, or t
  misc_feature (148)..(148): n is a, c, g, or t
  misc_feature (153)..(153): n is a, c, g, or t
  misc_feature (157)..(157): n is a, c, g, or t
  misc_feature (231)..(231): n is a, c, g, or t
  misc_feature (263)..(263): n is a, c, g, or t
aantttttcaccagaccccaagggaggaggggcagggaaaagagacgagactgtagagaggcagacgnggggncgcgggggnngngggngggagagggcacgttantttcctcctcttggtccctcttcagngggnttacaaantcangagcntggntgacaacactgagggggccaggtcagggtatgtggatgagaaatgacactggaaggaacatcaaagccccagcnacaaaaagaaagtaatcaagccccaaataganggggagcctcccagtgcacctcagaaatgggggcaacgatggggaaggagcagaatggagagcacacaaagggttaggggtctttaaaatttttttttgtaattttcttttattaaa

SEQ ID NO: 696362 - DNA, 374 bp, Homo sapiens
gagaactcggatcctgagtcggccgaggttttgatccactctggcttctaagtgtgggggcctcatgatgtgacccgaggacgaaaacctgaaggtgacttggagttattgtccgatttgcaccatgagaaaggccccagatggaatctggcacgtatcggcggttcacagtgtgtgtgtgtgtcttagcgcgtgacttacactgttgactgactcgcactctaccgtatatgaacagacttatcctgagctaaatatgagtgaccaatggccagtggcccagccctcatgagatccttgagaacctgtgcccagtgtggactgaatatatctggcattataccttttagggcatgagacatgtccatgactgt

SEQ ID NO: 696363 - DNA, 106 bp, Homo sapiens
  misc_feature (40)..(40): n is a, c, g, or t
tgagccggtaccattacgatttgttagtagagatggtaanaggggtactgttgagatgtgatttgcactttggctgttgtcggtcctttaaacttggcaacaaaaa

SEQ ID NO: 696364 - DNA, 143 bp, Homo sapiens
tgctcgactccaggtccagcaatcctccactcagcctcctgagtagctgggactacaggcgcctgccggtgtgcccagctcatttttttttacttttggtagagatgagttctcactatgttgctggccgtcgaactccataa

SEQ ID NO: 696365 - DNA, 248 bp, Homo sapiens
  misc_feature (114)..(114): n is a, c, g, or t
  misc_feature (146)..(146): n is a, c, g, or t
tgctgtgggaatatcctcgtagtatcacggtgctgtagaggagagaacacatgatttgcccgcctgagaacacgtcagcgtcactagtatttcttgcaatcctgcgcactggtncgacaggtggtacagggtttactctcagaaanctaccttgaaagccatcggattgtgaagatgaaccagagtgaggatgatgagtctggggctggagagctcaccagggaggagctgaggcaccttgcagagga

SEQ ID NO: 696366 - DNA, 183 bp, Homo sapiens
agctgtgtggaagcagtgtggaccactgagggctgagtgtgtgtgtgtgtgtgtgatatgtcttcttgtgtgtgcaagcatgtgtggaacgagtgagggctgtgtgtgtgtgtgtgtgtgtccatattcatgctgtgtgcaaacagagtggaacacagcgggctctatgtacctgagagatca

SEQ ID NO: 696367 - DNA, 390 bp, Homo sapiens
  misc_feature (266)..(266): n is a, c, g, or t
  misc_feature (324)..(324): n is a, c, g, or t
ctcggctctacctgtcgggttgtgagtacaacgttcctaggcaggtcccagcacactcataataagtgtgatacaagagggttttagtcatgatgttccccgaccacgtagtggtgggtgcagtggaggcatccctcccagggttctccttttaacatggataaggggagtagcaagaacaaagtgatgagtagcatgttcatacctcagcatggacagaagaaggctttttccgtggggggcagaaggcttaagcaaaagtgacnagcttaaatagcaaaagtaaattaaattatgaccaaggtgaaaatttacgtgggaccntccagaattttctaaacccaacattttactttccccttgaatgattgacttcaaaggctttcgggc

SEQ ID NO: 696368 - DNA, 675 bp, Homo sapiens
  misc_feature (205)..(205): n is a, c, g, or t
  misc_feature (288)..(288): n is a, c, g, or t
  misc_feature (301)..(301): n is a, c, g, or t
  misc_feature (303)..(304): n is a, c, g, or t
  misc_feature (310)..(310): n is a, c, g, or t
  misc_feature (313)..(314): n is a, c, g, or t
  misc_feature (316)..(316): n is a, c, g, or t
  misc_feature (319)..(319): n is a, c, g, or t
  misc_feature (341)..(341): n is a, c, g, or t
  misc_feature (347)..(347): n is a, c, g, or t
  misc_feature (361)..(361): n is a, c, g, or t
  misc_feature (369)..(369): n is a, c, g, or t
  misc_feature (379)..(380): n is a, c, g, or t
  misc_feature (387)..(387): n is a, c, g, or t
  misc_feature (392)..(395): n is a, c, g, or t
  misc_feature (405)..(406): n is a, c, g, or t
  misc_feature (410)..(410): n is a, c, g, or t
  misc_feature (423)..(424): n is a, c, g, or t
  misc_feature (444)..(444): n is a, c, g, or t
  misc_feature (461)..(461): n is a, c, g, or t
  misc_feature (482)..(482): n is a, c, g, or t
  misc_feature (492)..(492): n is a, c, g, or t
  misc_feature (498)..(498): n is a, c, g, or t
  misc_feature (504)..(504): n is a, c, g, or t
  misc_feature (511)..(511): n is a, c, g, or t
  misc_feature (515)..(515): n is a, c, g, or t
  misc_feature (518)..(518): n is a, c, g, or t
  misc_feature (521)..(521): n is a, c, g, or t
  misc_feature (528)..(528): n is a, c, g, or t
  misc_feature (537)..(538): n is a, c, g, or t
  misc_feature (549)..(549): n is a, c, g, or t
  misc_feature (551)..(551): n is a, c, g, or t
  misc_feature (564)..(564): n is a, c, g, or t
  misc_feature (570)..(570): n is a, c, g, or t
  misc_feature (576)..(577): n is a, c, g, or t
  misc_feature (585)..(586): n is a, c, g, or t
  misc_feature (591)..(591): n is a, c, g, or t
  misc_feature (595)..(595): n is a, c, g, or t
  misc_feature (606)..(606): n is a, c, g, or t
  misc_feature (612)..(612): n is a, c, g, or t
agtttctttttgtgataaggttgagaggttaaagagccacttatttagtaatgttgatagtagaattatgccgagataggtaacagatgaggatgaaatttgggcttgactgaagtaatgggggctgtctgtgaagccttgcggcagtacagcccaggtaatttgctgagcctaatgggtgtcagggtcagtctaagtgaaggcnaagagaggctgggatgaagggtgcaaaggaatagtaaagaaagcatgtttgagatccagcacagaataatgggtagtagaggnaggtattgagganannagagtntanngnttnggcaccacagggtggataggcnaaacantttggttgataagntgcagatnctgaactaanntgtaagncttgnnnngttttaggannggtnaaatgggggaatnntaaggagagtttataggtgnccatgctgtagcaggcnagtgataacaggctttaatcnttttaaagcntgctgngggatnggatatnggcnttnagnggggtangggtgattnngttttaatgananggtaaggggtgcntgatcngtcacnnaggagggnngtagnggtntcttatacttntgggtnaaggtggggtaatacagaggagcacgcaaaggaggctttggattgggaagaggcagccatggg

SEQ ID NO: 696369 - DNA, 173 bp, Homo sapiens
atctcggattactcaggtacggctgaagtgtgagagatcgagatactccgtccatgcctggcactgtagcatcagactccatctcaaaatagataaaactatcaactgcagggcaaatttccatccaatatggctattccagtctaagacttgagagagtataattcctctag

SEQ ID NO: 696370 - DNA, 128 bp, Homo sapiens
  misc_feature (76)..(76): n is a, c, g, or t
gtatctgtctgctctggtgcgagtgtataacacaggagaaacagattaggctttgtccaacgtttgcgacgtattnctgaatctgtatggaagccccagagagtacacgggattcccagacccctatg

SEQ ID NO: 696371 - DNA, 220 bp, Homo sapiens
tgtgtacgacgtaagtatgcgtacgttgtacttttacatgacaatagtggctccaagccaagcacaagcttacatgggtgatcacctaatgtgcctcacgtggcgtggttacataatgtgcagagttgtgtagcctgttgtctccaaactcacttgagtcatgctgtgacctggatgctctgcttcggccatattttttgagagcagcacatccattttc

SEQ ID NO: 696372 - DNA, 176 bp, Homo sapiens
taaagatctgcgtgcagagtccgatattgcaaacagcttacatctgttagcatgtactgaaggatgtgaatgagtattatctagttaatcaataagtgtgaaatcaaaaaacaagagcaggctgcacgcaatggctcacgcctgtaatcccagacactgtgcacgagccgagagga

SEQ ID NO: 696373 - DNA, 270 bp, Homo sapiens
tttcatggccttggttgggaaataaatatctgaaacaccgggagcttaaaataaaaagtagtagggagattttccacttccgtcctgtatacctttgagctcttaaatatttaaaaaaaaaaaaaaagtttccctgggatacaactaattagctactaaaagtaaagtctcaaattgttaatttgaaaatagataactttttttggatggctgtaataacaggaaaaaaagagtattttgacctcatgttaaaaggctctgtatagcttc

SEQ ID NO: 696374 - DNA, 231 bp, Homo sapiens
agatcaccggcaggataatgacgtgtatccaccattatcattttatactgaatagtattactgtcctaaaaatcctctctactgcacctgttcatctcctccctcaacccctgggaatcactgatctttttattatcgctatagttttgttttttttttttgggaatgtcacatcatatacagtatgtcaacattgagatgggcttctttcacttaatttgcttctactgt

SEQ ID NO: 696375 - DNA, 843 bp, Homo sapiens
ctggtccagttctgatggcaaagatgatccaattgatgtatctaaagacagtatatctagtgaagatcttacagaatcttttaaaagatggcattcagttcagagagtccttaccggaggtgaaagacctgctacaagcggttcatcttggcagcttccagacccatatttaattatcgtatgattagaaagcaatttataaatattatgtccagggaacaacattgcatttttctaaaataggccgttgttctataaatatgtttaacttgtgatcttttacagctttattggccttatactttatgtcacttacgctctacgtgattaccatgtatgaccgaaataagaagctttattagtgttagacatcttatttcattactttttcacatggtattcgagtcacaagacttcgttccgtgatacgttctataataacatcggtcttattgttattaattatctaaatatgcataacctaatattattcagcttcgcccctggtcacaatcttactcgattgtgtcgtcctcttgcattataatatatatcaaaattacccgtcccgacatcaagaagagtgaaatcaagaatatcatattatatcgttctccaaactaattgatgatgtaataccacgagataagtataaggtgtttagcgagctttaatcttatcaatttagttcacttcatgtgaaactggcaatgcacatatcattattacataaacatgaataataaaatgtagaaaatggatgataagataatagcagcgttcatgaaacaagtaccaaattaacaatgacccctagtctttttatatagtactactcagact

SEQ ID NO: 696376 - DNA, 456 bp, Homo sapiens
ttttaaattcaggtcgtggcaaacaaaaagccaacaattcatctgatctgtaagactgtagcaatacagaccatcatattcatatcacagatgacacaaaggataacatgatgacagcaatgaatacaacttactgataaataatacctatcatattagtactggaaaataacacaagaaagagaataaaaaagcatagtgatcattaagcaagcggaaacacaacgcacacacaaaagaacaacataacagacaaacgcccggcagcaccgacgaccaaagagagaaaaacaacacagcaacacacacatactcccatgacaaacatcacacaacggcaccagaacagacaaacaaaaaaagcaaaagaaaactcaaaaacaaaagaacacactcagagagacaaatacacgaaaaaacaaataaaaagaaaaacaagcgactgaagacaaaatg

SEQ ID NO: 696377 - DNA, 192 bp, Homo sapiens
ggtaaggccgcaggtcgactcttgtagagatccccaagcaggtaatacatgactcacaacgagccagaaagcattcatcaaagatgatgaatgtactcaagactgaacttcaattaatagctgaagcataaggcagtgccctagactctgtatgttggctctgtagtagcatgatgtgaggtgaaattctca

SEQ ID NO: 696378 - DNA, 418 bp, Homo sapiens
gttttggtttgttggttggtcccgccaaaatctccccggggcaccctccccaaaggttttttcttttcttagggggctctgggaaagggaaagggggaggatgcacccggggggtttttttttaaaccccccggtttttcccaggagcgggaaaattaatggcccctttttttggtagccaaaattaaagggggccttgggggccccccccttttttacctttcaaccccccgaaacccaaaaagccaaacgggttcccctttaagggaatggtttatattttttaaataaaaaggcgggtggggggggtgaaaactaaggggttttccaaggatctttctttcccaaccctttttgggccggccccggggggatttttttttttaaaaaaaagccccaggccttttggggttgttta

SEQ ID NO: 696379 - DNA, 322 bp, Homo sapiens
  misc_feature (16)..(16): n is a, c, g, or t
tagctgcgtcctctanagcggcgcaccaaacactagcatagttctagtaaacacagcctaatacagggaaggaacaaaacaaaagaggactgaagaaacacgttcgacgacacgtatgtccggaactaccaaaagaatccctagatctctaccagcacaaaggagcaccacacatggcggccaccactagcatcgacacagacagaggtcagttgaatagcaataaaccccgtactaccactacactgacggcttctgatcgatcaaaacccagcaaaagcacgcacaggccggaaagggcacgcacgccgccagcgcggcc

SEQ ID NO: 696380 - DNA, 240 bp, Homo sapiens
gctccgcagcccttgccaccttccctgcaccttgccctgcccggcctcatgtaccgcgcgctgtaccgttccgctcggcgagccatacgcgctggcgttcgcccgggcgagaccttcctggtgctagagcgacgatgcgcgcactggtggctggccgcgcgggcgcagtggtgagacgggctacgtgccgccagcctacctgcgccgcctgcaggtctaactgctgtcccctgccccccc

SEQ ID NO: 696381 - DNA, 137 bp, Homo sapiens
aattctctcacctctaacatcagaccatccaattccagtggaccagtcttccccatttacaggtcttctctccacctcttcacggaaagtgcctccacaaccagaggtggataagaggaaaggttggacttgaaggg

SEQ ID NO: 696382 - DNA, 482 bp, Homo sapiens
  misc_feature (12)..(12): n is a, c, g, or t
  misc_feature (27)..(27): n is a, c, g, or t
  misc_feature (39)..(39): n is a, c, g, or t
  misc_feature (66)..(66): n is a, c, g, or t
  misc_feature (439)..(439): n is a, c, g, or t
  misc_feature (441)..(441): n is a, c, g, or t
aaatgccgaagntgttgttaccccccncccatttggacncccctcctgagaccgtaccccagcaantagaaatatacctaaagaaatcattttataccaaaaattgtgattgccccccagaggtaagaggaaaagaatataaaaataatgaataccccaacagcctatcctctttggcctcctagatccttttggaaatccatcattcctcagcaaagtaacacaagaagggaaaaccccaacaccgcatgttcctcactcataagtgggagtcgaacaacgagaacacatggacacaggaaggggaacatcacacactggggcctgtcagggggtggggggctaggggagggatagcattaggagaaatacctgacgtaaatgatgagttaatgggtgtagcaaaccaacatggcacatgtatacctatgtaacaaantnctcgttgtgcacatgtaccccagaacttacagtataattaa

SEQ ID NO: 696383 - DNA, 1249 bp, Homo sapiens
tatgatgatagccctgtcttcacaggttcattgagatcctcgttttttccgtgctatactttttgtcactttagtttatagtgtgtcttgcccatagtcgctgtggtcaaccccttagttcctcgataatattgctatcttttgctcctatgagggtcactctaccctgatcgttgtaggattatcctgttcttaagcggtaaaattggggatattgtttttggccggttataatggtagtatatttgtgagtgtcgtctgtctcttatacacactatgtggggaaatcggactcgttcaacatgtgaaaatgggcacaaattttgttacatattggctttccagagggccttttcaagctggtaagggccaggcagtgagatgtgagtcccgtttatcttacttcaaagtatcgcactggcaagaactgttttcgacatgggctataacagtttgatgggctgcttcctgggaaaggcaccttactgatccagggacagactgcagtaggaggagatttaactagataatctcatacaatgtcttcacaaggtctggacactgtacgctcacaagccatgttaatccttagcacttgttggggaaggccaagcgcacggacgatcgcttcgagtccaggagtgtctaaaccagccttgggccaagatgggatgacctcatttcttagaccaaaaaggttaaatacaaaatacgtggagcattagttggttgcatcgcctagtaggtctctagctactttggaatggtctgtaggtcaggatggaccacttgtagcccaggaaggctaaggctgcatgtgagccatgattgtgtcacctgtactccagtgtaacgcatgaagagtgagaccctgtctcttacacaaatagaaagtcctccaactttaaattcaacattaagtcagacacagtgaagctttcgatgggttctgtgggcagaaatgaggcaacaagagtagcaaagcacaagagtcatacaaagatccacatagggggccaggcgccgtggctcacatctgtaatcccagcacttagggaggccgaggcggcggatcacgaggtcaggagattgagaccatcctggctaacaaagtgaaacaccgtctctactaaaaatacaagaaattagccgggcatggcttcgcgggctgcctgtagtcccagctactcgagaggctgaggcagaagaatggcgtgaacccaggatacggaccgggcagtgagctgag

SEQ ID NO: 696384 - DNA, 330 bp, Homo sapiens
gggggggggggggtttttaggggtttttaagggttttttttttcccccgggggggggggccccccccctttggggttcccggggagggggaatttaaattttttttgaaattggccccccccccccccccccaaggggggggtccctttttttggttttggaaggggactgttttttttttgccccccgggttttggaattgggtttggtttttttttttccaagggtttttttttttaaaaaattttcccccctttttggggccctttttttggaaggggaaaaaatttttggggggccgggggaaaaaaggggtttttttccccttta

SEQ ID NO: 696385 - DNA, 223 bp, Homo sapiens
gtagttcttctaagatctgccggagatagtacagatcaacactaggactaactcagcatgtcaggcatgtgaaataacagtggagctctagtgttgacagtgttatacattgtaggttgtaaaccatcatctggactgccaacgcagccgcatgtctgctgtcatatatgagagaactgaaactgcatcttgaaaggcagatgccagacagtcgaagtgcaca

SEQ ID NO: 696386 - DNA, 467 bp, Homo sapiens
aggcccttttaccccgatcactcagcttaaatggtcggccagctctaggaagagtcctggtgcttccaaacatcttccacttatggatgatggaggccactgtgctcattggaactttcagagcagcagaaatgtttctgtaaccttccgcagccttgtgcctcgagacaatcttgtcttggaggtctacagacaattcctttgtcttcatgcttggtttgtactttaacagccactgtcaaccctgggaccttatattgacaggtgtatgcctcttcaaaaaatgtccagtcaactgaatttaccacaggtgaactccaatgaagctgctgaaacatctcaagaatgatcagtggaaccatactgtacctgagctcaatttagagcttcacggcaaaggccatgaatacttctgtacttgtgatttttcagcttttttatttgtaataaatttgcaccaatttcca

SEQ ID NO: 696387 - DNA, 431 bp, Homo sapiens
gcaaaggtccccaagggtcacagggaggggacatacggttttgttaaaccccaaaaattaccccttcaggtcctaaagaagacatttttttttagagattttccttttgggggatttttaaaaaaaaatctgggggtaactggcccccattttttttttggggggggacccccaggaatgacccttttgggtttaagagggtgcggttcccagcttttcttgaaaggcccaggcccaattttgggcacaggggttctgtaaactgaaggtttgccaggggtttttagactcgcccattttaggggggcaaggggggcattttttttttcatgggggggcgggggttgatttgtttcaaaaattgggggtttttttgaaaaagggggcgggaaggcggcacccccccattaaaaaacattttaagcctttta

SEQ ID NO: 696388 - DNA, 106 bp, Homo sapiens
gcgctcggtcccgcacgcgcagtggtgggcgtctcgaaggcctgcccccgcggtggggcgcggggttttggcagcagtctcgaatgagccataagtgtccctcgtg

SEQ ID NO: 696389 - DNA, 295 bp, Homo sapiens
  misc_feature (73)..(73): n is a, c, g, or t
ttccttgggaaaaaaaatttttaaaaaaaatttaaaaggttttgctgaaataaaggatcctccattttaaatnccgggtttggaaggtgaaaagccctccctcaaaatccccggtttccaattccttgaaaaaatttttttttaaactaaaaaaggggggaaggaaaatttcctaaattgggaccccccgggtgctcctaaaatgggttccagtcatgtccccccggatgggatttttataaaataaagggaaaattggatattaaaggtccaaaaaaaatgttctttaagggga

SEQ ID NO: 696390 - DNA, 398 bp, Homo sapiens
taaagaatctggtagctgcttaattgggcaattaaacaatatatggctctattttgtaaaacaaactactggtaattatttttaatacctattttcattctgattactctttttttaagttaaagactatcagttcattaagattgagtttttatgatggttaaaaataattctctataggtttttcaatatatttttctgcgtgttctcaaattatatatttcccttcaattaaagattgcttagtgaaataaactggttcactatagaaaaagaattacgtcgcttaatacctaatatcataattggccaatatgaaaaaaaaaaaagtaaaaggagcccctaaaattatttacttggaacacccaaaatttaaatgcctaaatgggatatacgtg

SEQ ID NO: 696391 - DNA, 152 bp, Homo sapiens
cgctgatgatcttttatgaaccgtccgacggcctgcccgcgtaaccgcccagaaaagtgcgttaatgaaaatcacgacattccctcatctttcctgaacattgataccgaccgctatggcagtgcctggctggccttttcgagcgacccttg

SEQ ID NO: 696392 - DNA, 373 bp, Homo sapiens
  misc_feature (315)..(315): n is a, c, g, or t
ggaggggcggagggaagtaggcaggtgccagaaccacggtaaaggaagagttccatgagaatgcttacacagcagtggcaatcgagggctgcatccgcaagggcagatgacacagcacagtggttcccaacgctcacaagaagcaccctggtttcccgccttcctctgttcctattggcaccataatctctgtataatctgggccaaacgtgttacctctctgggtccacagatgagatactgtgccctgcctcgaaggctgcccgtgcgaagctcttgccatctttaaagcatgcaggctgcctggcacccggngctaaacaaaggccactgctctccttcaccgcgcagcccccaggcctacagaccccat

SEQ ID NO: 696393 - DNA, 411 bp, Homo sapiens
atttatacaaaattttcactaaggactgctcgacccaacagccgtgagtacattggtccaaccattaataaatagtcttaaataagaaaacaaacaggttgaaggaaagcaagctcatcgtcctgaacgagggattaaagggggggggtgttcaaaatacctttggatggaaataaataatctctttgctttgtaacacctaattactggtttaaatgtccaaatgatgctaaccaaaggctggtagggtcaaaaaactctcaccaagagggaccacacaaaaagccccagattttgccgcaaatgaaaacctaccataacaaaaaatactactccccagtgactaaaaagtgtaggctttatcccaaacttctaaataagaaaaacatcaagtaaacttaaaacacaccc

SEQ ID NO: 696394 - DNA, 240 bp, Homo sapiens
tgtttagagatcctaccatctgggtacctttgcttgaaccgtgcaaacaacatctagagtctattaagtggatcccatccagttggtttccacgggtgatccagttgggttgcacatagtgtggtcgtccacatcactcaatcttgacgagtgccaggagatagtctatcaatcatgccatagatttcatctggtttagtgactggtggaaccgaacctaggacatacagaaatacatat

SEQ ID NO: 696395 - DNA, 206 bp, Homo sapiens
acatgtgtgggtgccttttgtacatttacaaaagctttatttactctgttcacttatacctcattcataatgtatatcttcttaagattcgtggtaactggttttgctttgtttttagccttaacgttttgtcaggctggctatgcgaactccattcctggacttcggccctcctaatttctctcggaccaatgggggatcctcta

SEQ ID NO: 696396 - DNA, 942 bp, Homo sapiens
  misc_feature (106)..(106): n is a, c, g, or t
aaggtgtttcgcgacgcagaatattgttggtggcctgtctgttcggcgataaccccccggcgaggggcctcttgtagcgcgcgtcttattcccccggtgctctccnggtcgcccccgggtagtttcccagcagaaggttgttacgtgcacggcgcaaatcttgggggggtcgacaaaaacataagagcggttcacacatgtggccggccaagtggcgcccctcccagaaggaggcaaacgttggcagcgaatggaccttccccttcttttgggaaccacagttctgaacatggtttctctctgctgttcccaaatctccgcgcgtgttgcatatctggcgcttcttcttctcccccgctgttgcccgcgttcttggagcgggtcggttcgcccgaaagcccttctggttggagagactttggccccagggaaaaaccattcacacgggcggatattcctgcgagaaatttttaataccccttccgcacaccatagcaatacacgggggggaattggctctccaaaaaggggcacacacttcctgcgggtaaacccctcttcgtcaaaagatacttttttattcagggagccacgccaccaccacgtgttgtccaaaagtggcagagtacgtcaatacatcagtcgggggtcaattggcccatcgtccccaaaactctgcttaaatgcgccactcttctccccagcagaggtcattaccacccgggcaattccccacaccatagttaattggttccatcgagtgctctttcgcccaaaacaaatgtttttgtttctgtacaatgttcctgctataaactcttctaaaccacccctctcaaacccacttcttcgcacgcccaaatcggctcttcacaaaccaccacgcccaacgcggaacaattctgttccccaaaaaccaaaccaccttttccccacaaaaca

SEQ ID NO: 696397 - DNA, 967 bp, Homo sapiens
tgttttctcgtttttctgttgctgacttttattaatttttctccgggtacactgtttgcttctgtcgtttttggtggcaacttatcaatcaatttggttctctatacacacgtgtgtggttcctgtctcgttttcttttcgtgttgttcttcactactccttctggtggcttcgctttttttttgtccaaacacttggttcttttttctatatatgctactcatccttctctacttccctccttcctgtttgtgggtggatgaccaatgattgtgtgtttattagaattcctcctttttctcctcaattatatggcatgtttttcttatagggggggggctagacccaccacttttttttttttggaataataattcctttttctccacatacatctagccacctacatacagtggcgttgctttaatttagtatcgtctgctcgctcctcttcttttctctactctcctttgtttcgtctctatctcctcggtcagtttattcatagatcgcccctttcttttttaccaccctcagtggtgttttttatctccccactactgcctccacaaggtggttctcgcctcccacagttgttctgtttctttctttttttgtcttctttatgctctacccccacaacgttatggtgagcttgttcttgctcgctcgtcttctacaacaagggggctattctttgtttgtgtcgctccccacttgtccatctgcttctcttctagtcatcagtatgcttatctcactcgctctcgtgttgcgccccccttttttttttctcctctgttcgtgtctatcccattgtctcctccgtccccctcaaaggttttctggattaatttttttttccccatcacgggcccaaaggtgttttttcccccccccccccccccgcggggaaaaacacctggggggggggcccccctctttccaaaaaacccggggggcggga

SEQ ID NO: 696398 - DNA, 671 bp, Homo sapiens
tgcctggaaaaccgagttgcagtcctggaaaatcaaaataaaacttctaatagaagagttaagaatacgtttgcaaggatcgtttattccaataaaagtgtatgatgtcctaagacaagagaaatatttttgtggacatgccataagaatagttagatggatttccttagtggagttgtatagattacagaggtcgagaattgcaaggcttttgatttaggcttatccaaatcaacggataaatatcttacgcacgatatctagtgacagatggagaaagtggaaaatgatctcaaggaagctacgggcacaactggaagctttgtagaaattagagatattcaaggagcaagaacatgaacgttgtcagcaggtctacagatttgtctaaagtaaccaatagtggccaatctaaacatggcagagaagatgaactttgataaactgaattcgttgaaaaatccatttaccctacaggtttgcatttgtttgctgaaatttacctttttttagttatatatatgtgtgtgtgtgtgtgtaatttctgacgactaaattctaaattgacaaaggtaagagaaaacctagtacattactaaatatataaagtatatgtcttgattagtgtatacgttgttctagtgtgagtcttaataagtggggtattaaaa

SEQ ID NO: 696399 - DNA, 552 bp, Homo sapiens
  misc_feature (533)..(533): n is a, c, g, or t
tttttatcgatgacattgcctagatggcttccatcggcgtgcctgtgacatggatgcccacctggtgggatctaggtcccgcctccacgccagcgacttcagcgtcctgagtgcgctctatactgatgccctggtatttcatactgtcaccaacgtaccgccaggagattctcacgtgctctggatccgagacgcctcttgtcggaagcataagttgcggcagaaactggaacagatcatcctagccctcgtgtccagcgacagctaaggtggctggcgaatcggctgaggatgggggcttctcagtcctgtgccgtcctcccatccaggggagtggactggctcaagcctagggtccccgggctgagcctggattgggtatctgtgggacaggtcacctggccacagatgccccccggcacacccaggcccccttcattagtgccatttgctttgggcctctgcaggtcgacggggtgacagggcgagcccccaccccagcagcagcaatacccccaccctcctgacctgtntacaggctggtggacagtc

SEQ ID NO: 696400 - DNA, 318 bp, Homo sapiens
cgatagggcagaatcagtaccatgactgcatgtgccccgggaccccgtggccagtggggtgccctacacctgctgcatccggaatcatgcacagagatgttgtcaacaccatgtgtggttagagtactttcgacaaggaacgtctgagtgtgcaggatgtcatctacgtgcgggtgcgtgctgccacatgccgtgtgtcatcttggtgcagtggacaaatagcgccttcatggcgcggaatcctcctgggtcatctgagtccccagctgctgggaatgctgctgacgctgctgtacatcacccgggtggaggacatca

SEQ ID NO: 696401 - DNA, 732 bp, Homo sapiens
gagtctgatcaggcctcacccctcccctgggactttcccacccaggaaaggaggaccagtcaggatgaggcccggcctgttcccgcggcgcgtcccatgagactaggctcatgcccaggtatcctgggggaagaggagatgtgatcaggccccaacccgtgataatcaggcaaggaggaggagtcagatgagagccctgcgacttctcccaagaggaaccgaccagatgcacggtatttcacgaaggagacacggctgcgagaacggacatgagatcagtggcctgcccccttggggatcacagcctcacacccatgcccctgatgggactcatccttgccccaggtgagggaaggacacaggatgaggtctcgaccctgtacccctagggactgtcctagccaggtctcctggagaaagggacgatgtccaggatgatagctcgcatcacatttggtctatggaaaccaaccagttctaatccaggtccctgggccacgaagaaaccaaggacgtcaaagcgtaacataggagggatcccaggccgcataggagaggattttcaaacgcctcatggccccacattacaccgcaactggaagcccatagcaccatgactcatagaccccgcgggccaaaggaacacgagaaacgatgacgggaattgacgaccccaagaccgctatccccgccctgggacacacatactccaatggccagttctagagaact

SEQ ID NO: 696402 - DNA, 99 bp, Homo sapiens
aaggagaaataatcatagagtttaactattctggggtgatccagttctttgtgtattctatactctctgcaggcatgtttgtggtagttttctttcttc

SEQ ID NO: 696403 - DNA, 350 bp, Homo sapiens
  misc_feature (8)..(8): n is a, c, g, or t
  misc_feature (29)..(29): n is a, c, g, or t
  misc_feature (40)..(40): n is a, c, g, or t
  misc_feature (47)..(47): n is a, c, g, or t
  misc_feature (49)..(49): n is a, c, g, or t
  misc_feature (73)..(73): n is a, c, g, or t
  misc_feature (191)..(191): n is a, c, g, or t
  misc_feature (237)..(237): n is a, c, g, or t
ctcatttnttccctccctgccggcctctnttccttctttnataattntnttgaatacctccttcaagtttttnctcaaggctgagcgtggtggcttacgcctgtaatcccagcactttgggagtcggaggagggtgagtcacttcagattggaagttcgagaccagcctggccaacatggtgaaacccgtntctactaaaaatacaaaaattagctgggcgtggtggtgggcatctntagtcccagctacttgggaggctgaggcaggagaatcgcttgaacccgggagggagggttgcagttagctgaagatagtaccaagggcattttcagcctggggtgaccaaagt

SEQ ID NO: 696404 - DNA, 510 bp, Homo sapiens
  misc_feature (105)..(105): n is a, c, g, or t
gagtgagatgtattcactatcacgagaacagtatgggaaaaacctgcccccatgattcgattacctcctacgggtcctcccacgacacatggggattatgggaantacaattcaagatgaaattgggtggggacgcagccaaaccatatcgggtagcaacaacctagggtcagttttgcaggtggtaaagccatttaccaagatagttgtaggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttccttattgtgctacccacaggtaccgagctcggttcgatcatgtca

SEQ ID NO: 696405 - DNA, 967 bp, Homo sapiens
  misc_feature (105)..(105): n is a, c, g, or t
gagtgagatgtattcactatcacgagaacagtatgggaaaaacctgcccccatgattcgattacctcctacgggtcctcccacgacacatggggattatgggaantacaattcaagatgaaattgggtggggacgcagccaaaccatatcgggtagcaacaacctagggtcagttttgcaggtggtaaagccatttaccaagatagttgtaggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttccttattgttgcttacttatcaggtctccacataaaggtgtggaaacttcattcattcatatcttcaacacaaattgtaggtagcctgttttttaaaacatttattcaacaaatatttagtccaagccactattacttactaccttctctactattgtatggacttttaactatctctgacactattcactattcttccacattctctattatttatacctatggtaaaatttgccagtttgaccatacaactaatactcacagggaatatatagagtctagaagaaaatatacaggtccttaaaggctgccctgccaacaaaaccataatcgcaggaacaaacatcacaactatgccaaataatcaatcctacaaatgtccaaaattctactttaaaactggaattaccagacttcctttctgcattaaccagctttaactagacagtaacgaaatattcctactttatgctgtgatagatctatgttgtttgtttgttgtt

SEQ ID NO: 696406 - DNA, 321 bp, Homo sapiens
tgtgggtagcacaataaggaaggtcccaggttggggagagccccaagttgagaacaataatgaacaattattgtatgaacaattgttagagacagctaatcacaaacaacctgcgggcacaatgacctcattccacacgtagcacccttcagcaggaccctataaaactttcctccagcccttgcctctttgcaggtagccccttctctgctgaggctgcccactgcaacatattttcacaatttctctaataaatctgctcttcttatacctacaactatcttggtaaatggctttaccacctgcaaaactgaccctagg

SEQ ID NO: 696407 - DNA, 374 bp, Homo sapiens
aatcgagctcgtacctgtggtagacacctagggtcagttttgcaggtggtaaagccatttaccaagatagttgtaggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttccttattgtgctacccacaggtaccgagctcggttcgatcatgtca

SEQ ID NO: 696408 - DNA, 216 bp, Homo sapiens
acgtcccccatatgtacaacaaaaggagaaacaaaaccctcaaagtttatagataacactatgcaagactactcgaacatgagatttaaaaaagaaatcaatgaatgaggttttactatctttcctattgtacagggctaaaacatagtattaagctcacaaatcacttctaaaaaataaaaaaataatagaatcaaggaaaacaaattataatcc

SEQ ID NO: 696409 - DNA, 698 bp, Homo sapiens
  misc_feature (105)..(105): n is a, c, g, or t
gagtgagatgtattcactatcacgagaacagtatgggaaaaacctgcccccatgattcgattacctcctacgggtcctcccacgacacatggggattatgggaantacaattcaagatgaaattgggtggggacgcagccaaaccatatcgggtagcaacaacctagggtcagttttgcaggtggtaaagccatttaccaagatagttgtaggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttccttattgttgcttacttatcaggtctccacataaaggtgtggaaacttcattcattcatatcttcaacacaaattgtaggtagcctgttttttaaaacatttattcaacaaatatttagtccaagccactattacttactaccttctctactattgtatggacttttaactatctctgacactattcactattcttccacacgtcatacggggagtcctgctagagtcgaccg

SEQ ID NO: 696410 - DNA, 352 bp, Homo sapiens
ctcttcctgggcagtcgagctggcttcaccgccctcacatatgctgacgaggccctgggcagtgggctggtctagccgggctgttccccgacaacagaggtcatgctgtgatgctgccttagcgctggcggcctgagatttccagcatgagccccgtggcggtgcacagcactcatgtccttctgttgtatttccgtgaacattcggtggccgagagcctcaactacgtggcgtcctggaacatgagcaggctgcagacccggagacctcgtgaagtcggtccaggccacgactgagaacaaggaactgaaaaccgtcaccttctccaagctcttattgcccaggctggagt

SEQ ID NO: 696411 - DNA, 846 bp, Homo sapiens
  misc_feature (105)..(105): n is a, c, g, or t
gagtgagatgtattcactatcacgagaacagtatgggaaaaacctgcccccatgattcgattacctcctacgggtcctcccacgacacatggggattatgggaantacaattcaagatgaaattgggtggggacgcagccaaaccatatcgggtagcaacaacctagggtcagttttgcaggtggtaaagccatttaccaagatagttgtaggtaaagaagggcagatttattagagaaattgtgcgcaggttgtttgtgattagctgtctctaacaattgttcatacaataattgttcattattgttctcaacttggggctctccccaacctggggacccttccttattgttgcttacttatcaggtctccacataaaggtgtggaaacttcattcattcatatcttcaacacaaattgtaggtagcctgttttttaaaacatttattcaacaaatatttagtccaagccactattacttactaccttctctactattgtatggacttttaactatctctgacactattcactattcttccacattctctattatttatacctatggtaaaatttgccagtttgaccatacaactaatactcacagggaatatatagagtctagaagaaaatatacaggtccttaaaggctgccctgccaacaaaaccataatcgcaggaacaaacatcacaactatgccaaataatcaatcctacaaatgtccaaaattctactttaaaactggaattaccagacttcctttctgcattaaccagctttaactagacagtaacgaaatattcctactttatgctgtgatagatctatgttgtttgtttgttgtt

SEQ ID NO: 696412 - DNA, 397 bp, Homo sapiens
ctccatatggctattgtggggattagtagcatatctaaagtggcttataacagtgtgttacatacacggggtcaaatatagtgtgtagctattattaccattatcactgtgactatccttatactccaaaggttgcgacaaactgggagacacgataccggaaccattgagatggtgatcagagggcaactttttgagcgagttaaagaatgggatatagatatgcacaccaatggacttggttatattttaccccttaattaggtgaacttacctgccaattcatagagcatagaccattgcgtgggcaagaacagactggaatgagaggctctgtgaacaatccagagagaaagagccgtgccggaggttaattggctattcatttctctttccg

SEQ ID NO: 696413 - DNA, 625 bp, Homo sapiens
tgtgggtagcacaataaggaaggtcccaggttggggagagccccaagttgagaacaataatgaacaattattgtatgaacaattgttagagacagctaatcacaaacaacctggggacccttccttattgttgcttacttatcaggtctccacataaaggtgtggaaacttcattcattcatatcttcaacacaaattgtaggtagcctgttttttaaaacatttattcaacaaatatttagtccaagccactattacttactaccttctctactattgtatggacttttaactatctctgacactattcactattcttccacattctctattatttatacctatggtaaaatttgccagtttgaccatacaactaatactcacagggaatatatagagtctagaagaaaatatacaggtccttaaaggctgccctgccaacaaaaccataatcgcaggaacaaacatcacaactatgccaaataatcaatcctacaaatgtccaaaattctactttaaaactggaattaccagacttcctttctgcattaaccagctttaactagacagtaacgaaatattcctactttatgctgtgatagatctatgttgtttgtttgttgtt

SEQ ID NO: 696414 - DNA, 135 bp, Homo sapiens
cagttactgtgaatgttcccaccgctagatgctgctctgcactgactgctgccaggtgtggtttcctgcattgacagttgttttggagaacaacaaggacaactttatgtctgagaaaaggagggttatgggctc

SEQ ID NO: 696415 - DNA, 216 bp, Homo sapiens
tcctatttcacacggctactttattatttttgtagagtgagtctcactgttgcccaggctggtctcaaactctttgcctcaagcaatcctcccaccttggcctcttaaaatgctgggattataggcatgagccaccacacctggctatgatggttaattttatatgtcaacctgactgggtcatagggtaaccacatatttggtcttactctgggt

SEQ ID NO: 696416 - DNA, 317 bp, Homo sapiens
  misc_feature (3)..(3): n is a, c, g, or t
  misc_feature (13)..(13): n is a, c, g, or t
aanttcggcacgnggctttttttttttgagacagggtctcactctgttgcctggactggagtacattggcatgatcatggctcaccgcagccttgacctcccgggctcaagtgatccttccacctcagccctccaaatagctgggaccacaggcatgcatcatgatgctcacctaatttttaaattttttttgtagagacagcgtcttgctatgttgcccagggtggtctcgaactcctagggattcaaggcgatcctcctggccccagcctaacccaaagtggttaggaattatagggtgtggaggccaccacggt

SEQ ID NO: 696417 - DNA, 821 bp, Homo sapiens
  misc_feature (184)..(184): n is a, c, g, or t
  misc_feature (235)..(235): n is a, c, g, or t
  misc_feature (238)..(239): n is a, c, g, or t
  misc_feature (255)..(255): n is a, c, g, or t
  misc_feature (258)..(258): n is a, c, g, or t
  misc_feature (262)..(262): n is a, c, g, or t
  misc_feature (268)..(268): n is a, c, g, or t
  misc_feature (277)..(277): n is a, c, g, or t
  misc_feature (303)..(303): n is a, c, g, or t
  misc_feature (307)..(307): n is a, c, g, or t
  misc_feature (309)..(309): n is a, c, g, or t
  misc_feature (318)..(318): n is a, c, g, or t
  misc_feature (329)..(329): n is a, c, g, or t
  misc_feature (331)..(331): n is a, c, g, or t
  misc_feature (333)..(333): n is a, c, g, or t
  misc_feature (339)..(341): n is a, c, g, or t
  misc_feature (356)..(356): n is a, c, g, or t
  misc_feature (362)..(362): n is a, c, g, or t
  misc_feature (365)..(366): n is a, c, g, or t
  misc_feature (382)..(382): n is a, c, g, or t
  misc_feature (384)..(385): n is a, c, g, or t
  misc_feature (412)..(412): n is a, c, g, or t
  misc_feature (422)..(422): n is a, c, g, or t
  misc_feature (424)..(424): n is a, c, g, or t
  misc_feature (434)..(434): n is a, c, g, or t
  misc_feature (641)..(641): n is a, c, g, or t
aacaaaggatatcgtcaatgggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttcngcaccccaccctcgtcccttccctcccctacaggtcacataacagctgcancanngaccgcacagcgccanccncccngagaanaaagccganagccacccccccccggccccgagccngccncngccacaccncgctctcagtncncnccacannnccaaagagaccgtgnggtttnagnncacccgggccccccgncnncctccctgtccccccatttataggcanaaaatccacngnctgccagccnccctcccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactcncccgtcccacggaggccgcggggtgggggctggggggggtcccgccgaccgttccgctcttccggccaggtgcttttctgtcaatttctatggaatgcaaaaggaggtttttgttttattttgtttttttgtaaagcttaagaaaaaaatctacatcttatacttgagcctccatcctta

SEQ ID NO: 696418 - DNA, 341 bp, Homo sapiens
ccgccccagtagttgctaacgcttttactttgctgaacttcatgttattcctccttcccatcgtcttctgatgttcgtaattgaatttgttctgcctgcgtttcttccggctcccgctgatagaacttgttcaattgttcctcggcaatttgctggcttggtaatggatcggtggctaatttgacgcggccgttttcactcgtggctaagtaatactctttttctgactggcctaattcttgggcctctaagacatgcaaattatgttcgtaacggcctaagggttatcaacttctaagccatagaagcctaagaagccttccaggagactctcaccaaaa

SEQ ID NO: 696419 - DNA, 207 bp, Homo sapiens
  misc_feature (2)..(2): n is a, c, g, or t
  misc_feature (122)..(122): n is a, c, g, or t
  misc_feature (129)..(129): n is a, c, g, or t
  misc_feature (153)..(153): n is a, c, g, or t
  misc_feature (163)..(163): n is a, c, g, or t
tngctttgggacggcggaagggtaggacatgggcataggtagcggaagggtacagccaatgccgaatgccagagaaggtcacatggatgaggagaatgaggattttgcgcccggctgctcangcagatnaccgtgaatctaacgaagatcgantcgccacatngtatcacaacgcctgtaccctgaacggtgacaggggacatgtgt

SEQ ID NO: 696420 - DNA, 825 bp, Homo sapiens
aatgtgacccgcgtagggcagatgcgcctgactagtcccttgatcgtgccctcacctgcggcccacctgacagagctatcgatagctagccctttatctacagatagaatgagaagaagcctacatggacatgtcctgtgtgtgacaagaaggctccctatgaatctcttatcattgatggtttatgcgagattcttagtccctgttcagattgtgagatccagtatcaatggaagataggatcctggtgcccaatgaaacccaagaaggagcgcatctagacggtaagacacaccgaccagggataataggagctggatggccaccagatacagaccaaaaccacagggggcagatccaaacaggagcaataagaacgaaggcacagaagtgacacggactagaccacctagacaaagcgactaccatcagcatcgcaggagcgatctagaacacacaaaccacacaacagcacaagaaacagaacacccaccagacctggcccataccccggtaacagaagacatgagaaacgcaaaagcgaagatccaaggcagaactcctggaccaaccaagaccaaacacctcgagaggcgcacaagagagcaccagtggcgcatggcgcaaccagtatgggataggaagcaacaaccctggatcaacagaataacaacgaaaaaacacgtgaacgataacccaacgagaggcggagaaacgaactagggaagaacagaaaaatcacgacgggaacatcaaaaatgaatagaacaaaagcaaatcgagaagaggaaaagatacacgacaacaatggacacccctcagaca

SEQ ID NO: 696421 - DNA, 853 bp, Homo sapiens
ggtttcatgaatgtattgatcaaaaccagctatactattaaataataacagaacaccctcttctaactagttacataatctttcctaaagacttcctccttgttttttcagtccacattcctgtaaatgtggcaggaataagaaaacccccagtttcccgctctcacctttgaggccccgacaaagacagaaagaaggagctatccaggagctgattctccttgcaaagttgtgctttgagaagatgcagtgtgcatttcagctacatcatgccggctgtgtaatatgtataaagactcaatctatccagagtattttatataatgtggatgagtcaggattgtaatgctgtggaagtttcatgggaacacattaatatgtagcacagtttaacaaagaagatgtcaggtgcacagccctttctgggttttttcttgtgttccctgtggttctgaccattaggctaaagagagaaaagagaagcccaactgatctcatgacagtccatcaagattgtggatgtgcgacaagattgagaaagttgacaagaatgtgtcctcaatctgtcaagggataagttataggtgacattcattgagattgtgagataaattctggaatctgtatgggaggtgatacaggactggccaaggtttggattatgttcttgtcactgtttgaacttcgcatgtgacaagtagagtctcggcatctttgaagggtcaggaggtaaggcgtcaaataaacattggaatggaggttttttaatgtggggtgcgattggatggctttgaacaaagatcttaaaccggtttggtaaagagatttgtacgggagaagacaaggctactta

SEQ ID NO: 696422 - DNA, 1236 bp, Homo sapiens
  misc_feature (77)..(77): n is a, c, g, or t
  misc_feature (79)..(79): n is a, c, g, or t
  misc_feature (124)..(124): n is a, c, g, or t
  misc_feature (127)..(127): n is a, c, g, or t
  misc_feature (154)..(155): n is a, c, g, or t
  misc_feature (166)..(166): n is a, c, g, or t
ggctcttccagaggcaagaccaaccaagatgagtgccctgggagctgtcattgccctcctgctctggggacagcttntngcagtggactcaggcaatgatgtcacggatatcgcagatgacggntgnccgaagccccccgagattgcacatggnntatgtggagcnctcggttcgctccagtgcttctagtagcgagtggctgaacagggagcaacttttcctccaatccatggacacatccgaccacacattcaccattccgcacacctgctcggaacatacacccaccatgtccccatcctctacagtacccggcgggcaccaccactcaaaccagttcattgaacaaataaagcatgcactacccaaggacaacatgactcaaaagctcacacaacgagccagcaccccgttgacaaccacatacacacgaactcccaccatgcctcccagcacatacaccaaccccaagcaaccattacataggcctggaacagccaacaaatcgggcgtcccacacagacacgaagcagaaacacacactgcctcgactctgcaaaacacccatcaactccagcatggcgagggtcagacgcacagtgcacaatcatcaccgccaacagcactccagcacgcacgcgacacgcacggagaccacggaacacacagcaccgacaccaacacacacacggacccaaccagcacaatcgccaatacaacccatcaacaacaaccaccaacacacacacacaccacacagccacacccccctcccgaccatacccagcgcgcccccagcacgcccccccaccccacgcgaacccacagcgagcgcgggcggcccccgcaagagcaagaaaccagcgcccaccacgcgagacacacaccgcaaccggcgagcagcgaaaagcgggagcgagacaaatgaccaaacaagaaaaaccgcaggcgacttaacaccagagagcgtacggcacacacaaacactgggacacgagagaccataagacgcaacaagaaacgacggcccgcaaccgagacccaacaaacgacacaggatcaaaggacaacaacaaaaagaggaaagacaaagacgaacgaaggaacaagcaggaccaacaagcggaagacaatgactacacacacggcaacagcacaagagacacaacagacggcgcatcaaccccgaacgacaagaacacagacgaaaccagacaaacggacgacgacaaaac

SEQ ID NO: 696423 - DNA, 302 bp, Homo sapiens
actaacttgtaggacagtatttttccatagcttcattaatgggtaaaggctataaaaaacagacaaattgttataaaaccctccgcaacgtgactgtactaggcaggtaattaggtttaaactggacattatattaacaataacaaggttggacaggcatggtgactcacgcttataattccagcacttaggccgaggcaaggtagatcacttaaagtcaggatgttcgagaccagcctggtcaacatggtgaaacccagtctctcccaaaaatactataattaaccaggtatggtgatggg

SEQ ID NO: 696424 - DNA, 995 bp, Homo sapiens
  misc_feature (77)..(77): n is a, c, g, or t
  misc_feature (79)..(79): n is a, c, g, or t
  misc_feature (124)..(124): n is a, c, g, or t
  misc_feature (127)..(127): n is a, c, g, or t
  misc_feature (154)..(155): n is a, c, g, or t
  misc_feature (166)..(166): n is a, c, g, or t
ggctcttccagaggcaagaccaaccaagatgagtgccctgggagctgtcattgccctcctgctctggggacagcttntngcagtggactcaggcaatgatgtcacggatatcgcagatgacggntgnccgaagccccccgagattgcacatggnntatgtggagcnctcggttgcgcattacccagttgtgatagaactacatacgaatcttggtgcacagaatacgagtaggatggagctgtacaccttgaatcgatgggaagcagtggataaataacggctgttggagataaaactttcctgaattgtgaatcgcatgtcactgtcggggactgcccatgcatatccggacacacacccgagtgcaagtcgggatccgtgggtaggacacctgggattgccgaagttggcgagcatttccctggcaaggctaggatggtttcccaatcatattctcacgcacaaggtgccaactgctgatcaatgaaccaatggctgttgagacacgggtaataaatctcttcctagaagccattctagaagaatgcaacggcagaaagacatgtgccctacgtgttaagactctatgtggggaagaaagcagcttgtaagagatagagaaggtgtgttctaaacccgtaattattctgcgaggtagatattgggctgcaatcaaactctaaagagaaggtgtctgtgaatgagagagtgatgcacattcgtgcttacctttcaaaggatttatcgcgagacagtcaggaccgtgtgggtcaatgtctctggctagggtgccggaaatggccaattgttacatttaactgaccattctgaagttatgtcatgcttggcatgtggttggaccaggaccaatggccttagggcctaatggaaggccggacagtccccgaaaagagaacaccagaagagagcctgaagggtgcgagccatcactgatgaaaaccctctctggctggctggcttacgtacaggaatc

SEQ ID NO: 696425 - DNA, 1245 bp, Homo sapiens
  misc_feature (264)..(264): n is a, c, g, or t
  misc_feature (365)..(365): n is a, c, g, or t
ggcgggattcaggatgccattgtgtaccgtggggagccgtggatgagaaggttagtgacccgctgctgtgcgtgaactgtttctcctgtgctggacccatgtagttcaacaacccagcagtaggccaataggactaagacgcttcacgctggaccatacatcgcaagggcctatggcattggatgggccaccttcatgtgacggtgacgaggtaatgactgagctacttgccatgttacatggatcagtgaacgatgatacaanacttcatatgtggaaaggccagtatgcgcggttgactgcaaaggcacatgcacgctcacataccaaaaatacctgtgtattgctatgggtgggcagaccantattgtgcgatatgttgcaagcctggggacccccctaggaagattttcgactggacgatatgctctcgcctttgtatttgcactagctctgtcagggcgtcccatattgcgcaggttctactccttcatgcaagatgctcccaagacattactgtcgcgcgaaacccctgcaagcagcttgcgtcaaactattcacaaatacggcgtttgacttggaccctttatactctacaagttatattcgccttttccattccatgaactgcctttccggggacgtgagcatagtccacatctcgacataggtctctaggagaatattcggaggcacgagcttgagcccatttcttgatttgagactcgcttactctaattctaactcgtgtgaattctatttattggcgctttctccagaggcaaagcggcaacttctcaaaaggggcgatttgaaagaccgccgcgatagagtctctccggagagcaagagacccggtaggccagacacgttatcccttggtggacaggaagcgcgtcgaagcagagaactcccccggtctgtcctttcgctccgaagagaggcctttgagagttccgggcccctcgcgtctaaatccagggggcgttgtatggttagacggattggaatatgggctaggccccattcacggtttctccaaataacgcccttttctttgttcgtttcccgccataaattcctcggtgggggtggcggtcactacggggtccaaatttgtggggggcggattcctttggggagggcctttttccccttcgccaaggcgccaattgtggtctatgttggcaccctttctcatttctccgttgggggtactccccggttttttgacactgagagccg

SEQ ID NO: 696426 - DNA, 122 bp, Homo sapiens
gagtcccagcccaagggtagctggaggcgcgcaggccggctccgctccggccccggacgatgcggcgcgcccagaatgccgtaagcctcgttggctgtggcggcgctcctcagcctccgttt

SEQ ID NO: 696427 - DNA, 218 bp, Homo sapiens
  misc_feature (164)..(164): n is a, c, g, or t
cgattatgctctagacggccaggcgtggtggcgtgtgcctgtagtccagctacttgggaggtgaggcaggagaatagcttgaacctgggaggtggaggctgcagtgagttgagactgcaccattgcactccagcctgggtgacaaagcaggactccgtctcaanaaaaaaaagaaaagattcatgattgctgctgctcccagaaaggtttgctgggat

SEQ ID NO: 696428 - DNA, 300 bp, Homo sapiens
tgttagtgctgcataaaagtgaggcgggggggaggaagggaaaataaatggcatctttccaagtactcatctaatttaatttgtcaaaagattgataggccatgaattacttctccatctcactaagtggttaaatgtgctgtgcaaccccccactggtctgtgtccccatgccaccgaatgtgagtgaccttgccctacaaccatggtgggaccaccttgtgcttgcagtcctggagtgggcttctagcatggaatgcacatcacccccacacactcttcccctgactctaccctgggt

SEQ ID NO: 696429 - DNA, 320 bp, Homo sapiens
  misc_feature (50)..(50): n is a, c, g, or t
  misc_feature (67)..(67): n is a, c, g, or t
caaggtcatgaccagcccctacagaaaggcccaatggtgaagaactgaangcttccggccaacagcncatgtgtatgacgttggaaacaaatcctccagtcccagtcaagtcttcagaggctgtagccctgagtgacagcttgactaaaacctcaggagagaccttgagtcagaaccactcagacaagctggtctccgattcctgaccctcagaaactgtggaagattacaaatgtttgttgtcttaagttactaagttttgtggcaatttgttatgtagcaatcgataactgagataaagaaaatagtcatggctaaaa

SEQ ID NO: 696430 - DNA, 131 bp, Homo sapiens
tacgcaggcgcgcctcaggaacgctggcggctgacgacgacttcgacacgacactgcttggacaccgggactgacggactgacaacactgttaccgacacacccaccacaccactactgtcacgcacgact

SEQ ID NO: 696431 - DNA, 425 bp, Homo sapiens
  misc_feature (34)..(34): n is a, c, g, or t
  misc_feature (42)..(42): n is a, c, g, or t
ccggggagaattaaaataattggcctgtatttanaagtaccnccataatccgaatataagtatatgcctatataagtgtccagcaaatcctttttttaattccttgttccatgctgtttttttccctttcctcccttcttcattagagtgttattgtatttttgtaccctgacaaacttgtattcattcttcaaaatgcatagtgtagaacacatggacacagggaggagaacatcacacacaaggcctgtcggggggtcgagggaaaggggagggagagcattaggacaaatacctaatgcatgcagggcttaaaacctaaatgacaggttgataggtgcaatgaaccaccatggcacatgtatacctatgtaacaagcctgcacgttcagcacatgtaacccaggacttgaagtaaaatttaa

SEQ ID NO: 696432 - DNA, 117 bp, Homo sapiens
cactcccaacagatcacacactctgattactgaccacaggactgatttgtgtgctactgctatttcttgggatatgcaactacatgagcttgaagtgagcttgcatatattttaaat

SEQ ID NO: 696433 - DNA, 564 bp, Homo sapiens
  misc_feature (117)..(117): n is a, c, g, or t
  misc_feature (294)..(294): n is a, c, g, or t
  misc_feature (296)..(296): n is a, c, g, or t
  misc_feature (307)..(307): n is a, c, g, or t
  misc_feature (309)..(309): n is a, c, g, or t
  misc_feature (323)..(323): n is a, c, g, or t
  misc_feature (332)..(332): n is a, c, g, or t
  misc_feature (335)..(335): n is a, c, g, or t
  misc_feature (337)..(337): n is a, c, g, or t
  misc_feature (341)..(341): n is a, c, g, or t
  misc_feature (351)..(351): n is a, c, g, or t
  misc_feature (359)..(359): n is a, c, g, or t
  misc_feature (363)..(363): n is a, c, g, or t
  misc_feature (365)..(365): n is a, c, g, or t
  misc_feature (367)..(369): n is a, c, g, or t
  misc_feature (374)..(374): n is a, c, g, or t
  misc_feature (378)..(378): n is a, c, g, or t
  misc_feature (384)..(384): n is a, c, g, or t
  misc_feature (387)..(387): n is a, c, g, or t
  misc_feature (390)..(390): n is a, c, g, or t
  misc_feature (394)..(394): n is a, c, g, or t
  misc_feature (398)..(399): n is a, c, g, or t
  misc_feature (405)..(405): n is a, c, g, or t
  misc_feature (414)..(414): n is a, c, g, or t
actgctctgtcaaaaggaaggttcttctctgttaggtgagtgcatacgtcataaaggagtttctgagaatgtttctgtctagtggttatgggaagatatttgctttttcaccgtagncctcagagcgctccaaatatccacttgcacatactacaaaaagagtgcttcaaagctgctctctgaaacggaatgttcaactctatgagttgaatgcaaacatcacaaagacgtttctgagaatgcttctgtctagatttgatatgaagatattcccgtttccaacgaaatcttcananctatccaaatntncacttgcagattcnacaaaaagngtntntcanaactgctctntcaaaagnaagntncnnntctgntagntgagtncanacntcanaaannagtttntgagaatgnttctgtctagtttttatttgaagatatttcctttctcaccatagacctgaaagctgtcctagtgttcacttccagatactacagaaagagtgtttcaaaactgctgtacgaaagggaatgttcaactctgtgacttgaatgcagacatca

SEQ ID NO: 696434 - DNA, 260 bp, Homo sapiens
ccggatacgagcactagtgctctggggtgggaagctatggcgtgaaacaagggactcagaggtaagaatggtcaggaaatgtgtgggcgtgtgtccaggcaacaactagatatgttgtcaggagttaattagagaggcagataatttggcaggaacagacagggttccagggttagaatatctaaacatttggtcagaaatagggagccaccaaaagttactgaatacaacaatggtcaatggtaatatatggggtgcca

SEQ ID NO: 696435 - DNA, 228 bp, Homo sapiens
ctgatatggtgtctcacggaaggattcctcctatacggaaccagaggtggcattggatagaatggaagcatccatccaggaggcaaaggttatgagcactagccatttaacacgaatgggcaccggccactttgggttatggtctagcagggagaatgagagaaaaaggatcttccaacgctgtcacataagcacccagctgcacacggcacaactcagccaggagcc

SEQ ID NO: 696436 - DNA, 636 bp, Homo sapiens
tgaaatcagacccacaacgggggagggggcggccacgtcaccttttctgtgagaacaggctacaagtacttactgcatcatatgtaacagaacaaattataaaaaccattgaactacccaaaggttttcaaggagtcggtccaagtagcaatgatgagacccttttatctgttgttgggagggctttccacacaagctttgcgccaataacagggcaagtctccgctgttctgaaaaagaaccctgctgtttaccttaacacatctaaacccctctgcaaagcttttattgtcacatatgaagacatcaggaaacaggaagagcgactacagtatgtacgcatgaaattgcaaaaagcactgatgccacacatcttgtcacgagctgctgattcagaatagatgtatattaaaatgcacagtggatattaaccctaagaatatgatcaggtaactttcaacgactttccccagagaaaattcctagaaattgaacaaaaatgtttccactggcttttgcctgaaaaaaaaaaatgtaccaaccacattagccttttaatagcactacccaaggcctttttaaataactttctaagtaaatacctataattcaaacattatgtttattttgaacccc

SEQ ID NO: 696437 - DNA, 463 bp, Homo sapiens
  misc_feature (15)..(15): n is a, c, g, or t
  misc_feature (32)..(32): n is a, c, g, or t
  misc_feature (45)..(45): n is a, c, g, or t
tctctgtaccccctnaaaaccctaagtacctntttcctcctcccnagggaaaaatcccgaaggtcctaaaacttgaccttttttgaggtccttcctcaaacttgacctacagttgtgcctcaataattgtccttgcctttcccagcttaattattttaaggaacaaatgaaaactctgggctgggtggagtggctcatacctgtaatcccagcactttgggaggctacggtgggcagatcatctgaggcccaggagttcgagacctgcctggccaacatggcaacaccccgtctctaataaaaatataaaaattagcctggcatggtagcatgcgcctatagtcccagctgctcaggaggctgaggcatgagaatcgcttgaacctaggaggtggaggttgcattcaactgagatcataccacttcattccagcctgggtgacagagcaagactcttactcaa

SEQ ID NO: 696438 - DNA, 480 bp, Homo sapiens
cagtccaacatccggggtttaacgccattctccggcctcagcctcctgagtagctgggactacaggcgtgtaccaccaggcccagctaatttttggcatttttagtagagatggggtttcgccacgtgggctgggctggtcttagaactcctgacctcaggtgatccgcccgcctcggcctcccaaagtgctgggattacaggcatgagccacggcacgtggcccctggaaagctttttaaaagaggactttaatggttactacttccattattaggaagcaatttctaaatatgaccaccatagatccaagaagggaggaataatatagtcaccaggctcaaattggagggtcttatttaagcacacagtgcttactttaaaatgaatctaattatttctagactctggccttttcatgcctgatagtatggccatggtccagggccttgtgatcgctgtcctagataacaggagtatc

SEQ ID NO: 696439 - DNA, 1006 bp, Homo sapiens
cgctctccggggctgagccggacgcgttgtcttgccccctccccccggttcgcggtccgcgtgtagttggcgccgtgcccggtgagagtgagcgtggtgtcgacggagggagatggccgggagcgccgggccagtaactgggagctgctgagagtcgccgagggcgcgccggggccagggtgccgggttgcccgtctgcccgctgcgccgcgtctttgctgcgccctgccgccttacgcgtgcggtctcccccctccccgagagaacactcacaggccgggcagtgatggtacctgtatgcgaggaaccagcagagacctcagtgatggctgtcaccgacccggagggggggacctcgccagccctttacccaggggggggtgattgttcacaggggcacttaaaggttttccattcgatagaaggtcaccccccaaggataggcggggagaaccaccaaggaccattgacaaagaatgccgaagaacgccccgagagaattcctttcacccaacaaaaattaaagagttgtttgcgggacgacatcctgataaggtccctggaaaagcaaattacgtgtttgacaaggcacaggtgtcacgaggtagagggggcaaaaaaatggttgcaatacctcacagagttaagacgagaagggggattgtgttggccgcccaggtatacttcttcgcagcagatgaaaaaatttcaagacaaacccgacaggtggctccttcaataaggtcaacaattcacagatttcttcgtaaattccaaaggcaaataaacacgaagggcaaaaactttcaagagtgagcctttatgagttcttgcagagatgaactggtcttgaggcatattaggcgtccttctgggacaccaggtctacttaccacttggcgcaccccggcagtttccccatgggggagaaccccacagcgtgggttttaaggagaacaggagcgaacaggagcgcaacagagatggtcggcacaagttcccacaa

SEQ ID NO: 696440 - DNA, 1008 bp, Homo sapiens
tgtgggttatctggcatccagtactcgttggttggtatataggggtctttatccggtgtgcgctgttgttttttcctctgttgtttccttttcacctgcgttctgtttctcgaaagttcgcttcaaatgagatacattggtgtcttggccatagctgtctctcatcgtccacgcgtgtttcgcctagctcgctttgtgttcttttcgctcaggcctgtgtattcttggtgggtcctctttgtccccttttggcggtgactctctggtggccttcatttataggacgcgactctatagccattttgttttgctatcctattgtcttggcagcgtttgtcttctccgcattgaatgcgcggttaaaatttctttgggcaattcacaaaacggcgctactcactttggattattgtactcaccatctgtgcctgagtatgtgtctccgttttttaagcctccccttgggtgcaaatctccgggacgcatgtcctccggccacacttttcgtctggcgcttcctgccatggcccgctttgtcgctactgtgtcctgcctggctcctcgattggctatggttctccggcgcgagacgttcctttcagacagtgcccgttcttgctcagcaatgaccttttgccgcggcctaatcatgcctggcacagctaccaccagttacaacgtatgccagcgccccaccttcgtttccacctctacaccaagcatgtaggccacgctcctctggtgattagtgtacacttgtggacgtcgacagaggagccttacaacacggcaggtattgctgccccaggcgggtcttatgaacatagtgcgctgcatcccaggaaacccgggaccatgcacccagcgctgggcagcggtggcaacaagtgatagaagagaggcagtgggaaaagcacgggtactatctacaaggcagccagccatgagcaccaggagacagaggacccagttgtaataaggcagctgggagaggatgggcagctccca

SEQ ID NO: 696441 - DNA, 1060 bp, Homo sapiens
cctgtagcagggcacggaaggctaagcaagggctgaactgctgcatgctcccgcctcgtgcgctcgacccacccggaccgccgcccgagcgctcgagaaagtcctctcgtgtagaatcagcgcctgttcccggggtgcagatccaggtttcaggtcctggactataagttcaccattggcatcaggcaatgctgcctgataagtatctctatgtggataacaaacttcatcaacaatcctgctggcccaggccgactgggctgccaagaagctggtatgggtgccttccagacaagagtggcttcgaggccagccagcctcaaggacgaggtgggcgacgaggccatcgtggagctggtggatgaatgggcagaaggtgaaggtgaacaatcgatgacatccagaagcatgcaacccgcccaagttctccaagagtggaggcacatggcagagctcacgtgcctcagcgaagcctcgcgtgctagcaccaaactacaaggagcgttactactcagaggctcatctacacctatacaggactgttcctgtgatgggtcatcaatccttacaagaacctgcccctctactctgcagagatcgtggcactgtacacgggcaagacaacggcccgagactgccccctcacatcatatgtccactcccagacaccgggccaacacggaggtcctgcttgccagaccctgtaatgaatccagccacacttagttgcacctggtgcactctggcagcgggccacgcagtagaacacctaaatcggtactacagagatcaggaggtaacgtggtgcactgcacaatacaacaaacacggcccacaaactcctctgacctcactcctacatcgaaccaccccaccacgaacacatacacaagcccacccagacccacaccaaacacacaacaccccacaacccccctctacccaaatcacgttcaaaccccctatacacaacagcaacatcacacttcgcgacaaccgccaccacacacccacatccaaacaacccacaacacccacaaaacacacaaagcgaccacaa

SEQ ID NO: 696442 - DNA, 228 bp, Homo sapiens
  misc_feature (1)..(1): n is a, c, g, or t
  misc_feature (89)..(89): n is a, c, g, or t
  misc_feature (106)..(106): n is a, c, g, or t
  misc_feature (123)..(123): n is a, c, g, or t
  misc_feature (168)..(168): n is a, c, g, or t
ngggtcttttccctcaatctagttgtgtctgagtcaggatctattcaaaataggtctcacatccaggaatatgtcttctgtagagcagncttacttgactatgctncagggaaaaagagcagnagcatctattaacatacatgtatgtgtgtgagagtgtgtgtaatnaaaaggggatcagagcccttcttgatataagtggagtacaataggcaactgtctccttaa

SEQ ID NO: 696443 - DNA, 252 bp, Homo sapiens
cggatcttagctctggtcaggagtcaagaccagcctgtccaacgtgtgaaaccctgtctgtactaaaaattaaaaaaaaaaaaaaaaattagcggggcgtggtggcagtcgccatgtagtcccagcaactccagaaggctgagaacagcgagaatcgctttgaaccccagaaggttggaggttgcagtagagctagagatggtgccactgcattaccagcctggggcagcacagagccgagactggctatct

SEQ ID NO: 696444 - DNA, 302 bp, Homo sapiens
  misc_feature (5)..(5): n is a, c, g, or t
tgaantgaccaatgacttgtcatgctgaaaggctgtgtggtgggaaccaatgatagcgggttgctcaccctccgcaagtccttgctggtgcatgacgaagcggcgggtctctggagtaagattgaccttaagtttcattgacaccacctccatagttttggccatggctcgcttcccagaccatggaggagaagaaagtcattcatgggactcactgaagaaagaccgaatgtgcaaaggaagaaggtagcttaatgccaggtaacagtatttgtgcagttggtggggtctcaataaaaagt

SEQ ID NO: 696445 - DNA, 228 bp, Homo sapiens
cctgaaagacaagcgagatttagcttggtaccgtgcggaagagagagacctgctccgtcttgcagaaatgcgagatttcttcatttatgggcttgaatgggacctgcttgttctttgagagggacgggatgtgtttgtccgctctgaagatgagccagatctgcctgttctttgaggggtgctagagagagagcttccacgtataactaagcttgtactgcgtgatct

SEQ ID NO: 696446 - DNA, 81 bp, Homo sapiens
  misc_feature (32)..(32): n is a, c, g, or t
ggtgtgcgggcgccagaggacccggcacatgntgcggcgacacttggtcactttgaagcagttactacagtcactgattac

SEQ ID NO: 696447 - DNA, 1047 bp, Homo sapiens
gtctacaggttgtttaataatcagtcacacaggagaactgcaggaactgcatgctgtatgtattgcttctatgcataccagcagcatggtctaagaaacttcgaaagtggaccatgtttgtggtaggtttaagcgcacattccagtataccagtaaagggcacatattaatcactgggttcatttggtacacatatcattcattccatatcagacccacgtgtcagtcagatcaagacacgtctatgggtaacagctggctttatgtgctggcctccaccactgtgtgttgcattttgggttgtcttctggttaaggcagcgagttgatgtcagactggcatttggcgagagagtggtggtacgcaggccaagctcaaagaaggtgggtaagttcgcaaaacaggtaaagggtttctttatataaagtggcagttattccaggttgttcaaagttgtcattaagaaacgtgggccatgggcccttttcaaaaaaagtaattcgtgggtaagaaggtaattagcgtgggtcaatctgggttggttggaggcgacagaaaggaaagcaagggtaacggttgtggccgttgagtaggcttgcgcaatttaccaataattgagtgttcaattggaaggctcagaaaaatatctgggtggcgtttgggtagaaagtgtataggtaccgtattactataatttgcgttttgggaaagacaatgggtatgacgagttaaatttaggccactggggtggggcggaataggacatggcgtattcttgggtaagaatggaaaggggggattatttggtagagaaccgtttggcgtgaggtggagtgaggtggcgaagcgagggcacttgaaatgcggtttcaagctcgtggacagcccgactgcacaaacacggcactggctggggcaacaacgtgggcttcggttacctcaacatacggcgaggacactcggggcacacctaacacaattggtgttgaccttcctggaaggaggggatacggcactacagccgttacgggtcacaatctagacccc

SEQ ID NO: 696448 - DNA, 496 bp, Homo sapiens
ccctcacgattacctcaagtgatccatctaccttggcctcccaaagtgctgggattacaggcatgagccactgtgcccagcctttttttttttgggtttcttttaatgaagcctgtaagtttcttgccatggcatctttcatttagcattatgttttcagggttcatccatgtttgtagtatgtatcagctactcatttttttttttttttttttggaaacggggtctcatttctgtggcccagggtgtgaatgtgcacgggcgcatatcatggctaccctttagcttaacctccggggcctcaacccaccctcccaccttcagttcccaagttagctggaattataggattgacccaccaatgcccacccagtttttgtgcttttggacagacaggttttcgcatgtcgcccaggctttgttaaaaccccggggctaaggggactcacctgcactgccccccaaagtttgggattacaggcattagcacccccaa

SEQ ID NO: 696449 - DNA, 388 bp, Homo sapiens
  misc_feature (17)..(17): n is a, c, g, or t
  misc_feature (129)..(129): n is a, c, g, or t
gccccctagtccttggnagaaggcagagcatccttatccttctgtacctatgtgacccctgagcccacgtcagacatccctctctgggcctccttaagaaaacaacccccaaggccgggcacctggtcncacgcctgtaatccccagcattttggaaggccaaggcgggcggatcgctggaggtcaggaattcgagaccagcctgaccgacatggtgaaaccctgtctctgctaaacatacaaaattagctgggtgtggtgcgaatgcctgtaatcctagctatttgggaggctgaggcaggagaatcgctcgaacctgggagatggaggttgcagtgagctgagatcatgccattgcactccagcctgggcgagaaactctgtctca

SEQ ID NO: 696450 - DNA, 290 bp, Homo sapiens
gtcttggacttctatgtagctgccagatgctgtctcctttgccttctccttggcttccttggctagtctcaacaagtgttttggaaggggctcgccattgaagcttagccaagatatattcaaaacccttcatagtcttggtcacgtatgctttatgaacctgggcaagaccataattccttggacatgctctggagcacaccacaataatgctagcaggagacccatggcttccctgttttggatttcatgtccagccacttgttagccagcccggaggaattccgcgg

SEQ ID NO: 696451 - DNA, 701 bp, Homo sapiens
aaagatcagagcctcctaagaaatatccagaagtcaagccatggatccacctgcacataaaaaaaaaaaaaaaaaaaaaaaaaaaaatgtgttggggggccttggggccccggaaaaagtttttaaaaaccatgcgtatgggggcggcgggggcaccacagatgaggctaagtggcaacatggggtcacaggcgcggtgtcccctgaggaagaatccgcgggccacctgaaccagagggctcgtgggaatttcccaccacagattaaaaaaaccgccgcgcggggtgaaaaaacgagcagcgagtctttcgtgaaacacaatatccgcaagagagaggggagttctccgagagagaggtcactatacaagcggggagtatatctctatcacacagagagggggagctcccaagaggcggcgagatcgctccaaaagatctatcaacaatatattataccgcgcgcccccgcgcgtccatgggggggggggcagacaaacaacgaggccaaaacgagaagaagcagcaaggaagacaacagccgaacgacgagacaaacacgaagaaaggacgaagcgaaagagcagcacgaagagaccagcagaagggaacgagcaagacaggaaagacaaccgatcagaaggacaacaaacaaaaaccaagcgaaggacagacaaaaagagacgagagaacgacagaagg

SEQ ID NO: 696452 - DNA, 448 bp, Homo sapiens
  misc_feature (25)..(25): n is a, c, g, or t
  misc_feature (97)..(97): n is a, c, g, or t
  misc_feature (192)..(192): n is a, c, g, or t
  misc_feature (194)..(194): n is a, c, g, or t
  misc_feature (196)..(197): n is a, c, g, or t
  misc_feature (205)..(206): n is a, c, g, or t
  misc_feature (210)..(212): n is a, c, g, or t
  misc_feature (214)..(214): n is a, c, g, or t
  misc_feature (220)..(222): n is a, c, g, or t
  misc_feature (224)..(224): n is a, c, g, or t
  misc_feature (226)..(228): n is a, c, g, or t
  misc_feature (232)..(234): n is a, c, g, or t
  misc_feature (236)..(236): n is a, c, g, or t
  misc_feature (240)..(241): n is a, c, g, or t
  misc_feature (243)..(243): n is a, c, g, or t
  misc_feature (245)..(250): n is a, c, g, or t
  misc_feature (252)..(252): n is a, c, g, or t
  misc_feature (259)..(259): n is a, c, g, or t
  misc_feature (261)..(262): n is a, c, g, or t
  misc_feature (268)..(268): n is a, c, g, or t
  misc_feature (271)..(273): n is a, c, g, or t
  misc_feature (277)..(277): n is a, c, g, or t
  misc_feature (280)..(280): n is a, c, g, or t
  misc_feature (283)..(283): n is a, c, g, or t
  misc_feature (286)..(289): n is a, c, g, or t
  misc_feature (292)..(295): n is a, c, g, or t
  misc_feature (302)..(302): n is a, c, g, or t
  misc_feature (313)..(313): n is a, c, g, or t
  misc_feature (318)..(319): n is a, c, g, or t
  misc_feature (321)..(324): n is a, c, g, or t
  misc_feature (329)..(330): n is a, c, g, or t
  misc_feature (333)..(335): n is a, c, g, or t
  misc_feature (337)..(338): n is a, c, g, or t
  misc_feature (397)..(398): n is a, c, g, or t
  misc_feature (400)..(400): n is a, c, g, or t
  misc_feature (426)..(426): n is a, c, g, or t
  misc_feature (428)..(428): n is a, c, g, or t
  misc_feature (433)..(433): n is a, c, g, or t
  misc_feature (436)..(438): n is a, c, g, or t
  misc_feature (442)..(442): n is a, c, g, or t
  misc_feature (446)..(446): n is a, c, g, or t
  misc_feature (448)..(448): n is a, c, g, or t
taaaatggtcagaagcacaacaaanaaggttaagaatttaaaagcatctaacattctgccctaatggcagcataattaatagcaacaaaaggccgtnttgctgcctgccgcagccggagggtatttttgcagacctgacgagcaaattttgtgaaaaatgtagtatgaaggaagaaagcttggcgggtctcnantnnagactttnnactnnnantctttnnnantnnnatannntncatnncntnnnnnnanacgtgantnntaaaangannntaanatntcntcnnnntannnnaaaaatnatataataatnaatcnntnnnnattcnnaannntnnatattttttccaataaagccaacaaattgcacaaaatctacactgcataaaaggtgggnncnaagaataccactggtgagactttttngnatagnagnnntaanaggntn

SEQ ID NO: 696453 - DNA, 230 bp, Homo sapiens
gcgtcgacgttcaaactccattcggagttcgactggatcaaacatacccaactgacccttgacgatctcaaaggcaaactgaatctgaaagcggacgaattgccggcctgggagacctggtcgtcaggggtcctggccgatgccaaggagcaactgaaaaaggacaacggcgaaggtgaaaaggacgccgccgccccgaaggcgctggttgaccagaccacgccggaaag

SEQ ID NO: 696454 - DNA, 120 bp, Homo sapiens
acatcatggtgtgtcgcactctcgatcttgggcattgccaggctcccacagttggcaatccgaatctgtcgatcaggtgcttgatctccttgtgccgatgctggcctgagcgctgtgact

SEQ ID NO: 696455 - DNA, 1118 bp, Homo sapiens
  misc_feature (160)..(160): n is a, c, g, or t
  misc_feature (228)..(228): n is a, c, g, or t
  misc_feature (244)..(244): n is a, c, g, or t
  misc_feature (258)..(258): n is a, c, g, or t
  misc_feature (993)..(993): n is a, c, g, or t
  misc_feature (1001)..(1001): n is a, c, g, or t
  misc_feature (1009)..(1009): n is a, c, g, or t
  misc_feature (1039)..(1039): n is a, c, g, or t
  misc_feature (1043)..(1043): n is a, c, g, or t
  misc_feature (1045)..(1045): n is a, c, g, or t
  misc_feature (1054)..(1054): n is a, c, g, or t
  misc_feature (1064)..(1064): n is a, c, g, or t
cttaagggggtgacagcccgtaggagggttgtctgggactacagcaccccggaaatcagctcttctctgaggagggcctcaagggggagcaagtgaagctaacagaggccttgaagaattcccagggtctggagaagcccctgcaggtggcatctgccancgtctctgcaggactatggctactgtaccccaaaccattattcgaagacactccctacatcctggaanctggagagtaccccanctcagaggcctggngcacatcggaccccagcgtgggctccctgaagcccatgagattgggctgcccaagtgtggagaagccaggggagcccagggctgtggtgtatgaggccccaggctttcagggccgcagctgggaagtgagccgagacatctacaaccttcagcagccagaggacagccagagcccccacctggcctctgtggggtccctgagagttctcggaggctgctgggtgggctacgagaaggagggcttccggggccaccagtatctgctggaggagggggaatacccagactggtcacactggggaggctatgacgagttgctgacctccctccgggtcatccggacggacttcggggacccggccgtcgtgctatttgaggccatggacttcgaggggcacggcgtggaggtgagcaaggcattgccggatgtggagctggtgcaacacggccccaacacacaggccatccacgtgctcagcggcgtgtcggggagcacgatctgcacttcgtctcaaagattcagcttttctcccgccccgactttctgggcgaccacttctctttcgaagatgaccaggccgctctgccgcctccttccgacctcagtcctgccgggtccacggcggcagctggatcctgtttgatgagacgaacttcgagggtgaccagcacaattctctctgagggcgagttccccatctcacggcatgggctgctcgctccacagtcctgggntctctccngaaggttncctgactttcagagccctcccattttcctngttngnctcgagtgntcgagggganggggatcgagctcgccgggagttgcggagcctgcaagcggggttcacacctggc

SEQ ID NO: 696456 - DNA, 343 bp, Homo sapiens
caagatcctccaacagacataaggctattagtggaccaacagtgaactctaaataatgtttgtaatttggttaatatagatgtacccatttttcagctttgataaacatacctaggttgtgtatgatggtaacatcgggaaagctgggggacaggaatacaggaactctctatgatatctttcagaacttttctgtaaatctaaaattatccccagaaaagtttaaaaagaaaacaaataaaagagaggattctagcttctctgtgatgattaaactgagtttgaggttcaagagtgaaagcagagagcccagtaggagctaggtctactggagtggtccaga

SEQ ID NO: 696457 - DNA, 1209 bp, Homo sapiens
  misc_feature (160)..(160): n is a, c, g, or t
  misc_feature (228)..(228): n is a, c, g, or t
  misc_feature (244)..(244): n is a, c, g, or t
  misc_feature (258)..(258): n is a, c, g, or t
  misc_feature (1084)..(1084): n is a, c, g, or t
  misc_feature (1092)..(1092): n is a, c, g, or t
  misc_feature (1100)..(1100): n is a, c, g, or t
  misc_feature (1130)..(1130): n is a, c, g, or t
  misc_feature (1134)..(1134): n is a, c, g, or t
  misc_feature (1136)..(1136): n is a, c, g, or t
  misc_feature (1145)..(1145): n is a, c, g, or t
  misc_feature (1155)..(1155): n is a, c, g, or t
cttaagggggtgacagcccgtaggagggttgtctgggactacagcaccccggaaatcagctcttctctgaggagggcctcaagggggagcaagtgaagctaacagaggccttgaagaattcccagggtctggagaagcccctgcaggtggcatctgccancgtctctgcaggactatggctactgtaccccaaaccattattcgaagacactccctacatcctggaanctggagagtaccccanctcagaggcctggngcacatcggaccccagcgtgggctccctgaagcccatgagattggctgtggtgtatgaggccccaggctttcagggccgcagctgggaagtgagccgagacatctacaaccttcagcagccagaggacagccagagcccccacctggcctctgtggggtccctgagagttctcggaggctgctgggtgggctacgagaaggagggcttccggggccaccagtatctgctggaggagggggaatacccagactggtcacactggggaggctatgacgagttgctgacctccctccgggtcatccggacggacttcggggacccggccgtcgtgctatttgaggccatggacttcgaggggcacggcgtggaggtgagcaaggcattgccggatgtggagctggtgcaacacggccccaacacacaggccatccacgtgctcagcggcgtgtgggtggcctaccaggaggtgggcttctccggggaacagtacgtgctggagaagggcgtgtatcgtaactgcgaggactggggcgctggcaacagcaccctcgcctcgctgcagccggtcctacaggtcggggagcacgatctgcacttcgtctcaaagattcagcttttctcccgccccgactttctgggcgaccacttctctttcgaagatgaccaggccgctctgccgcctccttccgacctcagtcctgccgggtccacggcggcagctggatcctgtttgatgagacgaacttcgagggtgaccagcacaattctctctgagggcgagttccccatctcacggcatgggctgctcgctccacagtcctgggntctctccngaaggttncctgactttcagagccctcccattttcctngttngnctcgagtgntcgagggganggggatcgagctcgccgggagttgcggagcctgcaagcggggttcacacctggc

SEQ ID NO: 696458 - DNA, 343 bp, Homo sapiens
  misc_feature (86)..(86): n is a, c, g, or t
ttttttttgaagcagagtctcactgtatctccacgctgggagttcagtggcacgaatgctgctcactgaagcctcaacctcctagngctcaagtgatcctcctgcctgagccttcccagtagctgggacctcaggaatgtaccaccacgccttgcaaatttttaaatttttctgtagagacagggtcttgccatgttgcccaggcttgtctagaactgggctcaagcaattcttttgcctcagcctaccaaagtgctgggattacaggcattagccaccgcacccagcctccagttggattttttaaagggaactttatactgttactcccaagaacatctca

SEQ ID NO: 696459 - DNA, 219 bp, Homo sapiens
gggatgggttctcactatattgtccaggctagagtgcagtggctattcacagatgcgaacatagtacactgcagcctccaactcctagcctcaagtgatcctcctgtctcaacctcccaagtaggattacaagcatgcgccgacgatgcccagaatccagaactttgtctatcactctccccaacaacctaaatgtgaaaacagaataaacttcaccca

SEQ ID NO: 696460 - DNA, 621 bp, Homo sapiens
agatacccacgtttctggtgggaggacagtcagattgcagtgggaggttggggtgagtgatgtctcacgggtggagacaagtgtaatactaccgcagtgggaggttggggtgagtgctgtctcactggtggagacaagtgtaatactaccgcagtgggaggttggggtgagtgctctctcacgggtggagacaagtgtaatactaccgcagtgggaggttggggtgagtgatcgctcacgggtggagacaagtgtaatactaccgcagtgggaggttggggtgagtgctgtctcacgggtggagacaagtggcactgggtgaatactgaatatgttagaagaagtgaaggtggtggaggcaggaggccctaccagaaaaaatttgcaactgcagagtggatgggcctgatgggcttaccagttgttagtcgtagcaccgcagccgcctaacagtccagatgggcctttggtgggttagaaaactctctataactaaagtaggtcttttaatccgcctccttctctgacagctccaacagaagcaggagtatgtaaaaagctccaaacctaccacctggaaactttttatgctgatactgagactattatactcccaacctc

SEQ ID NO: 696461 - DNA, 334 bp, Homo sapiens
  misc_feature (12)..(12): n is a, c, g, or t
  misc_feature (68)..(68): n is a, c, g, or t
  misc_feature (74)..(74): n is a, c, g, or t
  misc_feature (79)..(80): n is a, c, g, or t
  misc_feature (83)..(83): n is a, c, g, or t
  misc_feature (102)..(102): n is a, c, g, or t
  misc_feature (122)..(122): n is a, c, g, or t
  misc_feature (146)..(146): n is a, c, g, or t
  misc_feature (151)..(151): n is a, c, g, or t
  misc_feature (155)..(156): n is a, c, g, or t
  misc_feature (167)..(169): n is a, c, g, or t
  misc_feature (174)..(174): n is a, c, g, or t
  misc_feature (179)..(179): n is a, c, g, or t
  misc_feature (204)..(206): n is a, c, g, or t
actgacctttgngacccctgacccagcctctgcccaaaccatcaccggatcccaggctgagcccctgncctgancttcnnagnactcccccttcctgaagantgtgtggacccagaaacccnagggggcagtggagaagggcaggnctganggannagcctgtaaannncaggnccagnaacagccctaggagaaacctcggcnnnggccctcaatgggcctgcccagcccccactgggcccattctgagtgccaaagcctgggcttgggaggctgtcacttacctcaccctattaaaagcaatggacagtgcagggaggtgggaggacaaggt

SEQ ID NO: 696462 - DNA, 1620 bp, Homo sapiens
ggtgatgagcccttgggttctcgctccgactgctaaattcgcttggccgggtccaccttctcgtggcctcactcgccacacggatcagaatccggagcaggcagttctctctattctgaggctcctgcggctgccgcgctgacttccctgtgtgcgggagggaactctgggcaggctggttttcttggaatgtgtttacgatgttgaatgggacttgaacaggaagctggacgctgcagctggaactagcgtgccaagttatttatgattccatctgatatacataggagagaaactgatagaagaattctgatggcaactgtatgatagaagctatataaagtcaagtgtccattttctttcaactatatttgagcatacccaggatttaagtcgtggaactgaacatttatttggctgatcctcatcatgaaccgtgcttttagcaggaagaaagacaaaacatggatgcatacacctgaagctttatcaaaacatttcattccctataatgcaaagtttcttggcagtacagaagtggaacagccaaaaggaacagaagttgtgagagatgctgtaaggaaactaaagtttgcaagacatatcaagaaatctgaaggccagaaaattcctaaagtggagttgcaaatatcaatttatggagtaaaaattctagaacccaaaacaaaggaagttcaacacaattgccagcttcatagaatatctttttgtgcagatgataaaactgacaagaggatattcactttcatatgcaaagattctgagtcaaataaacatttgtgctatgtatttgacagcgaaaagtgtgtaagtatcccagatgttgtagggtggtttgttctgttttataagccaggaattgtcttgcttctggcattggcaaagtatttgaaaatgaataattttctgtaaattattctgtaaaaagtctgtaaatacttagctgtactaatagatttattttgtcatgagaatatgcttcaggatttcatctgtaactaaattctcatggtcatgagcataaacttacatgtaaatttcttttattagaatgccatgcctgcttatgttatgcatgtattttataataatttaatctattttacaattttaaactcaaatatgatttagtattatgcacataatacaaacagtagtggtgagcaaacgtgtgtttcccccacatgtgcagaatatgatggattttatgaaaataaatattcttaactccaggaaatatgatctatatggttccttaaaagattttccaatacactgaaaatttagttccttatgttcattgtataaaaatcttaggccaggcgcggtggctcacgcctgtaatcccagcacttcgggaggccgaggcgggcagatcatgaggtgaagagatcgagaccatcctgaccaaaatggtgaaactctgtctctactaaaaatacaaaaattagctgggtgtggtggtgtgtgccagtggtcccagctactagggaggctgaggcaggaaatcacttgaacctgggaggcagaggttgcagtgagccaagatcgcgccactgaattccagcctggcggcagagtgagactccatctcaagag

SEQ ID NO: 696463 - DNA, 549 bp, Homo sapiens
  misc_feature (67)..(67): n is a, c, g, or t
  misc_feature (102)..(102): n is a, c, g, or t
catgaagaggtcgatagcaaatgctacgtgcagacaagacagcagttctttgtggaatggatcccancatgtcaagacaaccgtttgtgacattcaccctcntggcctctaagattgcagtcaccttcattggcaatagcccagccattcaggagcttttcaagcgcatctcggagcagtttactcccatggtccgccggaaggccttcctcccctggtacacaggcgagggcatggaccagatggagttcccccaggcttaaaaccacattaacgaccttgttttttagtatcaacaggtccaggatgcccccccaaaaaaggaggaggatttcggttaggaggcccaaaaggaggcctaaggcaaagcccccctcccctcagggttttcagttcccttaaccgttttaatcaaatgcccctttcctttccctcaaaatttgggtttgccgcccccatcctggtttttgtttttttttttgggggggggtttaaaacagtgcctggcccatagtaggcgccccattaattcttgtttgtttaaaaaaa

SEQ ID NO: 696464 - DNA, 2785 bp, Homo sapiens
  misc_feature (877)..(877): n is a, c, g, or t
ataagaaccaaatatttattgagtattttctctgcgcctatcacaactctattttaactcctgtaaatgtgactgtgactccgtgagctagattatagaattcctgttgacagttataattggtaggcacagaaagcgtaaagatggagtttggaatggaatctggcctgtctgactctaagccctggatccactgtaatacattataactgctagctttgcaaaatgcctttttccttttctcatctattttcacactcaaactaaaatttagtaaactaaattctgagcagcagaaaaaattttagtaaaggtcctctcatccttgaagaacttcttatataaggatactccttcttgctccctttcccacgcagaactttaccaaaggtcagtaagaatgggctgttgtgttttctctcaaatcctatacagaagtccttaattccgaggtaaacatctgaatggaacaaatgagtatgatctgggggttaaggcaattttcaagtgtgtgtatgtgtgtgtctgttttaaggcataacaaagtccagagattaaggccgagttaaaaaacaaatgaggacaaaccaatgaggacaaaccagtccgctgaggtgcggccagagcagcagcaactgtgtctgctttcttgataaaggctgtgaagacggcacgttttactcttattcgtgtatttcttttgacactttacccctctatgaagcctcagaggtgttttaaaattgtgttaggaaacacacagagataagaaaaggcaaatggtcctgatctagtgtctcagggaagagtctggaaaggaaacgcggcgcgagtggggtgggagagggggcctgtggttttgcttctgtccgggctnaagactgagtaaggtagggcccctccttctgcggatgggtttctctctcattccaccctccacccacctccggttccgcgtgcacgcgcgagatagtccagtgggcccacagataacgaccatcagagattaaagaaggaaagtcagcgagcttgaacacaggcgtcccgtgtggaaatgtccaaggagaccgccagaagtgcgcaagccggagtcggctagagtttccttctcaccgagagggggagcccggcgttcccggccgggagcgacccggagtccccagccccgcgtcccagctgccgccagcgccagtttggattcggcggattaggaagaggagggaggggggagagagcgcgaagagggaggggaccgaagctggagggtcccgagtccagcgccgtgttggcgtagagaaactttccctctcggcctcggagacggcgccccggccgtgccggagtggagatcgccaggctcggaggaaccggcagctctccacgcccctgcccgaagcctgacccgactgcctctctcagtgagttatttatgattccatctgatatacataggagagaaactgatagaagaattctgatggcaactgtatgatagaagctatataaagtcaagtgtccattttctttcaactatatttgagcatacccaggatttaagtcgtggaactgaacatttatttggctgatcctcatcatgaaccgtgcttttagcaggaagaaagacaaaacatggatgcatacacctgaagctttatcaaaacatttcattccctataatgcaaagtttcttggcagtacagaagtggaacagccaaaaggaacagaagttgtgagagatgctgtaaggaaactaaagtttgcaagacatatcaagaaatctgaaggccagaaaattcctaaagtggagttgcaaatatcaatttatggagtaaaaattctagaacccaaaacaaaggaagttcaacacaattgccagcttcatagaatatctttttgtgcagatgataaaactgacaagaggatattcactttcatatgcaaagattctgagtcaaataaacatttgtgctatgtatttgacagcgaaaagtgtgtaagtatcccagatgttgtagggtggtttgttctgttttataagccaggaattgtcttgcttctggcattggcaaagtatttgaaaatgaataattttctgtaaattattctgtaaaaagtctgtaaatacttagctgtactaatagatttattttgtcatgagaatatgcttcaggatttcatctgtaactaaattctcatggtcatgagcataaacttacatgtaaatttcttttattagaatgccatgcctgcttatgttatgcatgtattttataataatttaatctattttacaattttaaactcaaatatgatttagtattatgcacataatacaaacagtagtggtgagcaaacgtgtgtttcccccacatgtgcagaatatgatggattttatgaaaataaatattcttaactccaggaaatatgatctatatggttccttaaaagattttccaatacactgaaaatttagttccttatgttcattgtataaaaatcttaggccaggcgcggtggctcacgcctgtaatcccagcacttcgggaggccgaggcgggcagatcatgaggtgaagagatcgagaccatcctgaccaaaatggtgaaactctgtctctactaaaaatacaaaaattagctgggtgtggtggtgtgtgccagtggtcccagctactagggaggctgaggcaggaaatcacttgaacctgggaggcagaggttgcagtgagccaagatcgcgccactgaattccagcctggcggcagagtgagactccatctcaagag

SEQ ID NO: 696465 - DNA, 177 bp, Homo sapiens
ggcccggacaatcatttacacgattgctacagtatattatttacgtgtctagttctcagaaagaaaaaaaagagacatgaaaatgcaacataaatgtagagacacacacacacagggccgggcctggtggctcacgcctgtaatcccaggactttgggagtctgaaggcagtctgga

SEQ ID NO: 696466 - DNA, 1689 bp, Homo sapiens
ggtgatgagcccttgggttctcgctccgactgctaaattcgcttggccgggtccaccttctcgtggcctcactcgccacacggatcagaatccggagcaggcagttctctctattctgaggctcctgcggctgccgcgctgacttccctgtgtgcgggagggaactctgggcaggctggttttcttggaatgtgtttacgatgttgaatgggacttgaacaggaagctggacgctgcagctggaactagcgtgccaaggtagagtaaggaagacttagctggtgttgggcttggcgggtccacttggtacgctgggcaaactccaagttatttatgattccatctgatatacataggagagaaactgatagaagaattctgatggcaactgtatgatagaagctatataaagtcaagtgtccattttctttcaactatatttgagcatacccaggatttaagtcgtggaactgaacatttatttggctgatcctcatcatgaaccgtgcttttagcaggaagaaagacaaaacatggatgcatacacctgaagctttatcaaaacatttcattccctataatgcaaagtttcttggcagtacagaagtggaacagccaaaaggaacagaagttgtgagagatgctgtaaggaaactaaagtttgcaagacatatcaagaaatctgaaggccagaaaattcctaaagtggagttgcaaatatcaatttatggagtaaaaattctagaacccaaaacaaaggaagttcaacacaattgccagcttcatagaatatctttttgtgcagatgataaaactgacaagaggatattcactttcatatgcaaagattctgagtcaaataaacatttgtgctatgtatttgacagcgaaaagtgtgtaagtatcccagatgttgtagggtggtttgttctgttttataagccaggaattgtcttgcttctggcattggcaaagtatttgaaaatgaataattttctgtaaattattctgtaaaaagtctgtaaatacttagctgtactaatagatttattttgtcatgagaatatgcttcaggatttcatctgtaactaaattctcatggtcatgagcataaacttacatgtaaatttcttttattagaatgccatgcctgcttatgttatgcatgtattttataataatttaatctattttacaattttaaactcaaatatgatttagtattatgcacataatacaaacagtagtggtgagcaaacgtgtgtttcccccacatgtgcagaatatgatggattttatgaaaataaatattcttaactccaggaaatatgatctatatggttccttaaaagattttccaatacactgaaaatttagttccttatgttcattgtataaaaatcttaggccaggcgcggtggctcacgcctgtaatcccagcacttcgggaggccgaggcgggcagatcatgaggtgaagagatcgagaccatcctgaccaaaatggtgaaactctgtctctactaaaaatacaaaaattagctgggtgtggtggtgtgtgccagtggtcccagctactagggaggctgaggcaggaaatcacttgaacctgggaggcagaggttgcagtgagccaagatcgcgccactgaattccagcctggcggcagagtgagactccatctcaagag

SEQ ID NO: 696467 - DNA, 2944 bp, Homo sapiens
  misc_feature (877)..(877): n is a, c, g, or t
ataagaaccaaatatttattgagtattttctctgcgcctatcacaactctattttaactcctgtaaatgtgactgtgactccgtgagctagattatagaattcctgttgacagttataattggtaggcacagaaagcgtaaagatggagtttggaatggaatctggcctgtctgactctaagccctggatccactgtaatacattataactgctagctttgcaaaatgcctttttccttttctcatctattttcacactcaaactaaaatttagtaaactaaattctgagcagcagaaaaaattttagtaaaggtcctctcatccttgaagaacttcttatataaggatactccttcttgctccctttcccacgcagaactttaccaaaggtcagtaagaatgggctgttgtgttttctctcaaatcctatacagaagtccttaattccgaggtaaacatctgaatggaacaaatgagtatgatctgggggttaaggcaattttcaagtgtgtgtatgtgtgtgtctgttttaaggcataacaaagtccagagattaaggccgagttaaaaaacaaatgaggacaaaccaatgaggacaaaccagtccgctgaggtgcggccagagcagcagcaactgtgtctgctttcttgataaaggctgtgaagacggcacgttttactcttattcgtgtatttcttttgacactttacccctctatgaagcctcagaggtgttttaaaattgtgttaggaaacacacagagataagaaaaggcaaatggtcctgatctagtgtctcagggaagagtctggaaaggaaacgcggcgcgagtggggtgggagagggggcctgtggttttgcttctgtccgggctnaagactgagtaaggtagggcccctccttctgcggatgggtttctctctcattccaccctccacccacctccggttccgcgtgcacgcgcgagatagtccagtgggcccacagataacgaccatcagagattaaagaaggaaagtcagcgagcttgaacacaggcgtcccgtgtggaaatgtccaaggagaccgccagaagtgcgcaagccggagtcggctagagtttccttctcaccgagagggggagcccggcgttcccggccgggagcgacccggagtccccagccccgcgtcccagctgccgccagcgccagtttggattcggcggattaggaagaggagggaggggggagagagcgcgaagagggaggggaccgaagctggagggtcccgagtccagcgccgtgttggcgtagagaaactttccctctcggcctcggagacggcgccccggccgtgccggagtggagatcgccaggctcggaggaaccggcagctctccacgcccctgcccgaagcctgacccgactgcctctctcagtgagttatttatgattccatctgatatacataggagagaaactgatagaagaattctgatggcaactgtatgatagaagctatataaagtcaagtgtccattttctttcaactatatttgagcatacccaggatttaagtcgtggaactgaacatttatttggctgatcctcatcatgaaccgtgcttttagcaggaagaaagacaaaacatggatgcatacacctgaagctttatcaaaacatttcattccctataatgcaaagagtacgtaggagagatgagaatgaagaggaaaggattgttaagagaagtaaaatgtggcagaaaacaccaagattttggaaataatttagatgtgaacacagaaattgatgttatcaatggattatgtggttgcttttcaaatattgattaggaaaatgtttcttggcagtacagaagtggaacagccaaaaggaacagaagttgtgagagatgctgtaaggaaactaaagtttgcaagacatatcaagaaatctgaaggccagaaaattcctaaagtggagttgcaaatatcaatttatggagtaaaaattctagaacccaaaacaaaggaagttcaacacaattgccagcttcatagaatatctttttgtgcagatgataaaactgacaagaggatattcactttcatatgcaaagattctgagtcaaataaacatttgtgctatgtatttgacagcgaaaagtgtgtaagtatcccagatgttgtagggtggtttgttctgttttataagccaggaattgtcttgcttctggcattggcaaagtatttgaaaatgaataattttctgtaaattattctgtaaaaagtctgtaaatacttagctgtactaatagatttattttgtcatgagaatatgcttcaggatttcatctgtaactaaattctcatggtcatgagcataaacttacatgtaaatttcttttattagaatgccatgcctgcttatgttatgcatgtattttataataatttaatctattttacaattttaaactcaaatatgatttagtattatgcacataatacaaacagtagtggtgagcaaacgtgtgtttcccccacatgtgcagaatatgatggattttatgaaaataaatattcttaactccaggaaatatgatctatatggttccttaaaagattttccaatacactgaaaatttagttccttatgttcattgtataaaaatcttaggccaggcgcggtggctcacgcctgtaatcccagcacttcgggaggccgaggcgggcagatcatgaggtgaagagatcgagaccatcctgaccaaaatggtgaaactctgtctctactaaaaatacaaaaattagctgggtgtggtggtgtgtgccagtggtcccagctactagggaggctgaggcaggaaatcacttgaacctgggaggcagaggttgcagtgagccaagatcgcgccactgaattccagcctggcggcagagtgagactccatctcaagag

SEQ ID NO: 696468 - DNA, 2903 bp, Homo sapiens
  misc_feature (877)..(877): n is a, c, g, or t
ataagaaccaaatatttattgagtattttctctgcgcctatcacaactctattttaactcctgtaaatgtgactgtgactccgtgagctagattatagaattcctgttgacagttataattggtaggcacagaaagcgtaaagatggagtttggaatggaatctggcctgtctgactctaagccctggatccactgtaatacattataactgctagctttgcaaaatgcctttttccttttctcatctattttcacactcaaactaaaatttagtaaactaaattctgagcagcagaaaaaattttagtaaaggtcctctcatccttgaagaacttcttatataaggatactccttcttgctccctttcccacgcagaactttaccaaaggtcagtaagaatgggctgttgtgttttctctcaaatcctatacagaagtccttaattccgaggtaaacatctgaatggaacaaatgagtatgatctgggggttaaggcaattttcaagtgtgtgtatgtgtgtgtctgttttaaggcataacaaagtccagagattaaggccgagttaaaaaacaaatgaggacaaaccaatgaggacaaaccagtccgctgaggtgcggccagagcagcagcaactgtgtctgctttcttgataaaggctgtgaagacggcacgttttactcttattcgtgtatttcttttgacactttacccctctatgaagcctcagaggtgttttaaaattgtgttaggaaacacacagagataagaaaaggcaaatggtcctgatctagtgtctcagggaagagtctggaaaggaaacgcggcgcgagtggggtgggagagggggcctgtggttttgcttctgtccgggctnaagactgagtaaggtagggcccctccttctgcggatgggtttctctctcattccaccctccacccacctccggttccgcgtgcacgcgcgagatagtccagtgggcccacagataacgaccatcagagattaaagaaggaaagtcagcgagcttgaacacaggcgtcccgtgtggaaatgtccaaggagaccgccagaagtgcgcaagccggagtcggctagagtttccttctcaccgagagggggagcccggcgttcccggccgggagcgacccggagtccccagccccgcgtcccagctgccgccagcgccagtttggattcggcggattaggaagaggagggaggggggagagagcgcgaagagggaggggaccgaagctggagggtcccgagtccagcgccgtgttggcgtagagaaactttccctctcggcctcggagacggcgccccggccgtgccggagtggagatcgccaggctcggaggaaccggcagctctccacgcccctgcccgaagcctgacccgactgcctctctcagtgagttatttatgattccatctgatatacataggagagaaactgatagaagaattctgatggcaactgtatgatagaagctatataaagtcaagtgtccattttctttcaactatatttgagcatacccagagtcttgctctgtcgcccaggctggagtgcaatggcacgatctcggttcactgccacctccgcctcccgggttcaagcaattctcctgcctcaacctcctgagtagctgggattacaggatttaagtcgtggaactgaacatttatttggctgatcctcatcatgaaccgtgcttttagcaggaagaaagacaaaacatggatgcatacacctgaagctttatcaaaacatttcattccctataatgcaaagtttcttggcagtacagaagtggaacagccaaaaggaacagaagttgtgagagatgctgtaaggaaactaaagtttgcaagacatatcaagaaatctgaaggccagaaaattcctaaagtggagttgcaaatatcaatttatggagtaaaaattctagaacccaaaacaaaggaagttcaacacaattgccagcttcatagaatatctttttgtgcagatgataaaactgacaagaggatattcactttcatatgcaaagattctgagtcaaataaacatttgtgctatgtatttgacagcgaaaagtgtgtaagtatcccagatgttgtagggtggtttgttctgttttataagccaggaattgtcttgcttctggcattggcaaagtatttgaaaatgaataattttctgtaaattattctgtaaaaagtctgtaaatacttagctgtactaatagatttattttgtcatgagaatatgcttcaggatttcatctgtaactaaattctcatggtcatgagcataaacttacatgtaaatttcttttattagaatgccatgcctgcttatgttatgcatgtattttataataatttaatctattttacaattttaaactcaaatatgatttagtattatgcacataatacaaacagtagtggtgagcaaacgtgtgtttcccccacatgtgcagaatatgatggattttatgaaaataaatattcttaactccaggaaatatgatctatatggttccttaaaagattttccaatacactgaaaatttagttccttatgttcattgtataaaaatcttaggccaggcgcggtggctcacgcctgtaatcccagcacttcgggaggccgaggcgggcagatcatgaggtgaagagatcgagaccatcctgaccaaaatggtgaaactctgtctctactaaaaatacaaaaattagctgggtgtggtggtgtgtgccagtggtcccagctactagggaggctgaggcaggaaatcacttgaacctgggaggcagaggttgcagtgagccaagatcgcgccactgaattccagcctggcggcagagtgagactccatctcaagag

SEQ ID NO: 696469 - DNA, 3030 bp, Homo sapiens
  misc_feature (877)..(877): n is a, c, g, or t
  misc_feature (1485)..(1485): n is a, c, g, or t
  misc_feature (1504)..(1504): n is a, c, g, or t
  misc_feature (1518)..(1518): n is a, c, g, or t
ataagaaccaaatatttattgagtattttctctgcgcctatcacaactctattttaactcctgtaaatgtgactgtgactccgtgagctagattatagaattcctgttgacagttataattggtaggcacagaaagcgtaaagatggagtttggaatggaatctggcctgtctgactctaagccctggatccactgtaatacattataactgctagctttgcaaaatgcctttttccttttctcatctattttcacactcaaactaaaatttagtaaactaaattctgagcagcagaaaaaattttagtaaaggtcctctcatccttgaagaacttcttatataaggatactccttcttgctccctttcccacgcagaactttaccaaaggtcagtaagaatgggctgttgtgttttctctcaaatcctatacagaagtccttaattccgaggtaaacatctgaatggaacaaatgagtatgatctgggggttaaggcaattttcaagtgtgtgtatgtgtgtgtctgttttaaggcataacaaagtccagagattaaggccgagttaaaaaacaaatgaggacaaaccaatgaggacaaaccagtccgctgaggtgcggccagagcagcagcaactgtgtctgctttcttgataaaggctgtgaagacggcacgttttactcttattcgtgtatttcttttgacactttacccctctatgaagcctcagaggtgttttaaaattgtgttaggaaacacacagagataagaaaaggcaaatggtcctgatctagtgtctcagggaagagtctggaaaggaaacgcggcgcgagtggggtgggagagggggcctgtggttttgcttctgtccgggctnaagactgagtaaggtagggcccctccttctgcggatgggtttctctctcattccaccctccacccacctccggttccgcgtgcacgcgcgagatagtccagtgggcccacagataacgaccatcagagattaaagaaggaaagtcagcgagcttgaacacaggcgtcccgtgtggaaatgtccaaggagaccgccagaagtgcgcaagccggagtcggctagagtttccttctcaccgagagggggagcccggcgttcccggccgggagcgacccggagtccccagccccgcgtcccagctgccgccagcgccagtttggattcggcggattaggaagaggagggaggggggagagagcgcgaagagggaggggaccgaagctggagggtcccgagtccagcgccgtgttggcgtagagaaactttccctctcggcctcggagacggcgccccggccgtgccggagtggagatcgccaggctcggaggaaccggcagctctccacgcccctgcccgaagcctgacccgactgcctctctcagtgaggaggaaatggagagcctactgggatatggatgtctgacaacttaggacaagtggttctcaantctggctacacattgaaancacctgaaaagctnttttaaaattcagacttctgggtctatagcagttatttatgattccatctgatatacataggagagaaactgatagaagaattctgatggcaactgtatgatagaagctatataaagtcaagtgtccattttctttcaactatatttgagcatacccagagtcttgctctgtcgcccaggctggagtgcaatggcacgatctcggttcactgccacctccgcctcccgggttcaagcaattctcctgcctcaacctcctgagtagctgggattacaggatttaagtcgtggaactgaacatttatttggctgatcctcatcatgaaccgtgcttttagcaggaagaaagacaaaacatggatgcatacacctgaagctttatcaaaacatttcattccctataatgcaaagtttcttggcagtacagaagtggaacagccaaaaggaacagaagttgtgagagatgctgtaaggaaactaaagtttgcaagacatatcaagaaatctgaaggccagaaaattcctaaagtggagttgcaaatatcaatttatggagtaaaaattctagaacccaaaacaaaggaagttcaacacaattgccagcttcatagaatatctttttgtgcagatgataaaactgacaagaggatattcactttcatatgcaaagattctgagtcaaataaacatttgtgctatgtatttgacagcgaaaagtgtgtaagtatcccagatgttgtagggtggtttgttctgttttataagccaggaattgtcttgcttctggcattggcaaagtatttgaaaatgaataattttctgtaaattattctgtaaaaagtctgtaaatacttagctgtactaatagatttattttgtcatgagaatatgcttcaggatttcatctgtaactaaattctcatggtcatgagcataaacttacatgtaaatttcttttattagaatgccatgcctgcttatgttatgcatgtattttataataatttaatctattttacaattttaaactcaaatatgatttagtattatgcacataatacaaacagtagtggtgagcaaacgtgtgtttcccccacatgtgcagaatatgatggattttatgaaaataaatattcttaactccaggaaatatgatctatatggttccttaaaagattttccaatacactgaaaatttagttccttatgttcattgtataaaaatcttaggccaggcgcggtggctcacgcctgtaatcccagcacttcgggaggccgaggcgggcagatcatgaggtgaagagatcgagaccatcctgaccaaaatggtgaaactctgtctctactaaaaatacaaaaattagctgggtgtggtggtgtgtgccagtggtcccagctactagggaggctgaggcaggaaatcacttgaacctgggaggcagaggttgcagtgagccaagatcgcgccactgaattccagcctggcggcagagtgagactccatctcaagag

SEQ ID NO: 696470 - DNA, 354 bp, Homo sapiens
cagggccccttattttgcctcgatgggatttgagagatagtctctgcgagatctatctcgttcatatacatggtagtgttagttcttcaggagggagaagtccagctatgtaaggtgctagtggggcttataacagtggatctgttgtttaaaaattagtactttgctcctaaaatttttacctaaatgttacatccaacaacagataaaagtaattcgcacagtagcatctgctttattcatttcatatttccagtgcctgcacatattgcttggcatatagtaatttagtggatgtgtttgatgaatgaatgagtaaaaattattttacatgttaaaataaaactttgaata

SEQ ID NO: 696471 - DNA, 1865 bp, Homo sapiens
  misc_feature (320)..(320): n is a, c, g, or t
  misc_feature (339)..(339): n is a, c, g, or t
  misc_feature (353)..(353): n is a, c, g, or t
ggtgatgagcccttgggttctcgctccgactgctaaattcgcttggccgggtccaccttctcgtggcctcactcgccacacggatcagaatccggagcaggcagttctctctattctgaggctcctgcggctgccgcgctgacttccctgtgtgcgggagggaactctgggcaggctggttttcttggaatgtgtttacgatgttgaatgggacttgaacaggaagctggacgctgcagctggaactagcgtgccaaggaggaaatggagagcctactgggatatggatgtctgacaacttaggacaagtggttctcaantctggctacacattgaaancacctgaaaagctnttttaaaattcagacttctgggtctatagcagttatttatgattccatctgatatacataggagagaaactgatagaagaattctgatggcaactgtatgatagaagctatataaagtcaagtgtccattttctttcaactatatttgagcatacccagagtcttgctctgtcgcccaggctggagtgcaatggcacgatctcggttcactgccacctccgcctcccgggttcaagcaattctcctgcctcaacctcctgagtagctgggattacaggatttaagtcgtggaactgaacatttatttggctgatcctcatcatgaaccgtgcttttagcaggaagaaagacaaaacatggatgcatacacctgaagctttatcaaaacatttcattccctataatgcaaagtttcttggcagtacagaagtggaacagccaaaaggaacagaagttgtgagagatgctgtaaggaaactaaagtttgcaagacatatcaagaaatctgaaggccagaaaattcctaaagtggagttgcaaatatcaatttatggagtaaaaattctagaacccaaaacaaaggaagttcaacacaattgccagcttcatagaatatctttttgtgcagatgataaaactgacaagaggatattcactttcatatgcaaagattctgagtcaaataaacatttgtgctatgtatttgacagcgaaaagtgtgtaagtatcccagatgttgtagggtggtttgttctgttttataagccaggaattgtcttgcttctggcattggcaaagtatttgaaaatgaataattttctgtaaattattctgtaaaaagtctgtaaatacttagctgtactaatagatttattttgtcatgagaatatgcttcaggatttcatctgtaactaaattctcatggtcatgagcataaacttacatgtaaatttcttttattagaatgccatgcctgcttatgttatgcatgtattttataataatttaatctattttacaattttaaactcaaatatgatttagtattatgcacataatacaaacagtagtggtgagcaaacgtgtgtttcccccacatgtgcagaatatgatggattttatgaaaataaatattcttaactccaggaaatatgatctatatggttccttaaaagattttccaatacactgaaaatttagttccttatgttcattgtataaaaatcttaggccaggcgcggtggctcacgcctgtaatcccagcacttcgggaggccgaggcgggcagatcatgaggtgaagagatcgagaccatcctgaccaaaatggtgaaactctgtctctactaaaaatacaaaaattagctgggtgtggtggtgtgtgccagtggtcccagctactagggaggctgaggcaggaaatcacttgaacctgggaggcagaggttgcagtgagccaagatcgcgccactgaattccagcctggcggcagagtgagactccatctcaagag

SEQ ID NO: 696472 - DNA, 910 bp, Homo sapiens
  misc_feature (11)..(11): n is a, c, g, or t
atattcatgtnccatgactccctcgccgtcgggggttcactatgtggtcatttcctactggctttgatgcacgcctcgctggcggcctatttgtttaaaaacctttcagcgcataattcttcccggcgcttaacaaatacaatttcgtgtttggcgcccccgtattcttttattagtgtctaaagcccgagtttgccgtgaaaataagacgttccggaccaaagcggccccatgtgcatacggccctgcaccagtgtgtaatgacatgcccaaatcaccgctgctgtagtacgaacccaattctctccaccgaatacgccccgcctgcagaagtacaaaaggaggggatccaccaaggactcgacccaattgataagccccggcgcagacaagtatgctacgttaatgtaatctgccccgttctgtggcatatattaactttatacaaagacgcacaaatagacccactgttccttccaacaccccctacatacgcagtgcgacagttttaacacccggagatacccgcctgtataatatagaataggttcatatctcgcggagtggacaagattcattatgaatttcccccggcggtggaacacatctacacatctcaaggaagactgtccccggtatgagcgaaataaatcccagcgtcccacattgcgtagggatctcgtcgacttgctcccatgacagtatttgtattgagcgcccccaccacctctgtctttatgacagccagcaggctttatcccatgccgtcctctctgtaaaaaaatcatgcaatatccgtggtgttcatttgataaaaaaaggccccgccgtatcatgggaaaaatcacagattttcgatggggcacaaaactccctttttcggcacaaaaaaaacccccttccacataca

SEQ ID NO: 696473 - DNA, 939 bp, Homo sapiens
  misc_feature (462)..(462): n is a, c, g, or t
  misc_feature (517)..(517): n is a, c, g, or t
gccgtcccgatgcccgcgcatcccgctcgtccgtgcccgccggcgctatgtccggggccggtctagccgcggtggtgagctgcctgcgcccggcgatgccgtgtcgaggatccgcagacccagtgagacgcttactattcttgttatagactcatcctagactgatcgcaggttgctcggctataccttctttattggtgctaagaccctcgcatcttgctgctgctcttgaatgatgccttgagtttgcgttctccctgacttgttcttgggcacactcaataagcaagaaagattcctctagccgtgcaccatgctactacgttatgcgcgatgagctgggctacgattgttgctacaagaggttctagcatccgtcagagatgtggtattatctgggataggcatacgaagacatgacattctgctcaccagtaggttagccatcagcctgggctgagnctgttgcagtgtgataggtagcactgctagagcagctcttagtgaatcacaaggncagtgcagccgcatgcaacggagaacgaaaggactgcacatacggattctgtgcttgttagactgaaatcaagcaaccgagcttcgcatacgagtagaagcgcccattcaagcgacgagacttgcgacatgcagaacgcgcgaagactgcacatgtacatcacaattaggggcagacatagtgttggctagttggcagaccgatttcaagccattattcatagagtcacttcgcaatattaccaggaaaatcacaatagatgatctccatctagatacatgttggcgtgcaagtataagtgcacagcgcaacttcatacagcgaacatagctcatgtgaaaagtgggccgcataggtacagcatgttgtaaccgtcaacatcagttcaaccattttatgtgcaatctagacggacaagtaac

SEQ ID NO: 696474 - DNA, 323 bp, Homo sapiens
aaaggttggagagagagaggttggagagactggaacgggagaggcaagaaagggagcgagcgaagagcagttagaaagggaacagctggaatgggagagagagcgcgagaatatcaagtgctggtaacgacagtttacaaactcttctgtgttcttgtatctgagcttggatgatgtctcttgtgcagtccatgtgttaaacatatttcacatttgacgatgttatggcgattgaagtccattacagatttggacaattcatgtaatatagatatgacagcaagttactactttgataataaacatataatagaagagggcga

SEQ ID NO: 696475 - DNA, 325 bp, Homo sapiens
gtccaatttgcccccttcccctaaaaaaggcccgggtttagtggggggggccttccccctgccccccctttccccccaaagggccccctgtcatttttggccgggagagtgaccccctgggggggcaaattgccagctcccccgggtttgtgcaggattttttgggttgaaaacccctctcaaattgtttttggggtgggggtggggccgggcctttcctggacccccctttttggttggtttgcccccctggcccatcccgttttttgggttcccccccgggtttttcccaaagggaccccccccgtaaggcctttgccccaga

SEQ ID NO: 696476 - DNA, 239 bp, Homo sapiens
aacactgcgatttcacttggtatagcacggctcaaagactcgggcatgcaaatacatgattcgtttcccacattacggtgcacaaaatcgagcggagagagcctgtgggaaggggctagccgcggggcctgggtgcttggatttttttttttcccgcgggtccccgggagcgaagggacggagatgcaacctttacgaaggtcttcctcctccccctccctcccagtgacaatcccacg

SEQ ID NO: 696477 - DNA, 291 bp, Homo sapiens
ccccccccctttaactcatttgggcggggggggtttgcggtggggggtttgtttgcgcggccgtttttttgtttccctttccctcccctggttccccccccccccgttttttcccccccctcgtgcccccggggtgggcccccccctccggtttttggcctgggccggggggggggtttctttttccccccggggccggcttccctctttggcccttttttggtcccctttttccccgtttttggttcccagcgccgggggggcccgggccggttttccgggtggttccga

SEQ ID NO: 696478 - DNA, 437 bp, Homo sapiens
ctgaggatcccgtgcgacattttacaccagtgaggaaaaatttgcttcgttgaggtgatcgcatgatcaaaggctgcaggtgctcatgggccggatggagagcgtcttcaaccatgggcactcaggaacaccatctacgcgggattgcaggacttcggccaggtgacgctgcgtgaggccctgcggcaggcggtacggaagaagaagaatgtcctcatcagggtcctacagggaattcgaaagaacatctttgactgggagggagggcgagaggcccctaatgacccatggttgaagaggggagaaggaccccaaaggtggattttgatatccaaggttgccccggggttcttggtggggccatcccaggacaccagcttgtccacactggtgcggccgggggtcaccggaagctcgaattcggaaaccaggggccc

SEQ ID NO: 696479 - DNA, 218 bp, Homo sapiens
tgtattacttgtggtcgatctctacacggatcccccatgaggtccataggtttgggtcctagtcctttctattagctcttagtaagattacacatgcaacgcatccccgttccagtgagttctaccctctaacatcacctacgatcgacataagggatcaagcatccaggcacgcacgcattgcaggctctaggaacgcgttagccctagtccacacc

SEQ ID NO: 696480 - DNA, 285 bp, Homo sapiens
atcccctataaatctactacaaagctatagtagccagaacaaggtggctactggggcatatatacagtatacattgaccaaatggtaatcagtatatattggggcccagaagaattaatccacttcctttacagccgactgatttctgacaaagatgcctcaaacactcattggggaaataactgtctcgtctcttgaataatttatacctgatgaaatactgtatatccatttgcataacaatgaaactagacccccacttctcatgctgtgcataaatcaact

SEQ ID NO: 696481 - DNA, 366 bp, Homo sapiens
  misc_feature (114)..(114): n is a, c, g, or t
tggggctcaataaaatccagtgcaactttccttcagtggagggaagacaggatcaggacagcagagcatcatggggacaggctcgtttctccctccatggccgtcctggactgngcagggtggcagaagggactagcgcagcactgttgggacactagtagacgaggtgggtggccaggacgcgagggtcctgggtccagtcctggctcagtgaccttggtcaagttacatactcactgtgggctcagtttcccctcctgtaggaggaaggtgcttctctagagagttcatccttaaggagccatttagctctgaccttcaccaaggctctttgattcccaccagtgcctcgggggatcgtctaga

SEQ ID NO: 696482 - DNA, 340 bp, Homo sapiens
agtgaaggagagtgaaaaagctcctcaatgttagggtatgaggctgttctcagcttggcaggtcattaaaagaccagcgccatgactcttgggcatggtcatggccaggcgctgggtggctactggcgaccaagccagagcagacaaactttctgaacattccgaggtcaacccatccgttgaactcagcccgacaaggtcctggagcagtgggacagtgagcctcgaccaacctagtgacagccttgattctacctgggacggagtgaccgatggcccccagcccactgccctgaaagaaaccttgccagagggccccagacaccacctcctaagccca

SEQ ID NO: 696483 - DNA, 418 bp, Homo sapiens
catgggatgttaacagcccgttaggagctgcgcacatcgctaacgggagttccaggataatcactataagatgagaaaaattgatctctgaatgagctgtaacgaggtccgaagtgattttagctacatcaggagaggaacaagaccaacctgaaggatcagtgaagggagattagaagcgttctggaccaccacaggagatgatatccccaggaattcattaatggcaagcacaaacattgttggattgaaaggatcgtaatccaaagttactctgtacaaacctttagtatcgaaaaaagcacatataaagagccagatgattttgagctatggattgaaaaagattaggttcacacagaggggcagctgtacgtagtgtgtcacatgaagagttcgctacttacttgagaatttt

SEQ ID NO: 696484 - DNA, 235 bp, Homo sapiens
ggatatctcggatcaagcatactgaccactgcgatatcgcagcgctttgctcctcagaatgaaatacagctttcgcatttcttcacggggcgcgccctatgcttcttagcgtcgcttatcaaaatatcagctcatctagtctctagctgaggtactctggcagtccgttcatgtcattgtggtaataccgtatcatactgctgttgtcctcgctaccgtccactccatgctaccg

SEQ ID NO: 696485 - DNA, 291 bp, Homo sapiens
gatcataaggtgggggcgtttagctggcagcactgacagttatttgttttaagtggtttgggccaatgtgtaacaggaaaagctggagtcacatttccaaagtccgaagatgagcaacagagttctggattcagctgcgtgaggttcagcctacagtgactacaagtggacgatctgtctctcttgcaggtatgaccaaccagttttactgtcagtctgtccatttctaattaaatgagatgcagaaatgctggtgcctggcaaaataaaaaacaatcctaaataacaaga

SEQ ID NO: 696486 - DNA, 427 bp, Homo sapiens
gcgaggtacccatccttccttctctcacgctgaagtttaaaccggatatatatgctgctcacaatcatctcttcacacttgaggtcatcctttatcccaatttgttgacagagttaaaaggttgctgaatattcagaaacaccacttatgaaactagaatctacccgcagttatagtttccagcattaacgtctaccagctaagagctgcgcattctgaaagagctagacaatatttactgccttgagcacagaacagggacggcttccctaatacttatgctactgtttcactattaagaaggggtgaatatgttagaaatcacataaattccaattttaaacagaatgctgggagtgaacctcagtctcacatatcaaacacaatctggaaggtgcccaccctgagaggccagctccagcccatc

SEQ ID NO: 696487 - DNA, 355 bp, Homo sapiens
  misc_feature (48)..(48): n is a, c, g, or t
  misc_feature (268)..(268): n is a, c, g, or t
tcggatctagcggatcccttaaagtgcactcttctatatctactaatnaatctatatgcttagattagagcaaagagaaggaaaaaatggcctcggtaactgatgccaaaagaaaaaaattatactctaataaaagaaaaagcaaattagcaaaattaagccattttcattttcctaagaacacaatttcacatattctgtaattaaaacacaagacacatgtcacagactagtaatcaaatgaaaataacaaatcaggctagttagngcatctgaatcatgcaataatatgcagatcccaagtcaaatgtgttcatgatgccccaggatgtagatatagaagagtgcacttttg

SEQ ID NO: 696488 - DNA, 817 bp, Homo sapiens
  misc_feature (128)..(129): n is a, c, g, or t
  misc_feature (166)..(166): n is a, c, g, or t
  misc_feature (397)..(397): n is a, c, g, or t
  misc_feature (419)..(419): n is a, c, g, or t
  misc_feature (421)..(421): n is a, c, g, or t
  misc_feature (443)..(443): n is a, c, g, or t
  misc_feature (476)..(477): n is a, c, g, or t
  misc_feature (495)..(495): n is a, c, g, or t
  misc_feature (503)..(503): n is a, c, g, or t
ggcttccccagctccagaacttccggccagcgcggccatttggcttcctgaccttgggctacggtgaccgttttttgtggtgtactccgtgccatcatgtccgtcctgacgccgctgtgctgcggggnntgacaggctcggccggggctcccagtgccgcgcgcangatccattcgttgccgccggaggggaagctgggggatcatgcaatggcgttggctaacctcctgcttcgtgaccttcctcttgccaggggttgatcctgtcacacctgagacctacaggaggccagagtgaaggggtccgtctgtcccctcaaatgtgaccttgaccagccccaccgtccatccgtgtcatggtactggcattgtgtggcggctcccctgatcatgtcatnccaatccagtcacctcttctgnantcatgacctctgtgatgtctcnatggtgacctcctgtgggggtcactgaccttgnnggggggtcccccttgtancaataaantctatttaaccaacgaccgatagatcagctgcaaagcaaccaaacaacaacttttgttgggccggcctgcgctcgtcggaaaaaggttcaaaggaccccatctggtgggggggcgcggggcccggtaggtttagtgtgcaactgtgtccaatggcggctcccaagggagactgcggcatcggaatattgggcgtggttcccccagaaaaaagcgcccgggggaaccgggggtttggtaacaaatccaaggggggtctgggggccatacaggctctataacagggccaaggggcggtgacccggcgcgggagtgt

SEQ ID NO: 696489 - DNA, 517 bp, Homo sapiens
ccccatgcatcagtggtgcccagtttcaatctcctggcataaccagggaggtgcactcctaaccctaagcaacggtcctataagtcagtcagggtgtatggatcacacaggaagtaaagagccttagggagaagtccatcaccaggtttatctttataccagactttaacggatcatgaccctatctggctaccccgggatattttccacatgactggggacaaagggaaagcaacctcggctctccaggatcggttttcacatgggttatagcatctctgggatggagtagagggaggtcaggagaagaagcccacatagatatataacggtcttctctcagattacacattatagcatgaagggtttggattaaaatctaatggtaagatactggcggattacaattaccaaaatagcatcacaggagattcaattaaaatggtcagggaaataattttggaaatagtttaaaaggcaagaatattcagcgaggtcaataatttagagatactaa

SEQ ID NO: 696490 - DNA, 1506 bp, Homo sapiens
  misc_feature (950)..(950): n is a, c, g, or t
  misc_feature (1016)..(1016): n is a, c, g, or t
tgtagagacgtggatatgttctctccttagcgcctgggtgtaatcttgttgcgcggctctccctgtttgtgggaagggtctccagatgttcaccagtaaggtctaagttttgtgaatggtgggattatctaagggagtgtcctctgaaccccgttgagagagaaattgagacccctgtggtgaagtggggttgtaaagtgattagcgccccttagagtgccccagggattttggaaaagcgctcttgtgggtgtttcatcaagggcgccccgttgtccctagagatgttttcccccggtggtggccgtttttgtgtgtgggcgcacaccgcacccagctatacccgggaagttgtggttttttggccccaaaacccatggggaaggagagatgatttccgcatggtggttgaggtctacccccgtgtggccgggtgtaacgaccagaaaaccgggggggcacacagagggaacccagtttatgtgtctagaccagaaagttttatgctaaatgcgcggaagttctcaatgataagggataaccactttttgtgggagagagtgtagaagtgtccccccagtacccactccccctgcccgtggtagttcccaacggaacggacacacttggccttttttcgaagccgatatctttataaggggaaaagatttgaaaagaatttgaggttatagaacccacgctttttttggggaattccttgggctcggtgggctttttttgtgttttgtaaaaccacaggcaaaccgcgcttttcggcgttctcacgggggataatttctttgttacaccccacgagcccactctatataagcaccatatatgggagagatatatagaaatatatagacaaaaagagatatggctttttcgcccgctcccacgctgttggagaacacacgtgtggaggcccccctcgatatggccacaanaggggtgtgagaaagaaagagagagtcccggcaatagagaggagaccctctcgatatagagagacncacgctcacgagaagacacacgccaccacgagaagaccactcacgaggccacaagaccgcagaagaatgagaagaaaaatgggaatggtgtggggaccacgagatgagacgagaagaaagagaaccacgccaccaaggagaatctaccacgccctgagaaaaagaatgaacttgtaaaattaatacttctcacccactttggagtccctcgtgtggaagaggggaaatgttgagaaatttaccactcacttttcttctttgggaagaagacctttttttggagatgccccctaatccccttctcccctgcacctggtaaaaatgtgggagttaatgggtcaccacggagaaaaagtgggttttttaagttgaaattcttttttaacacatctcctcactgagaatgtaaaatttgtagctaatttaaactgagctatttttgatgtcaaaatcttgtcatgtgtataaaaatataaaaagatccccaata

SEQ ID NO: 696491 - DNA, 443 bp, Homo sapiens
  misc_feature (1)..(1): n is a, c, g, or t
ncttattggcaaccaagaaagacgttcgagattttaaaccacacctaaaacaaaagatgtggtggccaatctttgtacactctcccatctcatcatgtagatatattatacatgctaattactatccgtcttggagaatattcactgaatgcctttacatgtcagtaagcacatataaatcgtatcatattgctgagagattgtaattaccgcatataactatctgatatttaaatgataaataacgtgtgtataagaagatgaacctttggcctaagacttttttcacacattattaacatctaggtagaagtgctgttaattagtagaataatgttcaaagaaacaataataggatgatacaagaaaatccttgctaatgaacactggctttgatttatgtttttgctcagagttttccaagaaatatgcacatttataag

SEQ ID NO: 696492 - DNA, 818 bp, Homo sapiens
gagcgcggagccggcgcggcccctgtgtgtgctgcggagagcaaaagcagacatgtgtcaatttcaattctacatctatgtattggtaagcggaggcctaaataacactgtcaaatcattgggatttacaatcaaaaagagttcatcgatctcttaaggatcataaagatcaagtaacttgtgtaacatacaatggaatgattgctacattgttctggatctcttagtggtgaaatcattttacacaggtaacacctaatttatctagtactcctttggccatggtagtaaccaggtctccaatccaggtcgaatagaagtgatgatcgtggcacatctttatctgtcgcccaaattctggaagaagcatcaatttactaccaagcatgatagtccatctctgtcggcacttgaagtaacctccttgtttacagaacatcactactggccgctgtttcggataatggaatagtaacctctctgggatgtaaatagtcagagtccataccataactttgacagtgtacacaaagctcagcgtcagggcatctgttctcctgtccagaatgcctctgcgtcaccataggctggataaagatcatcttcttatgaaactttcaagtaagaagctagtgaaactctcaggtgcaccctctaacgcgggaaaacctgcccgaggagcactggggccaacggcctccccggggagcaatcgtccacaccgactccacccgctgccaccccgccagcacccgcgaccccccaacctggccgcacgcccaccccaggcgccacaccagcaacacacgggccacaac

SEQ ID NO: 696493 - DNA, 202 bp, Homo sapiens
ccagggaatcgcacggaggtggtgaccccgctcatgttgtccgacaccaggtggttgaggtccacgtagtcgggggtcggcagcttgagggtgcggaaacagatctctacaagtgcctcgatgtctatgcactaagtctcatccgtattctccaccacctggtgcacagacagcgtggcggtgacgagctccaccatcgtgt

SEQ ID NO: 696494 - DNA, 830 bp, Homo sapiens
  misc_feature (386)..(386): n is a, c, g, or t
ttcgagtgtcctccatgggcatgggcactgggctttccccaaagtaagcagtccaaaagagggtaagacagagcccacactggcttttatgaattagccttagaagtctaacacgggtacttccacccacattcattagtcggttagggtacagctcacattccatgggggagggaaaatcaggggcctggtcctttaggattaggagatggtatccaaagcaatttggtgggaccatatatttaaacatctacagaccactacatccttggatggtacctaaggtcagatgaactctccccaaggaggtctcaccagaagaaattgagcttccttggcccaacctaatatctaaccctttggtggggtagagaactccaggtagntggggctgggttaactggttcacaaccaggtgggcttctctaagacaaaacaaaagtggtattggagtacactattatatggttcctaagagttttactggattatggaagcaatggtggtagccacaggaatttcattaaagttattaaaatatacaggtattatattattggttaaattcccattaaaacctggttggtttttccacaaaagggttttaggtttaatttttccccaaatgcctggtattgggctaccattttctcggtgttacctcttttatggtcccggaccaatccaagaacagctggaaggccaaggcttggtaggccttgcgaccagttcattgtggtcacttgttccccactaatggggggcattccagggtgcccccttttggttttccccgtgtgcgctatgcgagggggatctccagaggggcc

SEQ ID NO: 696495 - DNA, 190 bp, Homo sapiens
tcaggagtagagacagccatgacaacatggtgaaagcacatgtctactacaaaatataagaattagccggatgtggtgacacgagtacctgctactcccagacatacttggacggctgagtgcgggagactccctatgaacccagagagatggaggttgcacgtgatccaacgatcaccatccctcgcat

SEQ ID NO: 696496 - DNA, 1008 bp, Homo sapiens
gggagtccgtctgaatctgccgtgactttcggagctgcccgcatttgcaagaaggttcattgttcagttgaactcctttacatttatttattctatgtattttattgtatttatttcatgtcttttatttcattttatgctattattgtctactcttattttatttcatttattttattttcattttgtctcatttttatttttattttattttatttttattttcatttttcttgagacggagtctcgctctgtggcccaggcgggagtgcaatggcaccatctctgcgcactgcaacctccgcctcctaattcaagtgattctccagcctgggcaacaggagcgaaacactgtctcgaaaactaaataacctaacataaataacaatacttcacccacacacttcacaactgagggctcccgaaagttaaatctgctaatctttcagcttcgttactatcctgatccaaaggaagcagactgcagcaccagttggctgactttggataacgtacctggggtccattttacctgagtaaagtatgggactggggtcagaggccctcccctcagtaaagtcccccttggttaaaaatgggttaaagatgacagggcccagcctggggtcagttggagccttgcgaagttcagtattgggtgctaagcacagttggccagtgtctgtgtcttgtcacgtattttgcttcggcgccattgatgcacacaaatgttacattgggcttaacaccacgcaaacccttcgtgcacacttgcaaaaactaggaggccttttgctttaaggcttccattacaaccagaacaacagaattctcctctcgtgatgcccgcagggcttggcccctcagggactatacgtgttgggcaagccagtgctccctagtgaacacacgtgggcgcaacgggaacctagagagcttgcatgtctgtgcaagggtaacgcttttctttcaccaatagactgtgtggcccttcgttcaagctggtca

SEQ ID NO: 696497 - DNA, 135 bp, Homo sapiens
taagtcggtaccctgttgtcttctcccaactcgcgtgctcacagaaccaggtgctgcacagccccgcagatgtggcccttcttcagcgaaagagcaaataagttggtcacgtacttgatgctataagtgactaca

SEQ ID NO: 696498 - DNA, 342 bp, Homo sapiens
  misc_feature (11)..(11): n is a, c, g, or t
  misc_feature (30)..(30): n is a, c, g, or t
  misc_feature (58)..(58): n is a, c, g, or t
  misc_feature (72)..(72): n is a, c, g, or t
  misc_feature (260)..(260): n is a, c, g, or t
gtccctgctancattctccaagtgttttcntgggtcgtgagcgccgctcctgtttccnatctctcagctgcncctcgtgccctgtgtgagatttgttctcgctaagagggggctcagatggtgcggcctgagtgtgcggccggcggcatttgggatacacccgtagggtgggcggggtgtgtcccaggcctaattccatctttccaccatgacagagatgcccttgtgaggctggcctccttggcgcctgtccccacggnccccgcagcgtgagccacgatgctccccataccccacccattcccgatacaccttacttactgtgtgttggcccttatcgag

SEQ ID NO: 696499 - DNA, 212 bp, Homo sapiens
tccccctccccccccccctcccaccccccccccccggtggcccagccccctgtgctgggctgacttgcagcgatttataaactggctgttacctactatggctgctttatttggcgatcacgagttgccatttaggcaacagccatttaggtaacagccactagacagccacttaaggctaacagccactttaggcttacagcccatttagg

SEQ ID NO: 696500 - DNA, 477 bp, Homo sapiens
  misc_feature (31)..(31): n is a, c, g, or t
  misc_feature (56)..(56): n is a, c, g, or t
  misc_feature (123)..(123): n is a, c, g, or t
  misc_feature (234)..(234): n is a, c, g, or t
  misc_feature (240)..(240): n is a, c, g, or t
  misc_feature (336)..(336): n is a, c, g, or t
  misc_feature (338)..(338): n is a, c, g, or t
  misc_feature (352)..(352): n is a, c, g, or t
  misc_feature (359)..(359): n is a, c, g, or t
  misc_feature (372)..(372): n is a, c, g, or t
  misc_feature (379)..(380): n is a, c, g, or t
  misc_feature (399)..(399): n is a, c, g, or t
  misc_feature (405)..(405): n is a, c, g, or t
  misc_feature (422)..(422): n is a, c, g, or t
  misc_feature (451)..(451): n is a, c, g, or t
cacatctcaacccctctgcaaagcttttatnggcacagatgaaggacatcaggganacagggaagagcgagtacagcaagtacgcaagaaattggaaggaagcctggatggcagacatcttgncgcgaggctggtgatacaggaagaggatggatattgaaatggcagtggagatgaagcctaagaatatgatcaggtaactttcgaccgactttcccaagagaaaattctagnaattgnacaaaaatgttcactggcttttgctgtaagaaaaaaaatgacccgagcacatagagcttttaatagcactaaccaatgcctttttagatgtatttntnatgtatatatctancattcanattttcatgtttntttttanntccaggacttaaaattagncttttntatatcaagcaggaccnaagatgaagctgagcttttgatgccaggngcatctactggaatgtagcacttacg

SEQ ID NO: 696501 - DNA, 460 bp, Homo sapiens
cgggtggattacttgaggtcaggagtttgagaccagcctggccaacatggtgaaatcccatctctactaaaaatacaaaaattatccaagcatgatggtgtgcacctgtaatcccagctacttgggaggctgaggcaggagaattgcctgaacctgggaggcagaagttgcagtgagttgagatcgcaccactgcactccagcctgggcaaaagaccgaggctctgtctcaaacaaacaaacaaacaaacaaaacactctcagtttgaaaggtagtgaatagggctgagataagtgtctcaggaaccaagtatttgttgtgatattcttttgcagttgtgttgttctggggtaggtttgcaattgcttcctcgaagattaatatatgagattagaagtggtggtgagcacatggacaattgtgtactttggagaattaccctttgttgcatgaatataga

SEQ ID NO: 696502 - DNA, 542 bp, Homo sapiens
cacgaggctcaccttcatctactgtgaagtgatgagaacaggacttgatagtggtgtattaacttatttatgtgctgctggatacagtttgctaatattttgttgagaatttttgcaaatatgttcattgggaatattggcctgaaattttcttttccactgtgtctctgccagaatgtttgtatcaggctgatgctggcttcatagaatgagttaggcaggagcccttcctccttgattttttggcatagtttcagcaggattggtaccagttattctttctgcatcttgtagaattcagctatgaatccatctggtctagggcttttgtgttggttggtaagttttttattactaattcaacttcagcgcttgatattggtctaggaggggtttctgtctcttcctggttcaatcttgggagattgtgtgtttccaggaatttagccgtttcctccagattttcttctttatgtgcatcgacttgagtgtaaacataacttatatgcactgggaaaccaaaaaatctgtgtgacttgctt

SEQ ID NO: 696503 - DNA, 247 bp, Homo sapiens
gagaggagggagcgccctgattttcttctccgggattgatagtccattggggaactcaactatttatttaaaattgtgtttcccaggaaatgagagttatgtatattcaactgtggttttgtgaatgtctttatatttatggtgttttaagtcaccaactttgcattataattatacggcaaattgtttattgctctttctactctaatcgtgttatagcacattgttattgtatatttaaaggcaa

SEQ ID NO: 696504 - DNA, 253 bp, Homo sapiens
tgttttatattttaaatggcttttgataatcgaagagggagagcagggtacaaaagacacttcttggccttagggatccagaactcatcacaaaaataaatattccaaaaacaacaatggaggggaaactcacatgtttgggctgaatttcaattcttcgtatgagttctgtattgtcccagtcatagaaggctaagccatttacagatctgactcccaataagaagccgccgtagatacctaaagtcgacgc

SEQ ID NO: 696505 - DNA, 375 bp, Homo sapiens
  misc_feature (48)..(48): n is a, c, g, or t
  misc_feature (57)..(57): n is a, c, g, or t
  misc_feature (89)..(89): n is a, c, g, or t
  misc_feature (119)..(119): n is a, c, g, or t
  misc_feature (173)..(173): n is a, c, g, or t
  misc_feature (333)..(333): n is a, c, g, or t
gcattgttcaccatggtcctagcttgatttttttggggtgtgattatnctttctttnctctctttctctctctctctttctttcttttnctttctttcgagatggagtcttgctctgtnacctaggctggagtgcagtggcacaatctcggctcactgcatcctttgcctctngggttcaagcgattctcctgcctcagccccccgagtagctgggattacagatgccagccatcatgcccagctaattttgtatttttgtagaaatggggtttcaccgtgttggccaggctggtctcgaactcccaacctcaggtgatctgcctgccttggnctcccaaagtgctgggattacaggtgtgaacaccaccacccg

SEQ ID NO: 696506 - DNA, 953 bp, Homo sapiens
ggaaccccaggaggaagcgtggtgagcggaggtggcgcctacgcgttcgggcttcgggggtctgcgctcgcggtttgcctggactcagcaggcccctggaaccatgtcccgcgccctgcgggcaccggctccgcggctctctgcgtttttccgttttgttgctggcagtgctgccggtgctcgggccgggggatacgagactatgcccctatcacgtgcacgtcgagagcagtgctgaactgtgcacactgctgacttcagcacagcagtgatcgacgtgggactggcatcaaacatcccgttggtaccagctatctttaagtgcgaatcagagaatgaccattccatgcacgtccggatgatgcatgaaacagtccatggatgctcgggtcaagtctctagcctatgtatggcaagatcccaaccgtacgcttcatattacgtggagatagcctatcttctctccggtatggatggcaccaagtcaggacaagatagtagccacacaaggaaggtcgttgcgagacctctgtgcgctcagggagcgtccatggaggttcaggcaagtggaggcgtgggctgatgaactgatgagggctagacatccgactacgggtgccattctgtggacctaggatgactacttggtgcttgcgctaacgtggaaggacacatttggcaatgatgggcgaacccgatgtgcgtctggcactattgagcccttctggaccactctcgaggatgcaggccatcgctgtctgcgcagaatggggcttcgacggcttcttcatttggcgcgccgttgaattatcaacgataacgcgggtacctatgcaggacacctggaaagatggtagcatcccaaggtacgtgccatgaacctcttctgaagtcagcgaacggaggaaccggttcccagagatggtgggaacgttggcgacacggccagggaa

SEQ ID NO: 696507 - DNA, 245 bp, Homo sapiens
  misc_feature (146)..(146): n is a, c, g, or t
tcaattgcatttcacagtgaacctctgcttcctcttaacagcccactaaaatgacaggcaagatgttttcacagggcaatagtcaccaagaacttgagaaagaagatgacagaactttgacagttggcaggcaagtggtcagagancagatctgaacctagaaagctgagaggtgcgtgtgtgtgtgcatgtgagtgtgtgtgtggtgtgtgtagtgtgtgtgtctgtgtgtgtagtgtgtgtgc

SEQ ID NO: 696508 - DNA, 471 bp, Homo sapiens
aaaactgttcccaaaccagagtttccagttattgttttgcccaacctggttgacccacaggacctccattattaccttgaaagggaggttacaaaagaatttggcaagtttggggccgttaaccgcgttcttattttcccaaaaaaacaaggcgaggaggaggatgccgaaatccttgtcaaaatttttgtggagttttccaaaaccttttaaacttataaggcccttccggccctcaatggccccttgttttctggccccaaagtggtgggttaaatgttccacccagagcgtttttataacaatgacctctttgggtgacagtggtccctttccccggacttgcccttgttccctgtttcctttgggttttaaaattaaacaatggtgtccccggggccaggggcgcttttcccaacccagccttcagttcggataaaggttcggattctgctggcccttaaaaaaaaa

SEQ ID NO: 696509 - DNA, 426 bp, Homo sapiens
gagagggagagacgcaggagcaacagcgttctgaacacctacactactcactgcggggagaatccggaagaccactgcatcccacaagcacgacaaccacgtcaggattctatttcctccactctaacccccagatccacttatgagaagtgagtgcaggcatggcaggggccatggagggtgcacagggacagcaaggatggtctgagggcctggacacaatagaaaatcttcgtcctttaacatatcctggactcagaaaacaagcgttggcagcaagcaggggggttgatactaaggtcagctatgtcaccccacttcccagctcctcattagaatacccagtcagccctggtcaggccagcaggagtactagggtgagaaaattctgaccaaggacagatgacccatccaacccctaagatc

SEQ ID NO: 696510 - DNA, 929 bp, Homo sapiens
  misc_feature (10)..(10): n is a, c, g, or t
  misc_feature (95)..(95): n is a, c, g, or t
  misc_feature (115)..(115): n is a, c, g, or t
  misc_feature (174)..(174): n is a, c, g, or t
  misc_feature (187)..(187): n is a, c, g, or t
  misc_feature (259)..(259): n is a, c, g, or t
  misc_feature (291)..(291): n is a, c, g, or t
  misc_feature (363)..(363): n is a, c, g, or t
  misc_feature (366)..(366): n is a, c, g, or t
  misc_feature (374)..(374): n is a, c, g, or t
  misc_feature (394)..(394): n is a, c, g, or t
  misc_feature (479)..(479): n is a, c, g, or t
  misc_feature (487)..(487): n is a, c, g, or t
  misc_feature (491)..(491): n is a, c, g, or t
  misc_feature (497)..(497): n is a, c, g, or t
  misc_feature (509)..(510): n is a, c, g, or t
  misc_feature (516)..(516): n is a, c, g, or t
  misc_feature (519)..(520): n is a, c, g, or t
  misc_feature (538)..(538): n is a, c, g, or t
  misc_feature (552)..(553): n is a, c, g, or t
  misc_feature (579)..(579): n is a, c, g, or t
  misc_feature (602)..(602): n is a, c, g, or t
  misc_feature (635)..(635): n is a, c, g, or t
  misc_feature (650)..(650): n is a, c, g, or t
  misc_feature (661)..(661): n is a, c, g, or t
  misc_feature (680)..(680): n is a, c, g, or t
  misc_feature (683)..(683): n is a, c, g, or t
  misc_feature (744)..(744): n is a, c, g, or t
  misc_feature (767)..(767): n is a, c, g, or t
  misc_feature (778)..(778): n is a, c, g, or t
  misc_feature (781)..(781): n is a, c, g, or t
  misc_feature (788)..(788): n is a, c, g, or t
  misc_feature (830)..(830): n is a, c, g, or t
  misc_feature (928)..(928): n is a, c, g, or t
atttattggngttgacaaaaatacataatacagaaaccaaaacaaaacacaacagatacaaaaccagaaaccccagcctagtgggcccatgtgcnttaggtactgacagtttgcngacccagattcccacaaagcatggcacttaattcatgaggacctccatctgcaccagcntcgcattggtgtncccagacgttcggtatggtatcattccagcaaaggtaatcagagttcgggcttgacttcggagttgagagtngcggtcctcgatgactcgctggggcctggatnacgaggatggactcgtccccttgagcctcttaaactgtgttaacaagacgtccatggtggcaagaagcactnctnacacgttntcccttatttcatcactcanatttctgaaggcagccactctctcttccacactttcctgatttaggggcaccagcttcaagcgctcaatgacatcaaaagctctntcaatatnaccnctatgntactcgttaaannaggtgntcnngtccaaaagaagacagancgtgcgagtccacnnatttttttgcgctttttccttgagcnctaccccgttcggcaatcgagantgccaagttcttcagcctctccttgttggattncggggcactaatctnggggacgacangactcagcagtttgttcancanctccagtaccttgtcagcattcttggcaaggtcatacagctttctgcctcttcaaacagtnctttattttctgccacacaagcnactttgttganaanaggcttngtgttattagtaaacttatctatcactccaggctttctactnccgtcattctctagtttcccaagaatcatatcgaactctcggctttcaatcacaagctcactcacacagcgcagaaacatgttttctccttgaatatnt

SEQ ID NO: 696511 - DNA, 81 bp, Homo sapiens
accgaggacacggccgtgtattactgtgcgagagatcctagcggcgtcgatatcgatgcttttgatatctggggccaggga

SEQ ID NO: 696512 - DNA, 250 bp, Homo sapiens
  misc_feature (77)..(78): n is a, c, g, or t
aaccccaacccaaaaagcttcattcaggccctgttttaaagccccagggtgggttaggtggtttaggaaacccaaannctccccccccacattttccttaatcccccaggccagtaatagccgaaacttgcctggtttttcctaatagactgtaagccctttagggacagggacagggttttatttatttttgtgtttttagggcaaagcctggccccctgttggggtttaataaagggggttgttttga

SEQ ID NO: 696513 - DNA, 146 bp, Homo sapiens
ttaaacccccggggaacccccctggtcccgggttggccaattttggggctttctcgggggggccgagaaaaggctttttccccaaaaccaaagggttttttttggtacaaaaaccccttaacccccggggttttttttctggggtc

SEQ ID NO: 696514 - DNA, 155 bp, Homo sapiens
caaaaaaaaagggggggtttttttaaaggggggttttaagggcccctttttgggccccccctttttaaaaaaaggccccggggtttttataccccggggccccaaagggttttttttttttttttttcgcccttaaaattaaattgtttggggga

SEQ ID NO: 696515 - DNA, 1324 bp, Homo sapiens
gcctaccgcagccatggctcgtggtcccatgaagcatcttgaagcgggtggcagctccaaagcattggatgctggataaacttgaccggctgatggtttgctcctcgtccatccaacggtccccacaagcttgagagagctgtctccccctcatcattttcctgaggaacagacttaagtatgccctgacaggagatgaagtaacagaagattcgccctgcacgcggttcattaaaatcgatggcaaggtcctgaactgatataacctaccctgctggattcataggatagtcatcagcattgaccatgacgggagatgaatttccgtctgatctatgacaccaagggaacgctttgcctgtacatcgtcataacacctgagtgaggccaaggtacaagtttgctgcaacccgtgcacgacaagatctcagtcaggcacaagacaggaatcccgtcactctgggtgactcatgatgacccgcaccatccgcatacccgatccctttcattcatggcttgcacctgataccatttcacattgcactttagcgagcactcgacacagatatactagaatatctcatacaacgttcccgacactacgctaaccctgagtgtcattggacgaacctgtgaggttgctctaaccctagtacacgcacattcgactgtgaatcaacaaaccagacaatcaggcacaccttggaatcccacgaccacagaaataccacagatgataccacacttgaccaaatagcgtacaccatgcctctagccccacataaggaacctaaccctaccacttgcccggccacactcgcgcacagtcgacctaccaaacccaccgtactctccctcacttccccggagtgacatgcggcaatcagcgcgctaaccaatcttctgttatgaacacttctcatatatcactttgccgtccccacgatagaccactgtgtataaaggtgtggatcctggttttaccttgtacgcacatatagaactattctaacacatacatacgagcctgagatcagactgacaggaaagtgacagctcgacggccggggaggcactctatgcccgagcatcgaagaagacgcctcaacacgcgaccttgcgtgatgccgccgggtgctgccgcgtcgtcagacagagggcctacgatcacggagcctgatgacgccgccgactcccgagtctttcacatcctatcatatgcccgctctgagtctgagtatgcgtcgatgcgtggtccccactcctgcccgtccgacgcgatccgacgacctctctcgcatcaaccctcccaccacacctaccg

SEQ ID NO: 696516 - DNA, 1188 bp, Homo sapiens
  misc_feature (1)..(1): n is a, c, g, or t
  misc_feature (9)..(9): n is a, c, g, or t
  misc_feature (32)..(32): n is a, c, g, or t
  misc_feature (650)..(650): n is a, c, g, or t
  misc_feature (656)..(656): n is a, c, g, or t
  misc_feature (658)..(658): n is a, c, g, or t
  misc_feature (699)..(699): n is a, c, g, or t
  misc_feature (776)..(776): n is a, c, g, or t
  misc_feature (1038)..(1038): n is a, c, g, or t
  misc_feature (1147)..(1147): n is a, c, g, or t
nttagaagnctcagttcatcactcaggctggnattcggtggcaccatcttggctcactgcaacctccacctcccaggttcaagtgattctcctgcctcaacctccagagcaactaggactacaggctcacaccaccacacctggcaaattttttttttgaaatgacaacgtctccagcccagctgattctgtctttaaatggtggataattcccaaagtacacttgcccttgggagtagtggcaaaatgacacggtggtgtcggccccctctggctggaacctccaggagactgaggtcaacccaccagtcgtattagtagacttgaacttgcaggtcagcttcccttgtgtaccatttgccacgaagatttcttttggtaaatatacttccaagactgatactccagctgtcaagagccccagcgccaccgccagcaccgaccacagccagcgcctcctgtctggggctgcaatcactgccccggctccagcgggcgctgccatcatccagccactgcagtcgccgctgccgcgcccctgagcccgggtccctgccgaggttcgcttggcttggggaagagggttctgatctctctgccacctgcactgggtggcaacgccacgccgcgctccctactctggccccagntgtggntngccagctctgcactctagcctcatccctgctctggcacatntgctaaatttttatgttaaaaagatggggctcgtgcctcagcgcggactctccgccgctccctttaggagggtaatnatgacctcgctactgactcctggtcgttgtccgctgagcgaccgaatagctactcaaggggaataaggtattccgatcccgaatatgagcacaactgtcgcccagtcatctaggcagcaccgccagttgcctccgctctctcactcccctccccgatatatataatacccccgagcaagcgcgagatcccgcgcatatatcaccgtttcgcgtaattgctgagctatcgtccaccctcgtgagaaccgccgcctctcatggnactgcgctccactcagcgtataatatggcacgctctccacgctgcgcgcgcgcggcgcggtatttacgctcctcgcgttatcacatgccgccctgtaatacctcccgtncctcccgcgccttctcgcaccgccctcgtatgtgtacgccc

SEQ ID NO: 696517 - DNA, 101 bp, Homo sapiens
gggagtgcgagatccgctgctgctgaggagaggagcgtcaacagcagcaccatggctaagaaccttgaaggctatgtgggatttgccaatctcccaaatca

SEQ ID NO: 696518 - DNA, 200 bp, Homo sapiens
tgcactagtgaatgtgctttgtcatggcatgcgtacttctcgttcatttacatccataagtctcacaacttctttataacttagcacctcatctttcattttttatttgatagcgactgttttcttcaacttccctgaagatataaatcagcggtttaaacaattcctgtattttctcatgtaaattttctttttttagc

SEQ ID NO: 696519 - DNA, 407 bp, Homo sapiens
  misc_feature (22)..(22): n is a, c, g, or t
  misc_feature (64)..(64): n is a, c, g, or t
gactcacctaaagggaaatttngccctcgaaggccaaaaaatcgggcacgagctttctttcctntttttttttttcagaagacaaagcctcgctctgttgccccaggctggagtgcaatggcatgatcttagttcactgtaacccaccgcctcccgggttcaagcaattctcctgtctcagcctcccgagtagctgggactacagatggtgcgccaccacgtgtggctagtttttgtatttttagtagagatggggtttcaccatgttagccaggctactctcgaactcctgacctcaggtgatccacccgcgttggcctcccaaagtgctgggattacaggcatgagccaacacgcccagctaatattcattttctaagaccatttctcaaaagttgatgtctatc

SEQ ID NO: 696520 - DNA, 138 bp, Homo sapiens
aggactagaggcatgagtcacggggcgcggccagtatatggtctctccatagttttcgtcagctcacacaggggcttcgcctctgtcaggactccccctagcaacgagaatcttccctatcgtcccatcagtattgca

SEQ ID NO: 696521 - DNA, 282 bp, Homo sapiens
caatactgtcctgtgagctgggtgaggtatgctggtgctctcccatcaccttctcccggccccacatgccttccccatgggggcggggcaggaggctggaggaacacagcttccccctgttctagcagagaaatgctggctgtatgcctcccctagggttcccaggctttctagggtgtggctggacttctgatggagcccactcatgctgggccgctggcacaggggctttgttggcacctagtgtcgcgatggtactcagtgccagtgtgtcaggattcc

SEQ ID NO: 696522 - DNA, 1011 bp, Homo sapiens
tctggcatatctgaccgacgtcgtcccagagcatagttgacagtcctccgggtttctcttctacgtcatacgtcgtcttgtgtcgtggtctttcgtctcgagcagttagcagaatgttccccttgatatcgtagctctccatcgacaggaggctacgttaagcgtgctccccttacgcctattttagaggcataaggggatttctggatgtcgctggcatggttcctggcggcttgcatcattgttcttgtctactcagctcgcagtggtacctctccaatgacaaagttaggtgagcttttgctcggtttcttagtctcttattggagcgcaccaggtcgcctacatgtcggagccaccctttgggaaatgaacgcacgagtatgtctgcatcctttgttggcaccgcccatgggggactgacgtgattcggactacgacgagatgaagggctcattgttgactgcgggtgcatatgccatcaatggtggcaatcctcgagacgggtagttggctctaatgcacgcgaggggtccataaagggcctggtccaagaacgaggtgtgacaccaatggagatagtggaaacttcatcatggtgccctgagagttgggatccaatagcctcgatacgccatcccgttcctagaccaccctcaacgatttctcgggaactaagatcctcccatcacgtggcctccccgtgcagtggaaatacgccaaacgtggctacagtggactgttcttcaactgctccggttcgattgctgacactcaagtgccgccagggacaggtcaggaacgctcccacacccatttctggaatgaggggttggaggaacggctgacgctgagcaaaggaccgatctctgctctggtatggtggggagggagcccattatacaagagacccctcagggctcatgtgatggggtgatcacacatcttggggagtacgtggctgtcactgccacgaggtgagagggtttggagagaagctacatgccttta

SEQ ID NO: 696523 - DNA, 835 bp, Homo sapiens
gctgcgtcgctcctgggagctgccgacggacggagcgcccccgtccctccgcctcggtctgtcctggtacgaaacgtcagtcatgtctacttattctgacgagatcatatctgtcacccgcctaccgtggaagatctgcgcgtcctatcacctagagttctgtgagtgctatggcagtcattcccctcagtgagtcctggatgtcgcatcctaggcatacataccatcgtatccacttggttccccgaggggtctgtccttggatctcccccgccgctatgcctatgttccaatccggtccctgttgtaacggcgctgttgttccagccactgcactgaaattgggtaacggtattaacccgtcccctgataacatgaacaggggtaaggttacaccttacgctatggtaccaccttgttgcggaatccggttacaatcctgtttgctgcctggcgattcctcggttaatgacacccctaaacgggttggctcccgggataatcgtgttgccatttaacgagtaagaccccctacccccgtgtttgttggtgtccactcccaaaaaggggccggccttgtgttaatctataataccgcaaaaaggtttcataacagttttattccgaaacattccactcagagaggtccctgagtttcgggggcccgcacttttattggaacagcggagagaaccctcggagagggagcacgggtagaggcaaggccaatcagtggtgtcggaaacacacagcaggtggaaactgtggctcgtgtctcaaaaggcgcgggaaatcgtcgccccttgtgtgttcgaggctctaagggggaccaaag

SEQ ID NO: 696524 - DNA, 546 bp, Homo sapiens
gttgatcaggtttttttaagctgtgaatgcaaggggttttgaaatgcaaaatacttaagctgtgaaatgcagaagcctgactcctactctgattctatggttcatagagtagagtgtgtggtccagcaagaggctgaaataagagtggaaaatgctgcttatgtgtccccttctgggagattcatagcgctcatgagcagattgaaaacttagccaagagaacttgggaaacttcgtttaacttttaaccaagtattgtagagaggaaaatcacttctcaagagttttcacaaaagtgttttgttgattcatcaaaggcccgacctgaaataagacaaaaacgcttcatttctgtcaagtaagccttctttattctgctggccaggaaggtaatgattctaacaaatttgtgttgggatacaaaaaaagaaactggttgggtgcagtcgctcacacctgtaatcccagcactcttgggaagccgaggctgacagattttctgagattcaggcgctcgagaccagtctggccaacatggtaaaaccc

SEQ ID NO: 696525 - DNA, 566 bp, Homo sapiens
cagaccctccccacatctgaaactgcctccccccaacacagcagcagcagggccctcctcccccacagtctccccacggcccctcagcatcactggacgaccgcaggcggggctaagccacccctcaaacccagggccccctggcacctggcgtctggccgtgttttctggccagaggcccccaatatttcctaactcgtgctccacttccgacttcataatacccgtactgtgaagaaagaactctccaccccagctccccacctgaccctggactagggtggacggaacgtgttgccatccaaatcccacagaagaaaccaagcccacctctagctagctggcggtggcgacctagacaagctgtagaccaagacagggggtccacgaggtgagcatggacccacacgtgggcctaccacgactcagcccccaaccacgccttcaagagacgaaaacaaggcaagaaccaaagccgaccacacccgaacaccacgcacagtagaggggaacaccacaggcggggaccaaaggacaaagcagagccgactaaccgcccaaccaca

SEQ ID NO: 696526 - DNA, 332 bp, Homo sapiens
  misc_feature (262)..(262): n is a, c, g, or t
  misc_feature (266)..(266): n is a, c, g, or t
gcacgagattattatgcttccacagcatgtcaagtttatcttattatctgccaccgttcctaacacttatgagtttgctaattggattggaagaactaagcaaaaaaatatttatgtcatttccacaccaaaaagacccgttccattggaaataaatatatgggctaaaaaggaactgataccggttattaatcaaaattcagaatttttagaagctaatttcaggaaacataaagagattctaaatggggagagtgcaaangggnctccttcaaaaactgacaacgggagaggtggatccacagcaagagggggccgtggtggatccaata

SEQ ID NO: 696527 - DNA, 397 bp, Homo sapiens
ctgtgccagaaaacacagattaggcagcacagagtcttcttcatttgggaaaagaatgagagagtgaatcgggccccgctgtgggagctgcagggcgcgctgctacagctgcttcagggaatacatattctgtagggtggacatgtgggcatgaaatgcggcctacagaagtcttttgcagcaggggcatccagaatgccctttgatcacgggcctcacgcctggtggagggaggggtatagctagagcgggagatcatggtggtgggacctcagcctccagctagtgatagaggtgttatggggagtggataagacccctccttggaccaggagtctggggtgagatgtgcagaaatcaggacagggctggtgagactggatccttcctcccccag

SEQ ID NO: 696528 - DNA, 122 bp, Homo sapiens
gtccaaacagtgccaccctatgtaccactaggaggcggcagaatctcattgggttaatctgtgtttgtctttaaaaaacaaaaacaggccgggcgcggtggctcacgcccgtaatcccagca

SEQ ID NO: 696529 - DNA, 283 bp, Homo sapiens
ccttttttttttttggggggggggttaaataaagaaattttttttcctcctctccctttttttttgggccctccccccctcccttttttgccaggtaaagggaggatgtgctatgagtttgcaaaaagggggacggtcagggggctttttttccaaaggttcctctttggcctccccttcccctcctttcccctccttttccttccttccttcctttccttggagcattgagccccatttggaaggttgagagaaaccaaaattaaagagagaaagagaggga

SEQ ID NO: 696530 - DNA, 92 bp, Homo sapiens
acacggctgtgtattactgtgcgagagactactatgatagtactggttactactacgtaggggcctacttggggccaaggaaccctggtcac

SEQ ID NO: 696531 - DNA, 431 bp, Homo sapiens
gaccagcagcctctgtggggctcgtgcatcgggcttgggcttctcccagcatggtggtgaggatcagagagagagcatgccaaaagcaagcaatccaagagaacgagaagcaactgcatgacccttccatgacctagccttaaaagtcgtaaaatgggccgggcgcagtggctcacaactgtaatcccagcactttgggaggctgaggcgggtggatcatgaggtgaggagtttgagaccagcctggccaagatggttcaaccccatctctactaaaaatacaaaaattagctgagtgtggtggtgcatgcctgtggtcccacctacgcgggagactgaggcaggagaatcgattgggccggggaggcggaggttgcggtgggctgagattgtgccactgcactccagcctggcaacagagtaagacttca

SEQ ID NO: 696532 - DNA, 1638 bp, Homo sapiens
  misc_feature (162)..(162): n is a, c, g, or t
tataaaacccgggggacccttttcttaaaaagaaccctgggacaaccctaaaacaatttttgctataggaaaaaaaaagggggggaatttctcttccctccgaacacgtgtttcttctgagccaccgggtcgtcccacgtgtggcaagtgcgcctcaacagncgcgtggtgtgtaggtggctctccctcctgtgataccctccccccctacgtctgtgagcggctgccttgacggtctcgcgagcgtctccgttgtcgcccccgcggattcttcaacagattgacagcgctctgtggaagccaacaccgatgatatgtggaaaaccaccctgtggttcctctatatatgccacaagagacgtcgttctacacagaagacacacaataaacagaaacacaaccgacgcctctgtgtcgcgcgcgtgcgaggcataaatcacgctgtcgtgcgtgtgtcttctccccccccgccgcaactcagctgtgtgcgcgagcgagtgcataacgcgtgtgtaacacacatatgtgctgtgtgtgcgacgcccccgccccgagaagaggatgttttctatccgcccgcctgtgacagaagacaacagccgtgtcgtgtagtccaaccctgcgcggagcgatgcagcgcgacgagccctcctacaaccacgcagcgtcgatgtgcggcgaccacaccacaaccacagtcgatgtgagaaccaccccccgatgctgctggtgtcatcaacaccacaaccacaccaccacacacaacaacacaacaccacaagtagcggcgtcgcgcgcgctgctgctctacttatttatttaaatgatgatgtccatcttctgctccgtctgtgtagatgacgtgggtgtctgcactcaccagcatcttcctctttttcatgctgtcggtcgtgctctcgccagtcgtgagtggttctcctgctgttgctgtctcgtgccccccacaccacggtggcgctcgcgctccgccccttcttttcatgctctgtcgtcgtccacggcgcgctcgtcctcgcttctctctctcctcgcccggcccctcgctctctctgcgcgcccgccgtccgcgcctgcgcgcgccgacttgcgctcctctgtgttagctctccgccactcccggctcgtgttgctgcgttctctcctctggctggtggtcgctacctactcgcggtccgcgtcgctccacctgccgtctccgggtcggcgcactcactctctccgtcctccgtggagcgcgcacgcgcggcgcgccctccccttctccgctccttatccgtctcgggcaggctgacggtcgtcgtcggtcgcgtcccgctcgctcctctcctccatcgtggcagcccacccaccacccccctccgtctcgccttcctcgcccgcctggtcgctctcttcgtctccccccacgtccctcgccgccggggccgcctctccttctctccagctccctctccttcctgacgcctcgcctctcccccccccgcggtccgctccccctgcccccgcccccgcgctgctccctcccgcctcgcctcctccccctcctccgccacacctccgttccccctgctcctccgctgcctgccggctgctgcccccccctcccccccccccccc

SEQ ID NO: 696533 - DNA, 372 bp, Homo sapiens
aacccacttccacctttactaccagacaaccttagccaaaccaatttaccaaaataaggtataggcgatagaaaattgaaacctggcgcaattagatatagtaccgaaaggaaagatgaaaattattaccaagcattatatagcaagactaacccctatacctctgcataatgaattaactagagtactttgcaaggagagccaaagctaagaccccgaaccagacgagctacctaggacagctaaagagcacacctctatttcgaaattagttggaagattataggtagaggcgacaaactccgagctggtgatagctggttgtcaagatagatctagttcactttaattcccacagacctttaatccctt

SEQ ID NO: 696534 - DNA, 301 bp, Homo sapiens
  misc_feature (120)..(120): n is a, c, g, or t
ctttctttctaagtagagacagggtttcatcatgttggccaggatgatcccgaactcctgacttcagatgatccacctgcctcagactcccaaagtgctgggattacaggcgtgacactngtgcccagcctcttggaaagatttggattcgcttcatggagccagggagcaggacataggtgaagaacccagcttgtggctcaagttggcctgaatagggttcgaggccctgctcccccgggcctctttgtccatgtgttcaaggaaaaaatttgggaagttcccaatttcccaaaaaagg

SEQ ID NO: 696535 - DNA, 281 bp, Homo sapiens
ttcccttgatggtttccagctatgatcagaagactttaattaaaaattttcctcccataaggttaaatagggaagttttttccacaggattccaggggggccccccccatggtggaaaaaatagccctttaaatcctttttatattaaaactctggaaaaaagggataaggcccttttttaaaaatgttttcccccaaccctaaaaccctaaacaagttgttttaggaacaaaacatgagaaagatgtttatggaggtggaaataaaatggcgtccccaga

SEQ ID NO: 696536 - DNA, 662 bp, Homo sapiens
aatcctagcacttatgggaggccaaggtagagagatcacgaggtcggcaattcaagaccagcctgagcaaacatggtgaaaccccgtctctactaaaaactacaaaaaaattagcgtgggctatagtggctggcaccgtgtatatcccagtctatctcggagaggcatgaggcgaggagaggtcgccatgaacctgggaggtggaggttgcatgtgagcgtgagtattgtgccatcgtgcactccgagccgtgggcgagagaagtcaagacgtccctcgtcaaagagaggaaatttttttagtgttgcaacccacatttttatcttcctcagtatttatagagtgtatatcagtgttctttcttaaagaggtgtttagaaatccagtcttgtccaagatctcaaaacaacgcagtctataattatagacaattattctcggtggctccgaaaacaattctattggatccttctcccaactttctaatcctctcagtgaacgcgggcacaaagtgtattcatactccgtgacaccaaaaaattagaaagggaaacaagcgtaacgtgcaggctacttcttggggttttaaataacacaatatagtctagcttaaaagtgcacaggtgggtctgtggatccaccataaagaatttcacaagtaa

SEQ ID NO: 696537 - DNA, 278 bp, Homo sapiens
ttttgccactgctctaaattcctttattatacagttttgacagccactgacatttaaaaagcatccaattccattacctaagccatccaccttctctgttcctcaacctgagttgccaagcactgctggaagaatggcatgttcatgagtattgatgccatatccattcattgtgtctagttcctgctgatctccaacactgcctagctatgtgtcctttatcagctcccttctcaattctaaactgaattttctcaaacttcctgctgcacgtcgac

SEQ ID NO: 696538 - DNA, 209 bp, Homo sapiens
ttcaggtaacttcctttccgtgcagttctgatgtagacctggatggagagagtttctggaggacacccccgttctcccctaggaaaggattttttctgcattagtaactctaaagtatatttccaagtgtcgatttcccaggaacccccttcaatgatctctaaacaaaggttcttgcttcagatgctgtttccttctggtctcgacac

SEQ ID NO: 696539 - DNA, 764 bp, Homo sapiens
tgtgtgtgtgtgtgtttaacagagaatatggccagtgcttgagttctttctccttctctctctctctttttttttaaataactctttcgggggaaggtgggtttataacggcctgcgccagggtgtagacgtgtgggtgaaatacccaccactaagagtgttgatagagtctccatattttctccattgtgccttcttatgtatttacagagattattcgtgtgcactttaaatttacttaactctaccataaagctgcagtggtgacttttcccacacacgggattgagagggctcttaacttctataagtaataggggccctcgttggatgaactccatataagcagtctattatgtctctataacatatcacacctactttttaaaaacaatatacttatcactatttttaattaggggtgggctcctatataaatttttcttagagattaagaaaatttaagaccccagtagaggtgacgtgtaagtgcaactccaactgcgagttatctcacacatatgtcgtagtatagtacatatccaggggctgacacgttgaacacaactatggccggagcagtattggtcaacaccgggaccaccgggtagaaatgcgtgaacacggggactcgacatatgccaatatgccgcgggcgggcagaaatgaaactcctcaagccaccaggattgctacaccaacgggcgtgcaccgtgggccccagagaattgacacccacctttaagactgcaccggtcgcgacc

SEQ ID NO: 696540 - DNA, 263 bp, Homo sapiens
aaaaacaagcacacacataacaacatataccaaaacacacacgcacaaaacgtacgacatccctcacactcattaatcatatccatcatagcaggcagtagaggtggattaaaccaaacccagctacgcaaaatcttagacatactcctcaattacccacataggatgaataatagcagatctaccgtacacccctaacataaaccattcttcatttacactataatataatcctaactactaccgcatgcctagctactcaa

SEQ ID NO: 696541 - DNA, 148 bp, Homo sapiens
aatccctatacttctgcataatgaatttactatataactttgcaaggagcagccaaagctaagacccgccaaacgccagctccaccttactaccagcacaacgctctagccaaaccatttatccgcaaattaagtactagagcgatat

SEQ ID NO: 696542 - DNA, 421 bp, Homo sapiens
  misc_feature (210)..(210): n is a, c, g, or t
  misc_feature (285)..(285): n is a, c, g, or t
gatcgaaggtctgcctgttcaattggacggtaatgttaacgagccgttcttctacatggtacgaggtgctggatatccccggtgacttccacccgcttctgaaaggtaagtcagttaagaccaccttcgggttgctgttgtttaacatcatcctgatctgggaaccgtttaaaggaacagttgattacgttaaccgtgaattcaccaaanggttctttgaagacctcttccgggaaatcatggtggacaaccctaagcaaggggaagttgttcctcagggtaaancgtcagtggatgaatgcctcatgttcacccacaactgtaacttcctgggaggcttggggactcacttcatcaaacccaggcggtcctggatgcccctgacggttagaccccagaagttattgcgcctgcgccgatc

SEQ ID NO: 696543 - DNA, 1041 bp, Homo sapiens
  misc_feature (436)..(436): n is a, c, g, or t
tgttttcttttgatgttgtttttttttctgtgggttgcttgttgtctttggttgatgtctcctttgttgagtcgattatggcttgttggtcttcttgtcttcctggtgattttcctgatgccctatgtttgtgcactgattttggggtatgctattttgattgacccctcttttgtttggttccttcccggactccgtgattgttcattttgtcctgccttcccgtattttgtctgttcatgttcgctgtcgatcgttgctcctcttccttgtcttggtagccctcgcgttttccccccctatggcgagtccgcctggcctcttgctgttctgttgtcttccaatgtctcggtcttttccttctggtttcctgctcgttgctaagagtcaccatcttttccttggtattttttaatttgccacagatcatcctgtngtgttttgcttctctctagttctcgcggcgtatttcttattctacttatttgggacgtttacttttcaaatctattccaccccgtataaggagccgaaagtggagaaagtgacttattagcgatgcaattgtgaggataaatggatgtaaattcgactcaatacatgactgaagtgggatttacaatacggtctatatggagcaaaactggtatatagggcttaggtgtttatggtacttcatggtagtttatgcacttttgcgcgctcagtgcagttatatggtcttatctatcctatatgcgcatcacacctttataggtagaaatcgctaattgagtatatgtgcttatgcagtcctctggtcttgtatcaatgggcggatatcgtctcccgttgccatggcgttagggaattgtgtataatgtttttctagtataatgttgcaacgagctaaggacaaaggcgaaaggtacaggagcaagaggaagggcgcaagcgagaacggcgtcaggagtaagggaaaagggaaaggagaaagcagaaaggagcaagggaaaggagaaaggagaagggagcaaggttaaggaacaaagaaaaataaaa

SEQ ID NO: 696544 - DNA, 899 bp, Homo sapiens
ccgagcggggcaacaacagcgagaagagatgcagaaacagggcgggcggtgtgccaaaaaatatggtggggccccaaaaagggtgggaaataacgtgctggccggttaaatagcggaaacctccaataagggcgagttgggctcccaaccccaggccggcgttccggaggcctcacacggcctggtcaagcgcaaacctttgggtgccaagggacacctggcttgcctgggagttttccgggtcgcgcctttggttataataagggatcctaactccccccggccttaaaaaattggggccagaccaatttggcctcggaagggaccagacaagcccgggaaaaattggggcgaaacagccaacggggggcaacaaaatggccccaccagcccgggaaggcgaaaccctctggtcccaggcaacttgcggagcacctaacaccgccggtccaaaaagggtctccaccaccaccgccccgtatagggataaaggcgtttctccccctgtgggcaccgccggagtaacaccattggtcccaacctacagcgagaacacttagtgactattggacacaagtgttgtatttcgtcggggagtcactcggaagatacagatacttcccctcttcggttagtacacgaaagaagttggttttcagaaaaacaagggagggacggggatcttctattgctgggcgccccccagagaggtttcttatccaccctctctggaccctgcggcatgagaggcattcccgcagacgacgcgtttggaagaatagacgccggtcgcccggtttatgtaaacaactcgggccctgcatgaatggaaactgacacgggctattacttctaaattgaaatttgccccttccaaaaaagcccactgccaacataaa

SEQ ID NO: 696545 - DNA, 107 bp, Homo sapiens
ggacccccgcctctatatacctaccctactccattgtaaaaaccttattcattcttatagactcaggtcaatgactgccttctcgggggcaggtatgatgaaggacg

SEQ ID NO: 696546 - DNA, 925 bp, Homo sapiens
  misc_feature (132)..(132): n is a, c, g, or t
gctatggccccctcctaaatggcgtccacaaaaggggtccccctgcttcccgtaatatttgtgctcggctttcctccttggggaatataaaaaccacccagtgcgtgtcggggtaatgtttttggcaggccncacatattattgccacatacccggtcttatatatattgggtttatacctacttgatgctttacctttccttgttgcgcatagacaaatgttcttattaacacggggtggacactcgccgctgtctcatgtatccccacacaacgcacggttacaccactcgcaattaatgcattaccacaacgggcgcacacaaaattcaggtgcacaacatttccgtcttagtttaacacccataatatatatggatatcattcttctaccgccactcacaagcttaagtgcctatagcagcttaataactacctaaaaagcttctaataaatatctatgatattctcctctcaccccctcccaccatacataatgagtgaagataagggtcctctcgtccgcaatacaataatctcctcctccagcacaaatttctctcaacaagcttgatcactcaatatgaatattatatttctggagactatcatatgctcgtgcgctgccaccgtcttccctccatccttaaattagtagtacatccgcctgtgtaatactcttcttacagtacaagtggataactcaatagatgacagggaggttttctgcgggggcccaccacaacagagatcagtagtgatacggtcaggaacaaaatacactatctgatgcgactgggttaagacttcttgtcttcagtgtaccgcatctggtgtcagagagccgcctacccgaaacacaacaagacggcagaaggaacagttaccccctcactcatataacaaaaaggatcaacaaacaacc

SEQ ID NO: 696547 - DNA, 374 bp, Homo sapiens
  misc_feature (326)..(327): n is a, c, g, or t
attccagctcccttttactggagtctgtggttgtgtacaggtatgggccaagtgtaaaatctcatccattttaagaacactcgggaaatgagtaaagaaaatgtaaagttgctgctagtcaaatcttttggaaagaatttctggaagtggtcactttaaaaattattttccacccttgcaaaattgccacatttaaattgttttactggcagttctatagtagtccagactttagaaaccaaacacaacaaaatggcttgttgccaatatggccacaccaggcccatcaaagacgccggcaccaccagccagaatagttggttttnnaaaaaaatgaagtcttgaatgctgtgtcaagaaccggcccaaaaaat

SEQ ID NO: 696548 - DNA, 312 bp, Homo sapiens
tgcgataagggccaatagggatacttcttcttgtctaataaggattatctgggaaagcttcattcaagtcctctaatggtcatctgatcaaagtggaattgagttcttcatcttctccatctctttctcatattctacaatcctggccttggagagagacacccacgtcaggacaagatttcacatcttctttttcttcggcatccaccgtggtgtaatatttttatcctcaagcacgggaaccttcagcgcattaaacttcttctcaaagtcatccaccaagccagccttggccacattggccttatcgag

SEQ ID NO: 696549 - DNA, 2396 bp, Homo sapiens
tcccacgaggaataaatttaagaaaatatttgtaggacatgcacattgataacaagccctaaataaaaatagaggtggactttgctcatggagtgttacatcagttctcccaaaactaattgataatttcagtgcaatctctggtaattatagcagatttttttttttgtggaaattgagaagctgaatctaaaaccgatatggaaatacaaatgagtaagagtagccaaaacagtaagttactcatcccagtattaagactgtgcagctacagtgatgagagtgtagtgctggtaagaggactggcacgcaggccagtggggtggaatggagcccggaaagtgaaccacaaacttttggttcacagaggtaccaggataattcaagggggaggaattgtcttatctacaggtggttctggcaacagagtattcacaggaaaaatggtgaacgttaacccttgcatcatatgcaaaaaattatttgaaacaggtcataagaactaaaaccatcaaacttctaggagaaaatacagggaaaaatctctgtggccttgaccatgcaaaaatttcttgggacacaaaaagcatgagccacaaaagaaaacgttgataggtgggatctcatcaaaatttcaaactctctttctttgaaagacagttaagaaaataaaaaggcaagccacgccctccaaaaatacatgcagtacatatacaggacaaaggacttatttctagaacctgtaaagaactcttagaactcaataataagaaaacaacccagtaaaacaatgggcgaaagatttaaacatgcatttcccagaaggtatatgagtgggcattaagcacacacagggtatcattatttatcagggacatgcaaattcacccatgagctacctgaacatacttgctagaatggtcaaaatgaagaagagacagtcttcattgttgataaggatatggagcagttgaaacgctcacacgttattgataggaatgtaaaatggggccgggtacagtggctcatgcctgtaatcccagcactttgggacgccgaggcagtcggatcacttgaggttaggagtttgagaccagcctggctaacgtggcgaaacctgtctctactaaaaatagaaaaactagccagacatgatggtgaacgcctataatcccagctactcaggagactgaggcaggagaatcactggagatggggaggatcacttgaacccaagaggcggaggctacagtaagcagcagtcgtgccactgcactccagcctgggggacagaatgaagctctgccaaaaacaaaaatagggaatgtaaaatggtaccattgttttggaaaacagtttggcagtttcttattaaggtagacgaacacttccatgtgaccaaacaattcaacttttatttccccaagagaaataaaaacctatgtccatgcaaagactgttactactttatgtataatatcaataaactgaaaataaccctgacttccatcaagaatgaaatggatatttggtatgtttgtagcagtggagtgccacacagcagtaaaaatgaatgattattaatacatacagcagtatctatggatctcaaaaacagggaaagaggccaaacaatgaagtatgtgccatacaatttcatttatttgcaattctagaagctaaactaatccatagggacagaaggcatgtctgtggttgcctggggttgggtgtggagggaaagactccctaccagtgggtacaagggaactttctgggcatgatgagaatattctgtatcttcattgtggcttgatgttatgtttgtcaaaactcattgaactctacacttcagatgggtgcattttaccatatatgtcatctctcaataaactgaattttttaaaaattaaaggaatttacttaattgcaaaagaggactggaaaggaaaggctgccgagcatcttggcctgctgtacccctcttccttcaaaggagggtgtggccacgtccgacagcagagttgaatgaagcctgcatgcttgcacaacatcagaactgtcagaatgtcaagatggaatactttcaattgagttttacaaaaagacaagaaatttgctgggtgtggtggcgcatgcctgtaatcctagcactttgggaggccaaggtgggggaattgcttgtagtcaggagtttaagaccatcccgagcagcaaagtgagaccctgtttttacttaaaaaaaaaaaaaaaaagaaaagccatttagaattctaaggtgaagctggacgtggtagctcacgcctgtaatcccagcagtttgggaggctgaggcaggaggatcacgagctcaggcgttcgagaccagcctgaccaacatggtgaaacgtcgacgc

SEQ ID NO: 696550 - DNA, 127 bp, Homo sapiens
ctatgctagtggtgagtgatgatctggtcatggattctgctccgggtagttggcaggtgatcttgaatctgacttgtgatctaccaactctggctccaaaatggtgggattacggggtgaagcacgt

SEQ ID NO: 696551 - DNA, 321 bp, Homo sapiens
gaaccctcagttctggtaattgctcacacctttcccgggaaacttatgaataatctaccccttgtttagcatataatcaataaataaccataaaaataggcaaccagcagcccttggggctactcttcctatggagtagccattctgtatttctttactttcttaatattaactactttcactttgtggactcgcccgaattcttttcttgagcaaggtccaagaactctctcttggggactggatcacgaccgctttctggtaacaggagcaatacaaatgggctattagtaaacggacgctttaagtaactctagtaca

SEQ ID NO: 696552 - DNA, 809 bp, Homo sapiens
tggcgtggcgtggcgtgatatagggtctagacgtgagtatctcctgccaggccagcatgcgccttcggggtgccgcggctagacaggccagtgagtttgcggccaggacaccgggttggttggtctgtagagtcgtgagcgctgagtgatgcaactgatgtctagactgggtagccctgggtggtgcccgtgccgggctgggactgttgctgggtaccgccgtgcggccttggattcctgatgcctctcctttacagtgcaggcgactgtgaagactgcgatgcacaggcgtcatggcactgccaggacacggagctcctgcccaatctcccgtgaggatgtactagcgcagagcattcaggacttccgagacagctcacagtgattgcctacctgacggatgctgtcacaacacgagtgggagcgtgtgagatgcctctagtgctgactcagtcttccacggaaaggacaagagactggtgctgtaacgtctgaattttgtgctagaccagccttgtggtctgctgacggcgtgagtgtggaggagctgagaagcagcctgcgagggcttgcgggggagattgttggggaggtccgatgccacatggaagagaaccagagagtggctcggcggcgaaggtttccgtttgtccgggagaggagtgactccactggctccagctctgtctacttcacggcctcctcgggagccacgttcacagatgctgagagtgaagggggttacacaacagccaatgcggagtctgacaaatgagcgggactctgacaaaagaaagtgaggacgggga

SEQ ID NO: 696553 - DNA, 723 bp, Homo sapiens
tgggggaatggtggtgtattttctaccacttgtgtattgggaaaacctgtatggcagtgatttattcatattattcctgtccaaagccacactgaaaacagaggcagaaactatgtactctgggtgtgatctcttgtcctcagtgtctcttctagggctcctgtccctcttgctttatagctagctgcccggtggaccaatggtacagtgtgaaagcaaggtagcagcttgcgggaggaggcctgtctgggcttaccagtctatacactggtggcctcaacctcccagacgagggcagagaactggtggggcacgctcgttggcgtttctaaggcatgggctgggaaaaggtggggacgctcattggatagactcatgatgggaaactatttttggaaacaggcttcctccttcaggagagatcatggcggactaaactggtgagcaatcccagtgcacctgggcagtagatcctttctcttggcaaagtactggtctcttgggtctccagtaaggtgggaccaccacatgacatcatttccccgggaaccgtggtcactggactaacacagacaatggggactccagagcctcaagagccaggagagggccagtacatacagagggagtcgatggggactccatttgagtcctgccttccgacactcagaaggagcccaggccggagtgtcagggctcggctgggggattgcggccaaaagc

SEQ ID NO: 696554 - DNA, 718 bp, Homo sapiens
gacagaaatcgcatgttggacatggtaagagtgggtgtgtcggaatatgatactgtgtcgagtggccttaagagccaacatgttattaacatactttgtaggtattaaaggttctctgtactttctatatatagttaatatgttgggcactaatacgattgcttgcctacttgttaaaaccatttgatcagaagtacttcacagatatgttggtttagaagtaaaagcaggaataccaagtattattatgtcagttgaattttgtgcacttttcaaagtggtaactgttaagatgtagggaattatcttaaagcataaaaccaaattttgatcagtttaagattattggttgtttgtgaacccaactaaaaggtgaaacagaaatgtgtgtacaattttaaatggtatatgtcacaagaaaaaaaacttgattttttacctgtggggccaaacttttttatgagacagtctcgctctgtggtccaggcaggagtgcagtggggctatctcagatcagtgaacccatgcgatcttgggttcaagcgattgtctgtgcttcagacttccctggtagctgggattacaggccacaacgccacatgcctggtagatttgatcctaagtaagagatgggtttcacgggtagccgggtggcttgaatctgacttcgggatcaactgctggctccaaatgtggatcagcatagcactttttgcaa

SEQ ID NO: 696555 - DNA, 150 bp, Homo sapiens
  misc_feature (28)..(28): n is a, c, g, or t
  misc_feature (74)..(74): n is a, c, g, or t
  misc_feature (77)..(77): n is a, c, g, or t
gcaagccgaacggttgggcttatccgtnactattggctgaagtcaccggttagaaccaattattgcacttgcanaanccattgtacacgattgccaaccaggttttagcgtcctcaaaatctttgatgtgggctaattcggtcacttaaa

SEQ ID NO: 696556 - DNA, 171 bp, Homo sapiens
  misc_feature (2)..(2): n is a, c, g, or t
  misc_feature (52)..(52): n is a, c, g, or t
  misc_feature (113)..(113): n is a, c, g, or t
  misc_feature (131)..(131): n is a, c, g, or t
gncctcaaaaaaaggtctcttttcgccaggcacatgtgctcatgcctgtaancccagcactttgggagggtgaggcaggaggatggcttgagctcacaatgttcaacgaccangtctgggaacatagcaanggtatcgtctctaaaaaaataataaaaaattttaaaaagc

SEQ ID NO: 696557 - DNA, 152 bp, Homo sapiens
gggaggatgaagagccagatagaaaaggagggagctatctcaggctgcaagcagtgacagtgcccaggctctgatgcgtctctcacagctgtaaagtgtgagacagctgccttgtgtgggactgagaggcaagagtgttcctgccacaacct

SEQ ID NO: 696558 - DNA, 423 bp, Homo sapiens
tggaaaatattatatgcatattcttggtaaataccttattaatttaaatcagcttttaggaagaactttgtcaaattcgatatcagcatatattagagttctcttcaatcaataaaaaactttttgcaccattccctcaagtggatgcagtattctcaagtgtccgtcatggagcagggactttctttgtttactgttgaatccatcctcgccgcctctcacacactctggcatcgtaggcattaaatgaatatcacaatgaatgaaccaattgccagcatttgcctgcaactgttatattatctgtgcactttatgactttgtttagatgattttaaatgctgagatctttcctttttgatattttgcactaaacatctaagagtatagatggcaaatttcctctgactaggatcatatact

SEQ ID NO: 696559 - DNA, 383 bp, Homo sapiens
  misc_feature (140)..(140): n is a, c, g, or t
ggactcgcgtcgcgccgcgagacgtgaagctctcgaggctctccgctgcggtcggcgctcgcctcgctctcctcgcctcgcccggcccggcccgcgcccgccatggagaagactgagctgatccagaaggccaagctgcnaagcagcgaagcgctacgacgacatggccacctgcatgaaggcagtgaccgagcaggccccgagctgtccaacgaggagcgcaacctgctctccgtggcctacaagaacgtggtcgggggccgcagtcgccctggagggtcatctctagcatcgagcagaagacccgacaccttccgacaagaagttgcagctgattaaggactatcgggagaaagtggagtccgagctgagatcatctgcac

SEQ ID NO: 696560 - DNA, 343 bp, Homo sapiens
tgggcacggtggctcacgcctgtattactggcactttggaaggctaaggcaggaagatcacttgagcttaagagtttgagaccagtctagcaaacacagcaagaccctctcactacaaaaaataaaaaattagcccagcatggtggtgcacacctatagtcccagctactcgggaggatgaggcaagaagatggctggagcctaggaaatcgaggctgcagtgagccatgttcatgccactggactccagcccgggcaacagagcgagaccctatctcaaaaagtaaattaaaaaaataaactctaaaacaaaaaataaaaagtacacagtcctatcttctcc

SEQ ID NO: 696561 - DNA, 168 bp, Homo sapiens
aacggtcgacggacataaagacattcaaatgccagatggcatcaggcgagaggagtatgtgcagtgggtggagttgctccccgaaacccagacgccctcctggatgggcctgtccaacaacgtcgagagagtcctccttaccacacagggtgtatacgtgatcagtaa

SEQ ID NO: 696562 - DNA, 149 bp, Homo sapiens
tccataattgaaaaatccttgccggtgcctatagtcccagctactcatgatgctgagacaggagaaacactagaacccaggtggcagaggtcgtagagagccaagatcacaccactgcactccagcctgggtgacagggagattcagtc

SEQ ID NO: 696563 - DNA, 1271 bp, Homo sapiens
gcggttgtgagcggcggtactgcggcgcatgccagcggggcgccgtcggcggactgtgccctgtcggccgcgggatgacgtgaacgcggaccgagcgccgtcgccttgtggagcatgtagcgcgtgcgccgccgtcgggctcgtcgctcctccggctcggtgcgccgcgtgcgcgtggacgtccgatctgccgccgtgagagcgaggaatcctactgcctgatcgtggcgccgtgcggtcgtgcgtgaggccgccgtcttgccgcatggctctgagcgctgcgcgacattgataggctgtgtgccgcttgtgtggcaggctgacaatgcggctggtgtggtttgctgccctgagtgaatgattacttttcttgtggtttctggggttgtagcatttgccacttccgtttctcatcaaactatgtcctgtgaatacagtgccaaaacttgagtttgtcttgagatttcgtacacgagttcccgtatctcagtatgatttgaagagaaaagcacatggatcaacggttatgaatcgacacgtgtaactacgtacctgcgaggcagaggacagacgtgaccatttggagtcttggcactaccggtccctgcagtcttggtggcaagaactgcccgaaggcaagagaccagatgtggtatgaggatgccttgggcttccaggtcgaccctatcatttctgtacctgcattgggaacgcccggtaccagaggacggcggacaccggtgtggacgctttaccaggtgctgacgttccttggttaccatgttggtcccctttgactaccgaggtgggggtgccacgggggaccgccatcctgaagggggtcgctgacccaatgaggccagccgcgatttggacgggaaccaagggcgaagtggtggacaccccgggtcacttgttgcccacctcgggccgggtgtgccactgtgtgcgcacccgtacgaagaacccccagccccaaatggagccccaacacgcgcgcaaagacccaagaataaccacgcggaggacgaccacccaacagcgcactataacaaggagaaacacctacacagttgagcaccgccacacagtacagcacgagactgatcccggtgcgccctccaagaactgactcgagaccacagacactagaacgctaccaggaaccactcacagcaaaccacacgacgcccaacacgaaacaacaagcaacagacgccaccaccacagcccgagcaaagaacaaaacgacaagacagcgaacaacaacc

SEQ ID NO: 696564 - DNA, 148 bp, Homo sapiens
gcacagatctgcacattatctaaacttaagtataatttaaaataatttttaatacagcttaataagcatcctccatcctagttggttgtacttactgtaatgatttcacctttccatgtattataatcttttgcctatttcttaatgt

SEQ ID NO: 696565 - DNA, 810 bp, Homo sapiens
  misc_feature (338)..(338): n is a, c, g, or t
  misc_feature (353)..(353): n is a, c, g, or t
  misc_feature (449)..(449): n is a, c, g, or t
  misc_feature (463)..(463): n is a, c, g, or t
  misc_feature (476)..(476): n is a, c, g, or t
  misc_feature (478)..(478): n is a, c, g, or t
  misc_feature (481)..(481): n is a, c, g, or t
  misc_feature (518)..(518): n is a, c, g, or t
  misc_feature (579)..(579): n is a, c, g, or t
  misc_feature (605)..(605): n is a, c, g, or t
ctccaattttgcaacgacgggcgcggaggaggaggttcccggaagccacgcgcagctggagcagcggcgaccgcagctggaggcccggagcgcctgcggggctggcagaggcgagggaggttgcgggtaggaatgggcggactgcgcgcgccccctgcgtcccgcgcacctcggggccggtccatgctcccgacggctgcgggcttcagcatctggggccaggttggggcggcggggtccagggcgcaggtggtgcggccgatgcgccgggccggaggctgaggccgcgctgcggggctgggacagcactggcatctccagagcaggcccggggccancaagggaggcgccgngatgccagacgaaaatatcttcctgttcgttgcccaacctcatcgggttatgcccggattgtcttcgccatcatttctttctacttcatgccctgntgccccctcacggnctcctccttctancntgntcagcggcctgctggacgctttcgatggacacgctgntcgcgctcttaatcaaggaacccgggtaatggggccatgctggacattgcttgacggaccnctgatccaccattgtgcctgtatggntcaaccttggcccttgttgtaccctggagccacgctgttcttccaaatcagcatgagttttggatgttgccagtcacttggcttcacctccacatttctgtggtccgaggcagtgagagtcacaagatgatcgacttgtccgggaatccggtgcttcggatctactacacctcgaggcctgctctgttcaccttgtggctgcgaa

SEQ ID NO: 696566 - DNA, 756 bp, Homo sapiens
  misc_feature (341)..(341): n is a, c, g, or t
  misc_feature (350)..(350): n is a, c, g, or t
  misc_feature (365)..(365): n is a, c, g, or t
  misc_feature (377)..(377): n is a, c, g, or t
  misc_feature (400)..(400): n is a, c, g, or t
  misc_feature (428)..(428): n is a, c, g, or t
  misc_feature (430)..(430): n is a, c, g, or t
  misc_feature (485)..(486): n is a, c, g, or t
  misc_feature (508)..(508): n is a, c, g, or t
  misc_feature (519)..(519): n is a, c, g, or t
  misc_feature (550)..(551): n is a, c, g, or t
  misc_feature (558)..(558): n is a, c, g, or t
  misc_feature (574)..(574): n is a, c, g, or t
  misc_feature (581)..(581): n is a, c, g, or t
  misc_feature (594)..(594): n is a, c, g, or t
  misc_feature (610)..(610): n is a, c, g, or t
  misc_feature (618)..(618): n is a, c, g, or t
  misc_feature (631)..(631): n is a, c, g, or t
  misc_feature (638)..(638): n is a, c, g, or t
  misc_feature (644)..(644): n is a, c, g, or t
  misc_feature (646)..(646): n is a, c, g, or t
  misc_feature (650)..(650): n is a, c, g, or t
  misc_feature (671)..(671): n is a, c, g, or t
  misc_feature (695)..(695): n is a, c, g, or t
  misc_feature (738)..(738): n is a, c, g, or t
ctccaattttgcaacgacgggcgcggaggaggaggttcccggaagccacgcgcagctggagcagcggcgaccgcagctggaggcccggagcgcctgcggggctggcagaggcgagggaggttgcgggtaggaatgggcggactgcgcgcgccccctgcgtcccgcgcacctcggggccggtccatgctcccgacggctgcgggcttcagcatctggggccaggttggggcggcggggtccagggcgcaggtggtgcggccgatgcgccgggccggaggctgaggccgcgctgcggggctgggacagcactggcatctccagagcaggcccggggtattttnttgtgtttntgttgtgattttatntttaaaaatatntttccttgtttcgttgccctaancttcattcggtttattgcccgtgatttntntttcgccatacattttctttttctactttcatggcccttgctggcctcccttcanngggccttccttcctttctaacncttgcttcagncggtccttgcttgggaccgctttttctgatnnggacacngctggctccgcggctnctttaantacaaagggatanccctggtttttggggngcccatancttgcgactattncttgtancggtancngctntgcttcccacccatagttgcnctgttttgggttcaaaccttgtgncccttgcttgttacctcttgggagcccactgcttgtttctttnccaaaatccaggcattga

SEQ ID NO: 696567 - DNA, 1041 bp, Homo sapiens
  misc_feature (282)..(282): n is a, c, g, or t
gccattgcaccccagcctgggtgacagagagcgactctgtctcaaaaaaaagaaaaaaagaagcaataagatgacctaacctcatgcaaatatgtagttggtagaaggtgtatttttaaagttttcagacagttgtgggtatttgttaacactaaatcaaaacttcacaagtggtggtttcttaaattagttacggtggcattttacatattaataaatttattccatcagtactcattgatctttcttgcacagtaaatggatcttttgctccatacttgnatttataatatcatgcattagttacttggaatatattggtttatgttttattgtgtcaaaaatcacttttagtttaaccaccaatcttactttaacacgcctttaagtattgaaaagctgccaagcctacagtagaaggaacaagtttttcaaagtccagaggaaagcttaaattttatcattgggaacaaatacgtatttcccttgaagtgacaacctctcacttcatttatttttgagaatgatagttgaactggttttttagaccgagtttcactctgtcacttggctggagtgcattggcatgatctcggctcaagcaatcctctcacctcaggctcctgtgtagctgggaccgcagatgtgtggcaccacgccaggctaattttcttatatgtttgatagagacacggtttcgttatgttgcctaggctggtctcgaactcctgaaggagctcaagccatctgcctgctttggcctctcaaagtgctgggattttacaggcgtgagccactgcgctggcccagttgtacttttaaataaaaatgatgttctgtgaaaaaagtgatttttcagttcacagttaaatcacggattctttaaaaacaaacaaaaaaagcgcttctggttaactttccacttattcagaatattagagacatgtcaagatttaacaacattaatttttactgcttcatcaaaaacatagcctgaatttcttaagaatgtctgtcgacgcggccgcgaatttagtagta

SEQ ID NO: 696568 - DNA, 720 bp, Homo sapiens
ctggcacagctggtcatgtgacgaaggtcggaggggccgatggggaccaatgctggatgatgacttcaaagagatggagaagaaggtggatgtcaccagcaatggcggtgacatgaagtgctgtgccatggaccatcgatgtacctgcgagcccaacccagcctcgcgtggctaatgctgaccatgctcaacactggtgtccaacgatcctggtggccagtgtgagagaacccctggctacccgcagatcggaggtggcttctggtgctgatgtgcatgatcctgccacgtggaagtgacgctgggcaggctgagtccaacttttgtgtgacgctattgctgtgatgccgtgcgatgtccactgaatgcgccttggcacgaggtgaatggactcccttggacatcgcaggtcaacgcacgaaccttcatttgacccccatccagaacactgtgcgagaaatgacctgaaggatgatccagcaccacctgaagaaacttggagtggccgccgcctgtgacttttgcactacaagaatgaagcggcaggcgcaaagatccccgcattgaggaagctacagccacgtgcgctgcgagaagttcatgaggagtccaaggatggtggcagcaagaccagcatgtcataaatctcctggcagactgacctcatgagcagtgtgagtccagctcatcggacctggtggatgcacatttggacttacc

SEQ ID NO: 696569 - DNA, 1153 bp, Homo sapiens
ggtagaggctgaggcaccgccagagctcgctgagacagagactgagaactgcccccggccagattccccccgtgagagacccgggtagggacagggacagagagacgcctctagtgggcagaggccctgggaggcaaagacccccaggagagatttacccaccccagacggaaagcgcggctcagagtcggacgaggggagacttgtcagatgtgacaactgccccctagtgtctcctggtgagacccctgaatgctgatcccctgtgtggtgcatgccctgtgtgcctgttgtccgtggctgagggtgacctatccttgtgtttgagacgcgattggggacacaatgccctgcatgggcttcctctttctcctcttcctcccgctgctgcatgccgcgtggggcctcggcttgggagcctgcacagtccaggcctgtccgaatgcttccaggtgaatggggctgactacctgctggcaccatgaacctgcacttgtgccctgtgctgtgggctgggcctgcctgtgcctcttctgggaccagacgcagcaacacagctacatgcagctgccatgtgacccccactggtcgctgggcggctgggctgcgcaacaacttctgccggtaacccagacggtgacgtgcaagcgtggttgctacgtggcttgagacacgaggacgggcatctactgggggctactgcggacatccccttcttggtcgacatttgcaaggctacctggggatggcttgtgggactcaaggggcaacccccaggccttaggcggcccaacgggagcattcccagaaagctcaagaggccaggtgtgcatacagctattgccgcttgaacggcgctccacttggagggcatgagcaggcgggggatacaacacgtgaaacttggaggcctggaagagcagccattgctcagggtgcaaaccgggtgtccccgaccacacgatgtgtacaaacattattttgcgaccccgcgaacaacgttgttgtcacacgaccaagctgctgcacgtacacaacgagttggacctgctttaccacagcttggcagacagcagtcataccatcatcctcgcacaccgtagccagcgacagagaacaccacgcgccgcggtcagccctcactgcgtccacc

SEQ ID NO: 696570 - DNA, 657 bp, Homo sapiens
  misc_feature (338)..(338): n is a, c, g, or t
  misc_feature (353)..(353): n is a, c, g, or t
  misc_feature (426)..(426): n is a, c, g, or t
  misc_feature (452)..(452): n is a, c, g, or t
ctccaattttgcaacgacgggcgcggaggaggaggttcccggaagccacgcgcagctggagcagcggcgaccgcagctggaggcccggagcgcctgcggggctggcagaggcgagggaggttgcgggtaggaatgggcggactgcgcgcgccccctgcgtcccgcgcacctcggggccggtccatgctcccgacggctgcgggcttcagcatctggggccaggttggggcggcggggtccagggcgcaggtggtgcggccgatgcgccgggccggaggctgaggccgcgctgcggggctgggacagcactggcatctccagagcaggcccggggccancaagggaggcgccgngatgccagacgaaaatatcttcctgttcgttgcccaacctcatcggccatgctggacattgcttgacggaccnctgatccaccattgtgcctgtatggntcaaccttggcccttgttgtaccctggagccacgctgttcttccaaatcagcatgagttttggatgttgccagtcacttggcttcacctccacatttctgtggtccgaggcagtgagagtcacaagatgatcgacttgtccgggaatccggtgcttcggatctactacacctcgaggcctgctctgttcaccttgtggctgcgaa

SEQ ID NO: 696571 - DNA, 180 bp, Homo sapiens
gtggctgactacgggggaaggtggctgactacgggggaaggtggcgactacgggggaaggtggctgactacggggaaggtggctgactacgggggaaggtggctgactacgggggaaggtggctgactacgggggaaggtggctgactacgggggaaggaggctgtggcacggtgtgaag

SEQ ID NO: 696572 - DNA, 958 bp, Homo sapiens
aatgtggggtgacatcctgaggtttcatgtgaggcgctgtctgtgggattgtgctcgtgtatcttagacgtgaagtgttccggggggaaggtgacgccgataggtgacgttgtagcctacctagatcacgcattgtagcaaacacagagtcaggcgccaaagaagtcccgagaaataggcgcagcggagggaatagggcaggaccgatatcgaaggttcttatgtgcagcaggaaccggggagcgcgcagaggtaggaagctaccgcggatcgtgtcatggggagagtaatctgggagagcgcaccgccggacagtctaacgagttccatgtctcgacttgctgctcgtgccctgcttgtagggaccgtggtggccgtgaacggtcggtccgacgttctgtccggcgcgccgttctgaacggcgggtcgcgttgtcgcagccggttggccgtgcgctgttgtgcgcattccgtcctttagggggttcccttacccaatttgggctgctacccttgtgaacgccggtgcacgcgtggggacgcccgcgagttcaaggactggccgcggctcagggggggggggccctataaggccgtgggcccgggggcccgggaaccagggggggtcgaacacactagggggacttgctggggccttggaaacaggccgccggcgggtaaacggctgcccgtatgccgggggtgctgctgtcccgtggggcggggcagataaatgggggggccctacccgttgtgtcccccatccacgtttttcaaacaaaaaagcacaacatacgtcagacggcaccaacaaacaaaaacaaacacaaaaaaagaggggccacaaaaacaggaggagctcgtaaggaagcccccggaggagcaccacacctgtatatacaaaagggggtctcacaaaaagggcgccaaaaagggagacacataaggagccggacaac

SEQ ID NO: 696573 - DNA, 142 bp, Homo sapiens
gtatctagcgatcccttaggagccttaccctggggcctgagattacccagctctcttgtctcagcccaccactcattgtgacttatgaggagcaagcctgttgctgcaggagacttggggagcaggacacttgtggggccct

SEQ ID NO: 696574 - DNA, 161 bp, Homo sapiens
cagctggaccagcttgtcatgcttccgcttcttcttgctctgcgcttcctcacggaactgattcgggggacattgtgcctgatttacgcgtctttatggctacttttgtgtttcccttccagagtacccaatccatactaccccaacctgcccatttcccc

SEQ ID NO: 696575 - DNA, 124 bp, Homo sapiens
ataggaccaatactattatattatgtggtccgttaaccctatttaaaagtttggggttttttcttggtggtagaggggcccagaattccattttgaatgaataaaggttaaaaaaaatccccca

SEQ ID NO: 696576 - DNA, 245 bp, Homo sapiens
  misc_feature (72)..(73): n is a, c, g, or t
  misc_feature (76)..(76): n is a, c, g, or t
gcctactactactactactactactaaattaacggccggtcgactgctggtcagcggtgcccagttggcatnncgntggagcatgacccgcctgccggaaccgacacagtggctggacgccctgatgactcaggacgtatcgttactcgccttgggtgtagtggcggcatcgatcctcgcctacgccctgtccatgctttgctggctggccgccttgccgacctgccattaggccgtggtcgacg

SEQ ID NO: 696577 - DNA, 263 bp, Homo sapiens
  misc_feature (130)..(130): n is a, c, g, or t
  misc_feature (142)..(142): n is a, c, g, or t
  misc_feature (194)..(194): n is a, c, g, or t
  misc_feature (196)..(196): n is a, c, g, or t
ttattatttttttggtcctttggttagaaagagcagactttcttagggctttttttccccacctgtacccattggcattctcaagttgctggcttttctggtacccagccaaggatatgtaaagcaaaangaaaacttaggnattcactactgtattattccttgggtcccaaagaccctagtcagtcttcctncntctctccacattttggaattatgcttatttaatatatagcgtccagagctttttgtagttaagcagg

SEQ ID NO: 696578 - DNA, 399 bp, Homo sapiens
gcggccgctactactactaaatttacaccccgtcgacgattcgggcttcaggtgcaccacgcaggttggacagtgacagcagcgggaactcctggcgctggcctggcggttcgaggcgatgaaacagccggcctccaggtgctcggcgcggtagaaacgccggcactggttctggaagtcctccagcaactgattcaaacgtttgcgccaatcctcctcgcccagcaccagcaggaaatcatcgccgccgatatgcccgacgaaatcccggctcgggtcgacgcggtcgttcaagcattgcgccaggcacaacagcacctcatccccacgcccatagccgtagatatcgttgaacggcttgaagctgtcgatatccacatagcgtcgacgcggccggaa

SEQ ID NO: 696579 - DNA, 415 bp, Homo sapiens
  misc_feature (396)..(396): n is a, c, g, or t
  misc_feature (403)..(404): n is a, c, g, or t
agcctatttaatatacattaaagaggccgggcgcaaagtggcacgccctgtaatccccaacaacactttgggaggcccccaggcaggcgggtccatgaggtcaggagattgagacccatccctggctaacacggtgaaaccctgtctctactaaaaatacaaaaaattagctgggcgtgatggtgggcgcctgtagtcccagctactcgggaggctggggcaggagaatggcgtgaacctgggaagcggagctcgcagtgagccgagatcacgccactgcactccagcctgggcaacagtgagactctgcataaagagcatacccatgtgtgtacctatctatctatctatctatctatctatctatctatctatctgtatatagatatattaaantgtaaannaatggcataaa

SEQ ID NO: 696580 - DNA, 599 bp, Homo sapiens
acacagctcaggcataaggcaggccacagaggacaaggacagcatggagacatgacgactggacgtcggatcccggcacagggaccagcgtgatggggtgtgtgtcctgggcctgcacctggccaaggagctgtgtagaggtagacgaggatggtgactcctggctgcaggtaacccgcaggctccccatacctacccaccctacctcaccactctagaggtgagccttcgctatagaagcatgaacctagcattatacactagagagccacataagcatctagctacctcaccctggctcgcactcagcagggagccacagcagtggcttggagctaggacatacacccagagcataagttatgcccctatctgagtgtgtaccaggctgagcacctaacggcacaagcacaagacacctagtgcctctcggaagtccctgggatgcccacctcttggccatggagtctaccggcctagtacatgttccctgatggagcagctgctacaaaactactgctgctaacaaacttcccttgcctgatggcccttgtgactaacagtgggtagtccacctaggagcggactttacagttgct

SEQ ID NO: 696581 - DNA, 128 bp, Homo sapiens
gcggagagactgtgtggaagaagttagatttacgccgatgaatatgatagcgaaatggatgggggcgtaggtttggtctagggtgtagccggggagagtcttcgactgatccagagtcttcgcctgat

SEQ ID NO: 696582 - DNA, 909 bp, Homo sapiens
tgcttattctctcgaaaccacaaacgacattgggacaggatccctattattcgacgcatgaacttgcagtccgtattgcacagctctaagacactcactataatacgagccgcgactggtgactcaggccaggacccaccttacatagtgtaacctgacgcacaactcctaacgaatgctgttgatctgatagactaggagcccatgcaataatgtacatagatctttacgtacatgatgtaatcaaccaattgatagattcgtgtggcctcgtgagaaccttgaatacggtgcgcccttacatgaatctgggaatgtgctcccggactagttgggcctgttcactcgcgccgccatgtaaaatcgagaaggttcagggacctctacatgtaactcgtgaacacattaccatcctaacttcactactgcccgtgtcgacggacttcatacgtattcggatggagcggccgggatgcaagagaagcaccgtggtagacaggcacgttcatagaccccttcaccctctacgcaagggagaatcatgacccttcaccgaccacactgtgggaactgaccctttagaaacagaaacctacgaagcaaacgtatcgtgcgctgttaacacccatcagacaaggttgtgactaccgtacagaatactgaaaggagaaataattcaaataaatcaataccaaatagaacaaagttacattcataaataattataaaaatcctctcattctcaagaaaaccgcccatcattatccaacacacgaccacccatccagcaaaacataaaatcagaacaccataatatgcctaagacacacacccataacaatactcatacccttaaactaataatattacccgagacataaagcagtgctgtgcatatcaacaccaata

SEQ ID NO: 696583 - DNA, 124 bp, Homo sapiens
ggtccagaatgggtcctgcgtggctagatggaacacggacaggtgagcagaatcctccccttgtgagtattaaaaacatttggttacggtcgggcacggtggctcatgcctgtaatcccagaca

SEQ ID NO: 696584 - DNA, 187 bp, Homo sapiens
gggagtcgtgtggagcgccgcactcccgggagcgagcctcacgtggctgaaatgcagatggactgccagtgactgggctgctctcagcacaccacactggtcccctcacagtggtctcccgcagcctggctgggggcgcagggcagcaggatttactcctcctagttatgtagtagtagtgcggcag

SEQ ID NO: 696585 - DNA, 709 bp, Homo sapiens
  misc_feature (526)..(526): n is a, c, g, or t
  misc_feature (554)..(554): n is a, c, g, or t
  misc_feature (584)..(584): n is a, c, g, or t
atacattccattgatacctagtctgttaagagtttttagcatgcaggcgtattgaattttgtggaaggccttttctgcatctattgagataatcacgtggtttttgtcattggttctgtttatgtgatggattgcatttattgatttgcatatgctgaaccagccttgcatcccagggatgaagccgacttgatcatggtggataagctttatgatgtgctgctggatttggtttgccagtattttattgaggattttcacatcaatgttcatcagggatattggcctagaattttctttttttttgttgtgtctctgccaggttttggtatcaggatgatgctggcctcattgagttagagaggattccctctttttctattgattggaatagtttcagaaggaatggtaccagctcctctttgtacctaaggtagaattcagctgtgaatccatctggtcctgagctctttttttggttgggaggctattaattactgcctcaatttcagaactcgttactggnttattcagagattcgacttcttactggntttagactgggacatgtatgtgtccagaantctatccatttcctctagaatctctagctgattgcggtagaagtgctataagtctctgctggtagttgcatactggggcatcagtgcgatatccccttgattatttttatggcactatttgatct

SEQ ID NO: 696586 - DNA, 274 bp, Homo sapiens
ccccccgggggggggggggccccttggggggaaaatttcccccttttggggggggggggaaaaaaaccccctcaaaggggggttgggaaacccctttgggggggaaaaaagcttcacccccctttttttttttttttttaagggggggggggggaattttttcccccaagttttttttttcacaaacccccccggttttttggggattccccaaaatggggggggggggttttttttttttttaaaaaacccctttaaccccccccggggggga

SEQ ID NO: 696587 - DNA, 125 bp, Homo sapiens
  misc_feature (65)..(65): n is a, c, g, or t
ctctttgtcatctgcgcatcctagacaggacaaggttgtgttacctttgcttgcatgaaccatgnaacctgtggacggaatcatttcatcctgaacttcaccaagctccgcctgtgggtgaggcc

SEQ ID NO: 696588 - DNA, 357 bp, Homo sapiens
tcagacatcatgagatgggccttgcgcccccggaatttaaagctctacttctatgctctcttatatctctctttaacatgtgtagcatatgtgtgctaccacagacacactggtggatcttagatgaaagagatccgaggtattggccaactacctgtggcattgcagaattcccggctacctatcaaacccaagtggacacgggtctacaggctttggaagacatcttacatctaggtggaaacccaacatctgaagtcaaaccggtggttaaagcgattccactcacttataaacccgagggatcatctccccatatgagagacgctgctaccttgttccccgaggttcgatttt

SEQ ID NO: 696589 - DNA, 391 bp, Homo sapiens
ccttggttgtgctgcgttcatgacgtttttaggtgggaaagatgatctgctgaatccactacaaggtgcaactgaacctcgtattgcaaaggccggttcagtctggcgcagaccatcagtggcacgattccatccttgtgtcagtcgagagcgcttcatggtgtgagaaactgatctattatcatttaaagcttcattatgcatgatatgttccactctattaacactaagaaatagtaccatcgatgagaaaggatatcaacctctatgtgtaccaaaaggggcgtacggcacacggggaatatttgcttgtgttgaggtacgaatcggaggtgttctgtctgacaggggcattattttttaatgactaaccctgcgcttttattacgtt

SEQ ID NO: 696590 - DNA, 115 bp, Homo sapiens
gagttaacaccgtcaccatcttggttgagaacatgaaagctcagcttggttgttattgcacatgacgttgatcccattcgagtctggttgttttttttgtccttcccggttttgg

SEQ ID NO: 696591 - DNA, 313 bp, Homo sapiens
aaggatgggagcaaaagcccagcatgtttatatgccagtggcaacaattcactgtgagaaaaatgtaaaggatgaattagttcctggagtgatacccttgaggggctaagagatttagtttacaagtgtagggattgacatatagaaacttggataatttatctgtgtcagtgggcagagatacagtttaaaagtgtagacagtggatggtggttgagtgggttgtgggagtttatggaagttctcttcaaatagcttcatgaaaaatattttctttcagtgaagtataggaagcaaagtcttcactgtaaaa

SEQ ID NO: 696592 - DNA, 523 bp, Homo sapiens
gctctccaggcccggttgaaggctccccgcagcccccccccacccattggaatggccaacaagggacctgcatatggcctgagccggaaggtgcagcagaagattgaaaaacaatatgatgcagatctggagcagatcctgatccagtggatccccacccagtgccgaaaggatgtgggccggccccagcctggacgcgagaacttccaaaactggctcaaggatggcccggtgctatgtgagctcattaatgccctgtaccccgaggggcaggccccagtaaaaaaaatccaggcctcccccatggccttcaagcaaatggagcagatttttcagttcctgcaagcagctgagcgctatggcattaacccccctgacattttccaaactgtggacctttgggaaggaaaaaacatggcctgtgtgcaccggacccttattaatttgggtgggctgcctcccatggtttggggctttaggaaaataagtttgtttatttaaataaaaaatttgtcctttttta

SEQ ID NO: 696593 - DNA, 428 bp, Homo sapiens
gcccatccacaactattgcccgaaatcaggggtgagcttcaaagtgcagtcccccccgatgtggaaaatgtttccatccccgtggaatgaggaaaacagtcacctgttctggccaaaggggtttggaaggacacaaaacccccgttggttactgaagatgacactgagctttaatggcttaaaacccagatcagggcagtgacagatcacagggacatttgtggctcccagttcaggacagaaaagactaagggtttggctggttcccttttccattttaggcccttatccctgtttagttttgaaagccaacttgaaaaaccatatgctagcatttccagtccccaactggggcttggtgtgaggactttttttatggctattgtgtcaggtccctgtggataaaggcaaagacagattttttttta

SEQ ID NO: 696594 - DNA, 856 bp, Homo sapiens
  misc_feature (35)..(35): n is a, c, g, or t
  misc_feature (68)..(68): n is a, c, g, or t
  misc_feature (73)..(73): n is a, c, g, or t
  misc_feature (78)..(78): n is a, c, g, or t
  misc_feature (80)..(80): n is a, c, g, or t
  misc_feature (96)..(96): n is a, c, g, or t
  misc_feature (98)..(98): n is a, c, g, or t
  misc_feature (114)..(114): n is a, c, g, or t
  misc_feature (125)..(125): n is a, c, g, or t
  misc_feature (152)..(152): n is a, c, g, or t
  misc_feature (158)..(158): n is a, c, g, or t
  misc_feature (164)..(164): n is a, c, g, or t
  misc_feature (206)..(206): n is a, c, g, or t
  misc_feature (215)..(215): n is a, c, g, or t
  misc_feature (240)..(240): n is a, c, g, or t
  misc_feature (254)..(254): n is a, c, g, or t
  misc_feature (261)..(261): n is a, c, g, or t
  misc_feature (286)..(286): n is a, c, g, or t
  misc_feature (295)..(295): n is a, c, g, or t
  misc_feature (317)..(317): n is a, c, g, or t
  misc_feature (353)..(353): n is a, c, g, or t
  misc_feature (370)..(370): n is a, c, g, or t
  misc_feature (398)..(398): n is a, c, g, or t
  misc_feature (406)..(406): n is a, c, g, or t
  misc_feature (410)..(410): n is a, c, g, or t
  misc_feature (413)..(413): n is a, c, g, or t
  misc_feature (421)..(421): n is a, c, g, or t
  misc_feature (428)..(428): n is a, c, g, or t
  misc_feature (481)..(481): n is a, c, g, or t
  misc_feature (500)..(500): n is a, c, g, or t
  misc_feature (521)..(521): n is a, c, g, or t
  misc_feature (540)..(540): n is a, c, g, or t
  misc_feature (559)..(559): n is a, c, g, or t
  misc_feature (561)..(561): n is a, c, g, or t
  misc_feature (573)..(573): n is a, c, g, or t
  misc_feature (603)..(603): n is a, c, g, or t
  misc_feature (640)..(640): n is a, c, g, or t
  misc_feature (672)..(672): n is a, c, g, or t
  misc_feature (689)..(689): n is a, c, g, or t
  misc_feature (724)..(724): n is a, c, g, or t
  misc_feature (741)..(741): n is a, c, g, or t
  misc_feature (776)..(777): n is a, c, g, or t
  misc_feature (786)..(787): n is a, c, g, or t
  misc_feature (791)..(791): n is a, c, g, or t
  misc_feature (853)..(853): n is a, c, g, or t
aacagagaatatcaggtggtgaaggagatacaaanatatgcaaaacaatcttcaaggatcttacacanaaggnggaananaaagccaaaaaatacntncaaaccacaagttatngagtttccaangaaaacgagatatcttccaaccaaggnctaaangaaaancttcaaaaagaagctggcatttcaaaagggccctgaggaacnaaaatgaanttcacaagtaggggaacaataaaangaaggggctgaaanctcaacntcgcccatagctcctgtttccaacnttgaaaacncttttagatatgacaacccatncagtcaacttcccagctatgttgccagccccttaantctgcctctcttcctgntaaacacattctgactatcccaaaaaanccctttcngaangcnacccttcnactcctnccccacaaagatgcccccttcagctcttctgggtgtcacaaacaacactaatnaagcaagaaagagtagtantgacagtctcatcagaatccncaacccatacccctgcttncaccccattgaatcctgcntngtgaaagatgcnatccaaagttagaaacctggcgacgaacgnggccatgcgatctcaactctcacttaacaatacatcngtgactcctcaaattatatttctcaactgggnacatgaatcttttctgnccattctcagcactccccactccctggttcacagngactctttgtagacccngccacatgcacacacaaatgtgcacacacactcannacaccctgnngtantttccttctgtctttgcttgtgcttcccctatgtattagtccattctcacattgctataaanacc

SEQ ID NO: 696595 - DNA, 995 bp, Homo sapiens
ctcgttcgcaaggatagtttgtctgatcaatagcacaaggtgtcgtgaaaactacccctagaaagtccaagacatgtgacacggcacaacagactcatatcaacattgtcgtcattgacacgtaaattcggcgcaagctctcacaagcaatacctgccccatcgtgcagtctaatacagtgcgtccgggtacttcgatctacaagatgcattgagtcatatgtgaggaaaggacgatgacgtgagatgggaccgggctaccttcagaagctatgcctggcggtcttgcaataaaacttgagagctgactgtgagcctggtatcatcgcatagtatatctccttgtggaaagccgaaaccaggaagtaactatgtgacttatgattgatgcccccggactgcagagacttaattgcatactacatggatcgaccggcagatctcaggactgacctgtgcttgtcctgatttgtcagctgctgctctttgggttgaaattatgaaatctgggtgtctcccaagaaatgggtcaaggacccgacggagcattgcccgttctggcttggcacaactggtgtgatcagaactcattgtcgttggttacaatatgtgattcactgcacaacctatgtcagaaggaggattgagggaactttggtgctgtgaggcgtccttgctctccagaaaagattgtctgcaatacccagaccaggatcattcgtgccacgtgctggtatgggtggtgtccccctgctcgatcattgtaccatgcctggtaaagggtggactccccggtggatgtgctccaggtgcaccctggtgggcctgttgagcctcaccgcgtgtattgagcctttgcctcgggctcacatgggtgtgcggcactgcgggggtggtgcccccgcgggggcgtgtgtgccacgttttgacccgtgcggtgtctggaattagtgtctctgcccaccgtgtccacacatttacgagatgtgctccgtg

SEQ ID NO: 696596 - DNA, 426 bp, Homo sapiens
atgcagttcacccccactactggactggccccaaaaacggtcatcccttctgtcttctgtctagtcacactcctattcaccgttctcaactactcataaataccctactcttgtttatactgccagtttacactgtttctccaagccatcgcagctgatatctcctggagctatccccaaaccgccactcttaactccctcttagagtggatagatgatctttgctggcagggcaccctccaatactttcaccctgatgaagttctattctttacttttatactcaatcttattctcattcccattcttatgccaccctctacctctccccagctatctccaccacactatcaatcttactcactctctcctagccatttctaatccctccttagcgagcaattgctcgccatggagtaaatggca

SEQ ID NO: 696597 - DNA, 661 bp, Homo sapiens
  misc_feature (470)..(470): n is a, c, g, or t
ctccagacacagatgacctgaagcagctggccaatggtgttgacagatacatctccaagtatgagcttggacataagcccttctccgactaggcaacacgcctcgaatcgaatctaccctggacaaggtcgtcgacacctcgtgaaggaatgactgctcatagcgtctctcagaagttcaccaaaatagctttaactggtaagagcctgtagtccagtgccgtggcaggcaggtcaagggtctaacgcctatttacaacctctggtaggaaagagcttgttagcccggttctaaccatctcggaatagaggaaggcataggaaatagtcttgacatctaatggcttctggcacgtcgaatgaaactggtggccgctggtgcttgatggagacaattgctgtctattacacaaaggtacgggacagagcaaggctcatgctctgggcaatgaaactgtgccatgcgacganagtggcgccttgtggaagtccccatgggcacgatgggggagctaattggttgtgacaagaggaacaccctggagcatggcgtccgaaaaaggcctttccaccgtcgttggttcgctagatagacaccttttcgatccgtaggtcactaattcaatcgggtcccaatttagacgtcacggatcccagtcaaa

SEQ ID NO: 696598 - DNA, 224 bp, Homo sapiens
gagctcggtcccctattcaggaggctgacaggagaattgcttgaacgtgggagcagaggttgcggtgaggcgagatcacgccattgcattccagcctcggcgacaagagcaaaactctgtctcaaaaaaaaaaaagaaggcaatttcctaaattcatttattggaaaccattttacaatttccccaggtcagccttcctgagtagggggatttacgggcttgca

SEQ ID NO: 696599 - DNA, 265 bp, Homo sapiens
ggaacctttttcccccgaacccaaaggggggggggttggttaagtggacccgtcccgcaaacccaaaaggcggggggccggttaaggggacccatctttccccgaacccaaagggggggggtttggcttagaaggggccggggccctcaagcctgggcaataagaattaacccgggtgggcccaaattaaaatttcaaaaaacaaaacaaacccccccctcccaaaactaccaaaggattaattaattattttaaaattaaatta

SEQ ID NO: 696600 - DNA, 195 bp, Homo sapiens
atttttaccccctttttttttttaattttaaaaaaaacccccccttttttttgaaaggggaaggaaaatcccaaagggggggaacccggggggcctttcctttttcccggccccccccctttaaaaaccagcccctttttttttccccttaaaaattccccaaggggcttaaaaaaaatttttttttaaagggga

SEQ ID NO: 696601 - DNA, 425 bp, Homo sapiens
cccctccgatcatgcagctcctgctcgggctcttgtcaggttactcttctgctgcctattcttccaacggagtgctcttggccgcttacacagacttctcaggtactctcacttattttcaaaaaaattccaatagaaattcctgaacgaaaattaaaagtctctaatttctcctccggctccatccctccaaaaattccctccttcaagattctcctccattgacatttgggaatggtattcttccacaacttcttttttaaaggtggaccacaggccatactcctggcagtacactggagagtatctctatggccggttaaacactggtggttaaggcctttccagtggtaccattcctttccttaattcctttagaggaaacccttggttacagagtaaggtggctaatccttcccaatttc

SEQ ID NO: 696602 - DNA, 135 bp, Homo sapiens
gattaccatggggagaatgccaagacagtttgagtacgagctggagcaggcctggaagcccagtagaagtacattgtgattagagcccactcgcattggagacgagacagcccgctggatcaccgtgggcaaaat

SEQ ID NO: 696603 - DNA, 805 bp, Homo sapiens
ggggcggccggggctgcgtactggctgtgggatgggaagtgaagccccagcgagcggtgcagcggggcgtgaggagcagccaggggaggcggcgggagtcggtgagcagctgggaagagcagaaccggggcggagcacctgcaggcgcggggggggcccaccatggcgattcgaagaaaagcacaagagcccccccagtgctgagcacgaattcgtcctgcagaatcacgcggacatcgtctcctgtgtggcgatggtcttcctgctggggctcatgtgtgagataacggcaaaagcttctatcattttgtactcttcagtacaagtgtcaccctcccagaacggaagaacaagctacttgaatcaggtgtccctttataactaatggcatcaaagattgtggctaactgtttcttctacatgctagtggggataattattcatgcgtaattcaggaggttatgtgggataaaattaccaggcgaatgcattctcaaaaagaaaaacagcaagtttaatgaatctggtcagttagtggggttctaccttttgtgcctgtggtgggggcacattcaattctcatctctggaaaattacattttcagacccaatatcttatggagggtttttccccataactgatgacacttcaaatgagttttctacatttcacacgtggttaaggtcacgtttcctggaatttattccgaaacaaaagaaatttctcgcggtgtcacatggcttcccttcacatgtgggcccttgaaatctgcgggcttgggggaacacgcatcccccgcggggc

SEQ ID NO: 696604 - DNA, 895 bp, Homo sapiens
acgctgtttatggccggtttgtttaagagagagatggtggaagaaaaaacttggtgttacacaaaacaggggggctttttcacatctgtgggggggtcaaaacaccacgctggccagacatacaccacacattggggggggcgatatatcagatttggtctggagatatgtcattgtagacaccaccacctggtgtgaccgacaccacattaaattgagacccccccgtcggtattacatactcgcggcgggacgatcacagaccgctcgtcgtgcgtttatgatggagcgacgctcatcgtagtgctgagcgtcgtgtgcccacagagagatctcgcttcactacccacggaggagatttatatcagaaaagagggggataccccccggggtgtggtgtcgacacacacgcaggagaagattctcccccccggaaatcaatttgtgtttggggccggtttgagcacctctcctggcgccaaatattttcggtggggcgtctttttcctcacacactgtgtcgtgtttttactgggaggcccaccccttataatagctctgagaacaatgtggagatgcacatcacctcggacagttaatagaactcaatacgccgtggggtaaatacaaaggtggtttttttgttttttgaaatgttagggaactttgggtgaaaacgacccctgttgaagccgccacctacttcacgtctgtaaaagcaccttagtgtgtccacaaagtctttttttctcggggggaaaaaccctaggtttcaaaagaagtttacatcccgtaagtgaagttttaaaaaccgttttccactaagccgccttttttttgtcaaacccttgcctgattttaaaataattaaaaaaaaaggtgcgttaatatttta

SEQ ID NO: 696605 - DNA, 484 bp, Homo sapiens
cggggaaaagtagggagaggaagtagcatgcagaaagcaaaggcagattagggcaagtttgtggactacggagagagaattgtaagcatagacatatagcaagaagggtactaccttatttcccttacgtggaactaatatgaaaaacacttattagatatactggaccaaaagagaactacgtactccaactctactgcagcattacaaaaaaaaacatcccttcaccacagtgtacgatttcagggcaagctgcccaaggatgcatgttatatcaaacacagcaagattgctgctgccctgccaggtacttccaatccctacccaggtcctactgaaatacgggtggtcccaattagttttatcgaaataaatctttaaagaacaagataaagcatgtgaaccagacaagtcaaaatgcatcaggaaccacatatccaacacaaactttatcctcaaatgagttctgttggcctcgcactta

SEQ ID NO: 696606 - DNA, 1016 bp, Homo sapiens
  misc_feature (16)..(16): n is a, c, g, or t
  misc_feature (34)..(34): n is a, c, g, or t
  misc_feature (42)..(42): n is a, c, g, or t
  misc_feature (62)..(62): n is a, c, g, or t
  misc_feature (78)..(78): n is a, c, g, or t
  misc_feature (133)..(133): n is a, c, g, or t
  misc_feature (193)..(193): n is a, c, g, or t
  misc_feature (259)..(259): n is a, c, g, or t
  misc_feature (265)..(265): n is a, c, g, or t
  misc_feature (271)..(271): n is a, c, g, or t
  misc_feature (285)..(285): n is a, c, g, or t
  misc_feature (311)..(311): n is a, c, g, or t
  misc_feature (316)..(316): n is a, c, g, or t
  misc_feature (358)..(358): n is a, c, g, or t
  misc_feature (372)..(372): n is a, c, g, or t
  misc_feature (379)..(379): n is a, c, g, or t
  misc_feature (409)..(409): n is a, c, g, or t
  misc_feature (437)..(437): n is a, c, g, or t
  misc_feature (441)..(441): n is a, c, g, or t
  misc_feature (452)..(452): n is a, c, g, or t
  misc_feature (454)..(454): n is a, c, g, or t
  misc_feature (491)..(491): n is a, c, g, or t
  misc_feature (526)..(526): n is a, c, g, or t
  misc_feature (540)..(540): n is a, c, g, or t
  misc_feature (548)..(548): n is a, c, g, or t
  misc_feature (603)..(603): n is a, c, g, or t
  misc_feature (616)..(616): n is a, c, g, or t
  misc_feature (642)..(642): n is a, c, g, or t
  misc_feature (672)..(672): n is a, c, g, or t
  misc_feature (699)..(699): n is a, c, g, or t
  misc_feature (755)..(755): n is a, c, g, or t
  misc_feature (797)..(797): n is a, c, g, or t
  misc_feature (815)..(815): n is a, c, g, or t
  misc_feature (822)..(822): n is a, c, g, or t
  misc_feature (825)..(825): n is a, c, g, or t
  misc_feature (871)..(871): n is a, c, g, or t
  misc_feature (881)..(881): n is a, c, g, or t
  misc_feature (890)..(890): n is a, c, g, or t
  misc_feature (893)..(893): n is a, c, g, or t
  misc_feature (902)..(902): n is a, c, g, or t
  misc_feature (906)..(906): n is a, c, g, or t
  misc_feature (936)..(936): n is a, c, g, or t
  misc_feature (979)..(979): n is a, c, g, or t
ttgtcagcatccacanggatagacgcggacagcnggccaggntggtgggctaagaggcagcntgccgggcctgaggcngcggggcaaaccgctgcatccgcccctcgagccccggccgaaagtggcggatcanaccctgcacaggccagggggccccgtaacccagagcacaaatcgtatggcctcctatctncttgctgacctcccacagggagtggatctcggccggccgggcatcccccctcacgaaacgtgccancacctngtccanccagtccacacccncacggcatggggtacactggccaaanccctngtgcttttagaactcaatgaggcgggcgagggctttcacgangtccgttgagcggnccatgangatcaccgcagccgtccccaggcctgtttntccctcccccagcccatcgaagtccatnagcnccgtctcaaananagacttggggatcagtggggtagacgagccgccaggnatcacagcaaggaggttgtcccagccgcccgtaanacccccagcatgcntttcaatnagttctttcaagggcacagacatctccccccccacagtccaagggtggttgacanggccagagaagtngaatagtttggtgcctgagtagcgtnctctgccaaagccagccaaccagggacctncacggcggcagaatgtgggggacactnccactttttccacgttggccacagttgttgggcagccaaacactcccacgtttgcngggaaggggggcttcaggcggggcttgccctgctttttcttnatggacttgatgagcgcngtttccnctncacagaagttggccccagccccgcgcaccacaaacacgttaaaatnatagcaaganccacatgcnttnttgccaatnaganctgccttataggcctcttggatggccaccngcagattggaggctcactgtagaattccctcggatgtagatanaggagcccgggccccatggccggcccccacaggaagc

SEQ ID NO: 696607 - DNA, 301 bp, Homo sapiens
tagctgggatgtaaggcatgcgcaccacgcctggtaatttgtatttttagtagagacggggtttctccatgtcggtcaggctggtctcgaactcccgacctcaggtgatccacctgcctcggcctcccgaagtgctgggattacaggcgtgagccaccatgcctggcctcatttttcatatatttgtaaattccaatgaggcagggaaatgtgctttcttaaaatattgttatcttgtgctctataagtgattacaaaaacaaaaaatgttaatttagctgaagtggctaataattttaat

SEQ ID NO: 696608 - DNA, 773 bp, Homo sapiens
cgatgacacagcatgggcccagaggcaggtttgctacacaggagcgagcgacgcaggcggcggccccagtcgactcgcaactgcctccctgacgcagcaggcggcctagcgcctcaatcgacccccgagaagccatcgccgtccaccgggcaggagaacctacggtgatccataacagccatgcttcgcgagtcgactaaagctacgtcaacaactatggcgggcgacgggcggcgggcagaggcggtgcgggaaggatggggtgtgtacgtcgacccccagtggcccccaatccgagatgggaaggggccggctcgcccctcaataactggcggctagtagcggagtgcgtcctggcgtaccatgatagcgtcctcgcgtgcgacagccaagtgggccggcaggtgaaagtagtaggtgtctcgagagcgaggcccgtcagagagtgtaccgggggaccttcgaggctccctgggtggccatagacgagaaggtccctcgggtgggaatagagcgaatccctggctacgaacgagttgccgggtccgagtgtctgcgaagagaggagagtgacgagaaagcgcgttacttaccgttcggtctaggcatgcggtaggcagcctgcgtaccccgaaggaaaccggaggatagatgaaggacgccgaaggcactaccctgtcttcagcagcagaatctcagagcatgccttccgtctacgagccggtctcctgttgacgacccaggagaggggctgcgggacttctcagttccta

SEQ ID NO: 696609 - DNA, 560 bp, Homo sapiens
gactagttctagatcgcgagcggcctgccctcatctcatttctattaaacgcctttgccagctaaaaaaaaaaaaaaaaaaaaaaaaaaaaaaaaaaaaaaaaaaaaaaaacaaaaaaaaaaaaaaaaaaaaaaaaaaaaaaaaaaaaaaaaaaaaaaacacacataataaatgaaaaagaaataataagaataagagaaaagggcggggtcgctttaaccaatgatcgttgattggggaagaactgcatagcttggggaatcttaagttagaaggaacctaacgttctgtgagttgtgacataattgggaaaaacataccgtacagaggattttaaagctacaaggggaaaaatagtagaagattgtgtaaaaagttggtaataaggggtgtttaaacagtagactgacaatattggcttagccgtggttgtgcaaaagtttgtggggcataatccagggagattctgaatttaatgaaaacttattttattacgccgggaagctatagctgaaaaaggagatatagtatagtagatataaatacacaataatatagtg

SEQ ID NO: 696610 - DNA, 218 bp, Homo sapiens
aacattcctggcgttcttcctttctttctttctttttctttctttctttcttttctttctttcctttctttctttcttctttctttctttctttcttttctttctttcttttctttctctctctctctttctttttctttctttcttctttctttctttctttttttttttttttttttttttttttgtttttttttttttattggaaaaaaacccgg

SEQ ID NO: 696611 - DNA, 707 bp, Homo sapiens
  misc_feature (60)..(60): n is a, c, g, or t
  misc_feature (92)..(92): n is a, c, g, or t
  misc_feature (320)..(320): n is a, c, g, or t
ggccttctcctgctgctgctgcgccccatccccccgcggcggcagttccagcccgcaccngcgtcggtgcccgcgccctccccgggccccgncatgggcctcaccgtgtccgcgctcttttcgcggatcttcgggaagaagcagatgcggattctcatggttggcttggatgcggctggcaagaccacaatcctgtacaaactgaagttgggggagattgtcaccaccatcccaaccataggcttcaatgtagaaacagtggaatataagaacatctgtttcacagtctggtgacgtgggaggccaggacaagattcggnctctgtggcggcactactttccagaacactcagggcctcatctttgtggtggacagtaatgaccgggagccgggtccaagaatctgctgatgacctcgagaagatggacggacgagctgcgggatgcagcgctgctggtactaggcaaccaagcaggacctgcccacggccactgcccgtgagcgagctgactggcaagctgggggctaccagcacttacacagcccggcacgtagggaaggtccaggcacaccaggggaccaccaaaaggcaacaggtcaggaagagagggccagggaattggctgatcacaacgagctgaacacagaggcaaaccagccaaggggcacggcacactgacggcccggacagacaccatgcgtacaa

SEQ ID NO: 696612 - DNA, 209 bp, Homo sapiens
tgcctgctgagtcgacttctagagttatccccctccataggaccgcatgtgacgggcgatccacttcttgcttcagcgcttctagcaaaggtgtcagaccaaccgacgctgaaccatcaccagctggcgcgcccatgtttgtgaaaccgcgttttgccaaactctggccgaatttatccaagaaccctgctgctgcacatgtgtgtcct

SEQ ID NO: 696613 - DNA, 590 bp, Homo sapiens
  misc_feature (60)..(60): n is a, c, g, or t
  misc_feature (92)..(92): n is a, c, g, or t
  misc_feature (320)..(320): n is a, c, g, or t
ggccttctcctgctgctgctgcgccccatccccccgcggcggcagttccagcccgcaccngcgtcggtgcccgcgccctccccgggccccgncatgggcctcaccgtgtccgcgctcttttcgcggatcttcgggaagaagcagatgcggattctcatggttggcttggatgcggctggcaagaccacaatcctgtacaaactgaagttgggggagattgtcaccaccatcccaaccataggcttcaatgtagaaacagtggaatataagaacatctgtttcacagtctggtgacgtgggaggccaggacaagattcggnctctgtggcggcactactttccagaacactcaggtggagtgttgggaggggactttctaaccgcactggaaaaggcgtctgggctggaacaacagaatcggtggcctacgctgggcccatatgccacggaagctacccttatccacttctaccctttctgcttggatatcctgtactcactattcaggactcaccttagtcttcaccagctagcacttatattcagaagcatgatgctgggaccaggctgactgattgatccgtcataac

SEQ ID NO: 696614 - DNA, 391 bp, Homo sapiens
gcgtcgacgataacatataaatcctttcacatctatttcggagtagtagcctactgtccttctttgttgcagcctaatgcagatcccagttaagacgtgccctcaccagtgtcaagtgaagtcagcaagggctggtcaggtgccactgatactagaggcagagggcggagaggatgagagagaggagctgagagaggaggagaagagagaggaggaggagaagagagtgcaggtcctagtggtacaagaggtagatgatctagaggaagagagaagagaaaagagagagtgcaggtcctgcacaacggtcaagttgacatggcatttcgtaaacctgtctggttcgcctcgagataagaagtcgttcagtgatgctgaatattgaaatttc

SEQ ID NO: 696615 - DNA, 152 bp, Homo sapiens
gttaatctgatgtgtaggcttacaggattgtagaatttgatggatgtatttggagaccgggttatgagactagtttggtatttttggtagggacggggtttggccatgttgcccagggtggtctccaactcctggtctcaagggaccgcccc

SEQ ID NO: 696616 - DNA, 1684 bp, Homo sapiens
  misc_feature (283)..(283): n is a, c, g, or t
aatagaggtgtcgttccgatgattaccccatagacagccaacagatgggaaggggaacatacgagtcatatcgggcattggtgcgctcatctgggacacgctacgcattcagtgcggccacagatcacacccaggtacgtgggccgactcgtggactcgtacttagagatggcgggtaggatctctcacaagacagacgaacgcagtcggaaagagagtttgcacggacacggcagggcgtgcctggaagagtgtgcgcatacacgggggccgtcccttgcanagaataaactgccctggagaggtcatgtgagcattaacaaatcttggaacacatggcatagaaggacggctggaaaaccagtttgcgtttactcccatcgcgagtcttggagtaaggtacatgctcatctgtttggagaacatactatgtggaacgcaacgctatggctagaggctctaattgaagttgtttgggagcgtaaagtgcgagtcttggaatagacgcttcgcgatggggaaaacgaaaccaaagggagggcaccgtatgttagtaactagacatatgagcgagttgaagtataccaaggtgcgcaacggattcaagtccatatgcgacatatgggaccctgagggtgtggccatctggatacctcttcggggattgtgggtggtaagcttttggcttggggagattaaggtataggggttttggaggagttatatggggaaaaagggcattacggagttacaacttcacttacggcggaaaaaggaatagaattggtggccgccacgaaggtaaaccacccagagaatttgaaagctccgcaattaggccacacccgttcgtataccattgtggtgggcaacgttacttccaatcaaatcggaaggcctctcggtgtgagagaattggggctcggttaaggacaaaaaccgaacaaaaccctttaaggaggatttgtgggttacaccctgttgcactcgcgaattacgttattaccatttagagagaataggatgggtggccaaatttttggccaacacccaatgtgttgggggtaatgtccccttacaaatttgcggccacggttattaaaacaaaagggaacggccgaagtggacaggaaacacaaaggggcaaattaaatttagggcaacggaaggggaaaaacaatgttcatgaggttttatgcaaaaagaagggggaaactagaggggggttccacgaaattggaggaggcaatctggtgtgattggaattcccaacttcacttaaaggaagggcaaaacaaccaacacaaacgtatttgtggcgtgcccgttttaatccacagagatatagtgcccccccaccatgtaatatggcaaagcctatatggtatgaaaaagccgcaaggctcatgattaggggagtatgggtggcgccacacaatataatggtgatatgtatcccacatgtggtgggtacattttttgagcgtcaaaaacattagggggtgaattggaaaacacaagatatactttattggtgtggggccagttaggagagggatatagcgacacacagaaaacagagtgtgttatgctcgtggataataagaccacagagcgtttgcggtcgcgcaggaattaatgaggaaggacagatatataatcaacaaaacgaggggagagagaa

SEQ ID NO: 696617 - DNA, 111 bp, Homo sapiens
cttgtcctcatctaatctcgccggcatgtggtcgttctttttgatattttttttacccctacaaaaaaaaaaattataagggtcattttttacaaaaaaaaaccaataggc

SEQ ID NO: 696618 - DNA, 690 bp, Homo sapiens
  misc_feature (12)..(12): n is a, c, g, or t
  misc_feature (40)..(40): n is a, c, g, or t
  misc_feature (64)..(64): n is a, c, g, or t
  misc_feature (72)..(72): n is a, c, g, or t
  misc_feature (79)..(79): n is a, c, g, or t
  misc_feature (124)..(124): n is a, c, g, or t
  misc_feature (126)..(126): n is a, c, g, or t
  misc_feature (145)..(145): n is a, c, g, or t
  misc_feature (167)..(167): n is a, c, g, or t
  misc_feature (204)..(204): n is a, c, g, or t
  misc_feature (228)..(228): n is a, c, g, or t
  misc_feature (253)..(253): n is a, c, g, or t
  misc_feature (267)..(267): n is a, c, g, or t
  misc_feature (270)..(271): n is a, c, g, or t
  misc_feature (280)..(280): n is a, c, g, or t
  misc_feature (293)..(293): n is a, c, g, or t
  misc_feature (332)..(332): n is a, c, g, or t
  misc_feature (358)..(358): n is a, c, g, or t
  misc_feature (365)..(365): n is a, c, g, or t
  misc_feature (368)..(369): n is a, c, g, or t
  misc_feature (390)..(392): n is a, c, g, or t
  misc_feature (454)..(454): n is a, c, g, or t
  misc_feature (457)..(457): n is a, c, g, or t
  misc_feature (463)..(463): n is a, c, g, or t
  misc_feature (467)..(467): n is a, c, g, or t
  misc_feature (482)..(482): n is a, c, g, or t
  misc_feature (486)..(487): n is a, c, g, or t
  misc_feature (490)..(490): n is a, c, g, or t
  misc_feature (501)..(501): n is a, c, g, or t
  misc_feature (526)..(528): n is a, c, g, or t
  misc_feature (533)..(533): n is a, c, g, or t
  misc_feature (538)..(538): n is a, c, g, or t
  misc_feature (541)..(541): n is a, c, g, or t
  misc_feature (546)..(546): n is a, c, g, or t
taagggtgtgcncttggccacagtctcagctgggctgtgnggtacatgctgccaagggtcgggngccaaaanaaagcanaatgaagccaggtccccaaggaagtgagggcccaaaatagggagngngggtgatgagggtggagtncaaatccagatgtcagagctanaatcgcccccaggtagcggagctcatgggcaagggcngggccaaggggctccttcccgaantccaccaggaagtgggggttcaatntcagccctcctttnacnngtgtctacntcaacctgcagantcacagagccttccctgatgagatcagggtaaaactggngtgtcccaggcactggtacagcgacntggtgantgnnaaaggcgcttcccatccaggnnngagcgggatcatctgagggcctccagccacccgttttcccttgaccataggggctcgtggtnggngacttnagtncctcgtcctccagantggnnacngggcctccctnaacaatgctgcctccgaggaaagannngtccngtganggnggggnctcggggggtcagagatgtcaaactggctacaggtccccatagagtcaagttgctgaatctacaggaagggggcggcagggacacgcaggatgcggaagacaggcctggcatacgggcaagagcagcctacaaaactagggagg

SEQ ID NO: 696619 - DNA, 110 bp, Homo sapiens
cttcatgttgactctagagtgatcccccctcgattgtgcttctgcacccctcagcctgcagcccccgccctgtccctctccctgcctgccccacagagagagctgtctgt

SEQ ID NO: 696620 - DNA, 402 bp, Homo sapiens
  misc_feature (49)..(49): n is a, c, g, or t
taccttaaaccgtgaaatataacatcttttaaaatttatttttaaatancccatgcaattttcacattgtaagggcccactttttcatgtatcatttatctctcttctcagctaaagactggggccgggcacagtggctcactcctgtaatgccatgactttgggaggccgaggtaggcggtttgcctgaggtcaggagttcgagaccagcctggccaacatagtgaaaccccgtctctactaaaaatagaaaaaaattagccaggcatggtggcatgtgcctgtagtccagctactcgggaggttgaggcaggagaattgcttgaacccaggaggcggaggttgcagtgagccgagattgcgctactgcactccagcctgggcaacagagcaagactccat

SEQ ID NO: 696621 - DNA, 929 bp, Homo sapiens
gaaagatggctgtccttgcgcctctgattgctttggtgtactcggtgccgcggctttctcgatggctggcccgaccttattgccttctgtctgctctgctttccattgctttcctcctcgtgaggaaactgccaccgatttgcaatggtctccccacgcaacgcgaagatggcaacccgtgtgactttgactggagagaagtggagatcctgatgttcctcagtgccattgtgatgatgaagaaccgcagatccatcactgtggagcaacatgtaggcaacatctttatgtttagtaaagtggccaacgccatccttttcttccgactggatattcgaatgggtctgctatacctcacactctgcatagtgttcctgatgacctgcaagcccccgctgtacatgggtcctgagtatatcaagtacttcaatgataaaaccattgatgaggagctggagcgagacaagagggtcacttggattgtggagttctttgccaactggtctaatgattgccaatcctttgctcccatctatgcggacttgtccctcaagtacaactgttcagggctaaattttgggaaggtagatgttggacgctacactgacgttagcacacggtacaaagtgagcacatcaaccctcaacagaaagtcctaacctgattctgttcccaggcggagaggtcattcgtcggcgggatgacagaaaggcgagtggtcttggactctctgagggaagggatcgggatcacttgatgggtttcacggaccaaaagctcaaggggggacttcaagaacgtggccgtcccacggcatgggacacagcaatgaccgggtggcccccgatagaattggcgcgcctaacacttcggcttttggccgggcgccttagaagacaaatagaccctaaaaataagttcccactcac

SEQ ID NO: 696622 - DNA, 619 bp, Homo sapiens
  misc_feature (17)..(17): n is a, c, g, or t
  misc_feature (30)..(30): n is a, c, g, or t
  misc_feature (44)..(44): n is a, c, g, or t
  misc_feature (46)..(46): n is a, c, g, or t
  misc_feature (49)..(49): n is a, c, g, or t
  misc_feature (71)..(71): n is a, c, g, or t
  misc_feature (75)..(75): n is a, c, g, or t
  misc_feature (99)..(99): n is a, c, g, or t
  misc_feature (155)..(155): n is a, c, g, or t
  misc_feature (169)..(169): n is a, c, g, or t
  misc_feature (186)..(186): n is a, c, g, or t
  misc_feature (196)..(197): n is a, c, g, or t
  misc_feature (214)..(214): n is a, c, g, or t
  misc_feature (227)..(227): n is a, c, g, or t
  misc_feature (243)..(243): n is a, c, g, or t
  misc_feature (249)..(250): n is a, c, g, or t
  misc_feature (274)..(274): n is a, c, g, or t
  misc_feature (276)..(276): n is a, c, g, or t
  misc_feature (283)..(283): n is a, c, g, or t
  misc_feature (297)..(297): n is a, c, g, or t
  misc_feature (313)..(313): n is a, c, g, or t
  misc_feature (318)..(318): n is a, c, g, or t
  misc_feature (329)..(329): n is a, c, g, or t
  misc_feature (332)..(332): n is a, c, g, or t
  misc_feature (336)..(337): n is a, c, g, or t
  misc_feature (339)..(339): n is a, c, g, or t
  misc_feature (342)..(342): n is a, c, g, or t
  misc_feature (348)..(348): n is a, c, g, or t
  misc_feature (364)..(364): n is a, c, g, or t
  misc_feature (382)..(382): n is a, c, g, or t
  misc_feature (388)..(388): n is a, c, g, or t
  misc_feature (415)..(415): n is a, c, g, or t
  misc_feature (437)..(437): n is a, c, g, or t
  misc_feature (442)..(442): n is a, c, g, or t
  misc_feature (462)..(462): n is a, c, g, or t
  misc_feature (475)..(475): n is a, c, g, or t
  misc_feature (489)..(489): n is a, c, g, or t
  misc_feature (493)..(493): n is a, c, g, or t
  misc_feature (496)..(496): n is a, c, g, or t
  misc_feature (502)..(502): n is a, c, g, or t
  misc_feature (511)..(511): n is a, c, g, or t
  misc_feature (532)..(532): n is a, c, g, or t
  misc_feature (538)..(538): n is a, c, g, or t
  misc_feature (541)..(541): n is a, c, g, or t
  misc_feature (543)..(543): n is a, c, g, or t
  misc_feature (603)..(603): n is a, c, g, or t
tattacgtaagggtttnttttatttaaaanatcattcacaaaanancanatccatagatttactttctgtnatanagctgaatgtgttaagtgtttggnattccattcttacatttaaaagtaaactgggttgcccagcagtttagatgcatgtnttttgttctttatnttatccacattgaagangtaagtgggnnatctgaaagcatcgggnttgattacaccanaaaatgcatgtttttntgaagnnaagtgttggggttacacaaatggntnttatctnagaagcagagaagnggaaaggggggagggnggggngagagtgctgnggnttgnngnggncttgtnacaagaaaaagtaggnaaagcccaggatgacggngggggnccaaatactaagcacattccgctgggngccccaggccaccctggccctnccatnacctggcgagggcctttttnccaggctcctgcngccggccgcccccnaacngcnccccanaggacaaantgggacttgggttctgaaggntttttnatntnttcacacgcaggcgttcaagcacaaaagcctaaaccctagcactcccacataacttctgnaccctgcacatgggaa

SEQ ID NO: 696623 - DNA, 196 bp, Homo sapiens
actatagagtatcccggaggagacacaggtcagcatgcgaacaggcactcagcagaggtgtgaggcggcaaaggttgtcaggagaaaaagaagacgatagatacagcggctcacgcctgtaatgccagcactttgggaggccaaggcaggcagatcacctgaggtcaggagtttgagaccagcctggccaacatgg

SEQ ID NO: 696624 - DNA, 285 bp, Homo sapiens
  misc_feature (77)..(77): n is a, c, g, or t
  misc_feature (165)..(165): n is a, c, g, or t
  misc_feature (169)..(169): n is a, c, g, or t
  misc_feature (203)..(203): n is a, c, g, or t
  misc_feature (240)..(240): n is a, c, g, or t
  misc_feature (255)..(255): n is a, c, g, or t
  misc_feature (264)..(264): n is a, c, g, or t
  misc_feature (273)..(273): n is a, c, g, or t
cagggttttttttttccctttatcatctgatgatgaacttaatgtttccctttgtattaaaggaaaactaagtcccnctgtgatttttgaaccaagctattcctaggcctgagttttattttgttgacccaaaaataaattaaaaggccaagcgtggtggcatgngccngtagtcctagttgctgaggtaaaaggattgcttnagcccaggagttcaaggctgcagcaagctttgattgngcccctgccctccanccttggggncagattaanacgctgtcccca

SEQ ID NO: 696625 - DNA, 247 bp, Homo sapiens
accacttcgagctcggcacccatccttccttctttcacggaagttgagcatttggtgactgaatgctgcgtttgtgcgtcctaacccctgtaattgtgggctgtgaaagcatgtccccagatctgggctttatgggcctctgagggagccccagagacacgctttggaaacataaaatactaaactgggggtggtggtttccctcctggcgttcctacaatagatacatcattgcgggaaaatagga

SEQ ID NO: 696626 - DNA, 755 bp, Homo sapiens
ctcaaccgggaggcggaggttgcagtgagccaagatcgcaccactgcactccagcctggcaacagagcgagactctgtctcagaaaaaaaaaacaaaaaccagtttaggctgggtatggtggctcaccagcactttgggaggctgaggcaggtggatctcttgaggtcgggagtttgagaccagcctggccaacatggtgaaaccctgtctttactaaaaatacaaaaattagccaggcatggtggcgtgtgccagtaatcccagctacttgggaggctgaggcgcgagaatcgcttgaaccctgcagatggaggttgcagtgagcagagatcgcaccactgcactccagcctgggcaagagtgagactgtgtctcaaaaggaaaaaaaaaaaattaaaaatgtggctggtattacttcaaacctactcgggataaatttcccagtagggcatctgaaatagctttgggcaaaagcaaaacaggttagtcaattaccccaagggggcttcaacgtagtttacatgcgacctaccgtgtcgaggggcttttttacctgggggggaaaaatccttagctgaacctgctactcctgggcgcattaggtcgttttatgcgactttggtttacggagtttctggggggacaaaccctggcgagagctacgggcccgacctttttttaaacagaggcacggcaacgtggccggggatgtagtgacccttgccggggctcctagggaccgtctacacggggg

SEQ ID NO: 696627 - DNA, 623 bp, Homo sapiens
  misc_feature (1)..(1): n is a, c, g, or t
  misc_feature (63)..(63): n is a, c, g, or t
  misc_feature (75)..(76): n is a, c, g, or t
  misc_feature (78)..(78): n is a, c, g, or t
  misc_feature (84)..(85): n is a, c, g, or t
  misc_feature (105)..(106): n is a, c, g, or t
  misc_feature (128)..(128): n is a, c, g, or t
  misc_feature (133)..(133): n is a, c, g, or t
  misc_feature (137)..(137): n is a, c, g, or t
  misc_feature (140)..(140): n is a, c, g, or t
  misc_feature (171)..(171): n is a, c, g, or t
  misc_feature (188)..(189): n is a, c, g, or t
  misc_feature (191)..(191): n is a, c, g, or t
  misc_feature (198)..(199): n is a, c, g, or t
  misc_feature (202)..(202): n is a, c, g, or t
  misc_feature (208)..(210): n is a, c, g, or t
  misc_feature (213)..(213): n is a, c, g, or t
  misc_feature (242)..(242): n is a, c, g, or t
  misc_feature (275)..(275): n is a, c, g, or t
  misc_feature (277)..(277): n is a, c, g, or t
  misc_feature (287)..(287): n is a, c, g, or t
  misc_feature (301)..(301): n is a, c, g, or t
  misc_feature (361)..(361): n is a, c, g, or t
  misc_feature (376)..(376): n is a, c, g, or t
  misc_feature (380)..(380): n is a, c, g, or t
  misc_feature (399)..(399): n is a, c, g, or t
  misc_feature (422)..(422): n is a, c, g, or t
  misc_feature (424)..(424): n is a, c, g, or t
  misc_feature (445)..(445): n is a, c, g, or t
  misc_feature (481)..(481): n is a, c, g, or t
  misc_feature (486)..(486): n is a, c, g, or t
  misc_feature (488)..(488): n is a, c, g, or t
  misc_feature (495)..(495): n is a, c, g, or t
  misc_feature (500)..(500): n is a, c, g, or t
  misc_feature (539)..(539): n is a, c, g, or t
  misc_feature (587)..(587): n is a, c, g, or t
nggttggaacttgctggaaaaaaaaaaaagttttaatggtattaaaaataaatttaaaaaagnattctagcacannanttttcnntaaactagattatgttgtcnncttttttcttaatcttgtaggngtgtnggtngtnaagaactagggcttattcctattccaaatcnatcttgggctccggggnngnggcggannggnacttgnnngcngtttctttaagatatggatttcttttttnttcttgctggtaatattttgcggcactgggtgngngcaatttttnttcaagggcgtcgngatgctgagaagtttcgttgataacctgtccatctctagtttcaaccgtcttaatcagangtgtcctttttgagngggnatcaaccagggggggtggntccagattagtttccctcaggtnanaggaggaaaagtttggaagangcagagaaatcctgctctcctcgccttccggcagcntcgcngnggggggnaatcncaatgtcaagggccctctttacattgagcaggtcttggnattcacgggggggggggcgcatttcctccttcatattctgaatctcancctgcaggcggccaatagtgtcttggtagttaaaag

SEQ ID NO: 696628 - DNA, 975 bp, Homo sapiens
aaaacgacagggtctgccccacgagaggctagtaagagctagctgtctggtctggtcattccttcttggagatagagatgtcttctaataggaagatctgtgctaaatcgtcaaagaagtactagctacatgacttgagttccaccatcccaatcaagatacttgtccatgacaatcaagctacgtgtgaaaggcatctctcgtgaatgggatacttgctgtttaatatcgtcattgtagatactcgcttgaatttcaagaaggtgcatgaggacatttagtaaacagctcattgtccaaggacataagagcgtatctcataggtgactggacgtaccccagcgtgccctcgtgcatgatgtatcgggtctcttgccaggggatcggcactctcctcactgaactcacttactcatagatctgtgcaccatttagtctcgtcaaaccactaagtgtggtgcataccatggcgtgttatatgtctactatcctgtctcgatctgggcgaggtagagtacttactcatgctcttgtgagaacgaaaaaaccctctgagggaaggaggcatacagaaaatcgaacctcagtcactgtgctgtacaaccccttccacagtagaggatcattcctactccctttcagggtgcttgatgattgtttcatcccaatttgatcggattcttcttggtggtagttaaaacatatccgcaggtatctcttgcggagtaacagggggaaattgtgggtcaccatcaggaggtggcaagagcagagatgggagagggaattgaggacggtccattgtaactgaggatttggttgccataggaaggggtggcggggtctcccgaaaaaaattgtggaaagtgtcaagcatgaaagtaggatcggaggatagaaaaggagagcaaaacatggtgaaatatggagacgtcacagcagaataaaaaacgggtggtgattatgtatgtgagt

SEQ ID NO: 696629 - DNA, 1657 bp, Homo sapiens
  misc_feature (192)..(192): n is a, c, g, or t
  misc_feature (217)..(217): n is a, c, g, or t
  misc_feature (403)..(403): n is a, c, g, or t
  misc_feature (448)..(448): n is a, c, g, or t
  misc_feature (488)..(488): n is a, c, g, or t
  misc_feature (636)..(636): n is a, c, g, or t
  misc_feature (1080)..(1080): n is a, c, g, or t
  misc_feature (1131)..(1131): n is a, c, g, or t
gtgcctgtctttcctggcctgtgcccctgtttcccagtgactgatagtgtgcactcctgcacctggacccctgtgtccctggctgctgctggctgtgtggcactgctgcccatccctgctgctgctgctgtgtgtgctgctgttgtgagtggtgtgtgtgtgctgtgcctcgtgcctgtgctgtgtgtgacnatgtgctgtgtgtgtgacctgtgtngtatcctgatgtgtcgcaacctgatgtgcttcacgctgtgtcgcattgcgctgtagtcgtgttcgctgccgtgtgtgctgtgtgaaattcatttgacctatacgacagtgcgtgtcccgaagtctagtacagtccacaacatgaaattgtgtaaggctcaatgcgctcgcaagtttgtcgcttccntacacagcgcaagtgcaagcgaatagcgaccaagacagttggtcntttgagacccttttgcctgtgattccccttcattcggatnacttatgatagacgactgtgcatgtgacgcaaatttgtgagcgagaatcgatagacgaccacttctagtgctacagttatgtgtgttcacacagaacgttcaagcgctttgatcattcaagcttggagcctggtagatctttagagancacgccaaggacatacaaacatgatttacacacgttagtatcaggatatgcgctgatgtgtacaacaagaagccactaagtagctggcctattagcgctcttgcactactatccttcggccttgtccgacgagaagtggcacttactgcgcacacggaacgcgccggaacactacagacaacgctgaactctacacacgacaagtgctggacacagcttacgcctgtactctgagacctgcgtttggcagcgccatgacccaccaagaggcccgaagttataattcgcccattggtgtgctacaccttatattgctagaacagccattcgcttgagctttaagaagacgctcagagaatggctcgatgaactgggactcagatagatgagcactccacggatttttcacactgagatcctgagtaatttctggtaaccttgaanagcattcaagcgtgactacacagtggctggatcgcattattatggcgcccnatatacattgagctaccatcacagtgtgaagagctattctttgttaccactcacacttggaaggcgttcagaacatttaacgtcgaaccactcttagcgagttatgaacctgtttcttgaaccacgtggttgtaccacttgggccaccagagttcagaagttccgcacatccatggggcgacttgtgtataccccacctagtgaaagcgggtgggtacggaggaccccgtgcccagggtcagtcaatcatcggacacaagtatacactgcattttgtttagtccacagtaaaaagcatgaagatagtgccaaccatgtagatggggacgtatagatcgccccaacccgaaccaatcaaaaccggggatcacaaggagtaaccaacaccagcacccacaggagtcaccagctatatataacacgcgggtgatgaccattcactatgatctgattgtagataaccattgatcgcaggtagacacctttacgtgtggtgaaacccgtgtgtggaagtgacatcgggtag

SEQ ID NO: 696630 - DNA, 133 bp, Homo sapiens
ataatacaagcccggatggggatactacagagcccgcgtgacattatcccattctaacctttattcccgaacagcgtgaagtagagagctgctagtgcagttcacgattacaatgggataacacgttcgcgag

SEQ ID NO: 696631 - DNA, 1313 bp, Homo sapiens
ctcggagctggggagaaacaggccctccttgtcctatgtgcagcccacacttttgtcctggctgtgggtggcatccattttgagacacctctgccacggctgcacgaccctggaggcgacacgggacgtgtggacacgacggacgggtgtaacgtggtcgacctgcgtgctgacatgggacggtgcaggtcctcggtgcgtttggcagaacgacggcttctggagtttcgaggcacataccatcctttcaagagcttcaggatattgagggcgacttccctggtgtctaggcggagtgtaccatgtccccatgttcaggtcagcacctgcggagaccactccacccctcttcccctatcgcccctggactttcctgacatactacctgggagttcgttcactagtgacaggtcgtgacgctgtagctcgatcctatactgatcatctgtatgatacccgactttttcctacctagacagaagggatggtggacgacgggtcggtggatctccttctacacactcactcataatctgaacacagcgcaatcgaggcgctttggccaagtcgccaggtcattctcaaacttagtccgccacagtaaaccatgaatatatgatcttgcaccttccaccttcacactattgcacaacaaaacgcctctttagaaatcccttaacaatgggccgctcagcatttcagacggaaattactcagcaaaggaccaggtcaagctcttcaccaaggaccaagttgagggcacctggcttgatgctcaggagctatggccatgggtgaatgctagggactccaacgcccctcggggtcgccaatgtattcgaccaatacctcgggctgagccaagttacaatggacagggccgacaacaccgcggcaccgcgcaccacgagccacatatacagggcatgacagcacggcagcggagaaccaccgggacactgccacatggtaggcaccggccagcgtcccacgtcgaacgtggcaaccactgagcagaaaggcgacactccgtatgtggcaaaggagcgacaacgaacaagctggtactcagagccgagacagggacagatgacaggagcaagcacgcggacgactagagcgcgcagggccgacatgaaagcgaaaagccaccaagccaatgacgcagaccggggatcagcaaggacgtagagctaccactgaaaacagcacgaaccagcaggcactagccttacatcagcggtgaaatcgaagcaacaggctgtggtacgactggtcgtggtcgtgcttcgctgtagcacagcccgcacata

SEQ ID NO: 696632 - DNA, 870 bp, Homo sapiens
  misc_feature (744)..(744): n is a, c, g, or t
ctacagtttaaattctgatttttctggctacaagtttctaaaataagttgtgcttccttaaagtcctatgaactgaaaactagatgttttatcaggcgctgcctctaaaccccccaaccatcacagaaggaaatctcttcactgctggcattgacaactaataactgagggtgcccggaatccttcaccccatgtctagtgagtctacggaaccagggtaattgagacaatatctgttacaggaatcaactcctggatacatcacacttgagtcaaagcctggaaagctgaggaagcaacccctgagagcccaaaggaacgtcctaaatataatggaaattatttactacgccttgtgggaattgctttactctactatttgcagtaggactatatactatagcaccttcagggtggaatatctgacagggaatctcaattgctgtagcattttgcttaattattatcctcatagcaggaataactgttactaacaaaagataatatgtgggcctttccaaacatgtgcctctgcctctcattaggtagggaatgttgtttctatctcaaccaatcaggcctagtaagagactgctgaaaaacttaaaggtctaaaaagctaagggaataccaaaacaaccagacagattcttggtttgggagcagaatcatagcatgggtcaccccattcctgggccctctcctaataatatgcctaggactaatggtcttaccctgcctaantaacctttttcaaaagatttttagctgacagactcatgaccatttcacacacactacccaaaaacattacagggtatttctgcagtcaatccaagacccaaaactgctggccccttgcacaggaag

SEQ ID NO: 696633 - DNA, 359 bp, Homo sapiens
cgcgtgctatcccagtctctaggaggctaagaggcgggaggatagcttgagcccaggagttcgagacctgcctgggcaatatagcgagaccccgttctccagaaaaagaaaaaaaaaaaaaaaaaaaaaaaaaaaaaaaaaaaaaaaaaattagggttaatttccttaaaagaaaaaacccccccccccgtgggttggacccaaggggttttcactcggtgttgcccaggatgggttcttcaattctcttgactctcgtgactcgggcccaacttttggccccccaaagggtgctggggatttatgggctagtacgcccacggtgcccgggccatctgtgcggttgtttattaccgttt

SEQ ID NO: 696634 - DNA, 115 bp, Homo sapiens
tgaggatccccctgcatcccggggaggtcaccatattgatgccgaacttagtgcggactttcgatcggcatagcgcactacagcccagaactcctgttctcaagcgatcctccca

SEQ ID NO: 696635 - DNA, 1220 bp, Homo sapiens
ggccagcatggcggcgggggcggctgaggcagctgtaggcggccgatggaggaggtcggctcagccgggtcagttatgaggagactgcatgcgccgtcaaagccaagtccctgtccttgtgtggatccagtttctgggtcaccatgggctccacagtgtgcacagatgaacagaagttggtggcagaggttagctaagaagaactccctcagggttgcagtgtgtgaaagtgggaacgctcgaatggtagttcctgcaaggtagtcgtgaaaacactatgaacatttaggcctcgtgtttgccccagcgtatttcctgtgtgttcgatagaaggtctcaaggaagagagtctgcaccggatgttagagtggatgcaccatgctccccaggatgctggacccaaaacatacaggttcaggcgaaacatgacaatcttaagtgggctttccttctctcttacctcatggggtctagagtgaaacaatcttagatatgcagacgattccctgcaaagcacctttcgacttctggaacaggacaatttgtggaccgtccaatgtctagcacacacccattgacaaatgacatggtatgtgagtggacacacgggggaacctccatactaaatgcacacccagcggcgtggggggcgttttccatgcacacacgcacagcagtagcggtggagacaacacgttgtccttttcaaacgaagagtcgagttacaattaatttccaacggtgatctaacggccaaaggctacaatcggacataaattccttagtgccttccacggactggacaacgcaggggttttccgaacccaggggggacccgtcaacagaggggcccataaatattcccgaaggatggcgcgccctagccttaattccgctccaggcgttcttagttgttatcacctgggaaggaagggcgtccaattacggaaggggaaacgtggacctacttataacttccaaaggggacgccgtaagtaaaggccggtcctctgaaaacagggagaccttagcgaatataccaaacatgttgggtcccccaagtgatggtcatccccagagatattacgaagagggaaacgagggggctccaaagcagggtgcgctgagccacaaaacttaaaacgagccattcctggtcgaaactgccacccctattaatgtgctacacagggggcaactctcagtaccgggacacgcca

SEQ ID NO: 696636 - DNA, 119 bp, Homo sapiens
agttataatcagtgagggtggccaagggaagcttgacgcttttagagccgagttatcaaaatttcttccacagagtataatacaggactgtctgtatgggaaggcatccgacaagactg

SEQ ID NO: 696637 - DNA, 374 bp, Homo sapiens
tttttcccccgggtttgggggggcccccagttttttggcccccccccggggggaaaaaggggggtttttttgtttgttttaaaaagttgggggggttttttagccccccccttgggggggccaaattttggggcccaaaaaaggcctttaaaggggggggggttttttttttccccccccgggggtttaaagggggggggaaaaattttaaaggcttctcccccctgaaattaaaatgggggggggtggagggggggtggccccccggaacccggggaaaaaaatttggggcccccccaatttggttttttgtttttttttaaggggggggggcccccccccggaaaaaaaaggttttttgtttgttttgccca

SEQ ID NO: 696638 - DNA, 347 bp, Homo sapiens
cgacggttcgcatgtatcctatcatcaggcactttcccccttatccaactagctagcctataccctctgctgcccaagaaaatgagcccaaccagtacaccaggagtggggctccatatcagcccctaaggtcaagcctgtgtccactgtggaaagtagttgatggaaatgagggaacactcaaagagtacatatgccactttccatgtctaattagaccttataaaaggaaagaattggccagttttcagataaaccagaaaagcttatacaagagtttgttacgttgactatgttcttcaaattgccacgatttacaaatattgtcatccgcttgctgtgctgtg

SEQ ID NO: 696639 - DNA, 149 bp, Homo sapiens
gacgtaacacaatcaacaaagcaaaaaccacaccaaaagatcgctgccacattatgactgacaccagcatgacaggactgcatctccggtacaccattctaagccgaggctcagtcgtatgagattctgtgcgattgtccgccaccagg

SEQ ID NO: 696640 - DNA, 122 bp, Homo sapiens
  misc_feature (2)..(2): n is a, c, g, or t
  misc_feature (5)..(5): n is a, c, g, or t
angtnactgcacatcagtgttgatatcaactctttgaacagacgttgcacctttttctgatatactgaggaaactcggtctctagcaatttcttcaagtcatccctgtagacggatggaatc

SEQ ID NO: 696641 - DNA, 149 bp, Homo sapiens
gggattcaggaatagcactgtgcctggcacagcatatatttttaaagattattgtatacccttttatggtggtgaatgtctgtttatattccttatctatatttttttacctttgggaaacaataagcactgtgcggccgaagacactg

SEQ ID NO: 696642 - DNA, 1008 bp, Homo sapiens
  misc_feature (1)..(1): n is a, c, g, or t
ntgttgatacctctcaagtaataggaccccctggttcactcatagactcctctagaatggcattctcgttaccctgcttcgaattatacggccccgcgtcactcgttggtggccttcctatgagctgcaatcttgcgcccattttgccctcagtggcatcgccatatggacgcatacggtcatgtacgcgattgaatagcatcaagtcattgcatgcccatcaaaagatacaagtactaaacttatgcaagcgcagcacacaactcatgcgcttcaatgtgttgcccctttggggtagtttcacgcgctcttatatacgaaccttgcgtggcccacgaacttataactactgcgacgcaaatatcacgtcattacggacatatttttggaggggtgactagaagttccagtaatgcactgtccctagatcctcccgctgtgtatcttatcactctccacgcgtagcgtctatcgcaggagtaatggcgtatgcatagaaggcccaacagcttactagggtttccctatcttttgagcgacgtccaagccttgtagcaaaggagcaagcagaaaccttcaccaggcttgcctcgagtgccttggagagcctacgcacaggctccctctcgagccacatacatgcatgtccacgagtcccgctggtgctcctagccctttcgctgccctgctagtctgacagtgccagctacgcaaatccctttggaccgacagggttatcgtctctagctggcgttgaaagcacaaaatcggttctgtagtaattcaatctcgtagacccgaatagcttcattactaggctgctgcgcagccccactttctatagcagtcattatctcctcttgctggggactcatgtcagcatgctactagacaatagatctagtttaacatcacctgtgtcaactacaagatcacggaaggcatttgatgcagaatttatgcatgacaacatagaaataatatataaatagtgtttgttctgaactg

SEQ ID NO: 696643 - DNA, 800 bp, Homo sapiens
gatccatccaggccaaagtgcttgatcccccatatccaagtggctcccacagccctgtgtttaaccgacaatacgaacaaaggaccagtccaagaggggaacttctcttaagggtgttgtcggaaaactgacaaactaggaatttcatgagtctctttgtctgttgcagtccccgctgaaggagagcccttcatttggagaatgacagtttctttcggggagacggctcgaggacttgaacaaaattccatgcatttgcgaaatggatggtgaaagtacagtggtagctatgtccctttccgtctttcgtctttcatcttgtgatgtcccaagttgtaagaaatgtgaaagataaggtactatgttaagcccacataaaggtttacctccttgtagagacactgtccagaatctggactccctcttgtccaggcacgtgctgcccaagcctccaagctccatctccactcgcagattttatgacagctgcctgcaagtactatgacctcactatcagaagagttctcagctcccaaggctctgagcaaacgtggctacctgggggttctttcttcatctgctgaaggaatacattgctccttgacattgtagagcttctggcaccttggagacttgtactgaaagatggaactgtgcctctgcctgtctcccccaccaggggtgggagctctgcagagcaggaaacatgactcagtatatctctcaggtccctgtcagggccaagcacctagcctcgctcttggcaggactcagcgatgaatgctacatctgggcaaatt

SEQ ID NO: 696644 - DNA, 858 bp, Homo sapiens
  misc_feature (352)..(352): n is a, c, g, or t
  misc_feature (412)..(412): n is a, c, g, or t
ccactccagcccccattccagcatgaacagtggagtcggtcggggtccccagagtggcagctgtgtgtccgcgggttcacccgtgagaatccaccacaaggggtacccaccgcgaggcacgacagcttccttcaagctctttctgctcaaacattcatcgcggggcaagaaaagccgtgttgaatctctaccgggccgaaccttgggccttggtgtcagcgcacggcagggccacagagactacagccctggggttccagagccggctctcccgtgctctccagaaatcccagccatagtaaaaagaatctgttttttgagatggagtctcgctctcgcccaggctggagtncagtggtgcaacctctgcctcccaggttcgggcggttctcctgcctcagcctcccaggtngctggggctgcaggcatgcgccaccacacccggctgattttagtgtttttggtggagatggggtttcaccatgtttacctacctggctgctctcgagctcctggactcaaatgatccgcccacctaagcctccgaacatggtgggacgacaggtatgagccaccgctcctggcccgaaaggcagactctacatctctgcacttggccaggtagaaaccctcatttgtgtcccgatgatatcagagatcaggaaagctccgtgagccctcgtcttggtcacgtgactcggcccagaggcaagtggcaaagcaggaccttccaccatcagccctgtgggtcctgcacaccctccacaaaacagcctcgacccacggggacctgggctccgagttcctgcctggagctgtggtcaccgcttcattcactcttggatgtattttcactcc

SEQ ID NO: 696645 - DNA, 180 bp, Homo sapiens
gttcacacagatacaggcaatttgcaggctagctccatagatcacacctttttaggcctcaatgcaggcagaacaaaggccaactgatgtctcaaaagcaattttatgagtgataggtctccgtctttcaagaatgaagaaagtctggtttacaccgaccaagttgtcccgttgatgcac

SEQ ID NO: 696646 - DNA, 105 bp, Homo sapiens
atgctatatcaagcaacgacatgccaattctcagccaaatgatgacgatgcctcctcgtgatgcctacggctattgagcctgctctctactggtttcacgcactg

SEQ ID NO: 696647 - DNA, 686 bp, Homo sapiens
  misc_feature (352)..(352): n is a, c, g, or t
  misc_feature (412)..(412): n is a, c, g, or t
ccactccagcccccattccagcatgaacagtggagtcggtcggggtccccagagtggcagctgtgtgtccgcgggttcacccgtgagaatccaccacaaggggtacccaccgcgaggcacgacagcttccttcaagctctttctgctcaaacattcatcgcggggcaagaaaagccgtgttgaatctctaccgggccgaaccttgggccttggtgtcagcgcacggcagggccacagagactacagccctggggttccagagccggctctcccgtgctctccagaaatcccagccatagtaaaaagaatctgttttttgagatggagtctcgctctcgcccaggctggagtncagtggtgcaacctctgcctcccaggttcgggcggttctcctgcctcagcctcccaggtngctggggctgcaggcatgcgccaccacacccggctgattttagtgtttttggtggagatggggtttcaccatgtttacctggacaacatggtgaaagccctatctctacgaatgatgcagaaaaattagccgagtgtggtggcacatttctgtagtcccagcaacttgggaggctgaggcaggagaattgcttgagccctggaggtgaaggttgcagtgagccgagatctcgccactgcactccagcctgggtgacagagcaaggctctgtctc

SEQ ID NO: 696648 - DNA, 647 bp, Homo sapiens
tggagatgggactctcgctctggtcgcccaggctgggatgtgcagtgggcacgattttgggctcactggcaacctccacctcccaggttcaagcgattcttctgcctcagcctcccgaggcagggattacagggctgtatgccaccacgcccagctaattcctggtattttaagtaaaagacaggggtttcaccacgtgggccaggctgggtcttgaactcttaacctctagtgatccacctgcctcggcctcccaaaggtctggggattataggcgtaagccaccgtccccagcctgctgggctattttctaaattttatataagggaatacatatggtattttaataatttatcatgagaaaaaacctttatttatcacctaaaaaatgggtcttaccggcctaagggagaaggacctagatcagttgaccccctgaaagtctaactcttagtgattgaaccagtatccaggaaatagcatctttagaaaacctggaaggacatgtctacttctggggctctaagccttcggtcctataacaaattcatctccatatttctcctgccttcatggcttaaagctgtgacatttattcccatatctatgtttcttcatactcctcttggacaacggggagaaaaccc

SEQ ID NO: 696649 - DNA, 988 bp, Homo sapiens
gataggtaaatttctcaagggttataggttgaggttcttacaactttttgtggtgtgtgttgagcctatagctgactcagagtgcgttagtgacttcacctaaaaaagctaacctctcgtgctgagcgcgagcggatatgcggcgtcatggatgagtcctcagggcttcatgtctaataagtctgtgtgatgaaagccggttctgcgctgttccttcgatggcgaccttaattcatgatgaatgagctaatgctttatctgactttatacctcattggtcgcataccgtgtgccagatggtggttctcaataatgccatcgaacctcgtgcgtaatcttcccatcatttgtggtcaacccggggtagaattcctccataaacggtaaatccaaacttgtatgtaacgaagctgagcgcagagttctttcactggtagcaagttatgtcgcctgtacctgatagatggtgccctattctttaaagctactgctcctttcgaagttagattattggatggactgataaggactttacgttgagagatcgtgatagactagttgcacgcgtcaagtaagacatccatttatggactccctgatcggaggtgaagaactctggtcagttgttgcttgctctgaagaatgacattgatatatgctttgtgttccactgagttgagcaatctctgtcccctcgtcgggcaataattagtgtccagtgggagtttccaccaaggcctttgaactgtctcccctgtgggactaccgcgcatgttcttggattccagtgtccatcacaatgactctgagggtgaatacgaaacgtttgagccagttggcctggacattggcgttcttgcagggctggtccatttgggacgctttattaagatgccaacttaccagaattcattagattaatacccatttggttctgggactcacgccagaaaaacagcagttggaaaactgggcgtgccaagggaaa

SEQ ID NO: 696650 - DNA, 133 bp, Homo sapiens
cgtaagggtctgtaatttttttaaccagcactacaatagcaacaaacctagagagtcagttcatgacggcttctccctgtaatgctgccttacaactctacagaacagcagtcactgctgcacagttagatac

SEQ ID NO: 696651 - DNA, 286 bp, Homo sapiens
  misc_feature (3)..(3): n is a, c, g, or t
  misc_feature (13)..(13): n is a, c, g, or t
  misc_feature (120)..(120): n is a, c, g, or t
  misc_feature (124)..(124): n is a, c, g, or t
  misc_feature (208)..(208): n is a, c, g, or t
  misc_feature (210)..(210): n is a, c, g, or t
  misc_feature (213)..(214): n is a, c, g, or t
ctngaaaggcctnctggcagggattgagcaagcttggtctgcgctttgtccgacttgaggtgcatctggcacatgcgccccagctcccggaaggcctcgttaatattcccgcaacgcgcnaccntcccgcgcgttattggccatgcgcctctcccggtccctcaggtctttctcctccagggacagcacctcgtccgtactgctggtncncgnncggggggccttcagctccttcttctcctcctccgagtggtcagccgctgacgtgtaggactcgtcctccttc

SEQ ID NO: 696652 - DNA, 183 bp, Homo sapiens
gagtctcagtaatagatatgtaacaaaggagtagagcaggactctttataagagctagatggtcgtaaggagaggcatgggtacagcagtggttcatgcagaatctccttacgaccatctagctcttataaagagtcctgctctgctcctttgttacatatctataactaagactccgggaga

SEQ ID NO: 696653 - DNA, 118 bp, Homo sapiens
cgaagacccccatgctcaaaaacgtcgcacacatcggcattgccgtgacgcctctcgggccgtcccatgaactgtacaggaagcttcacggcgccgcccattctacagtcgcggcggt

SEQ ID NO: 696654 - DNA, 278 bp, Homo sapiens
  misc_feature (86)..(86): n is a, c, g, or t
  misc_feature (188)..(188): n is a, c, g, or t
gtatgatatttcttaggccataatcgtgacagctagggtcagaatgatgtggttgcttcctggaatggggccaggggccaagggangcaggcatccggtaaaatctggagaaggttaggaagtgttctctctcccctagagagagtgtgtggtcgtttaggctactagaggtgtgctaagttattccnggaatcataggagacttatatagataaggtctactgacggagatttacattttggacagagattccaaggaggtgagggcaccagctatg

SEQ ID NO: 696655 - DNA, 330 bp, Homo sapiens
  misc_feature (35)..(35): n is a, c, g, or t
  misc_feature (47)..(47): n is a, c, g, or t
  misc_feature (60)..(60): n is a, c, g, or t
  misc_feature (86)..(86): n is a, c, g, or t
  misc_feature (90)..(90): n is a, c, g, or t
  misc_feature (158)..(158): n is a, c, g, or t
  misc_feature (175)..(175): n is a, c, g, or t
  misc_feature (266)..(266): n is a, c, g, or t
  misc_feature (307)..(307): n is a, c, g, or t
agatccacttaaagaagcttgcaaaggaacggacnttaagggccttnttagaaatagaanaaaaggaagtgggcttaacaggtggnggtnggggagaatccggactttaagagctttggattggccaatttaatgtgaatccctgcgtagcagtggancaggttataataagccnggcgagactcttatcagccatttgcagggatggaagtccccaccgaccgggtagactcatttctttggttcaggatgaacctgctgctatnacttcatgccctttagaagccgtaggttggtctcaacttanactttgagggccccgggcttttg

SEQ ID NO: 696656 - DNA, 713 bp, Homo sapiens
tagagatgccgggatcctgcagctgaagggctctagagttgtcatgagaggatctgagagcttctgtggagaccctgaagcggggtggtgggcctgtgcagctccgaggaaatgtgctcggtgagaccctagtggttgctgcgccagatcatcactggaccacctgctgtgatgcaactgcgtgtgtgtgatgcttgatgtgatgcttgactcctgcatgatgatgtggcatgtgatgtgatgactgtgcctgctcatgccctcctgatgaccacctgtgtgtgcaacagtgtgtgctgtgagagtgctcaagattatcctgtgtgatggatgtatgtgcatgactccatgtgacgcagctgacgagagtgatcagcagtgagtccctgcacacaacttgttgacagtcctgtgaggtgcctaaactgaggatttcatgcttccattatgcccaactccatgtccaacatcattgagtgcgattaaatgagcttgctagtgtgagctggaagtggcacaattggatgaacattgcatgcccagtgctctgtgagcacattcactccaatgatggttgatcatgaccattggcttctcccgaacatgtaggagggccttcctcagatgatgctgccctgatatgacgaaattccatgtcatttgtaagcagagtgtgctcctttcttgccaggtgtcatgaccattggcttgta

SEQ ID NO: 696657 - DNA, 367 bp, Homo sapiens
  misc_feature (77)..(77): n is a, c, g, or t
  misc_feature (175)..(175): n is a, c, g, or t
  misc_feature (219)..(219): n is a, c, g, or t
  misc_feature (228)..(228): n is a, c, g, or t
tctggaactggagagcgtttcacttaccaactttaaccagacctcgaaagaacatttcaatccgaacaatgcctttnacgccgaagtttaaccaaactgactcaggaaacagagcgccgtcgccgcgaacgtaacgaagttgaacaggatgtagaagttgcggtgcgtgaaaaanatcgcgatgcgctatcgcgcaagctggagattgaacagcaagangcgtttatnacgcttgagcaggagcagcaggttaaaacccgtactgccgaacagaatgcacgtattgcggcttttgaagctgaacgtcgtcgtgaagcagagcagacacgaattctggctgaacgacagattcaggaaacagaaatcg

SEQ ID NO: 696658 - DNA, 555 bp, Homo sapiens
ggaggcgagagcttgcgaaaggcgagaggctgcgaagggcccaggtgtcgggcgctgttctcgttcatcatatagacaaaacagccctggtgaaaggatggtcaagtacctaaaaccggaagaaccttcttgtaagaatgtggtggcaagcatcagcctcacaaagtggacacagtataagaagggcaaggattcttggtatgcccaggaaggaggccgctatgatcggaagcagagtgctatggtgggcagacaaagccaattttccggaagaaggctaagaccacaaagaagatggtgctaaggtgaatgtgttgagcctaagttgcagatccaagaggatgctggccattaagagatgcaagcatttggaacctgggaggagataacgaagagaacgggccacagtgatccagttctaaactgtgggatatttttcttcaatttgtgacgagacacatggtgaagccatagaaaagttacccggggacaactaaattccggtggttattcttttaccacaaagaaaaaaatataaaaaaaacaaaacaaatt

SEQ ID NO: 696659 - DNA, 1753 bp, Homo sapiens
tggtgaagggggaaaggaggggggggtgtgcgttggggctctccgggaaggccgtccgggctgtggggcttgttcggccggggggcggaggcacctcgcgcgggggatgtggcccacgtgggtgtgacctgtggtcagctgtgttccattttccgtgtgtgaccattcttcattgtgcacaagggacactcggctctccgaaggtcggaacccacatctgtgggtctccttttatacgaggaaagtgtgtgggaagagggggcaagctgtggtgcttgtgagacttggtgccggaaatgtgaagcggtggtgcggaacactgtggctcaaacgccctgtggagtgtttctctcccgagagaaactctcattaccgagcttggtgagtatcaccgtgcttgtgtggagaaacagagctcccaaagaaagagtctctcagccgcctgtgggtggaaaactctatagtcgcagcaactgagaacaccacaccatgagataccgccctcgtagacagcacctgtgtgacgcgtgagaagatgcatgtgccacctatctcccctatgaagaggggggtgtgccgagtgagggggtgtgtctcccctattaagaggatcatcaagaccgttgtgggttgtctccacgaagaacaccggacgaggtgttcaccgttggaactcatctcgtcaccccacgctgtgttgatctgttctcttgaagagaacgcccgctgttggggaaaaacaaacaccaccgactgccgctgttagtagggcgcggtggggagagacaaccacccacatgcacagctgggtgagcaactatcctccgccgtgtgggcgacaacacaacatctccaaggtaaagttcccccaaagtatacttcggtgggggaaaaggagtacatccataactatcgcacgcacgcaccaaagtggggcgggtcgatcaatcgggcgtgcgcaaacacagtgtgggtgacccaccccctggaggtgagagagtggtcataagacacgagacacatagtcacctcaagcagaggaggccttacacacatcgacacggagagacagcagaaacccgtcgtgtggtaacaacacccccctccgcaacaccagttgtggataccaaggcgctcggctaagagcaatctgaccaagtgatccccccccgcgagtgattacgcaagacaccaagatctcacgccgacgagactgcggactgagtagtggaaacaccccccgccaacagagaaacagatgcccacaattcacgcagggggatctgacacccgaatgcggcattcgccccgacaagcgtaagatgcagacaacacgaggtgtgcacggtggggtgacatcagaccgattgtgaaactcctaccacacatcggcggaaacacgccgattaacccaaacaaatcgaaaggcttctcggtgccaccacgagacttttgaagaggggagaatcaccgtcgtaccgtagaacgtctcgtgagcaggtgacatcccaaccccgtcgttagaacaaccccagacgtatcaaacatgaacaaacagcgcatccacagacacctctcgtgcgacccaataccgagggggccaacaacatatggtcgcggcgatcataaacagcacggacgatcacatccacctttcgtcggcgacaatgcagttcacgagtgagaagcatcgctgagacaaacacaaatccactggcagtatgcacgctgggaccacctagcggggcaccag

SEQ ID NO: 696660 - DNA, 160 bp, Homo sapiens
cgtgcactgccctcggctgtatgcccacagccatacctggctgaggacaaaggcttgcactgtctcgcctgcgcctgggccccaccaccctccccggccagcctgaggctgctgaggaaggaaggacccgcttcctgttgtcggtgccgattaatagcga

SEQ ID NO: 696661 - DNA, 197 bp, Homo sapiens
tgtgatcgtggcagaaatcaaagcttagcgcgagacccacgatgccttccgctcctccctcagctctgccaggctgacttcaaccagctgtgcgagctgtgacgccagatcaagagcttccgtgtagcctccaacccctacacctggtttaccatggaggccctggaggagacctggaggaacctacagaaaatcat

SEQ ID NO: 696662 - DNA, 379 bp, Homo sapiens
aaatccctgtttatatggatcccatttcctgccagagtcaacactcgtgtcttggcggttgtgaatcactgtccatcctttggttgacagacacaaaaagcgcatatattaccccacagcaaatattgtctctttgaaaataatatctgaatccccggtccattccatttagtatatattgggtgctctaaaatagccccaataaggaaataaatatgagagtgtaaccttgtaaattcatacctttttaaatctcgaggttgaattccacctcaaatcactctgtgtcagctatgttagatgttagagctaagtcgtgtctccgcgctttataattaattttttttttgagagacagtatctcacctcgtgccaattc

SEQ ID NO: 696663 - DNA, 1028 bp, Homo sapiens
gggcgctgcatctcggaagaggaagaagaaggagaaacgaaggaacgaagaagaagaactaagaagaactaagaagaaggagaagaagaaggagagaagaaacgaagaaacggagcaacggaacgaagaagaactaagaagaacggaggaagaaacgaaggagaaggaacgaacgacaccggagaaggacgcaaggacgcaggcgaacgcaaggaacggacgaacggaacgaggacggaagaaactaaagaagacacggagaacggaagacggacaccgaacggacgaacgaacggaagacgacacgaacagaacggaaccacggaccgaagcgacggacggacacgaacgagacgcgagcgagacgaacgcgacgagacgcaaccggagcgacagagaacttagagacgcgacgcccgcgcgacacgagacgcaggacgagacgacgggagaggacagcgacctggacggacacggaagcggcacgcgcagcgggggcagcgctacagacacgggaccacgacagcacacagaaaacacaacacgtctaccccatcgtttcgcaaagcacacaccaaatcgggacaccgcccacggaaaaaaggccacaggaccggacaagcaaacccttatcgcaaatgtaggaggcaagccacgaaggggacgcgccaacaggcaagggatcaaaagcaaaaggacacgtttgtgggacaaccaaaagcaaagggagtaaaggcgcaggaaaggaaacccgcagaggtagaggcaaagggaaagggcaacaagaaaagcatagaggacacggtaaacgcacaccaacggaatagtatacaggggaacaccggcccgccgggggcgagacaaacgcggagagggacgatttactgggcgagaccgaaacggccccccggtaggtagaaacgcgtcacagggaggcacgacaacaacggcgggggcttcttatagcacagggcagggaaagtcacgcaacacggaaggggccgccagaagtcgaccgatttaggcgc

SEQ ID NO: 696664 - DNA, 1040 bp, Homo sapiens
  misc_feature (5)..(5): n is a, c, g, or t
  misc_feature (426)..(426): n is a, c, g, or t
  misc_feature (442)..(442): n is a, c, g, or t
  misc_feature (448)..(448): n is a, c, g, or t
  misc_feature (458)..(458): n is a, c, g, or t
  misc_feature (472)..(472): n is a, c, g, or t
  misc_feature (482)..(482): n is a, c, g, or t
  misc_feature (490)..(490): n is a, c, g, or t
  misc_feature (516)..(516): n is a, c, g, or t
  misc_feature (523)..(523): n is a, c, g, or t
  misc_feature (533)..(534): n is a, c, g, or t
  misc_feature (539)..(540): n is a, c, g, or t
  misc_feature (542)..(542): n is a, c, g, or t
  misc_feature (544)..(544): n is a, c, g, or t
  misc_feature (549)..(549): n is a, c, g, or t
  misc_feature (552)..(552): n is a, c, g, or t
  misc_feature (554)..(554): n is a, c, g, or t
  misc_feature (558)..(558): n is a, c, g, or t
  misc_feature (561)..(561): n is a, c, g, or t
  misc_feature (565)..(565): n is a, c, g, or t
  misc_feature (570)..(570): n is a, c, g, or t
  misc_feature (573)..(573): n is a, c, g, or t
  misc_feature (576)..(576): n is a, c, g, or t
  misc_feature (580)..(580): n is a, c, g, or t
  misc_feature (586)..(586): n is a, c, g, or t
  misc_feature (592)..(592): n is a, c, g, or t
  misc_feature (596)..(596): n is a, c, g, or t
  misc_feature (638)..(638): n is a, c, g, or t
  misc_feature (697)..(697): n is a, c, g, or t
  misc_feature (699)..(699): n is a, c, g, or t
  misc_feature (706)..(708): n is a, c, g, or t
  misc_feature (715)..(715): n is a, c, g, or t
  misc_feature (969)..(969): n is a, c, g, or t
gctgnctgcttttgtcccggttcatcacggccaatcagtatgagatgtgtaaggagaagtctttcaagaatgacggaataagagacctgttttaaaaaggaactgcagcaatctttgaaagacttccaaagaatgttagagcacagtacataatacacttgccctgctccctctaccccttaccccacaacgtgcaactgacactcccacccagtctctgctccacctttcagcccacgtcacgtgtagtgtccattttgtgaagccctgttgtgccacagagtgtagccaggtccccctgcagctagtcctagtgaacctcaccccgaggccctgcatgggccagcccctccatctgtacttggtccaactgcaactcatcatcggtgactggttatcacaccatcgctggcccctttgggcccngcatgtagtgtgggangccccngttagccccncactgtggtaaatnccacacaccnttaagtanataagcagacgatagttatctgcccntttcacntaatcccatnnggttnnantnccccnccncnaacnctncccnacccnccncangctncctaanacatgnaacnaaacaccccaataattgtccatgaggagaaaaaaagcatgtntcatgcatgaaggaaactgaacttgaggtggcctccttgcttgtacaacctgggtatgngnaggcagnnnagtgcanctttgcccctcagttgaaacctgtataaccctgttacaaagctgtgttgttgcttcttgtgaaggccatgatattttgtttttccccaattaattgctattgtgttattttactacttctctctgtattttttcttgcattgacattatagacattgaggacctcatccaaacaatttaaaaatgagtgtgaagggggaacaagtcaaaatatttttaaaagatcttcaaaaataatgcctctgtctagcatgncaacaagaatgcattgatattgtgaacatttgtgatatatgtattaataaatagagcaattacaagcaaag

SEQ ID NO: 696665 - DNA, 674 bp, Homo sapiens
tgaacgcttgatctcaacaaagcttcaaacccggtatgcggccccaggcgggttggctcaagatagccccacaaccggctggcatattcgagcagcaccctggcatcgacgccggcaagcggttgcttgaaatgcggcaaatgctgggccgacaagctgtactcccaggagcggcagtaggcctcaagcaccttgaggcacacctccaccaccgcttgcccttccaggcggcggaaaccaaagatattcagttcttgagcgagcgcctgcttggtcggcaccctcaccggcgtattcagcggctttggcctcgggccatgcaatagagcatgggcgaagtcctggaaggtatgcccggccttacgctcccgcgcttcccaccatgcgcgcacgcagggtttcgagtttagccgggggtgcgtgccaaccagtaaggtcttttccgggcgcaggtgctccagcaaggccaccagcaggtgactcttgccaaatgcctgcatagccttgaacatgcaggtcttcgttcaggttggcgcggaaggttctgagcaggcttgtcttgctcggggctcaaccagcgctcgcgatgcctgggcgtgattactgctggctgacggatcattgccttgaggtgcggactatatcgacgtccattgccctggcaaagatagccg

SEQ ID NO: 696666 - DNA, 655 bp, Homo sapiens
  misc_feature (17)..(17): n is a, c, g, or t
  misc_feature (70)..(70): n is a, c, g, or t
  misc_feature (72)..(72): n is a, c, g, or t
  misc_feature (95)..(95): n is a, c, g, or t
  misc_feature (104)..(104): n is a, c, g, or t
  misc_feature (116)..(117): n is a, c, g, or t
  misc_feature (121)..(121): n is a, c, g, or t
  misc_feature (125)..(125): n is a, c, g, or t
  misc_feature (142)..(142): n is a, c, g, or t
  misc_feature (148)..(149): n is a, c, g, or t
  misc_feature (151)..(151): n is a, c, g, or t
  misc_feature (153)..(153): n is a, c, g, or t
  misc_feature (155)..(155): n is a, c, g, or t
  misc_feature (158)..(158): n is a, c, g, or t
  misc_feature (164)..(165): n is a, c, g, or t
  misc_feature (170)..(171): n is a, c, g, or t
  misc_feature (174)..(174): n is a, c, g, or t
  misc_feature (179)..(179): n is a, c, g, or t
  misc_feature (182)..(182): n is a, c, g, or t
  misc_feature (185)..(185): n is a, c, g, or t
  misc_feature (189)..(189): n is a, c, g, or t
  misc_feature (193)..(193): n is a, c, g, or t
  misc_feature (204)..(204): n is a, c, g, or t
  misc_feature (206)..(207): n is a, c, g, or t
  misc_feature (209)..(209): n is a, c, g, or t
  misc_feature (214)..(214): n is a, c, g, or t
  misc_feature (219)..(219): n is a, c, g, or t
  misc_feature (222)..(222): n is a, c, g, or t
  misc_feature (226)..(226): n is a, c, g, or t
  misc_feature (232)..(237): n is a, c, g, or t
  misc_feature (240)..(240): n is a, c, g, or t
  misc_feature (245)..(245): n is a, c, g, or t
  misc_feature (249)..(249): n is a, c, g, or t
  misc_feature (256)..(256): n is a, c, g, or t
  misc_feature (258)..(258): n is a, c, g, or t
  misc_feature (260)..(260): n is a, c, g, or t
  misc_feature (263)..(263): n is a, c, g, or t
  misc_feature (266)..(266): n is a, c, g, or t
  misc_feature (269)..(271): n is a, c, g, or t
  misc_feature (274)..(282): n is a, c, g, or t
  misc_feature (290)..(290): n is a, c, g, or t
  misc_feature (294)..(294): n is a, c, g, or t
  misc_feature (301)..(301): n is a, c, g, or t
  misc_feature (305)..(307): n is a, c, g, or t
  misc_feature (311)..(313): n is a, c, g, or t
  misc_feature (315)..(317): n is a, c, g, or t
  misc_feature (319)..(320): n is a, c, g, or t
  misc_feature (324)..(325): n is a, c, g, or t
  misc_feature (327)..(327): n is a, c, g, or t
  misc_feature (329)..(329): n is a, c, g, or t
  misc_feature (335)..(335): n is a, c, g, or t
  misc_feature (342)..(342): n is a, c, g, or t
  misc_feature (584)..(584): n is a, c, g, or t
tacgggttagcacaccnccgcgcgccccggtccgcccgccagcgacgcgcccaccccccgcggccccccncntcgcgcccaaagcccacacaccngcaactacncaccccccccanncttntctnttcttttcactcaatcncatccnntntnanttncccccnnccaannctnccctnccntcntcangctnccccacacatntnncnaaacncctcnatnattntccatnnnnnnaanaaaancatntctcatncntnaanganacnnnacnnnnnnnnnccccctcncctntcacatncctnnntatnnntnnncnntttnncncntctttncctctcngttgaaacctgtataaccctgttacaaagctgtgttgttgcttcttgtgaaggccatgatattttgtttttccccaattaattgctattgtgttattttactacttctctctgtattttttcttgcattgacattatagacattgaggacctcatccaaacaatttaaaaatgagtgtgaagggggaacaagtcaaaatatttttaaaagatcttcaaaaataatgcctctgtctagcatgncaacaagaatgcattgatattgtgaacatttgtgatatatgtattaataaatagagcaattacaagcaaag

SEQ ID NO: 696667 - DNA, 80 bp, Homo sapiens
  misc_feature (3)..(3): n is a, c, g, or t
  misc_feature (14)..(14): n is a, c, g, or t
agnacttttcaagnaaaaatacttgaaaataaattacattgccttttgtccattaatcagcaaaaaaacatggccttaac

SEQ ID NO: 696668 - DNA, 1080 bp, Homo sapiens
  misc_feature (5)..(5): n is a, c, g, or t
  misc_feature (426)..(426): n is a, c, g, or t
  misc_feature (442)..(442): n is a, c, g, or t
  misc_feature (448)..(448): n is a, c, g, or t
  misc_feature (458)..(458): n is a, c, g, or t
  misc_feature (472)..(472): n is a, c, g, or t
  misc_feature (482)..(482): n is a, c, g, or t
  misc_feature (490)..(490): n is a, c, g, or t
  misc_feature (516)..(516): n is a, c, g, or t
  misc_feature (523)..(523): n is a, c, g, or t
  misc_feature (533)..(534): n is a, c, g, or t
  misc_feature (539)..(540): n is a, c, g, or t
  misc_feature (542)..(542): n is a, c, g, or t
  misc_feature (544)..(544): n is a, c, g, or t
  misc_feature (549)..(549): n is a, c, g, or t
  misc_feature (552)..(552): n is a, c, g, or t
  misc_feature (554)..(554): n is a, c, g, or t
  misc_feature (558)..(558): n is a, c, g, or t
  misc_feature (561)..(561): n is a, c, g, or t
  misc_feature (565)..(565): n is a, c, g, or t
  misc_feature (570)..(570): n is a, c, g, or t
  misc_feature (573)..(573): n is a, c, g, or t
  misc_feature (576)..(576): n is a, c, g, or t
  misc_feature (580)..(580): n is a, c, g, or t
  misc_feature (586)..(586): n is a, c, g, or t
  misc_feature (592)..(592): n is a, c, g, or t
  misc_feature (596)..(596): n is a, c, g, or t
  misc_feature (638)..(638): n is a, c, g, or t
  misc_feature (723)..(723): n is a, c, g, or t
  misc_feature (725)..(725): n is a, c, g, or t
  misc_feature (748)..(748): n is a, c, g, or t
  misc_feature (756)..(756): n is a, c, g, or t
  misc_feature (1009)..(1009): n is a, c, g, or t
gctgnctgcttttgtcccggttcatcacggccaatcagtatgagatgtgtaaggagaagtctttcaagaatgacggaataagagacctgttttaaaaaggaactgcagcaatctttgaaagacttccaaagaatgttagagcacagtacataatacacttgccctgctccctctaccccttaccccacaacgtgcaactgacactcccacccagtctctgctccacctttcagcccacgtcacgtgtagtgtccattttgtgaagccctgttgtgccacagagtgtagccaggtccccctgcagctagtcctagtgaacctcaccccgaggccctgcatgggccagcccctccatctgtacttggtccaactgcaactcatcatcggtgactggttatcacaccatcgctggcccctttgggcccngcatgtagtgtgggangccccngttagccccncactgtggtaaatnccacacaccnttaagtanataagcagacgatagttatctgcccntttcacntaatcccatnnggttnnantnccccnccncnaacnctncccnacccnccncangctncctaanacatgnaacnaaacaccccaataattgtccatgaggagaaaaaaagcatgtntcatgcatgaaggaaactgaacttgaggtggcctccttgcttgtacaacctgggatagggggttttgggtttaaagcccgccaangnttttaaggctcggccccaatttntccttttnttgccctttcggttgaaacctgtataaccctgttacaaagctgtgttgttgcttcttgtgaaggccatgatattttgtttttccccaattaattgctattgtgttattttactacttctctctgtattttttcttgcattgacattatagacattgaggacctcatccaaacaatttaaaaatgagtgtgaagggggaacaagtcaaaatatttttaaaagatcttcaaaaataatgcctctgtctagcatgncaacaagaatgcattgatattgtgaacatttgtgatatatgtattaataaatagagcaattacaagcaaag

SEQ ID NO: 696669 - DNA, 319 bp, Homo sapiens
  misc_feature (190)..(190): n is a, c, g, or t
  misc_feature (197)..(197): n is a, c, g, or t
  misc_feature (205)..(205): n is a, c, g, or t
  misc_feature (229)..(229): n is a, c, g, or t
  misc_feature (259)..(259): n is a, c, g, or t
  misc_feature (265)..(265): n is a, c, g, or t
ctagttttagaagtttcaatcagcattcatcttatatagtttcccacttgggcatcatccgtgtgcaagaaagctggtggtcttggtgcaactctgcgcggggccgggtcactgggtgtgcctgcttaatgcgtcgaaagcctttcatgcgtgttccatcgtcctgaacagacataaagtgttcttcctngcccaanttaccctngtcatcgtgctacgcggcatcctncattctttctgtgttttaagggggactgcnctcccnacacttttactttgaacgcggtagctagctgctatggaaacttctaaaactagg

SEQ ID NO: 696670 - DNA, 351 bp, Homo sapiens
aacgtcatatagcgtgcttcatactattctatcagtgtcctccaaagatgattcctaagtattttaatgtcatcctttattgactcataatagacttgaacctgttaggttatttgctcgtcagttaagtacacataaatatcatgtggaatttagacatcaaaatttgcactgtccttagcagtcatgacttctagcccccttgcgcctgaacagggcttgattaaacgaaagtgaggttcgttagaaccaagaaggacaattatcattagcttccaagaaactaacttggttattgtcttcatttccagggagtttcctggtctggtttttggacaggatttgatcttc

SEQ ID NO: 696671 - DNA, 901 bp, Homo sapiens
  misc_feature (215)..(215): n is a, c, g, or t
tggctgtaaataactttaaggtgttgatgtgggagtcacaggggaggtatgtttgctccaagggttcttcagtgccatcctcaaagctggttagtgcaggaggtagggcagagtgggttccagttttcttccaggaagggtttagggaggtcccaggagccccaggaatgagtccctcggtaccatggcaagcacaatttaagaggggttttctngcccacccttgagcctaccccaggtccagcagaggaacgaggaggccagatgggccaacttgctatagacagcgccgtatccagagcccaactgcgcatggggtcattttctctatctggggcagatcctcatgccagcaccttttctctctcacactgtgtgatctggagccaatgtgtcgaggttgtgccttggttgcagaggcctctggtccgtggggatcgctgaggtgcggaggggggcaaccgagcgagccctaggggagtggtctggggggacagcatccatggcaaacaggttcgggttctcccccaggcagggcttgggtccagctctggggctgggccactgaggcagtgcgagcggggtgtataggcaggcgacaggcgtggttctgtgaaccttggccagccacgggtgtggggggttgtcctccaagccctttgaggcctctccccgctggggtcaggattgtctagtcacccgtttgcgatagttcatcccaggagggtcaaataagccttccgtattgggacaggggccccttgttttgcccgagtgctggggggggtcccggcgggagcgggggtttccacttcttggattttcacacaggctcgggtcccatgggcattgtaaaaaaggggtccagagcctccaccgttgtgaggtccccattgtgtaa

SEQ ID NO: 696672 - DNA, 147 bp, Homo sapiens
  misc_feature (66)..(66): n is a, c, g, or t
ggccatggccgctttcaaaccatggaggagaaaaaagccttcctggggccccttaaaaaaaacccnatttccaaggaaaaaggggctttatgccagggacaaatttttccgttgggggggtttccataaaaggttttttccccttga

SEQ ID NO: 696673 - DNA, 1330 bp, Homo sapiens
cgacttgcccaaaccctacaaaaaattggaaattttcaaaaaaaaaaaaaaaaggggaaagggagggaagagagaaaaggaattgggccctttcgtgcacaaagaagtttgagaaagagttggctcttcaagtgaatctcaggctttaaccttagttcctttgcagattgagttaagactttccacagcttaactattgttgaaagaaagggtggaaccagagggaccaggttcacgcaggcacttctttttccacaaagggggggggattctccgggaaccaacattgaagagaccaaaccaccaacctttgttgccagttgtggaagaatatattgaaggtgtggtgaggttatctccgagtggacacgtgtgtgtgggacacagagagaacactctcgagccctttgagcgtgaaattgagagcgacaaagaggtttgtgggaaagaaacttcttatttctccaaacctgtgtaagaaagttttggccaattctctccattaaagtgttgtgcgcaaaagccgagaagagagcctttatgtgaaaaaagagcttttctcacaactgtggggcaacagggtgcgctatttaaatttcagaagatctctgtggcccacaatgttggagttttaaagagggcaagtgtgtccccagtataaggcgtatacatgtgtggcgaataacattggtgaaactattatgtgtggccacccaatttttgtggcgatatataagggggacctgtggggtaaacactctcaaacatgtgggttttttacccatattaggggccccaagggaggaagggtttttccaaagtggcccattttatgggaggaaaggggcgccacaaggggggtatatattcaaaactcttctttatccgcccaaaggcggcaacattttgtcggcccttttcaactctctaataaagttgtgaggggcggcgcacatctattacttataaaccctccaagaggatatccctttttccccaaagggctggagtgatttttcaccatctctgtgggggagggaatgtggcaaacaaccgccccaggggtgttgtgtcccaaacagattttcttttcccgccaaaggttttcatctaccaatcgtgaaggaaaaacggtcgttgctacaaacaacccctgtggggggagttttccacatctacttggggcgttaacaccgtttcttcattaaaaggatgttatcacacccgtttttataggcccacattagacctcttttcaagccaccatttcttttcttgggggccccaaacaatggacaaaacacgggggcttcatttggccgaatgtctg

SEQ ID NO: 696674 - DNA, 145 bp, Homo sapiens
gggtgctctgcctatataaggtcttatgtgtgatgaaaagtgtaagttgatgttgcctgagtcaggacgacaggtgttaggtattatgctcagcctgaggatttgcttcatgcacggggtgtttagtaataaagtgacgtttgca

SEQ ID NO: 696675 - DNA, 973 bp, Homo sapiens
  misc_feature (209)..(209): n is a, c, g, or t
aaatgacctatcctctaaaaggcctttctttctctttttaaaattctttgttaaatttttaataagtaatacacatatgtgcttcaagctttaaaaaatgcaaaaggcggccaggtgtagtggctcccacctgtaaacccagcactttgggaggctgaggcagaaggatcacttgaggccgggagttcaagaccagcctgggcaacctngtgagaccctgtctcttcaaaactaaaaataaagaaattactctctggtgcttcaagcaacatctctggagagtcgtgttgtgtgaattggtttgtatacattagtatgtgtatgtattcacacattcatatacactcaggatacagttggcctaattatcattggggccataggtaaaacttatgaagaatgttctcatgctgaattgtaattttcttttacctgtaaagtaaaatttagatcaatcccatgtctgtgtttattttgaatatcatagatatgctgtacatttaaagaggcaatgctactgggattatgtaggttctaactcattttaacaagggcactgtcaggcctctaagcccaagctaagccatcataacccctgtgacctgcatgtatacatccagatgacctgaagcaactgaagaaccacaaaagaagcaaaataggcagttcctgccttaactgatgacattccacccttgtgatttcgttcctgctccagcctaactgaacaactgacctcgtgacattccttctcctggactgagtctcaggagctccccgacaagcacttgtgacccctgaccctgaccaacaagagaaaaaccccctttaactgtaattttccactaacctaaccaaatcctataaaactgcgccaccccatctccctttgctgactcctttatatggactcagtcggctgcaaccagatgatcagaggctttatggccaacaaaccacaaataaaacacac

SEQ ID NO: 696676 - DNA, 508 bp, Homo sapiens
  misc_feature (141)..(141): n is a, c, g, or t
  misc_feature (256)..(256): n is a, c, g, or t
tttttaaaaaaaaaaaaaagtatggttgggcgggcccttttttttaaaaaaaaaaacccgtgtattttggcggattcgggggggccccccccccccctctataaaaaaaaaaaggtttttttttagggaccaccccccccnaaaaaaaaaaaaaattttttttttaaaaacacccccccccccccccccctaatgttgtttctccccccccggggggggggagaagaaaaaaaataataattttctcttttttttntaaaaaataaaaaaaaaaaaaaccccccccccccaccatttttgggggggaaaaaaaaaaatttttttttcccccccccccccccctgaaaaaaaaccccctctttttccacattttttttccccccccttttttaaaaaagggaaaaatggggtttttccccctttaaaaccctttaccaaaaaagggggggccccatggaaaagcccaattcccccccagtttgtggacaaaggtaggccagtcaacaaa

SEQ ID NO: 696677 - DNA, 987 bp, Homo sapiens
  misc_feature (118)..(118): n is a, c, g, or t
aggtgcggtctcggctcgctgcagcctccgcctcccaggttcaggagattctcattcctcaacttcccgggtagcttggattacaggcatgtccaccacagccagctaattttttttnttttttgaaatggagtctcactctgttgcccaggctggagtgcagtagcgtgacctcagctcactgcaacctctgcctcctgggttcaagggattctcctgcctcagcctcccctgtctcttcaaaactaaaaataaagaaattactctctggtgcttcaagcaacatctctggagagtcgtgttgtgtgaattggtttgtatacattagtatgtgtatgtattcacacattcatatacactcaggatacagttggcctaattatcattggggccataggtaaaacttatgaagaatgttctcatgctgaattgtaattttcttttacctgtaaagtaaaatttagatcaatcccatgtctgtgtttattttgaatatcatagatatgctgtacatttaaagaggcaatgctactgggattatgtaggttctaactcattttaacaagggcactgtcaggcctctaagcccaagctaagccatcataacccctgtgacctgcatgtatacatccagatgacctgaagcaactgaagaaccacaaaagaagcaaaataggcagttcctgccttaactgatgacattccacccttgtgatttcgttcctgctccagcctaactgaacaactgacctcgtgacattccttctcctggactgagtctcaggagctccccgacaagcacttgtgacccctgaccctgaccaacaagagaaaaaccccctttaactgtaattttccactaacctaaccaaatcctataaaactgcgccaccccatctccctttgctgactcctttatatggactcagtcggctgcaaccagatgatcagaggctttatggccaacaaaccacaaataaaacacac

SEQ ID NO: 696678 - DNA, 179 bp, Homo sapiens
ggagcctggtttctcatagacagacccaattcagactggttttctacatgtctctgactgcagctctgcctgctccctgctcaaacccgagcatctcgggaactcccattagtgtctgacgctggagtgtgcccaggatgtggacgcattatgagcctgcagcaccgcagagcactgtc

SEQ ID NO: 696679 - DNA, 104 bp, Homo sapiens
  misc_feature (76)..(76): n is a, c, g, or t
ctttagtgtatgtccatgtgtcatgggcgcttcaggccttggggcatagcccatgttcttgagcacctcggtgttnggtgtggcattctccaggcctcccgctg

SEQ ID NO: 696680 - DNA, 160 bp, Homo sapiens
cgagggggtattttggaaggttttataaaatcaaccaacagatgagaatttaagggacattttgagaaaagtaaaatgatcttgaacttaaaggtttatgacattgaaaaggtaaacttgaacatttttctttaataaaattaattcaaaacaaaaatat

SEQ ID NO: 696681 - DNA, 533 bp, Homo sapiens
atatgagagaacctacatttttttttggtgaatgagaagagacaaatatctagactgggaaagggtgcctggcactcagctggagcactgccctagtgcggaggaagagatgcagaatatgatggggctcccacctctgtcccgtcttcctggtccctctccccttctggaggtgactgagttgctggtgtctcatgagatgtggtaaagcatcctggttaagagcacgggagatagtatccagctgggctttccatccggttatgaatgggcagattaaccttggacaagtgatttgaacacggcctcagttcttaatctgtggagtatgaagaaaaatagacctacctcccagggttatggggcagtttaaatgagttaaggtatacgaagtatttacatcagggtggggcacccagggatcacggtatgagaatttcctgaacaacaacaacaaaaaaacccttctagaaatatttttacaaattatgagtgtattttcctaattttgaaaatacaactagtagaatacc

SEQ ID NO: 696682 - DNA, 200 bp, Homo sapiens
gggtgaatgtgagtacagggaagcagcggccgccatttcagggagcttttcgacgctgtcgcaggggttggatcctgagctgccgaagccgccgtcctgctctaccgggtggggttttttaattccattgtttttttttagattcttctcgggcctagccgtccttgggacccgattatttggggtggggggttccgcgg

SEQ ID NO: 696683 - DNA, 357 bp, Homo sapiens
atacacctccataacgtgtgcccaggctgaagtgaaatagcgcgatcttgactcactgtaacctctgacttctgggttcaagcaattctcctgcttcggtctgcgagagcatgtgggattacaggcgcacgccaccatgcccagctaaatttttggtatttttgtagaaacagggtttttccacattggccaggctggtcttgaactcctgacctcaaggaatccatcctcttcagcctcgcaaagtgctgagattataggcatgagacaccttgcccggcccctgtgactcattcttaaaaaggatctttggattatgggtttccacttttgcaaggaaatgtgagaatgatactt

SEQ ID NO: 696684 - DNA, 1006 bp, Homo sapiens
tggtggactccgccgcggtctctggtgctgagatcgtggaatcggatcaaggcgagaggatccggcaggcaaggagcttcgtgggagcgggggttgggccgcacatttacgtgcgcgaagcggattggaccgggagctggtgacgatggcggggccgcagccctggcgctgtagactggaagcaggttgttgaacccgcgaaacaaggcgaggcgtgaccctgtaatgcggaccccgtagtgacagccactgcttgccagggtgatttgactagggtttgatgaaggggaatgatggggagaggtgatttcctagtagtggggtagcattagaacacactggcattcgaggctccctgcttggacacggacaaaaggtgttgcggaaaacctcctctagaaaagcatggaatgaagagcattgggagcagactctgcacaggatcgtctgattgagtgaaatatctgatgaggaaggggtctggacgatgaagattctagcagggactggagtctggaaggaatatgatgaggacagacctgggtgattgcttgaagaacaggagtgtggttgatcacgaggcatgagcaagaagagtgagaagccagtctgtaaaaaaaccggtgcttaagtgtccgagagtatcagtgacttgagaaattatccctagggactggatgacttggtgagcctgtgagcgaggaacgaagaccgacgagacggcctggaacccaggggatgacgcggacgaccccccagggcacacgctgggaacaaggcctgcaaatccaaccccggcgcgaagcgggcgggacgcccccacagggccaggtccgacgaacggaacagacagcggaaagccaccgggggcacccggaagacgtacaaaagcctcggccaacgcccccactgcacgcacacgcgccaaaccgcgactcagcaccgtggcgacatgtccaaacaacgccaacacacggaccggcgacacaacgcggtacaacgaccg

SEQ ID NO: 696685 - DNA, 128 bp, Homo sapiens
ttgctccacttgggtgtgaggagttcagttatatgtttgggatttaataaggtagtggtgtgttgagcttgaacgcttacttaataaggtggactgcttataaggccgtactatagggtgtctaaata

SEQ ID NO: 696686 - DNA, 247 bp, Homo sapiens
accgccttcccctacagtgagctgatgatcatgcattcggtctagcctgtgtgacagagtgatgatccatccttaagcataataaaacaaaaaaaacaagacaaataaacaattcattgcggtattgggtggcattaagttaaatcacttgtggccaaatttttttttgaaaatggttttccggttttttataaaggaaagggtttttttttaaattgccccctttttgggctggtatgcacaactt

SEQ ID NO: 696687 - DNA, 785 bp, Homo sapiens
gtttcggtccaagttggtcgcttccctgcgccgagagtgagcagtagtcaaacatgtcagggtgggagtcacattaggaaaccgagggctgaggaagaagcacgaggaggaacatagcacagagaagcttgagagcaagtggaatactataaatatgcaggaagagatagtttgatggtttcggttgatgcctccaatggctatgttggaattctcagagtgaagatgagtgtgacaatgcttttgacattgagcttgtccaggtgatatccaagagtgtgtacatctagtaagtatcatcagtcagtagatctgagatcagcttggctgtgagtgtctctatgggtaccgaccagaagaccaacattcagtgaatattagagaattgaggtgtatgttttatagggagctgggagtagatcgcgaggtgcaaaacgaattttagagctgtgacccgagtattagaggggctaggcgaagggacagaaacatgtttgatcgagatatgatgggctcgcggatctggatagtggactcagtggaagtgctgtgggtctgtgacagactcttataatgatgtccagatgcaacgattgagatcatcaagacggatgcatggctgttgccccaggtgaatgacagatcgcgcaatggtaatggagctggtgccggaaagctagccgggccgagggaccaggaggtcggttatctccggagatacatggcatctgccttggacttggtgccctgaagaaaacttggggttgaaaatattcttggtctaa

SEQ ID NO: 696688 - DNA, 370 bp, Homo sapiens
  misc_feature (17)..(17): n is a, c, g, or t
  misc_feature (52)..(52): n is a, c, g, or t
ctgcttcggataggcancccaagtctgcgagaggctcctggaccgggcactngcccttctggctctgaccagcaagaccagaaagacttcatctggctactcgcgcctcccaggtgtaggcaaagctgggaaagccccgatccaggatgatggagaaaggcatcttccagaaacctggggtatctgaaggtcagaggtcacctcacacataaagtcctcaggtcactgagaaggctcatttgaggcaccccattccaagacacaagcatacaataaaaactctcagaacatcacagtggcccccagctcgggaactggttagcaagtgtggtcatccgaagcaagttgacggggtaccgagatcgaatac

SEQ ID NO: 696689 - DNA, 551 bp, Homo sapiens
  misc_feature (64)..(64): n is a, c, g, or t
  misc_feature (68)..(68): n is a, c, g, or t
  misc_feature (314)..(314): n is a, c, g, or t
tgatccgcgttctggtaaaagctggaagatggccttaattcttgaagtctggtgatgctgccantgtngatatggttcctggcaagcccatgtgtgttgagagctctcagactatccacccttggggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctcccccccactcttaatcagtggtggagaacggtctcagaactgtntgtttcattggccattaaagtttagtagtaaaagcctggttaatgataacaatgcatcgtaaaccctcagaaagaaaaggagaatgtttttggggaccccttgggttttctttttgcggggggcaggttttaagtaataagtttttaaaaccagtccttttaaagggaaccaccttgcccaaaatttggccccagatttttaggcccctttaaaaaggttaattgagaaaaaaaaaa

SEQ ID NO: 696690 - DNA, 900 bp, Homo sapiens
gggtcgtgtctgctctggggtggcgacagttctgtttatttgtgggtcccaggtgcttggcggtgctcccgtgttggttccgctcggcctggttgccgtcctgtctgttttctggccccctggtgttgggctctgctgtcgttgtggttgtggcccccgttcagtggcctgtggggcccctgggctcggggatttgagacggttgcgttagttggtcgcccttggccagagtgacattgcgacaatgtaaagtgttcacacaagatgtttgtaggactgtcgggggaagcccctgtggtcggattgtagggccagatgtcccagatgggcgggcgttctccccctgggccggtcaccgtgctcttgttcggggtagtgcgcgcccacgtgtgttggtggcgcccagtacctctgagtgtaggtccaggccctgtttctggagatccgccagtcccatgcccccgttgtggccccacccgcccctgggaccccctgccctcccacctccaggtagttgttttgatgtttagccccctccccattgtcccaacaccctcccttgctatcgcccggtgccctgaccccaggagccccacctggtttatgggatcccaggagtctccccgcccctggggtcttggtctctctgcccctctctgcacgggattgtcgccccccgtctttctccagaccaccccccctgaggggggccccaggtttagtgctgctgcgtttctactgctgcacccgcagcccatcggccaggcccccccagaccagccctttgtactcttgcttgcggagggctgggagacccctccaggacattctccaccctcccccctgtctgcccagttgtagctatagctacccaattaaaaaaaaccctgttttcccaga

SEQ ID NO: 696691 - DNA, 282 bp, Homo sapiens
caccctcggatcgtgtcttgacgattactcatctgctgagggtggaagggcgagtgagcagacactcaggaggtgtcttgagattatcatccgctagagtggtggaacggggagtgagcacacactcgaggaggtgtcttgacgattatcatcctgctgaggtgatggaaaggggacgtgagcacacactacgggaaggtgtcttagagacttatccatccgctagagtggttggacagggagagtgcagcacgacactatgggcaggtgtctatgaggcta

SEQ ID NO: 696692 - DNA, 420 bp, Homo sapiens
  misc_feature (365)..(365): n is a, c, g, or t
  misc_feature (409)..(409): n is a, c, g, or t
tcttgcctgaggaaccctgcttgtccaacagggtgtcaggatttaaggaaaaccttcgtcttaggctaagtctgaaatggtctgaaatatgcttttctatgggtcttgttattttataaaattttacatctaaatttttgctaaggatgtattttgattattgaaaagaaaatttctatttaaactgaaatatattgcatcaatgttaaataacctatttttttaagtcacttaaggagaagttcaagctctagtgtaaattggaaattcaatattaagagatttacccaagaatcttatggagttactggatgtctttctacacaagttagcttttacaaggactatctgctccataactagtntagaactttcagtacatgtgaatagttgattttaagcttaggtnttactgttctg

SEQ ID NO: 696693 - DNA, 1046 bp, Homo sapiens
atctggggcttggtgcaggtgagaccacaaagcaacccatccactttgaactgatctgtcctctgggttcattagtccacattacacagtgactgtcgtcgtcgagcttggtatccggtgcagcacttgctcatggtaaggctctgggaggtgcgcattgcccggcatgggatatggcgcattgactgatgaaattatgtgatgtgcatcctactggtggatcgcacccaggctacactccctcatactcccacgagcattttcgtcccaaaaaagtcagcgctaagctccgttcactacaagcaccaaaaagtgtgatgctcttgttcgcggctagtacgtcgacctaactagactgtagccaagggccctagccatatccggtagtatactaccacgactattggtagcgtttgtgtgggcgagggacgtggaccccatcgagatcggcgcgtacgtccccttcatggggatctgtccttgcggcgcgctgctctgttgccctctcggtgtgtcgagcgatgatactatctcggtcggtatagcattagcgaggcagcgaagggtcggtcgtgtctgcctcgtctgcatggcccttcctgtcctccgtactacattcagctttgtcactcggatggtaccattacccagatctgcatgatgcacgcgaagcgacgggggcctttcctttcaaggttcgtagcattgggcggggcaaggtatgggcatcgtctccctgtaatgcgtgatgtcatgcgtggggattccgcatgaggagcggcctgtcaggtggcacccgagctgaagactggtgggctggtgctgacgggtgggcccgcgtggggcgggctggtcttgacttgggtggttgttgttgccgtcgattcgtgggggttgggcctgccgaccgtgaggccggctttggtcccggccctcggagtgggtgttggggggacctcgagggtgcggcttattgtttgcagagggcccgggataaggtcccgggagggtgggtggtgccgctggctggtggacaagaggggttc

SEQ ID NO: 696694 - DNA, 84 bp, Homo sapiens
  misc_feature (79)..(80): n is a, c, g, or t
gtgttttcctctttttctgtgtgaggttttttttttttttaatctgcatttattagtattctaataaaagcattttgtnntgga

SEQ ID NO: 696695 - DNA, 194 bp, Homo sapiens
tgcagatccctagtctgtagccagagctaaggcactcgtccttttccttttatttaaaaagaaaaacaaaaaagcatggatagcagaggcctcggagctctcaaatgccttgtcttacccttccctcctccctcccggaaagttttggccaagtagtgatgctttatattaactgcaaagtgaatggactagag

SEQ ID NO: 696696 - DNA, 811 bp, Homo sapiens
ggatttgaatcggaggctgctgtgaaaagggatgcagcttctgctagccactgtgaacttctgaatctcactagggtgggtctgcttggggcactcagataaccccagtatttcccaaaccagcgtttcccttgtgcttcaggacatatctgtacccaagcctgcactatggagaagtgggacggtcaatgagggcacctcagcttttcacatgccctgagtggatgatccagttggctgaccagaagcaagaattcaacaaagtaggcagcaaaattggacgtcgctctgtgtctcgttccatttctcagtcatctactgacaggtacagttcaggggcttcatatacagatagctctgatgatgagacatcggccagggactagcagcaaaagaactctaagggaagcaggtgacttctgtgttaagaacatcaaaagggcagagtgtggcgaagagacaattgagattggtggaacaagaaatgctgcattgatggcttgaggaagagagctcaaggagaaaaagcctttgtggtggagccaaaatcgtgggttgaccatacatgcatgtcagaactgtgtgcttatggaacactctgggtgctcttggggggccagtgccgatggggctggctgcagacatctattccactcttcactgaaggtggctgcttgtctagcagaaagtgggtttctgttgttggcctggaagggagagttcggacattgaatttggggggtgtatccacacaactttgtggactgtggagggggtgcgagcccacacttgatcttgggttgattggcgg

SEQ ID NO: 696697 - DNA, 118 bp, Homo sapiens
cagagcgggctcaaggataggtgattttggaagaacgatctcggtccggcaacattggtcacagtgggacgcaatttggggtgagtctctctcatatgatctcctcttaattcacatg

SEQ ID NO: 696698 - DNA, 282 bp, Homo sapiens
  misc_feature (114)..(115): n is a, c, g, or t
  misc_feature (181)..(181): n is a, c, g, or t
  misc_feature (228)..(228): n is a, c, g, or t
  misc_feature (235)..(235): n is a, c, g, or t
  misc_feature (260)..(260): n is a, c, g, or t
gtgttgaagaagaccagacggagaaccccctgatcctcatcgacgaggtggacaagatcggccgaggctaccaggtggacccgtcgtcggcactgctggagctgctggacccanngagcagaatgccaagctttccttgtggacccaaccttaacctgggaccggtgccaccgttggcacntttgttcccacagggtgcctgcttcacaatccttgcgacggtgcgcnaaacggnttccacctgtgtacctacgccaaantcccccccccgtaagcccccgg

SEQ ID NO: 696699 - DNA, 157 bp, Homo sapiens
agaagttctatctaatcattaaagtaaaacaaagccatctagggtcttatattcaagtactgacagttctcatgaagaagctcttcagactaaaaagacttctacttcatgttccgtcatccctgacacatcaaattctgatactgaaaccaaaacg

SEQ ID NO: 696700 - DNA, 971 bp, Homo sapiens
  misc_feature (858)..(858): n is a, c, g, or t
  misc_feature (885)..(885): n is a, c, g, or t
  misc_feature (963)..(963): n is a, c, g, or t
  misc_feature (965)..(965): n is a, c, g, or t
  misc_feature (967)..(967): n is a, c, g, or t
ctcaaaataataactccccagcatccacttgccttgaccagaaaagctgtcattccacaattgtgctaatttgtcccagaaaagcagacatcctatacatgaaaacagacttgtataatgcatgatcattatcataactctagctatagtaactaacagctttctcataatcaatgagggacccattttctctggctttattgaaacttccttagtgaagatcaacttcatttccttagcaaataactctcattcggactccatcatagtaccttttcctacctctagtaaaaattcctctcactttatttccaaaccattctctatatacctctcaaacccccatccacaaacacattaaacagctctcctcgtcctactctccaatttccaaaccagtaagtctcagttcccagtaacttacctaaaatacacatacttcttactctcttcagttcacaagtttcttaacattaatttagataccttcaaactgccagcttaagactatggggaaaatagcaatcagaaaaaaaactgcccagttacctcataatactgaaattgttctggatcatcagttagctatgttctaaggcaggagtcagaaatttctttacttctctctgaagaagtaagcttgagtgccactggtaggcctacagcaagagtaaaagtggagagagaaacaaagaaaaaggataggagagagaagatgccagatgtacatggtaaggaggtaggtcaagtaccaccaccaactacctgcatttaaaattgccaatccactccagctgaatgggagtttgacccaaactcaacatgtgtctgataagtcattagctgatggctatcatngtttgagctagtcaagatgaataggtnattcacctgtcccataactttaactgccacttcacgataaggacagttttttcttaaatcctcctaggatccttccangncnaatt

SEQ ID NO: 696701 - DNA, 768 bp, Homo sapiens
ggtagaaacatgcttgccttatgtatcagaggacatgctcagcagatccaagagatatatttggcaactttttctagaaaaggcacattgggtatcattcattacattctctgatgttatttcttggggtttcttgttctttttgttttgggaaacaggtctggtgggggttcgtgcccaggctgggtagtgtgggtgggccccaagtcacagctgcatggcagtcctcaagtcacccaggcctaaacaatcctcccaccttggtagcgcggggacatacggcctcacgagacacaccgtggccataaacatgtcttatgtgggtggaaagcggatctcctcatagtggtggcccgaggggggctcctcagggcctccgtgggcctcagaagtggatcctccgtggccatcaggttctccaagggcacaggggccaatgtgtgatacgctttgtgctccctgtgtgccatctcatgtgcgccaaataagagagggtccatatatcacctttttaaacgagaattggagcttcccaataaaatcggggataaatggtacgggtggggcgcaaagcgttgctgtcaaaaagcgctggagaaatagtgggggaaatgcgcgccctctgagaaagtgtgtggttaccgcagtggcgagtgtaacacccaggagaaacctaaaggaagctcagcaaataaaggcggtgaggcctggggggggtggtcgaacaaaaaagaaaaaaggcaagagcaaaaaacagaaagagacggg

SEQ ID NO: 696702 - DNA, 869 bp, Homo sapiens
acccgagctctttgctgaactctacggtttgctctgtgcaataatcattccactgccaggatacttgcattactgtccctatttagtataatcccactttgtgcacttctctcacaccagcaagtgtttgacagtgtgccttggaattaccaaacaatacatagatcttgaccacttctatgtaagtcgatagtctctatcgatgccactttgaaacaggaaactgccacctcggcagtcaatgcttatatccttattgaatgtacctattagtgtctattaattgtttgcatctacatgcagctctaaaactttaccatgacagtcataaacagctaaacaatgtttcgttatgtattcaacgcgggatatcagctgttactcaaagtcatgatccagggaccattctgggtcatgacgcctgtttcatacaacctgaatcacatcttaatagggtggtgctttgaggatgtctaatgtcagtacggcacctctaggagattcttatctcacccactgttgtgagaaccactaccatgctgagtcggaacctatactaggttgtttgtcctggggtacccttgaaagatgcagattcgaagacctaactaaggacttcgatgtgacctcgacatttaggaaaatatagcactgcctggctttaatacgatcccttttgccttccatggtgtcctctcttgagcaaacgcttgcacttgggtccctaacgggatagcattccgaataatccctttttgttccaggtttcggggttaggcttaaatcttatgaaacctctctgacataattcattgttatcccaggaatccattttaaggttggctgcaaaccatggaccactgaaggag

SEQ ID NO: 696703 - DNA, 1244 bp, Homo sapiens
  misc_feature (689)..(689): n is a, c, g, or t
  misc_feature (701)..(701): n is a, c, g, or t
  misc_feature (860)..(860): n is a, c, g, or t
  misc_feature (1201)..(1201): n is a, c, g, or t
  misc_feature (1240)..(1240): n is a, c, g, or t
agcggagatccagagaaagacaaatgaaatgggtgccaataaatcctcaaggctgcagagataaaagaaaagaatgaaaatccaggatgcaacaatctattctactatctaatctccctttttccactctttgttttcatttttttttaatgctgctctgagagatccaaaattagacatgaattttcttgaaggttaagtcttctttttgcatttgtttccaggacacacctgaccctcacatacaagaaacactgccttctgcagagaaaagattcaacaattccaagtccgtcatctaagatcctttactctcttttctctacaagataagaataaaattcaatcacggacctaagtaggtataatagacattaatataaatcttttaaatactaatactctttcctataaacatctattcaataaggctaaaagatgaaaataaaatcgaaaatttgctttttgtcattctggtaatgctgttcttcatcatagacaataacttggagataacttcaagccagagatggtagctttgctcatagttgctttggatggtaatcaaatgagactttcgtttatgtcacagatggaagcttgcaagtcaaaacattcaaaagaaatgaagatttctacatacccaagaactaatgagctagccagtgagtgagtcattatccatttangtcacagatggnagcttctaagtcaaaacattcagaagaaatgaagatttctacatacccaagaaccactcagctagccagtgagtgagtcatcatccctcacttggcctgctctttggctccatactggcttcttggctcctgttctttacctgctacagtttttgtccncatagtagccagaatgattctgttgaaatgaaacagactatgtcatttaagctcaaaaacctcgaacaacttttcatctcactcagaatactatgattgtgtggaacccatattatatgacctctggctaacttgattgaatttatacctcaccattctttccttctcaaagttcactccatcagccctgactttttggtggtgaaaccaagtatgcttccattcactgcctctgcacctacatagcttctgcttgtgaagctcttcctggagacatttacttggctcacactctccaatcaagtctttgttagaatgtcccttatttgcgtgttgctccnacctaatctttataaaatggcaccctttgcatcactaanaaaa

SEQ ID NO: 696704 - DNA, 150 bp, Homo sapiens
agcttcactgcacagtttctctgtcagctttgatgccttgagcttccaaagaacaattcttccagttctttcaggatatcatcttcatcaaagtcctgcttttttttctcttttttctttttcccttttgactttgggggctccagggga

SEQ ID NO: 696705 - DNA, 222 bp, Homo sapiens
tacctagaataccgtagactaaagacttgattgacaaagactgatctcataaaataatatgggaaccattgccaagtctagatactaaagcatacatggaggctctaaatgctggtgcagacatctccatgattgggcaatttggtgttggctattattcttgcctacttggtcggcagaaaaagtggttagtagatcacacagcacaaacgatgaatagaa

SEQ ID NO: 696706 - DNA, 825 bp, Homo sapiens
  misc_feature (18)..(18): n is a, c, g, or t
  misc_feature (31)..(31): n is a, c, g, or t
  misc_feature (103)..(103): n is a, c, g, or t
  misc_feature (117)..(117): n is a, c, g, or t
  misc_feature (119)..(119): n is a, c, g, or t
  misc_feature (121)..(121): n is a, c, g, or t
  misc_feature (125)..(125): n is a, c, g, or t
  misc_feature (139)..(139): n is a, c, g, or t
  misc_feature (148)..(148): n is a, c, g, or t
  misc_feature (158)..(158): n is a, c, g, or t
  misc_feature (167)..(167): n is a, c, g, or t
  misc_feature (180)..(180): n is a, c, g, or t
  misc_feature (205)..(205): n is a, c, g, or t
  misc_feature (217)..(217): n is a, c, g, or t
  misc_feature (221)..(222): n is a, c, g, or t
  misc_feature (228)..(229): n is a, c, g, or t
  misc_feature (252)..(252): n is a, c, g, or t
  misc_feature (256)..(256): n is a, c, g, or t
  misc_feature (280)..(280): n is a, c, g, or t
  misc_feature (290)..(290): n is a, c, g, or t
  misc_feature (292)..(292): n is a, c, g, or t
  misc_feature (301)..(301): n is a, c, g, or t
  misc_feature (307)..(307): n is a, c, g, or t
  misc_feature (310)..(310): n is a, c, g, or t
  misc_feature (319)..(319): n is a, c, g, or t
  misc_feature (445)..(445): n is a, c, g, or t
acaggtgtcgtgaaaacnacccctaaaaacnaaaatgggaaaagaaaaaactcatatcaacattgtcgtcattggacacgtaaattcgggcaaatccaccacnactggccatctgancnanaaanacggtggcatcaanaaaaaaacnattaaaaaanttaaaaaanaggctgctgaaangggaaaaggctccttcaaatatgcntgggtcttgganaaannaaaaannaaacgtaaacgtggtatcaccantaanatctccttgtggaaatttaaaacnaacaaatacnangtaactatnattaangcnccagaacanaaaaactttatcaaaaacatgattacaaggacatctcaggctgactgtgctgtcctgattgttgctgctggtgttggtgaatttaaaactggtatctccaaaaatgggcagacccaaaaacatgcncttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgt

SEQ ID NO: 696707 - DNA, 138 bp, Homo sapiens
agttcggcacgggggcgagcgcgcagcaacaaactcgccgccgccgcccttcagcgactggggccgcctggacagtcacgtcaggcggctggaagaccttctggcagtcagtgagcaaggagagggtggcgcgtacga

SEQ ID NO: 696708 - DNA, 1010 bp, Homo sapiens
  misc_feature (455)..(455): n is a, c, g, or t
  misc_feature (467)..(467): n is a, c, g, or t
  misc_feature (626)..(626): n is a, c, g, or t
  misc_feature (967)..(967): n is a, c, g, or t
  misc_feature (1006)..(1006): n is a, c, g, or t
agcggagatccagagaaagacaaatgaaatgggtgccaataaatcctcaaggctgcagagataaaagaaaagaatgaaaatccaggatgcaacaatctattctactatctaatctccctttttccactctttgttttcatttttttttaatgctgctctgagagatccaaaattagacatgaattttcttgaaggttaagtcttctttttgcatttgtttccaggacacacctgaccctcacatacaagaaacactgccttctgcagagaaaagattcaacaattccaagtccgtcatctaagatcctttactctcttttctctacaagataagaataaaattcaatcacggacctaaatggaagcttgcaagtcaaaacattcaaaagaaatgaagatttctacatacccaagaactaatgagctagccagtgagtgagtcattatccatttangtcacagatggnagcttctaagtcaaaacattcagaagaaatgaagatttctacatacccaagaaccactcagctagccagtgagtgagtcatcatccctcacttggcctgctctttggctccatactggcttcttggctcctgttctttacctgctacagtttttgtccncatagtagccagaatgattctgttgaaatgaaacagactatgtcatttaagctcaaaaacctcgaacaacttttcatctcactcagaatactatgattgtgtggaacccatattatatgacctctggctaacttgattgaatttatacctcaccattctttccttctcaaagttcactccatcagccctgactttttggtggtgaaaccaagtatgcttccattcactgcctctgcacctacatagcttctgcttgtgaagctcttcctggagacatttacttggctcacactctccaatcaagtctttgttagaatgtcccttatttgcgtgttgctccnacctaatctttataaaatggcaccctttgcatcactaanaaaa

SEQ ID NO: 696709 - DNA, 450 bp, Homo sapiens
catagtatagactggggaagagggatattctgcatatgtgttctttggcagtatgcatggatatgtggcatttgctgggttgcagtgttattattgctttgccgtgcttgtgactgttgtaatggtggcattggatttcttcataactgttacaaaaagctgccttcggatcataaggtgaacttggactgccactttgttagatctcccagtgcaccgttgaatctgatgacactggttctatgttcttgggcttgaagtttaacaacctgctgtatttatctgacaaccactgctattctgattgctatggcgaggcaccatgtgaggcttaggcgagttagtagctctggcagggctcaaaggcctgacaggaaacggaccccaagtggattgagctggtggaaaagtacctccaaagtgggtcatgggcaaccttggtggacggat

SEQ ID NO: 696710 - DNA, 292 bp, Homo sapiens
tcgagccggtcctatgaatgagggtaggtgagggcacactggggcactatgatgaggctggtgagtgcacactcgggcactatgatgaggctaggtgagcgcacactgggacactatgaagaggctaggtgagcgcacactgggacactatgaagagggtaggtcagcgcacactgggacactatgatcaggctaggtgactgcacactgggacactatgatgaggccaggtgagcgcacactgggacactatgatgaggccgggtgagtgcatactgggatactatgatga

SEQ ID NO: 696711 - DNA, 387 bp, Homo sapiens
acaggggaggagggaagataacactgcatagtctagcccagaatctagagcacgctaacgaacaccactcatacactctaacacatgcttcataaacactaccaattagactcgacagccacgcatagcataatggctggataactgccgaagtaagcgccgctccatgaagtctgcttacttatttaaaaatcgtgtatcagttttaaatactgtacattgtgtgcagatataaggggactagggcattctgtagaattcatacatgtctagttagtaacgtgtgtcctgtgtactgcagatgtgtgtactctgggcttaatgtatctgtacagtagctttcacattaaaaaaattgtggacaaacttgtccgtggggtaggaggt

SEQ ID NO: 696712 - DNA, 461 bp, Homo sapiens
  misc_feature (80)..(80): n is a, c, g, or t
  misc_feature (85)..(85): n is a, c, g, or t
ccgagcatacaccgagcagatgcttaaggaaatcaaggactatgctcaaagtgacacagctaagcagctagagccaggtncacanccaggcctgatgctgtgcatgagcacttcaccaccgcactgtatgcacactctctgggttctccttctccagtttacaatcagtcagaattagtcacaactcaaaaacatcgtcattccctaaatttattctattcttaaaaaccagtgagggggtgaaaagatgagacaatagttgggttagctaaaaaaaattccattaggcaagtatttactcctgttttgaaaagtctgttttggccacacattgtgctaaacctgaggggtccaggcagggcagcaactcagattttagtgatggacatgttagcagtcactttcgctgaagtcccacatctgttttatgagcatgttctagaaaattaagtacattgtta

SEQ ID NO: 696713 - DNA, 316 bp, Homo sapiens
ctggctcgggtaaccgcagtcgtattctctatcttcatgagatccactttttatgctcccagcgagataagaacatgtgatatttgtctttctgtgcctggcttatctcacataacataatggcccccagttccatccatgtggctgcaaatgacaggggttttattttgttaagggcctaataatgttacactgtgtatatataccacattttctttatccattcatctgttgtggacacttaggttgattccatattttggctatggctattgtgaatagtgctgagataaacatgagagtgtagatatctatt

SEQ ID NO: 696714 - DNA, 244 bp, Homo sapiens
acctcgctatcatcggcaccagtgctatgatttctctctcttagcatgtgccgatgaataggaggtgccgatgaatagggcacctcgctattcatcggcacctcgctattcatcggcacctcgctattcatcggcacccttggcaaggttagggaggctagtcaagtgaagcagtgggagtggagaaggaacaaagaaatctgtaactggttgtgatcaattagttgtaggtgccgatgaatag

SEQ ID NO: 696715 - DNA, 254 bp, Homo sapiens
  misc_feature (21)..(21): n is a, c, g, or t
aattcctgccagcgtagagcnagttgttacggcaagcaccatctcggtatgtgctcttactagattatacagtgctggagagggatggcatctctagtgttttggtattccacctcacccccagcacatagcccagtctctggcacaaattaagtacttaaggtgtgtggagctaaatagaataaaggattattagcattagcatatgtggtgcctgggtggtatacgcgggaatggaatgggggtaccgagct

SEQ ID NO: 696716 - DNA, 873 bp, Homo sapiens
acagtttaaaaaaaaaaaaaaaaaaaaagccttcccctacccaacctccgcccatggttctcttccaaggggcaattaagtaggatctacttggtacatctcaagtaaaagttaattccctgatacagggaccagtttcttagtggtaacgacatacacatcctggctggtccacgctggttcctccaaaatctacttgggcttcagctccgggtcctggtaccagatgggaaaatggttttcgggtagatctgggctggctggcttaaacgccagttttccctaagaactccaaaggctaaacgtctacctagggcgcagacgtgtgaaggatacggatttctaatcagagaaaagtgggcctccaggagctttcatttatgtcttctccagaccaggtttctccggtatatcttccttataatccccttttcaaccaacacagggtgaagttcttccagcccacagaggtagtaatatcatcttttctatctcctcctctccttgggccatgtaattgaacgcaaaatattatttatttagcccaggcttgagagccactggttgtgtgggacagtcttcatctagaattccataccctgcctaggccgagcgaaaggctccaccaggctaatttgccaggatgggcagcccctataacccccaagtctgcagggtaggggaaataccctaaattaaggaggaggccaatggctttgggacatcctggcatgttcgcactaagggcgggcgcaacctttaaagccatccggggcaggaaccgcgcatggcttacgcacggccaagagaccttcatggcaaagcccaaacgcccgactggggcgacccccaaatcacccaaaacattgagaa

SEQ ID NO: 696717 - DNA, 418 bp, Homo sapiens
tgcagatatctctatgctgggccagttcggtgtgggattaatctagcaatttgtgtagctgagaaagtaactagtgatcaccaaacataacgatgatgagcagtacgcttgggagtcctcagcagggggatcattcatagtgaggacgcaacaggtgaacctcatgggtcgtggccccaacagttatcctacacctgaaagaagacaaactgcagtcaccttggcaggacacgacgaatcaaaggagattgtgaagaaaccattctcaggtttattggatcatcccattactcttttggtggagcaggccacgtgcatcaccagcaagtaagcgcatgcatcgcaggctgacgcacacggccgcccccagcacagcaagcaaaacgcaacacagcacgcagaaagatcggacagcacc

SEQ ID NO: 696718 - DNA, 549 bp, Homo sapiens
gcacgagcccaactcctcggcaacttgcttgatatgcttaggactctgagctcttgatatatcaatatctgaaggcactggactttctaagtgtaatggaagaggtttgataactggaagcttttcagattccacgaattgccttttagcagctaatagtacattggaaacaagcatagcgacagtcattggacccactccaccaggaacaggggtaatataagatgtcttttcctttacagaatcaaaatcaacatcaccaactaatttttgcccacttttcttactgatatcaggtacgtagttgatacctacatcaataaccacggcgccttctttaatccagtctgatttaacgtattgaggaataccgcaagctgcgataactatatcagcttgggagaccacttctgcaatgttccttgtatgactatgacagacagtaacagtggcattcgcatttttcaacaacgaagcaattggatttccgacgatacttgatctgcctaacacgacggcgttcttaccatctaacttaacatgagcttc

SEQ ID NO: 696719 - DNA, 689 bp, Homo sapiens
  misc_feature (508)..(508): n is a, c, g, or t
  misc_feature (527)..(527): n is a, c, g, or t
cggcacgagatttattcgtcttaacaatcttttcatcatccctcaacagaattacctatattcctcatctccccttccccctctgaaaaaagatatataagtatctgagtcccattgagatatttggagtgatcacgctgtggttttcctccatgtacattaaaaaatttttattctttctctcctaaaattaaaaaaatgtattcctctctcctgtcttcggtgaaccgatttttcagtgaaccatcagagaacaaaggagaagctttccattggtccctacgatactgaaaagtattttgcatatttttaaatatgtgcatacgtatatacacatatataggtttttgataagtatgtacaaatatacatgtactttttttagccttccatattttgatttttaaataattattggataagttttaggtgtttttacatttccaaatataaacttaaacatactaaaggtgctgataaccaaggtataatttcaactgggcctggngagtaataactggtggctntcatataaccctctattctcaacactttcacaaacttcatactgaggcaatctctgggaacaggtactacgcccaacttcaagctggatctggccctaacaactttcccaagggagcatttaggaattccacagaagttgcagagggcacatttgcatgctt

SEQ ID NO: 696720 - DNA, 136 bp, Homo sapiens
atggcgaatcgcacctctgtgttgatagcttcacgttgcgctgcaggtagcggtcgatcataataaccttgcttgcagccagggttggggcagggccgctcccggacctcctcgattgtgctccttgagtgtgctt

SEQ ID NO: 696721 - DNA, 355 bp, Homo sapiens
aatgttaatcaaaacaatctgctgagcattaaaaaccatctaaatatcaattctttgcaaccagcacagaggtaattttctgtcaaatccatacacaccaccaaggttaagtttttctgatgtaaaccaagagtcaatgtagggtgaaaaatttcctcagcgcaagagagctgagtagtgttttggatctttctctggctggtacaagcagtattagaaaatctttttggcaagggagaaaaataaatacaaatggaatgctacatttttaaattagcaaactgtctcaggaatgataaaactatcagtaaagtagcaaggggataactttaaaacattatttgtcctggtctca

SEQ ID NO: 696722 - DNA, 105 bp, Homo sapiens
tttgcaggcagcatgtgttgatgagtccttctccctttttttaacatttatttttttggagtctcgctctgtcgcccaggctggagtgcagtggtgtgatctcag

SEQ ID NO: 696723 - DNA, 436 bp, Homo sapiens
agatcgcgccactgcgctccaactgggcaaaagagaaagactctgtctgaagaaaaaaaaaagaaaggcataaacctcagtttcaagtgctaagaaatcatatccccatttaaacaaatgtcctttcaggtgccagattttacacatgaacttacttgtgtatttcataagcccagggtcagcttcagaaggggatatttacaaaggtctaaaacatgcgtgctcgagccagccttttacaaatgcaaatgaacatctggaattttgggctaatttataagagcaaatgaagatgttgaaaacgtgaggggtccagataggagggggaccttcttcagttctcaaattcaaggttgcaatgttacttggattagagggctagtcagagactcctgtagtagtttgtaccttttaaaaaccatcaaggagggcgggg

SEQ ID NO: 696724 - DNA, 622 bp, Homo sapiens
aaaccttgggaagcacctttagaaaacccgctgtcccaatgacatcctggaccccaacaagctttctactccggtccctacctacagtaaggattcaacacttcaccaattaggccccctaaatcaacacatctgattaggtgtcaattcactgccatccccgtacaaagtggtttttttcactcttcccatcattatccatagctctcgtgtccctagaacgcctcgtccctcccccatcaacacaccgctatgaaattgtcttccttatatagagaacaacttcttgtttcggcccccccaataaatagtactatttacctaacagtgagagttttataaggtcacactcgggagatttctcctccgttatcgttgtccttcaccaaggagatctgtgccaggtaacccttaaaatcttggtttacaggaaatgaatgcgacttattgatgaatcccactctccacgatgtgctgaagtcagctctcccccttctgtctcgccccggttagactccccggtctcttattcagaacccacggtggtccactttttgtgaaaaaaacttcaacccctgttttctccgggaaacaaccagaacccgaaccccccaacataaca

SEQ ID NO: 696725 - DNA, 284 bp, Homo sapiens
  misc_feature (245)..(245): n is a, c, g, or t
gtctgagcaagcgtggaaagggcaggatgccagaggcctcagcttcgggaaggttagagccacaagctgagcagggtgagggcgcccggggccgttccaccggtgtcactcacctgagctctggggaaccgggcctcgtgccctcctcgcccgcaggggctgatggtgggtgcctccttagtgtgccagctggagacaagcttaaggtgatctccaaagccacgatggagttggcatataggtgntccagaatttcggtttcaggtccaaaaatatgtcatcct

SEQ ID NO: 696726 - DNA, 331 bp, Homo sapiens
tctacgagctatcccggctctgggtatgacataatctttacaacaacccctgtgacacaagtttactacataacaaacctgcacatatacccccaaacttaaaataaacgttttttaaaaaagaaaatcctgcttcaaactaacagaatttaagaatgttggctgggcacagtggctcacgcctgtaatcccagcactttgggaggccgagatgggcagatcacttaaggtcaggagttcgagaccagcctgcccaacatggtgaaacactgtctctactaaagatacaaaaaattagccgagggtggtggcgtacgcctgtaatcccagc

SEQ ID NO: 696727 - DNA, 168 bp, Homo sapiens
gagctgggccgaattctaattacgcaatgttgtgctatacaccacagaggtattgcctgtgttctcctccaggagtttgctgatgtcatgttttatgtttaaatctgtaagccattttgagtttatttttgtgtatagtgtgcaggtgtgttctagtttaatttattt

SEQ ID NO: 696728 - DNA, 676 bp, Homo sapiens
gagacattcttctatctagtaggagtcatgcccctgtagtgcccaacctagccaggtagtcaccactgtgcccaggcaccaaataaaccctggttgggaagaaaaaaaaaaaaaaaaaaaaaaaaaaaaaaaaaaaaaaaaaaaaaaaaaaaaaataaaaaaaaaaacaaaaaacaaaaaaataaataaaaaataaaaaaaaaaaaaaaaaattaaaataaaaaaaatcaaggggtgaacatttaaaaacttttaaaagggaaaacccttgtattacccaaataaaaagccttgaaacaaaattcccttttgcaattggggaaaaaaccaaaaagtccttaacgatggtctattcaaaaaattttcaaatcttaaaggcaaatggaaaatttaaagctttaaatatttgttaaacatcccgttaaaattttgttaatacagttattttataaccataggccgtaaatgtgaaaaatctttaaaatcaataaaattaacccgaaaaaggttaatattttttcccaattggaaaaaagattccttattataaaaaatgggattttaagtgttaaagggtgcaaaaaccttttaataaggaaaaggccctaaatgtaaacccatacctataaaggtttttgggggtaaagtgccctacaattctacccttggggcctcc

SEQ ID NO: 696729 - DNA, 496 bp, Homo sapiens
gatgacgtgattgaatatctgatgaataatccatagtattaagcgcatatatttactataacacgtgtataagcaccagcagcaagaagctcaggatactcagtcattgtgccttcttcaaaatgacgtgcgcgtattcctccaaatatcgaagacagcagagagtgccagctgatgagtgaccgcccattcacaatggcttcacagggactaaaatacctaggaatctaacttacaagggatgtgcaggacctcttcaaggagaactacaaaccactgctcagtgaaataaaagaggataccaacaaatggaagaacattccatgctcatgggtaggaagaatcaatattgtgaaaatggccatactgcccaaggtaatttatagattcaatgccatccccatcaagctaccaatgactttcttcacagaactggaaaaaactactttaaagttcatatggaaccaaaatgagcccgcatttgcccgggcgaatt

SEQ ID NO: 696730 - DNA, 512 bp, Homo sapiens
  misc_feature (9)..(9): n is a, c, g, or t
  misc_feature (470)..(470): n is a, c, g, or t
  misc_feature (502)..(502): n is a, c, g, or t
cgttaagcnacctgcttcactcttcccagactcactggctcccttcttcttccccaaacaagctctttccatcttggggcctttgcactcttcaaccacatatctctccccaggttttcaggtggctgccttctctattcagatggcagcttctcagggacccttctctaacatcattaaagcatcaattccagttactctttagaatatcatttcatttcttaaaaataacttgtgcgtttgttcctgtgcatcccacggtaagtaaaagagtagacttgggagtaagtctaactgtgtgacattggatcccttaaacttgctaagcctcagttttcacatctataaaatgggggaaataacagcatgcatctcatagagtcatatgagaattaaatgagtcgatatacagaaagtacttagagtcttgcacccagtaagaagacccatgagtgttggctgttcgtcantgtctgcctttccttcttaggatgcgaggtantcttcatagg

SEQ ID NO: 696731 - DNA, 172 bp, Homo sapiens
agcaagactgaagtgtgtctagaggaactagaatacaagaaccaactccgaagcatgaagaaaagatatactaaaccagagcagaaatgaatgaaactgaaacccaaaaaaatccataccaaggatcaataaaaaaaggttggttatttgaaaggataaacaagatctataa

SEQ ID NO: 696732 - DNA, 646 bp, Homo sapiens
  misc_feature (44)..(44): n is a, c, g, or t
  misc_feature (75)..(75): n is a, c, g, or t
  misc_feature (86)..(86): n is a, c, g, or t
  misc_feature (95)..(95): n is a, c, g, or t
  misc_feature (130)..(130): n is a, c, g, or t
  misc_feature (144)..(144): n is a, c, g, or t
  misc_feature (224)..(224): n is a, c, g, or t
  misc_feature (228)..(228): n is a, c, g, or t
  misc_feature (231)..(231): n is a, c, g, or t
  misc_feature (250)..(250): n is a, c, g, or t
  misc_feature (293)..(293): n is a, c, g, or t
  misc_feature (308)..(308): n is a, c, g, or t
  misc_feature (316)..(316): n is a, c, g, or t
  misc_feature (319)..(319): n is a, c, g, or t
  misc_feature (322)..(322): n is a, c, g, or t
  misc_feature (325)..(325): n is a, c, g, or t
  misc_feature (329)..(329): n is a, c, g, or t
  misc_feature (349)..(349): n is a, c, g, or t
  misc_feature (354)..(355): n is a, c, g, or t
  misc_feature (358)..(358): n is a, c, g, or t
  misc_feature (363)..(363): n is a, c, g, or t
  misc_feature (368)..(368): n is a, c, g, or t
  misc_feature (370)..(370): n is a, c, g, or t
  misc_feature (377)..(377): n is a, c, g, or t
  misc_feature (382)..(382): n is a, c, g, or t
  misc_feature (385)..(385): n is a, c, g, or t
  misc_feature (391)..(393): n is a, c, g, or t
  misc_feature (395)..(395): n is a, c, g, or t
  misc_feature (399)..(399): n is a, c, g, or t
  misc_feature (408)..(409): n is a, c, g, or t
  misc_feature (411)..(414): n is a, c, g, or t
  misc_feature (418)..(421): n is a, c, g, or t
  misc_feature (423)..(424): n is a, c, g, or t
  misc_feature (428)..(428): n is a, c, g, or t
  misc_feature (431)..(431): n is a, c, g, or t
  misc_feature (435)..(437): n is a, c, g, or t
  misc_feature (440)..(440): n is a, c, g, or t
  misc_feature (442)..(442): n is a, c, g, or t
  misc_feature (444)..(447): n is a, c, g, or t
  misc_feature (455)..(456): n is a, c, g, or t
  misc_feature (458)..(458): n is a, c, g, or t
  misc_feature (462)..(462): n is a, c, g, or t
  misc_feature (466)..(466): n is a, c, g, or t
  misc_feature (473)..(473): n is a, c, g, or t
  misc_feature (477)..(477): n is a, c, g, or t
  misc_feature (480)..(480): n is a, c, g, or t
  misc_feature (483)..(483): n is a, c, g, or t
  misc_feature (494)..(494): n is a, c, g, or t
  misc_feature (542)..(542): n is a, c, g, or t
  misc_feature (584)..(585): n is a, c, g, or t
  misc_feature (643)..(643): n is a, c, g, or t
ttttttcttttccttagggtcaggggaagggaaaaaaatgtgtntttatggtgaacatgtgtcaagaggactccntcccataaacncggtgcccncaataagtatatttgtgtagtaattaatgtgagancagagacacaagtnttgccaaaaggccattgtcagtatggggtacattatttaggtcaagaatccagttttccaaatgtggtatacattgtgcncgcngtnattaagcgttttgtcatcnaacgacaaagcgagccagagttactcccagacggattataccnaaaacacagtttccnaatgtttnttnttntgnaatnttttaaggaaattctatgcngaagnnatnttaanacatntnttattanatctnttngacaannntnttantaatattanntnnnnaggnnnntnntttngtntctnnnagngncnnnntgtcattnnangtgncggntgtgacncgcnttntcnatcacgtgttnctgggtcatccttctttgtcattcactttcttgccgaggtctccagtnacacccttgccatgccaattctcctccaagacgtttaccgcnngccgtctgttatcccagcgcaccggggaggctgaggcaggagactcgcttgctcccgngag

SEQ ID NO: 696733 - DNA, 265 bp, Homo sapiens
  misc_feature (56)..(56): n is a, c, g, or t
  misc_feature (67)..(68): n is a, c, g, or t
  misc_feature (158)..(158): n is a, c, g, or t
agaatgaaacctgccgctactcattagatcgtgtcatatgccataagcatcgcatntgtaacacacnncgcgcgcacgctccaaagcaacttacttatattgctatacgtctcatcatgcatctgtgctgctagatagatattatggcgcgatacatngagtagtatcaaggactagcattatgagagcgacatttcctcgttttaccagaaccttgctagctagtctcagaatcgtagcatcatcaactgtcaagagattgctg

SEQ ID NO: 696734 - DNA, 144 bp, Homo sapiens
aaccgggacgcctttgcttctccagctccagaagtgtgcggatctctccaggtctgggggctgtccagcctgcatcagctgccatatgctgtggttctcatccagggtcatctctagcaggtccctctccatcatgagctcctc

SEQ ID NO: 696735 - DNA, 1195 bp, Homo sapiens
taatgacctccgtggtctgctccgctcctgcgagttatatctattgcccgcggggaggagtatcattttttacccgcgacaccgttgtggccgccctgcgcctttttggggccccacatggaggacacagtgtgtggcaccaaaaacagcgtgcgtggtgcccgtccccggatttccccgggatattatgctcggacccccacacggcgtcgcggtaccagacccgagggaggtacgcactgtggtcacggagttggccttaatactcgccttataaaggaggaatattaattattcctcccccccgcgtaattgcaaccaccctgactgccccacaaattattggtttgaaggttggccctcccccaaattatgcctccccaccatattgtaacgtgcactttctcctggccccccccaggctttcttcccaattaggttttggccatggagcaaagattctattgaaagccccacacatgggaggtgactggtgagtggaaacacacatagtggaaaacgcattggattggtccacaccccaggtgccgttccacccggcgtatattgggatacccgcgccccttgcccagagacttacccactggccaataaagatttttggtgccccctgaagggaagcctttggatggaaggccttgtctgtagtcccctccaccaagtacccacaccgagtttcccctgggttaatggattcttgagaaccccaaggagattttaaatcgccacgaagtaccactcggaagccaccacatcactgggccacagaaattttgccacagaattaacacatgcgcctaacttaaatggaagaaagatgaaagaatggcttacccagaaaccacgttcttctccaataccacttaagaaccacgcgtaaactccagaccactggaaggagaatgtatatatagaaagtcttcacatttctgtctaatatcgcaagagaaatccacgttctattgaaaaagagagccccacgaaaagaaagttttaaaagaagaggtggacaccgtccccaaatgtcccttgctccagaagaaggatcgggtagctccaaaagaaggccagcttcctccagagctccaggagcgggctgcttgagagctaaaccccacgccattttttatgattttttcagaaatagataataaacctctggaccagccactta

SEQ ID NO: 696736 - DNA, 909 bp, Homo sapiens
  misc_feature (13)..(13): n is a, c, g, or t
  misc_feature (77)..(78): n is a, c, g, or t
  misc_feature (101)..(101): n is a, c, g, or t
  misc_feature (168)..(169): n is a, c, g, or t
  misc_feature (171)..(171): n is a, c, g, or t
  misc_feature (182)..(182): n is a, c, g, or t
  misc_feature (202)..(202): n is a, c, g, or t
  misc_feature (206)..(210): n is a, c, g, or t
  misc_feature (213)..(214): n is a, c, g, or t
  misc_feature (218)..(218): n is a, c, g, or t
  misc_feature (222)..(222): n is a, c, g, or t
  misc_feature (225)..(225): n is a, c, g, or t
  misc_feature (229)..(229): n is a, c, g, or t
  misc_feature (242)..(242): n is a, c, g, or t
  misc_feature (245)..(245): n is a, c, g, or t
  misc_feature (252)..(252): n is a, c, g, or t
  misc_feature (368)..(368): n is a, c, g, or t
  misc_feature (406)..(406): n is a, c, g, or t
  misc_feature (412)..(412): n is a, c, g, or t
  misc_feature (500)..(500): n is a, c, g, or t
  misc_feature (511)..(511): n is a, c, g, or t
  misc_feature (534)..(534): n is a, c, g, or t
  misc_feature (537)..(537): n is a, c, g, or t
  misc_feature (594)..(594): n is a, c, g, or t
  misc_feature (625)..(627): n is a, c, g, or t
  misc_feature (644)..(644): n is a, c, g, or t
  misc_feature (695)..(695): n is a, c, g, or t
  misc_feature (736)..(736): n is a, c, g, or t
  misc_feature (774)..(774): n is a, c, g, or t
  misc_feature (802)..(802): n is a, c, g, or t
  misc_feature (847)..(847): n is a, c, g, or t
  misc_feature (854)..(854): n is a, c, g, or t
aaaggaactgttnaaaaaaagaaaacaatttaaaaaagaaaaaaataaaaaaaaaaaaaagaaaaaaaaaaaaaaannaaaaaaaaataaaaaaaaaaaanaggaggaaaaaagaaaaaaagaagggaagaaattaagcaacaaatacattccttctagacagcggtnngngatctcttgtnggtttctctccatcacttcngggnnnnnggnnagcngacnggntaangggaaagggggangcngggggantctaagaggcctctacccccaaagcaaaaactattctccaagttctccccttcctctcgcctccaaagagccaatttggaagttgttgtcacatccacctcccctactttccattntgttttgcttttgccatcagatttttataatgtttgtntctcanaaaaatactctagtgacatgttaaccttaggtagccagaagccaaacacttgggtgccatcttggggtagtccagattgtcaattgtnacatgcaaganagaggtcaagggcatggaagggnagngtctccagggggccacagtttgccctagacagggcgtattccaaaaagtcatttgtntctttaattgttcaagaaccatgttgccacnnnggggcaggtctggaaanaagggagggtaaaagacaggagtctcccagtattacctaccctggacagancagagcactggcccgaaaactgagagcctgagcatggagcntccttgattgggaggcagaagagatgcccaaaggaggnagcgagaacttggaattgtatctcccanggccctggattcttaggaaaatcatggcttcccaactggatgggnagcaggncttggggtgaagtaaatggtagactacccagggccgagtgacacagaacaagaac

SEQ ID NO: 696737 - DNA, 1052 bp, Homo sapiens
gggaccggggggggtccagtcccgggcgggccgtcgcgggagagaaataacatctgctttgtgccgagctcaagaggagaccccagacccctcccgcagcagagggctggagcctgctcagaggtgcttgtgaagatgctgtgagcgcccgcctctggttgtcgggcacctgtggttggctcggcgctctgttgctgcttggtggtgctgcctgctggctttctgagcggccttgggggctggggcgccttggtccccttaattccgggttgggaaccgagtttccattcctttggcggcccaattcccacaaaacttggcttcctttgggtggaccacccaagggagggcaaggccgcattccttgtgaaacagagtttgttggacaaccgaatgtggggagcggcccgggggaaacggcacatagaagtgtgtgcgttggggatggcgcaatttgagaccacgtataactggggtagagccagcaacgggcagtgttgggccccataggacgttggtgggggcccgacaagcagacggggcaaaagctctgaggacccgctgctggttcaggaggaggcaccacgccttccggggtgcttagcaggacacgcgggagcgcccatacttggtggcaaacatcaagatggtgcgctgtgcccaccggcttggctgtacacacccagggtgcgccaggcactgatccaccattgggagattcaacccgggatgttggtggccgccatacccacaggggaggcgtgggaatccggcagcgttagagggacaaggtcccctaggtggtgagaacagtcccatagaaaattatcccccaggtggaggaacgaaggtttgctgttggcgcatcggaggtgtctctcctcacccatggtaggcccggcaccgccgaccgctctccgtgagacattggccctgctgacacggaaacagcaaggcacgacagtagtgcaagggcagccaattacaaacggtccggaccttgtgtgtgcacacaacacctgacgaacagggaggcgcgctacaacacatcg

SEQ ID NO: 696738 - DNA, 321 bp, Homo sapiens
  misc_feature (299)..(299): n is a, c, g, or t
tggaaagggaatttggcttttggaaataggatctggctccgatacccaggcgggagggcaggggcacaatcagggctcacggcaacctcgaactccgaagctcaagcaatcctcccacctcagcctcccaagtagcggggactacgggcttgtgccaccacgtccagttaatttttaaaatttttttctagagacagagcttggcggtggttcccgggttgggtctcaaaccctgggcctcaagtgatcctcccacttgggccttccaaagtgcggggattacgggtgtgagccatggnacccagttgaggaccatcgtgg

SEQ ID NO: 696739 - DNA, 329 bp, Homo sapiens
attacttatcattcatgtgttcactggagtcacacttttaatttccttcaagaacttttcctttgttttcactgcttggctaactgtcaggtataagagacctagctttcagtctgtctctgcttctgtcctatcttagctttcaacatgccttcctcaataagctcaatcatttctatcttttgatttaaaatgaggggcatgtgactcttcctatcagttgaatagttagagcccactgtagggtctattaattgggcctaatttcaatattcttctgtttcagggaactaggggagggcctgagtaggaaataggagagatggagg

SEQ ID NO: 696740 - DNA, 160 bp, Homo sapiens
ccgttgtagctggtgaaagtggttaggtttacgactgtccggtgaattgcatcttgctttttaagcctaatgtgcggacagctcactgcagtgcctagacgtcttgtgatgtacttattatacgaatgggggcttcaatcgtggagtactactcgcattg

SEQ ID NO: 696741 - DNA, 1170 bp, Homo sapiens
  misc_feature (340)..(340): n is a, c, g, or t
  misc_feature (366)..(366): n is a, c, g, or t
agcgggggagcgcgccagcaagatccactcctgagagcccgtaggacccctgcagcacgcgcctgacatgtcccctgactggtcctctcggcgccgcggcgatcgccgcatgcgccaggacgtactggcccgccgacccgtgtggctcgccgagcaccgacgcgcctcagggcacgctaccccgacgctagcttcacgctggtgtacgaggtggcccagcggctcagcgatgcgtaggagctggtggctagtgatcgtaccgtccgggtgtgcgaacgatcaagcagagttcacccgccggaccatccgagggggctccccggtgtcttccagcccggtnagcgcctgggcagtggatgccgcggngtcccctttgtggtgcttccaccatctagcgacgggccttgatgcacatgagaggttatgagttgacactgcctcttcctggaatttgagacgataactgttccttcagacgaggctaggtccctatgccttgtgaaggcaccactcaacatgaactgccaaagaatgcttgaacgagaattgacgttcccaggagtaggccttgtcggtggctccactagctgggaaagtcggaattggcgagtcctcatggatagggtccctaactccattgttcctttgctttccctgtccttgtagccttgcctgcagcaatgcttgcctgactcgggatcgagttgcgagccctgggacttctatccccttttcgtggtcctttaaggggaccgttccttgtttttgcccctttcctgcccgtccttgttgccgaggtagctgtgcctgccagattgcccatggtttccacggggcccaagaggctttggtctgtggggcgttagccatgtccatggacctattgtggggtggcacccccttgctcaagtggtccttactacggcgaacccttcaggagaagattgggatagccctattcgttgcattaccacttccatgtgatagcagatggaattcaggggcagaacccctttgacacaggcggcggggcgccccccaccgctcccacagtttagaggttgggagaacccatctaattgacataccttttcgcaagggcgaggcccacttgggcctcaaatgccccccaaaacgttggcgtttccccggcgaatatggaactcccag

SEQ ID NO: 696742 - DNA, 485 bp, Homo sapiens
  misc_feature (172)..(172): n is a, c, g, or t
tataaaattattagtataaaaggggaaataggtaggattaccgtggtaagggcaataagtgtggggagaaaatggggtgggtttggtatgtccaaacgtggtaccttaatctttacccgtggtatacacatcttgggagcgatcgtgatagcttaagcggtgagcgatcacntatcggcgatcggatcaaccgatcacggtataccgagcgggatacctggtggcatcatactggtgggagctactaccggcatctggctcccggtaacctcttcgaataagtggcccattgtgggccacacaacagcccgggtatacagcggggggacaaggcccctccctaagggagccacggcacgggctgcacacttggcactcacaaggggtgctaaagctacagtcgtcacccctgtgtcacccaggggtgcaaaccactacgctcacacaacgggtccgtggagtgcacggaagatactacacgttga

SEQ ID NO: 696743 - DNA, 84 bp, Homo sapiens
  misc_feature (14)..(14): n is a, c, g, or t
ggaacccaggggcnttatttaaaatgcagatttccagtgctggaaataggattgcctaaaaaaaatttaaaattgcaggttaaa

SEQ ID NO: 696744 - DNA, 146 bp, Homo sapiens
tgtggtgttacgtccggtggtagcatggctgcatatccccttctcttagggcctgtgcctatttcaaactctcttctcaacagaacaaagggtgggggaaaacaatgtaacttcgtaactgtatacatagtaaggataacctgacc

SEQ ID NO: 696745 - DNA, 902 bp, Homo sapiens
tcgtgggcggggaatccttccgcacattctctaggaggggctgcatagcagcggggagagtgaactgacagactcagtcactgacagagggaaaaggagtgagaacgacaaagccgtcaaagccccaacagcttggtatttctccagcccggcgcataccccggagctccgaggcactccctccatctttggaacacgccagtaattgattgataacagcgaagctatgagggaccctgtgagtagccagtacagttcctattctatttctggaggatgcccatcccagcaactggatctgtcggacctggaaggctgggtctgtcagattacagccaactacaaggtcaaagacagcagcatgtcgggcaacaatgatccgggcaatgcaacttgcagcaagaccagtgagaacaaaccctgacaggtgaatggcctccttgagtacaagcaccttcaacttctggagagctcccattgccagcatccacttccttcgaactggactcgctctaagagcaagaattctatctacgcataacctttgccctcactggtgttccttcacaaggcactttcttcacatacatttccatttaaatctggctcttcccaacgggttgtgtgctgctgcactgcagagctgaggtcacggcaaaataacaatctggcatccagttttcaagccctagtcaagcatatgcacccaggactgggcaggaccctttcccaaatatctgaacagtgtggactgcgcttcgtcagggagagactcatagcgacaccatcgccgcaacatttgggctgtttttagtttattatgatgtacatataccagcacgtaaccgatcgagccctaacatcagcgtcgaccccgcgcttcacacgtatgatatcgagag

SEQ ID NO: 696746 - DNA, 822 bp, Homo sapiens
ggtcgttcttctacaagcgggagaaggctgtcggggacaaggtgtattggacctgccgggaccacgcgctgcacggctgccgtgagccgggccatcacccaggacagcgggtgactgtgatgctgtgggcactgccaccagccctgatatggagggcctggaagccctggctggcagcatgtgagaagtgcctgtggagacgctgcatggctgggcatggacggccctgtggagccaagtggacacgcttgctccgaggctgtggatagttttgctctacctgcatgggggtcctgggtcccctgactctcaccaggcctcggcccagaaatgcgagcaaaggtcgaagaccaggaagctgccaacccaggccctgaggccccagacgagcaccaggacatggacgcagacccgggaggcctgagttcctgaagacgcccctggggggcagcttcctggtgtacgagtccttcctctacctgtccggcgacaagtgcggctggcgtgacgaaggtgtacttggacctgccgggcaccagtgccccgcattcgtgcctgccgccatcgccgtgcccagtctacccagggtccgatcgggttgactgtcatgcgtggtcactgtcagcctgccggactggggaggcctgcgggccctgaggccgtcgggagacacttccccaaatagcggcgcatccgggggaggcccaggaggccccgagctcttgaagatgccccctgtcgtgcctccatcctgctgtccgagtccttcctctacgcctggagacggggccggggacaaggtgcatggccctgcgggaccat

SEQ ID NO: 696747 - DNA, 949 bp, Homo sapiens
ctattgcatacacttattatcatctattgataaagctaattcattgtacttgttaatgcatgaatgttccatgcaggtaggagaataaagcagtagagttcggcttgttcaaatcttaaatcttaggctatattagctaaaacatgttaggatatgccgttcaccacttgtaaggacagttattgatagccattatgcttacctatggtatagcataatggtatctaaaggtacaacaaaccgcagattattatctatctagctagcaactgcacatcatgttacaagaaacactgtaaattaagctcctgacagaaccattctgtcctgcatcttagagtccaggtcatttaacatactgcgtgtagtgtaatattgcgtcgtcttagatgcaagcattacttaaagtattcccgtatatgcttccttggtcgtatcacagaggagacgtctccatgtcaatgggtccttcccacatagaaatgtatactggtacagcgctgcataaccatggatagcaatgtgaaaaggtatgcctacagagagcagaaaccggctgagcttacccccacccatcggatcctctgcttatactccacatgcaattggattaactggttagcacagattctgaggttatagaactgttgtttctatcaaaactcctggtagatgaccctggaaataatggagcaaagtaaaatgtttgagaagtcatgatacttcatcttgttttacaactatggggtccctcaggttacagcactgattggaagcagcttatgcaaagctataggaactgacttacaggggcgcaatgaaaaaagaaccagagctgggagatcaggcacgtcagagaaggaccagggaaagtaagccaaaaacaggaaggaacgaagcacaagaaaacaaaagagaaaagaaaggacaaggacgcacaaagacgagg

SEQ ID NO: 696748 - DNA, 197 bp, Homo sapiens
caagattttacttcaagaatagtcagttaaatagtacaaatttggattcatgatgaatgttaaaaagaattcaactaaaaaacccactttttcctgtgacccataatcccgcattttacagtgcatgggataaggggattagggggcattcaaaacaagtctcttccaaaaagaaatgatgtttatttcacatctcc

SEQ ID NO: 696749 - DNA, 296 bp, Homo sapiens
  misc_feature (30)..(30): n is a, c, g, or t
  misc_feature (32)..(32): n is a, c, g, or t
  misc_feature (206)..(206): n is a, c, g, or t
  misc_feature (266)..(266): n is a, c, g, or t
  misc_feature (274)..(274): n is a, c, g, or t
aggcccaaaacaaaaaatccttcccagggnanctttttggccttaaaagtttcccccattaaccattcccaaccaaaaaattttccttaaaaaccagggaagtcctttaatggtccccctgggaaagccaaaactaatggtttgggtaactaatgggttccctaaaatcctccatctctaccaaaaacttttccaggggttgtatncttttttccttttttcctccggtaaagaaggttgttttctttcaattaccttggaatttnaataagtnacagtcttatgattgctggcac

SEQ ID NO: 696750 - DNA, 360 bp, Homo sapiens
gtttgagattattataattatctgtacacacttgataaaagtaaatgcattacacagtttttgagtaattatacaaaagtaaacattttttgaaacatgagatctcagtaggatgtcaccccccacccccatctggatggataatactgtcagaataagacaagttcagtaccacttctactttttgtttttatgtacatgaattctgagaaactgtgttctcttaaatagtagttggagatggggttatttttaaaattttaaatttctattatagatgggatcttactatgttgcccagtcttatcttgagtcaaggagttcaaaaccagcccaggcagcatagtaagaccccatctc

SEQ ID NO: 696751 - DNA, 108 bp, Homo sapiens
gtgctctagaggtccctgagacgacttacctttaatagcggctgagcatcgggatgtctgatccacatcgaggtcgtaaaccctattgttgatatggactctagaata

SEQ ID NO: 696752 - DNA, 690 bp, Homo sapiens
  misc_feature (470)..(470): n is a, c, g, or t
caagggaaaagctttttggaaattccaaaaggaaaaatgtcaaaatttggtatgggggagccctttcaatttcaaaattttttaagcaataaagttgggtttgaggctcaaaaaccccaattagtttgggtgaaacattttttaaacagtcaaaaaggatttggtaaaaggattaagttgggaatgaacttatttcccaagagtccaccaaggacacgggatttaatcctcctattgcctgtgggaactaagggttttattaaaccaaaaagactttaaggtctgtccggggtttacgccaaaatgagccccatgtggtctagtccaagcactggcaagggttattgcttaaggcgttgaaaaaattgggtcgtggggcggtgcccctctgttaagcaagcccctgggtatacgctctcgtagaagtcatggaacagagtgtgatcggttaagcatcagatgtgtactcncaaagtccacgcagacaggttctgaccagcacgcccatatctatgtgtgtcccatgttacaccccttgttcacgtcagaacagtctgtcgctgacgcatagtaattctccctctgtacgatttgtccatcagccccccaatgatgtgtaggacgagagggaatacaatgggctcgtggtttgggtatataaatatagcacaaccccaataaaaaaaaaaa

SEQ ID NO: 696753 - DNA, 118 bp, Homo sapiens
tgctgtatagtcatgatatctagagtgcagcttacaaaccatcttttataaatgtcatcctcctgcattgttgatacactaacaaatgcttggtacagccatttaggtagggaccgag

SEQ ID NO: 696754 - DNA, 1308 bp, Homo sapiens
tggggaacatagcagaggaggttaaataggataagtcagctacatttgttaatggtgtatcaactgttatcattaatggtggtgatacatttagcggccctacgtggaaagggaagtaccagtcttggggcaaaacttaagagattcctggaggaacctacggcctgaaccttaaaaaaaaaatctctaagagaaccttacgaggtgcgtggcgtggctttaccattttcattttataatttatcaacagcggggaggtggcaagtggggctaagtgtgtggtcaagcgtggtattttataggaagttcttaccagagtggtggccacatcgagaaactcgggagtgtgaccattcgaggtggacctataagagagatgtgtagagcattgtgtggtggaaattactttatagtctccaaaagagcctttataaacaaaactattatagaaccatatattatttcatatatattgtttataaacagtgtgagatgtatagtggcatttaaaaaagtgtcgtggtggcacacaatataacaaaccagtggatgtggggcggataaacatgtttcttcacagagaaaaagaaaagaagaagagaaaacaacacaacaacaaaaaagagaggggcgaggcgcgcgcgcactactaagagagatagtatcacacgcaaggagggaggggcgccaacaagaagtataacaagcgcgagatcccccagagcgcattagtctgggtgacaaacagggggggcgccccccataataaaggcgagagagcgagagaaaatattatacaaacgaccgatgtgaagcacctacaggtaggacgccagagcgagttatataaacaaacaaacagagcagctcgcagagaacatcgcggcgggagaaacaacaccgacggccacaccaacggaggagcaaaacctactactagtgaggagaaaaaggagcgaacaccccattaatcaccacccacggcggggggggcaggtaacaacacaataatcagtgtgcgggccaaaaaaaaaattactacctccaaagcaagaaagataaaattatttataaggcagagccagccctaaatagagagggtgaaacaactatcattacaacaatttttataaagacggagcgtgtttataaagcaggtggtgtggtataaacacacaaaactaaagcaggagaaacatatatagtacgatgattaactggtaattataaaaaaaaattattgagggaacaacacatggaagagaattaatgtcatgatcgataagagaaaaaatatatgtatagcca

SEQ ID NO: 696755 - DNA, 217 bp, Homo sapiens
agctccaaaacaggcacgaggtagcttagaaagccccaggcactgtggccaggctcacattggccaagttatcatgtccattccgcaccaagctgcagaacaaggagcatgtgattgaggccctgcgctgggccaatgtacaagtttcctggccgccaaaagatccacatctcaaagaagtggggcttcaccaatgttcaagtgctgagtgaatttg

SEQ ID NO: 696756 - DNA, 269 bp, Homo sapiens
caccgtgctacgagacgccacactatcggacatcaaagctcctattcgcaagcacgaggcctttgagagcgacctggctgcgcaccaggaccgcgtggagcagatcgccgccattgcccaggagctcaacgagctggattactacgactcccacgatgtcaacacccggtgccagaagatctgtgaccagtgggacgccctcggctctctgacacatagtcgcagtgtagccctggagaaaacagagaagcagctggaggccatcgacc

SEQ ID NO: 696757 - DNA, 882 bp, Homo sapiens
  misc_feature (385)..(385): n is a, c, g, or t
  misc_feature (845)..(845): n is a, c, g, or t
ctcagaatacggaatctgccaatattgagcagttcttgcaagaaaggatcaaagtgaacggaaaagctgggataccttggtggaggggtggtgacaatcgaaaggagcaagagcaagatcaccgtgacatccgaggtgcctttctgcaaaaggtatgtgatatatctaaccacaaaatatttgaagaagaataatctacgtgactggatgcgcgtagttgctaacagcaaatatgagtactaagtagcttactttcagattaaccaggacgaataagaggaggaagacgaggattaaatttcatttatctgctaaattttgtatgagttcttgaataaaacttgggaaccaaagtggtggtttatccttgtatctctgtcgctgnggattggacagaaaattgggaaatcataggcaaagggctttcctttggttcgccactcatttattttgtaacttgaacttgtttatttttcttgcttaaaaatttcaattcttcgggtaataccacagcagaaagggaagggtgacgttacccgactggacatccatttgaggaggcatattgcgggtatgggaagtggaggcttgaaggtcttgacctgtatgatgttaacaattgcactgccatttgatccttctggtctcccactgatgctgggatacgcgtgttcttttttctcaaaaccaagaaatgcgacactcttttattattttttgtggaaacatatgtcattattggccagcctctgtgcattaaaaaacaaaagccacctagcgtaagagttggagtcgacgaacctccttctaggggggtattgatgatcctggacactgtaactcgncttcgtttttgaacgtttccgctccccccacagcgat

SEQ ID NO: 696758 - DNA, 336 bp, Homo sapiens
ttgaaagccaaaaatcttgtgtaaaataatagtatctccaaatggaaactggaagtcagcgtcatattcccatgttaaagacgaggaacgaagactgagaaaagttaaacgacttgtcaaagtttactcatgtagtgagtgaccgagccagaacttggtctctaggatttcaaactcaaagtctaatgttaactccatcactgttcctctcagttttctaatgccagtacatttccactccggagtccttcaagaccttctcatgccacatagctttgtttatttcagacatttttcaccccaaattctgagaacgtcattgaagcatatgagaaa

SEQ ID NO: 696759 - DNA, 2656 bp, Homo sapiens
agcatcgagtcggccttgttgcggaacggaaccactgggccgcagcgaccacaggggagttcttcgccggccgcaggttcaaagcgatctgcaatgagcgcctttaggaattcattcgaaggcgcaaaagaaaaagaaattaaggcaggaactgagcgaggaaggaagggagggaaagaaaggaagaaagagaaaaagagaaagaaacagaaagaacaggcaaaagctgaaagggtcatgggaggaggctgctggttccagtgaatggcgctgaccccactgagatcaacaccttgctggaggcctcaaacactgaaagaaagacatgcaaaggaaataattcaggaccaactggtgggctccaaaaatctcttctatgaggaaggtgaatgcaggctctgctacgtcctgcctgtgaaagaatcccttcaggaaaccagagcttccctcgtttaccttttctcctacaaagggaagcagcctggaagaaagagtccagtacttgacccatgcctcaacaaactctgctatcaatatggtgcagcttaccaaaggtcctagaactttgtcaacgcacttggagtaatttttatgaaatattgtgtgtgataagcaaactgtggaaatttatataagatgttggtggcatagagttatacgattgtgtattaagggtagttttaggatgtcatttttttttcagttcatcatgacagaagtccttttcatgagagaagtcacatgagaaaaaactttcttatattgtaagctccttctatagtggtatgtgcatttaatgacatccaactaaagatggtgtaataccacggtggtttgacttagagttttttaactttatatctggtttatctgggtattacatgcgttttaaatgtggatcttttcaacttacgatgagattatcaagacatagccccatgctaagtcatgagcatgtggacttataatggttcaatttagatttttcggctttaagataggattattggggcttacccccatcttaagtagagaaacatctgtattgtgtaatactatatgatgtacatttttctgttttcctattttcgtgcatgttgatgtaagcatggaaaaattttaggaaatgtatttattaggctgtttacatgggctgcctggtgcaaatcagcagtcaaaaatgactacatacacaactagcaatgggaggagaaatcctccctctgtgggaggcactgactacattccagttctccctcctacgcccagagactggaccagggtttgatgactggcaacttctcaaggggccggtctgtcttagttgatgattttagaggtatatagaggtatttatttacaaataaacaaatatttatttataagtagatgtttacatatgcccaggattttgaagagcctggtatctttgggaagccatgtgtctggtctgtcctgctgggacagtcatgggactgcatcttcgtccttgtccacagcagatgaggacagtgagaattaggttagatctgggactacaaatagcttctctttcaagtgccattacagctgaacattagtgaatcttgggccttctttgggctcagggcagagcaggtgtttatctgccccggcatctgctatggcatcaagagggaagagtggacggtgcctgggaatggtgtgaaatgattgctgactcaggagtggatgggcccctctcgcttctggtggtctgtgaccctgagcccctgagctgcattttacggtaaagattcctgagctgcagcatctgactcatctcagaaatatcaattcttaaacactgtgacaacaggacctagaatggctgacacattaaggctttgtccttgtgtcacgctctattattttatttaaaaacttcagtaatcattttagcctctttccagcaaactcttctccatagcagtccagtagtggtaggataaattatggatgtagtcgttcaagggattttggtcttttccatctcaagccatgtgttttgtcttgttccgggactggtttggctgggacaaagttagaattgcctgaagatttaggcacattcagtgttgtgtccatggagttttaggagggggtagcctttctggtctttgcacttccatcctctcccacttccatctggcgtcccatgcgttgtcccctgcacatctggaagacacaaggtgctgctgccacctggtctttgcttttgcagggccttctgtgcaggacacttggcctcaaagcccagagggagccagtccagccccagctcccttgtgccttccgtagaggccttccttgaagatgcatctagagtgtcagccttatcagtgtttgttaagcttattcttttaaagtaagcttcctgacaacatgaaattgttggggttttctggagttgtttggtttgtatgggatttgctttatccccaagccaaacagcacatgacacacgacagccacttaagacagtgtgtcactcgtggttagagtcctttgatgtttctgccctatggaccctatttgaagactatgttgtaatatcaaacaatacaaggaagcacgttatacagaaaatgctcatatgtttatgaattttgaccaaaataaatagaaatcttatatt

SEQ ID NO: 696760 - DNA, 724 bp, Homo sapiens
agcgggagttctcctcttctcttgttctatatccttgggagatgaccttttaaccacatggcagtactttctcttggtctctgctgtcacaatggctgctcaggttcagggttcaattcctggcttaggaaatgagtcctttctggtttgatatcagtgtgacatttgccattttttaattctcttcccctctaggaaccatctttggagtaatccttgcaaccggaatttggctcaaaacaggtttttcttagagcactaatcgacactttaacaaaaaattgtaaaggttataaaaattgtaagggttaaaaaaggtttatgagtatctcaccttatggtcaaacattaaatttgggtagacatgtcaatgagttttattaagaattggttttaacattaatagtacactaatgtaaaggtgaaatttggcttatttggtacaaaaatcatacaggaagcactgtcacatgtgaaatagtgtttggctttctttgggctatatttgtttaaatatgttgttggtatgtgttccaaaattacgtaaaactcctctaattctaataggacttagtgtatgttattcatacattgttacataaaatcatatgccagaaaggtaaccaaattttctttgtcaatcgtgtttttaactgtggctgccctaaaaagattttgtccattcacagaaaattgtcatgttggttgatcctcttcaaagatg

SEQ ID NO: 696761 - DNA, 579 bp, Homo sapiens
agcggggagggagcgactagacggacagtccggtgagggcggcgagaggaagcccgctacgagtgccctagctccccgccgctctcgatgaaccggacggaataagccgcgcctccagcaggggctgcgcctccatgaatccctagttgtttttttttttttctttctcttccccttcttccttcacccgcgcacgcgccgaggccccggtcgccgcctttctccgcttcgcgcaagaggcggccgcgtccagggtcgcggagtcgcataccgggagcgcaagggcggtccaaccccgaaacgggggagagattctggctcagcggaactggcaggcgggattcccgaaagtcttccgttgttctgagcaatgtgagtgctgttcaaacatttcagactttgcagatacaattggtgcagcagaaatgggatgatatcaaggatcgaattaagagagaaatagggaaagacctgaaaatcaaagaaggagctgaaaatctgaggaaagtcacgaacagataaaaaaagttgggcttatgtagacaacatttggaaaaaatcaattaaaaaattagaaga

SEQ ID NO: 696762 - DNA, 252 bp, Homo sapiens
gtgagactagatatctgtctctatgaggaggcccgcgccctttgttggctcagaggaagttctgaggccgtctcatccagtccaccatgttgggaggactttgttcaggaagaaatcccttctccacttaaatacaataattagccaggcttggtggcaggctcctgtaatcccagctattcgggaggctgaggctggagaatcacttgaaccccgtggggtggaggttgcagtgagttctccagcccagct

SEQ ID NO: 696763 - DNA, 142 bp, Homo sapiens
agtcatagaagtcggcgtaagagtgtttagattcaccccttcccaataaagctaaaactcactgtagttgtgaaaaactcccgttgacacaaaatagactacgaaagtgggtttaacattatcttgaacacacaatagctaa

SEQ ID NO: 696764 - DNA, 340 bp, Homo sapiens
acagcgttgctgtgtcatgggtctagcaaaatgcttgtaatggattatcttaatttagctttagtttgtgactttattattgttattgttattattattattattattagctatagggcattgttctgttgcccaggctggagtgcagtggcatgataatagctcactgtagccttaatctccagtgctcaaatggtcctcccactgcagcctcctgggtagctaggactaaaggcatgtaccaccatgcccagctaatttttaaaattttttgtagagatggggtatcactatattgcctaggttgatttcgaacccctggcctctagtgatcctcccg

SEQ ID NO: 696765 - DNA, 291 bp, Homo sapiens
ttctgcggctctccaagtggatagcatctctagatgatggcatggacttttcctgctattgcttcagaagaaatgtaaaaggggtccctctttccaaacatacactaaacattcagagttaagacagctgagaattgaaagggatatcttaatattggtgaaggtgaaggaatcgggattcttttgttaacaatcaacattgcagctatactaaaagatttcactatgacagacaaacacatgtagggcggatctcaagcattagaaacaaatggatgggggagagtggtt

SEQ ID NO: 696766 - DNA, 114 bp, Homo sapiens
gactttatccaaggaggaaaagaccaaaaaataaaacctccccctttgtttggacaaactggcctttgtgattacatagatcagccctttaaataaaacaagccttaatttgca

SEQ ID NO: 696767 - DNA, 130 bp, Homo sapiens
cgcgtgctcttaagaggcacacctgagctggtcacaggacttggagtgggagctgccacggtactgagctcagtgctgggggcctggcggtcgctccagcgcttgacaatggctgtgttcttcttggtcc

SEQ ID NO: 696768 - DNA, 696 bp, Homo sapiens
ggcggaactgttgctccgtgcgtgctgggacggcgtctgatggcggcctggacagtgccgagataggcggctgagctgggcatggagcaccagtgaggtggtgggcgcctgtgaagagccttcaggcgctgggcgatgtcatctgaggctgaacttcgggtaccaccaagcactggtgagcttactgcgagaggtgcgagggacatagccctgggaggcgcagacatagagcgccgtagtgtctcgacacatccccccagagggactggcccacagcgagcttattgcgactgcccaagtggacaacagtgtggcttcagcaaggccatgtcaacaagtggattcgtggtggacaagagtgcaggtgacgggccccgggattgttccgagtggtgcgacaagcatggacgatgaggtgcgcgcggccgtgcctccaggcctggtcctggggcccggacaggcctgcagacagctgcggccgcacaaggaccacggaaccgcacccttcagcgacaggacggcagcctgctgggctccaagtgactcctgccaccaccctcactgtccgcacaaccggccagctgccctttcgctccccaggcaatctcccgcagccacgcagacccgagcctgatcccacagatgatataccactggcctctgggcgcgcacccgtccttaagccctaacgcttct

SEQ ID NO: 696769 - DNA, 294 bp, Homo sapiens
tccccttaaacccacgatcactaaacatactactactcactctcactgcccatagtaactatcaaactcccgagccaacaacttaatagtgactagcttacacatagcttttactgtagatgataccttctttactggactccactttatgactccctcagatgcccatgtcgtaagcccccatcgcatgggtcaatagatacttagccgcaattaatctataaaactacggcagctaatagataataatacgcctaattttacaccactccacgataatcgtggggtatgtaa

SEQ ID NO: 696770 - DNA, 631 bp, Homo sapiens
acataaggctaagtacgaggctcggtgttaatcggacgaggccaagagcgtggtgcaacagtaccttggacgttgaagggataccctgtatcatgcctgccatactggtgtgcctgggcttccacctgtgccgctggtgtgctactcctccaccgcatatcaccctgccaggtggtggagaacatgaccagtggcccacttccccctgtgactgtccaatggaacgacctggactacatggactccctgtgagaggacttcacgttcaacaaggatggcttcctgtggacttccctgtgccatggtgcagtgagctgcaccagtggctgtgccaggcgctacatgatgatctgtggatcctgccatcagcagctctgtgtgccctgccgggatgctactatgtgccctacgactgatgtgtgtctgcgtgattgtgtgtgtgtttatcatcaccaaacgagaccggccagcctgcatgattgtggaagtgtatttgccctgggtccaactgcacttccccgacttcaccaacacccacagcccctggacctgagtgaggagtgacatggtggcttgagtatccatgaccatggtgcccattcagacagagcatgtggatagacatgaacga

SEQ ID NO: 696771 - DNA, 136 bp, Homo sapiens
tggcagcataggcttcttacgccgcacaatccagaagaaccgtccatcccacctattcctgtcacaatatgacagctgtcgtgtgatcacttgacaagatcacccgcaagtcatgtgccacgctgtgcctgcttca

SEQ ID NO: 696772 - DNA, 947 bp, Homo sapiens
tacggagttttgcccccaacacctggggccaccccttgtgtgccccccgggggtgtttcccccaccggggatttttggctcccgttgggtggccgttttttcgacgcagcctcgtggtggtggcggacacccgtgctcccttaagagcgggcaagacaggtttcttgcacatgtcgctgccgccaagccccttccccgtgagggtggggccccctgtccccgtctggcaaggtgtgtcgggccccctcccgcggtgggctgggccctttctgcgccgccccccggtcgggggatcattcttccacccgctaacccttgggtagtggtggcccgcccacattttttggctgccctcaccattcccgccgggggtgcaggccctgccctgcctcgtgtttcggtgctttgatcgaaagcgtgcggctatacacgagcttctttctctgttagaccccctcggcccggcccagcgcccccgcctcgagcgtggggtgaggcgcaccctggcaccccctctcgggaggaattggtggactccgctccctcctccccccctattgcacgtgacaggcacggtcttgccgccctcctcgcctcgcctcggggtggtctattttcttttcccggcatcccggatggagagacagtcgccaccacactttttgcatggtgtcccatcgtcccgcaaccttgcgtgtggcccgctcgctcctggtcccgctccacgcgtcggggatgtggcgatggtatctattttggaccctgttgcagctgtgcaccacccaggcccccctggtccgcacctacctttcgcgccgtataagaccccactatggcgcaccccccatcaaaagctctacgagcatactacaacgactttcccgctcaataaggatggcacccggtcccaaagataacaaaaagtattcacccccgcccacaaaaca

SEQ ID NO: 696773 - DNA, 120 bp, Homo sapiens
ctaatgagctcgtaccgtctgagcagctgggaacacaagtggggtttgtacaagtccagacgcatgttttggaaaccagtgggttcaaagcgtttctgaagtgttgtggtggatccttgg

SEQ ID NO: 696774 - DNA, 331 bp, Homo sapiens
ggagacaaagtctcgacccatcccccaagctggagtgcagtggcacgatctcggctcactgcaacctccacctcctgggttcaagcgattctcctgcctcagcctcccaagtagctgggattacaggcacccgccaccacgcccggctaattttgtatttttagtagagacggggtctcaccacgttagccaggctggtttcgaactcctgacctcgggtgatccacctacctcggcctcccaaagtgctgggattacaggcgtgaaccaccgcacccggcctgttatggactactatgacaaaattttttaaattgaggacacactgcca

SEQ ID NO: 696775 - DNA, 493 bp, Homo sapiens
  misc_feature (42)..(42): n is a, c, g, or t
  misc_feature (53)..(53): n is a, c, g, or t
  misc_feature (88)..(88): n is a, c, g, or t
  misc_feature (94)..(94): n is a, c, g, or t
  misc_feature (108)..(108): n is a, c, g, or t
  misc_feature (132)..(132): n is a, c, g, or t
  misc_feature (174)..(174): n is a, c, g, or t
  misc_feature (209)..(209): n is a, c, g, or t
  misc_feature (217)..(217): n is a, c, g, or t
ggtaccttcctgtgtagaggagtggttccccaaaagttgacncaggagtggangctggcagccccagaccagaagctattgaatttanccaagnggaatttaaatagncaaatcccagtttcagagatgagncatattgggatcccagataaattctgaagttggagaccaatnggatttcccactggattagctatttttgccgtaanaggaaagncaagttaaaatgatccccaatatcccaatatattaatatctagctttaccaatgagagaggtgaaattactattaaatgatatgtggaaatggaatagcaagtttggggtcaggagtggaaatcagtattgattttggacatgttaatttttatatgagtattaaatatcatatgggctggacacttaaatctgaataagagcatcagttcagctacaaagaggaacagagagatgggctatagctggagggagaaataaggtcaagagaaaattt

SEQ ID NO: 696776 - DNA, 81 bp, Homo sapiens
gtagccaatagcctaaaatgaaattttaattttgcttgttcacataattttgggttttttttccccttctgtcgtcttctc

SEQ ID NO: 696777 - DNA, 495 bp, Homo sapiens
gaagcgaggtgacgacaagccctgtggagcgtccctggcagaggactccggccagcggagtgacgcaatccaaagagcgctcccgggtaggaaagggccccgggggaatgccttgccagagcagcgcatagcaggctcccgagaaggattaacactggctgaacaccgggaaggaactggcacttgaagtccagacatctgaagcttgtcaagactagtcttgggaacttgccccactccatgtgagtggaagcatggcctgatcacccacggtgtgcctgtatggacatcttggttctggtttggactgggcttgactgggtaagactagtcttgggaacttgccccactccacgtgagtggaagcgtggcctgatcacccacggtgtgcctgtatgggcactttggttcgggttaggactgggctcgacttggtaagactagtcttcggaacttgccccagtccatctgagtggaaacgtggcctgatcacca

SEQ ID NO: 696778 - DNA, 724 bp, Homo sapiens
  misc_feature (85)..(85): n is a, c, g, or t
  misc_feature (87)..(87): n is a, c, g, or t
  misc_feature (91)..(91): n is a, c, g, or t
  misc_feature (107)..(107): n is a, c, g, or t
  misc_feature (109)..(109): n is a, c, g, or t
  misc_feature (114)..(114): n is a, c, g, or t
  misc_feature (118)..(118): n is a, c, g, or t
ggcagtgagttcgacacaccatgccgactgtcagcgtgaagcgtgatctgctcttccaagccctgggccgcacctacactgacgnangaantttgatgaactatgtntntgaantttnggtctggagcttgatgaaacttaccactctgagaacggaaactaataaagtacaacgacaccaggtaatgtaaacggcagcaggagcctctgatgttgtatctttaccaacacattgaccgtcccgtgccaatacgatattgatctccttgtggtcttggacagggaatctgggtctcagacgggactttccaagcgttcctttccaacagaccgaacacagggaattaatacggcatcccagtttgttacttaaacacagggggtaaaatggccctggattgggacacaaaattcccaaggcacaaatcttcgacctctcacttcccacgagaaaacaaggtaagctcacccagcccttcataggactttaccggtaccccttctttggggccggggctacgaaccaggtccacggttccgtcgcggttaaaataattaagacaggcttttttaacccgttcacaaatatggggaaatttccagggaacttactttggccacccatgggcctttttccaaattttttgcaacaccccctttccaagtcggcagtcaacacattttaaccctttccaaggaacaagtaacttttggccagggacaa

SEQ ID NO: 696779 - DNA, 635 bp, Homo sapiens
  misc_feature (85)..(85): n is a, c, g, or t
  misc_feature (87)..(87): n is a, c, g, or t
  misc_feature (91)..(91): n is a, c, g, or t
  misc_feature (107)..(107): n is a, c, g, or t
  misc_feature (109)..(109): n is a, c, g, or t
  misc_feature (114)..(114): n is a, c, g, or t
  misc_feature (118)..(118): n is a, c, g, or t
ggcagtgagttcgacacaccatgccgactgtcagcgtgaagcgtgatctgctcttccaagccctgggccgcacctacactgacgnangaantttgatgaactatgtntntgaantttnggtctggagcttgatgaaattaaagacctagagcttttatgtccaaggtgcagttcgtccactgatcaccagcatcgctgatgtttggcccactaaagcaaggctgcctcctatcacggaaaaaactggatgcaatacaatgcaccgtggaaggagagagtgcgaactacattgacaaacgtcataactatacaaaccagacaaatcactggaactggcagaaacaagacatctgagcaaggaactagctaagtaccagaacaaggctaacgtacacaggcagcaggagcctctgatgttgtaacttgtacaaacattgaccgtcctctgccgcaatagactactgactctcctgtgctctggaacggattggcttcgaggacttcaggtcttcaacagataggatcccaggctccagtgtataaacgggtaatgcctgatgggaacaatccagaaattgattatcacagaagagacagctaagatacgtcctttcgcggtagcagcagatctccgg

SEQ ID NO: 696780 - DNA, 402 bp, Homo sapiens
agacattcacattaaacccacatttgactctaacgctagatacaaggcagaaagttcaacatacactcaatgactcaagtccacaaatcaaatactacaatgttaaggcagcacagctaccagtgatagcaacgctaaccaaaaggtaatgaacatttagtcacttgccagacctttagtaacaacagtgtagtacatttccactaagacaataagctacacggataatttactgctgtgacaaggctacctctgtggcaaaaaacaccacaaatattccagtgtgacagtcagtccatggtgatataaatctatatctgcatacttacacaatttacactgcacacatcgtatacaggggacaattcaactgagagggttaatttaaatgaccatacaaaa

SEQ ID NO: 696781 - DNA, 450 bp, Homo sapiens
aagagttgtaccagtaaggctggatcttcagagaaagactatgaaatgcttttcaaatctatgaatggaatgctttccctggaggaagtgttgcctcagacgctcagattatgctaaagtggcaaaatattttataacttgtccatacagagttttgatgatggagactattttcctgtgtgggggcacatgccttggatttgaagagctttcactgctgattagtggaagagtgcttattaactgccacagatctggtgacgggcaatgcccgctgaacttcactggaggtcaattgcacagagaatgtccagaatttcctactgagtggtgctggcattaagcagaaaacctttactgccaatttccataagtgagcctctccgtgaagaattttcaatgatgaaaagttaaagaagtttttcaatgtctaactaccaatacagatgg

SEQ ID NO: 696782 - DNA, 114 bp, Homo sapiens
ttcattgagtcctgacccccatctccctaggggcctgtgaaaggagagggaagggtttgttttgctcagctccatgtcccccattttcctccccaataaactggggctgggcta

SEQ ID NO: 696783 - DNA, 170 bp, Homo sapiens
tagagcggctgcgattgtcactattatcaagcctagttggcttgaagttgagaaggctacgatttttttgatatcattttgtgtgattgcacatagtgctgtaaattaaggtggtgatagctccataggcattagtgttatatgtttgaacatagttgtgttagtttctc

SEQ ID NO: 696784 - DNA, 1677 bp, Homo sapiens
  misc_feature (1275)..(1275): n is a, c, g, or t
  misc_feature (1287)..(1287): n is a, c, g, or t
  misc_feature (1319)..(1319): n is a, c, g, or t
  misc_feature (1322)..(1322): n is a, c, g, or t
  misc_feature (1342)..(1342): n is a, c, g, or t
  misc_feature (1355)..(1355): n is a, c, g, or t
  misc_feature (1364)..(1364): n is a, c, g, or t
  misc_feature (1367)..(1367): n is a, c, g, or t
  misc_feature (1372)..(1372): n is a, c, g, or t
  misc_feature (1382)..(1382): n is a, c, g, or t
  misc_feature (1384)..(1386): n is a, c, g, or t
  misc_feature (1604)..(1604): n is a, c, g, or t
  misc_feature (1632)..(1632): n is a, c, g, or t
cagtagttgtggtgtgggtgtatagtggtcgtatgcctgaggacacccgcctctttgtgtgagcccctctcatttgcccgtgggcatttttgcgacgaacgatgtgtggtgtgctgcccactgctggggtgttgggggtgttcactgccccctatggtggtccgacccccccccccgaccggggggccctttgtttgaggtccccaaatggttatggtgggcccaccatccgtctccgccccatcggagtgttataattttccccggtgtggtacttctaagggagagaagttggtccctaaatttaatattgatgccccaacgcgccccagcgtgggggccccgaacacgaaaaaaaagaagggcttggtggaaggaggggtgaacaccacttgcccggaagggaggtttttaatccttttaaccacccaggagagaatgtgggtggcccccttctataaacttgggggccacaatttagagaagaaatttccttcggggtgtaaccacgaagaagtggttttgtgttgggagaaggaaaacggagatcgccgccgccccctgtgtggggtgggttttgtgttgggtggggcggcacacaccaccaacagaagaggtggggtattaatattaacaagggggatcctccgggagaaaaaggtggaaagagcgccgcagaaagtcccccacgtctggtgttcttttcccccctccgcgcgataggagaggagattttctcgtcccaacggtgtgagacttaagaccggagccaccttgtgtggcttgcgccccaccacaaagaggtatatatacttgatcacacacaccgtcgtgttgtaggaagaaagcccgccccttctttcccctctcttggggggctcttgttctatagggagaagcgctctcactctggggagagacaccccctgatagactcgtgggagagatatgtggtttttgccacacatcggcctcgggctctcttctgccccgcgcacacacacgcagaagtgtgtgttctcactcggagaccccacgcgctcttgggggcacagcgcacacacacgtattatgagcggcgccccgagctctttatagagagagttttgtcgctcacaagagcacacactgcgctctctctcccgggagatagagaggagatgagatgagcccctgttgtgagagagaatgagaagcgcttggagggccccacacgcgcgctccaagagaagttctctataggtgttatatatatgcgccacgcgctgtgtctcnctggtgagatgntctcacacgcgggtcgccacgcgcggtgtgtntgnccccaccctccaattatatntatatctctagcnctatacgcnggncacanaatgtggcgntnnnaatcttgtgtgggagatgctctgtaagaggagaatggagatgggcttctgggagatgaatagtggccagagtttaaacaaataaacattccattggtttggcgaccctgccataatttagactgttttgggacacacccagagttggattcccttggagatttctcaaataataagactgctgccagtccacatccaccataattccgtggtgaaatnttgtttgttactgtccattccccttccntttcgtttagaatccagaataaagttgtatttccaaaaaatcgta

SEQ ID NO: 696785 - DNA, 368 bp, Homo sapiens
aagctagtagtcttatgttttttaatgacacagagtctcgactctgtcacccaggctgaaatgcagtggcacaatctccacagtcttggtcactgcaacctctgcctcctgggttcgagcggttctcctgcctcagcctcccgtgtagctggaaattcaggcgcctgccaccatgcccagctcatttttgtatttttaatagaggcagggtttcactatattggccaggctggtctcgaactcctgacctcatgatccgcctgcctctgcctcccaaagtgtagggattacaggcatgagccaccgaacccagcccaaagttaagcattttttaaccacaaggtgagaggtggaagtatctcgttgag

SEQ ID NO: 696786 - DNA, 407 bp, Homo sapiens
agcatgatgcgcgaaaacatccagcgacccaagatcgcgtggtcaatcacaggtgaacgatactgtgcagatgattaagggacaggcaagataatccactttatcaaatatgatacaggcaatttgtgtatggtgattggtggagccaacctcggtcgtgttggtgtgatcaccaacagggaaagacatcctggttcttttgatgtggtgcatgtgaaggatgccaatggcaacagctttgccacgaggctttccaacatttttgtcattggcaatggcaataaaccttggatttccctgcccaggtgaaagggcattcgacttactgttgctgaagagcgagataagaggctggccaccaaacagagcagtggctaaattgcagtagcagcatatcttttatactt

SEQ ID NO: 696787 - DNA, 508 bp, Homo sapiens
  misc_feature (240)..(240): n is a, c, g, or t
  misc_feature (506)..(506): n is a, c, g, or t
  misc_feature (508)..(508): n is a, c, g, or t
ccaacatggtgaaatcccatctctactaaatatacaaaaaaaattagctggacgtggtggcacaggcctctaatcccagctactggggaggcccaggcaggaggatcacttgaacctgggaggtggaggctgcagcgagccaagattgcaccactgcactctggcctgggcaacagagtgagagtccatctgaaaaaaaagaagcactccagtctggtcaacagagcgagactccatctnagaaaaaaaaaaaaaaaaaaaaaagaccaggttggccgacatggtgaaaccccgtctctactaaatacacaaaaaaaattagctgggcatggtggcacacgcctgtaatcccagctactcgagaggcccaggcaggaggatcgcttgaacctgggaggtggaggctgcagcgagccaagactgcaccactgcactccggcctgtgcaacaaagtgagactccatctgaaagaagcactccagcctgggcaatatagcggactcctntn

SEQ ID NO: 696788 - DNA, 1195 bp, Homo sapiens
  misc_feature (692)..(692): n is a, c, g, or t
acatcaaaacccacctcaggtattgcatcatcagggaagactgcttctcttaagaatccttaacccctacatatacataagatgtattataatcaagttagcttgtctttcactcccactagactgtgactccttgaggacaaaattggattccttttcagccatatatctctagaatctagcattgtgtttgccccataatagactttagtaaatatttattgaatgaacgaatgacatcatctattctaattcactcatttactgataaaggaatttgcggagttgcctttggaagtccaaaaggaaagaatattttcagaggaaaaaatgaaatggttcagtcactcttttttttcatttaagttaactttattaagtataatttatgtacaataaagttatatgtatattttatgtaaaataaaatgcattttaagtgtacagttctataagtcttaacaaatgtatatacccatgtcaccaccaccacatcaagatatagaacatttccatctcccaaaatagttccttttgtgcccctccccatccaatcccccatacacgcattcactccaaccactcatctgcttctgtccctaaagattagattcatcttttctagagtttcacgtaaatggaatcatccatatgtacttttttgtgtctggcttcttttgcttagcatgttntgagattcatccatattatgtgatagtagttcattcctttttactactgctaggatttcatgtatgagtatttcacaatttttttatttaccattgttaatgtacattcatgttgttttcagtttgggtgtattatggatacagctactataaacatttgtgcacaagccttcatgtggacatatatctttaattgatctggggtacataccttaggaagtaggattccgggtaatggtgtaagcaacgtgtaaaacttagaaggaaggactccaaactcttctgaaggttggttcataacgttaaggttgccacaacaaagatatgagttccagggtttcccactcttataacaaactggggttgaccataagcatccaaataggggaaacatggtattcccaaaaggatggcaattttcaacaaatgcacaaataaaagtgcggaaagataggcacaatggccataacaaaaatgtaaaaagcaggagaggacaacggtaa

SEQ ID NO: 696789 - DNA, 361 bp, Homo sapiens
tgtgctacacgagcagagcggtctcaaacaccacagatataagaacaaagcaaacagaaaataatttccagaggccgaggtagggcggatcacctagaggtcaggagtacaaaaccagcctggccaacatggcgaaaccccgtgtctactaaatatacaaaaattagctgggcatggtggtgtgcacctagtaatcccagctactcaggaggactagaggaaggagaatcgcttgaacctggtagtcagcggctgcagtgagctgagaacatgccactgcattccagccttggcaccaaaatgagtgaacatccatttcaaaaaataaaaaatgtacctgagaacattactaaactcccag

SEQ ID NO: 696790 - DNA, 94 bp, Homo sapiens
ttcttgaaaaatttttgtttaaaaaattgaaggttcttttcaaatgggaaactgggggctataaacaatggaaaaaaagcccccgtttttttta

SEQ ID NO: 696791 - DNA, 190 bp, Homo sapiens
cgccgcccgcccgttgttaccggtattgtaagaacaagcgtaccaaagtctcgcttctgccgaggtgtcctgatgcaagattcgcattttgacctgggcggaaaaggcaaagtggatgagtttcgctttgtggccacatggtgtcagatgaatttgagcagctttctttgagcctggagcttcccgattt

SEQ ID NO: 696792 - DNA, 126 bp, Homo sapiens
ctcatagctagtccaaagcatcattttgtgtctgacgtgaatgatgccaaaatcctcaatgacgtccaggcactggtttgaagttaatgtggcagaccttccagaggaaatcgacatctccagtcg

SEQ ID NO: 696793 - DNA, 856 bp, Homo sapiens
  misc_feature (39)..(39): n is a, c, g, or t
  misc_feature (85)..(86): n is a, c, g, or t
  misc_feature (93)..(96): n is a, c, g, or t
  misc_feature (120)..(121): n is a, c, g, or t
  misc_feature (131)..(134): n is a, c, g, or t
  misc_feature (153)..(153): n is a, c, g, or t
  misc_feature (160)..(161): n is a, c, g, or t
  misc_feature (167)..(168): n is a, c, g, or t
  misc_feature (170)..(170): n is a, c, g, or t
  misc_feature (175)..(175): n is a, c, g, or t
  misc_feature (177)..(177): n is a, c, g, or t
  misc_feature (184)..(184): n is a, c, g, or t
  misc_feature (186)..(186): n is a, c, g, or t
  misc_feature (188)..(188): n is a, c, g, or t
  misc_feature (195)..(195): n is a, c, g, or t
  misc_feature (198)..(198): n is a, c, g, or t
  misc_feature (201)..(203): n is a, c, g, or t
  misc_feature (209)..(209): n is a, c, g, or t
  misc_feature (244)..(244): n is a, c, g, or t
  misc_feature (248)..(248): n is a, c, g, or t
  misc_feature (259)..(259): n is a, c, g, or t
  misc_feature (264)..(264): n is a, c, g, or t
  misc_feature (267)..(267): n is a, c, g, or t
  misc_feature (274)..(274): n is a, c, g, or t
  misc_feature (277)..(277): n is a, c, g, or t
  misc_feature (288)..(288): n is a, c, g, or t
  misc_feature (303)..(305): n is a, c, g, or t
  misc_feature (309)..(311): n is a, c, g, or t
  misc_feature (313)..(314): n is a, c, g, or t
  misc_feature (316)..(316): n is a, c, g, or t
  misc_feature (325)..(325): n is a, c, g, or t
  misc_feature (327)..(327): n is a, c, g, or t
  misc_feature (333)..(333): n is a, c, g, or t
  misc_feature (335)..(335): n is a, c, g, or t
  misc_feature (374)..(374): n is a, c, g, or t
  misc_feature (377)..(377): n is a, c, g, or t
  misc_feature (381)..(381): n is a, c, g, or t
  misc_feature (386)..(386): n is a, c, g, or t
  misc_feature (391)..(391): n is a, c, g, or t
  misc_feature (399)..(399): n is a, c, g, or t
  misc_feature (409)..(410): n is a, c, g, or t
  misc_feature (419)..(419): n is a, c, g, or t
  misc_feature (433)..(433): n is a, c, g, or t
  misc_feature (441)..(441): n is a, c, g, or t
  misc_feature (449)..(449): n is a, c, g, or t
  misc_feature (456)..(456): n is a, c, g, or t
  misc_feature (514)..(514): n is a, c, g, or t
  misc_feature (580)..(580): n is a, c, g, or t
  misc_feature (592)..(592): n is a, c, g, or t
  misc_feature (610)..(610): n is a, c, g, or t
  misc_feature (620)..(620): n is a, c, g, or t
  misc_feature (640)..(640): n is a, c, g, or t
  misc_feature (643)..(643): n is a, c, g, or t
  misc_feature (652)..(653): n is a, c, g, or t
  misc_feature (667)..(667): n is a, c, g, or t
  misc_feature (672)..(672): n is a, c, g, or t
  misc_feature (704)..(705): n is a, c, g, or t
  misc_feature (713)..(713): n is a, c, g, or t
  misc_feature (720)..(721): n is a, c, g, or t
  misc_feature (727)..(727): n is a, c, g, or t
  misc_feature (731)..(731): n is a, c, g, or t
  misc_feature (739)..(739): n is a, c, g, or t
  misc_feature (760)..(760): n is a, c, g, or t
  misc_feature (847)..(847): n is a, c, g, or t
aacatgacaaggccaaacaaaggatgcccatttgcaatngaggatgatgaccactgcaaggaggaatgctgctgaaagcgatgcnngcacatnnnngccatgcttctgaaaacaaggcanngacaaacttnnnnctgacaaaaaccagacagngaataannaggcgnngnaggcntnaccatcncnanggcaacnacncannncaaagnagcgacagataatatataaacagatgagtatagcnagtnccaataaagcnttatntgngaatgcnganaattttcacgncatgaaatattaggnnntgannncnntncccaaccantnaaaaangnggaaaccattctgagcggacaggggagagaaaaacaggnagnaggnggganttggnccacatgngggagattgnnaacccatgngacaaaatataccntaaaagcntgtgaccncaaaagntcaaagcactgcgtcccaaagacttaaagtgagttagtcaaagcttcctcagtaacgncgttgttagatcagcggggttccagtttggactctggtctttatcaagtaaaacagcgctaacgcnttcatgaaagtnatgaccgctcagacaagngtgagttagncgatactccatagtgaggangtngtgcaaggnngttgaagatccctncatgngttgccttagtgtgattttttgagatggtggnnatattttnttttttnncttcanttgntctagggnaaaagatgaaccatcttgctnttagttttcaataatttcttccacagttttggctgaaaaacaactgtttattttgttcatgtgttcctcaagtataaaagacttgtntcgatcaat

SEQ ID NO: 696794 - DNA, 816 bp, Homo sapiens
ggccgaatgggcagatcacttgaggtcaggagttgagaccagcctcgccaacatggtgagaccctgtctctactaaaacgataaaaaaaaaaaaaaatttagccaggctggtggtgggcccaccgccttggttaatcccaagctaactcaagatgggctggaggcaggagaactcacttggaacctggggaggtcaaagctggcagtcaagccgaagatcttggccattggttactccaagcctgaagagcgagaactctggtctccaatcaatcatcaatcaatcagttacttatttcaattggcacactatgaatgtgggaacgccattttctggtgtcactctctttagggggctaaatctttaatatttggggtttctctcccctgtgcgtttcatatttaagcttatggatctaaatatatattgggatatataatatttagggaatagcttaattaaagaactcacagacttggacaaatggggtaacctaagactttttaattactagattcttcaaattgaggcttaagtgcgtgtagcagtgccaattccaattcccatgattggtgtttttatacactagtggaaatacaaccgtggtaggtataagtggtcctggagggggtgatctacttagtgtaacttgtgtccaatttttaaggttcaagtgaaaccactgtttagggtacgtgaaggggtaattagtaccaataggtgaattatttcgggtcttgcctaaggtaaatttaatatatcttcaatattagaataggggtaaattatttcattcaaggttaatgtgtgattta

SEQ ID NO: 696795 - DNA, 362 bp, Homo sapiens
  misc_feature (12)..(12): n is a, c, g, or t
  misc_feature (219)..(219): n is a, c, g, or t
  misc_feature (259)..(259): n is a, c, g, or t
  misc_feature (279)..(279): n is a, c, g, or t
  misc_feature (338)..(338): n is a, c, g, or t
  misc_feature (348)..(348): n is a, c, g, or t
ctcacacctgtnagcccagcactttgggaggctgaagcaggaggattacttgaggctaggagtttgagacaacaatctagcaagaccccatccctacaaaaaatataaaaaattagcctggcatggtggcacaagcctgtagtcctaggtggttgggaggctgaggtgggaggattgcttgagctgaggaattcaaagttacagtgagctatgattgtnccactgccctccaccctgggtgacagagtgaggccctttntccattaaaaaaaaaaaagntactagaggtaatatctttcgcttaatccatacattatttgagtatcttactggttgtnaagaattttntgatacaacttttt

SEQ ID NO: 696796 - DNA, 511 bp, Homo sapiens
  misc_feature (2)..(2): n is a, c, g, or t
  misc_feature (511)..(511): n is a, c, g, or t
anagcccacccgggcaacatagtgagacccccatctctaaaaaatttaaaaattagcccaagtgtggtggcatgcacctgtagttcccagccacccagctgaggtgggaggatcacttgaaccccagaagttgggaggatacagtgagctttgatccaattggtgccactgcattccagcttggacaatagagcaagactctgtctctaaacaaattaattaaatttaaaaattaaaaaaataagagctagcctgcactgctccttcaaagcagaagctttacacatgaatttctggaattagcatatagcatagattcagtctatacttaaggaattgtagaatattattgattacatttaaatgaccttaaatttgtatttgattgaaaacagaaatcaaaacaggtgtggcagctcatgcctgtaatcccaacactgtggaaagccaaggcgagaggatcacttaagcccaggagttccaagaccagccttggcaacatagggagacn

SEQ ID NO: 696797 - DNA, 941 bp, Homo sapiens
agcgggcagtcaccgcggacgccaatcttgtgcatggagtcgccatttggctcctagagaggccgacagaatgacccggcgctttcttccttctgcagctgagtgctgcggcggggccgaggctggggtcggggccaggaggaattgtgttgtcagagaataacaacggaggttgtccataattgacctttaagcagcaatcagtaaaacattgagctcttcagctccgccttatcttgctctggaaaagtttggaaaagaccaacgaaggtctctgatgtatccgtagtgacgccacctgaattagaaaccaagatgaaccataaccagaaggtggtctggtgtcgtactcagcacaactcgaatccatcatgtatggacgctatcaaacgaaaattgcatgagcgagtaggggtggcgatgggccacagtgccaggttgtaccaggaacctaacagagaaacgcagagtacaaattcaagagtctgtgaggggacacaccgcatgtccatcatccaagatgttcgaaggacgtgaacaaccacatcatggagctacctgatccatgggtgtatgcattgtaaagacctctatgtgccaagaagcatcattggcgtgatagcctaattgccttacagcaagcagtgcacaaatgagcacaccaagaggctccaatggtctctaaactgcttggtaccagtgattgtgccacagctgcgactaaatcactcgttaatataccacattgggactttaccacccgcaacgggacaatctccaggggcgttccgtccacgacattccctggtcgaccacagttaacagacgccacatctaccatagcttattagccaggcaccattccccagccacacgctcccagaaattagcgcgaaaaggcggtaatccagtgagccaggtcgccgccctcgaggcatcag

SEQ ID NO: 696798 - DNA, 1460 bp, Homo sapiens
  misc_feature (909)..(909): n is a, c, g, or t
ctctagtacctgtgctagggaccagtcgtcgtgccgtaagtataagaaccctgtgtgtgcacgtgggggtatacacacagtagtgtccgaaatagaccaaccagggggatggggcccggctgggatcgtcttaataaggggtgacctatatcaccacgtctcctggtgtaatgcacccctcttgtcgcgccaggaaatatttgctcggcgaaactacttctttggtgtggtgagacaccgctttaaaaatggtgtgtgatcgtacttactttggggacagagaaagtcctgtcggccacgcgcaaatattattttactatggatcggatctctttccggcgacgttaatggggtgcccacactctaaaatgttccgcggcccccattgggggagaaaaccacagcgatttttttgcggaatgaataatcgccacaattggggctctgttgccccacagtctatcgtgtttttggccttttctttaaagaacgggattaattttgtgtttttgggcttttatagagtggcgtctcccccatgggagtatagcggtatagtttgtgtaaagtgccgctgctatattcctccggagcgcccagaaaatggcccacaaaagggtatgtttttcgtgcacccctggggaattttggggttgcctacgaattgggagctcacaagactcttgcccacggtgttaaatatttctccggctccacttcgctggttctcccgccgctctgtttctacactttccgcgcactcggggcgctcgtgaaaagaggatattggataataaaagggagaaaatataatgaattgggagaaactcgcggttccgagacatgtgtttctcttcttaaagaacattcctctgggtctcgctgaaatgagcacacgagggttatatntaggtggaatttcactgggaggaaatagaatagccacaggaattgtccctcttggcctcggagtgagaaaatgttgttctccctctttctcacaaatttcttctgcccgcagttttgggagaaaagtgcacaaactctgagctcgttaacccccgagggagaattggtgagaaaaattaactctttaacgcccttggcacagcctcgtggagaacttcggttcttaacacgcctctctcgcttctttctggcccacaacacgggcccacacgcacgttttggagtctcacacgagaattgcacacaaaatcggagaaaaaattatatgaaaaaggcacatctgagtaaaatgtggagcggcgtcccacaatcactgtccctttatgagaaatcttttctattgtagaaaaggaggagactaaaattgtataatgtgagattcaccacaatgtacacacaataatataaaaataagtttttaaataattatataacaagtaagatactcctgctgctttactattgtataatatagtagtttttaagttcca

SEQ ID NO: 696799 - DNA, 571 bp, Homo sapiens
  misc_feature (571)..(571): n is a, c, g, or t
tgagctcggtaccctactggcttggagcatcactgcttttgtgggatgcactgactgcagtctgactgttctcctagtggaaaggggagcaatagcttctgtctgcatgtgcatgaaacagatggaaatttagaagagattctagtgcagacaacttcatcccacccccgctgcccacagagctagccatgtgcacggtgtgtttgaacaatgttatgttgctgctgtgcacagagatccccagtctcataaaacatactggatggaaggctgtcgagagatcatcaggccccagtgcataagttcttcctaagcatccttaacaggtgatcacctcgcctattgagaaccctcaggaggcagcccacttacggaagcactgattgttacaaaagccctgaactaaatctgcttgtctctaaagccagccctgcagatgtctgcagtgtaactactttctcttctctcaagcagttcagcccttcaaatcattgacaacagctctacaaagccctctaaatagcccgttctcctggctaaagtgtgttggtttcctcagcatatgatgaan

SEQ ID NO: 696800 - DNA, 145 bp, Homo sapiens
  misc_feature (14)..(14): n is a, c, g, or t
agggccttttgttngcccccctcccacccctacttggaggggcccaggtttggggattttaagctgtgttaaggagaacaagggcaaggagccctccctttgggctccctcactccctaataaacatgagtttgatgttttccca

SEQ ID NO: 696801 - DNA, 1407 bp, Homo sapiens
ggggcggccggatcggcggcggcggcgacgcacgtacgtgggatgcctggatgtccctgccctggctgtggcatggtcgggcccaatggctcctcttcctcactggccttgaccctgtgatgctcttggagaagggcttggtggtgttcccgagcacggccgctcctggatgtccggggtgactagctgatcgggccgtggtcagccatgggacgaacgaatggcaaaagcgtgatgtccgttggtgtggtgctctttgcatgaggcatggaatgcagcgtggcattgtgtacaacccttgtgcatcatcgcttcctcatcgcttgcgtgttcccatcaactggtatgtgtgactcgagcggtgcgtctgtcccggtttggctttgtcgattaccactcgtatgcacggactgtgtggaccacagtgactcgccgccttcaagacatgtctgtggtgtcgctgtgcgctctgacacggcgagcttggctcacgtctttcgcgcacatggggaggagaactcctgggggagtcgaatggatagtatgacatagcagtcatgcctgacccagaagacctggggccttacaacgatgcagacgaccagcaccttgagtggtgaagggagcaagagtcctggcagtaaggcaaggaaaaattagggctagtgtgcgcatgttggggatcactcatgcttggcagtccatgacacattcactggagcgttgagacaaacgatggtatccatggaccaagcaaaggacgtgacgagaggacccaaagtacatcagcccaccacgaaaacaaacgaacagcccaaataggccagaggatgcacagaccaagaagagaccaacacgggaagagacacaccagccatagagaccccaacacacagagaataggaacgcaaaccacagagaccaccacggcgcaccacgaaagagacaagaaaaacaaaccaaaaagaacaaccagagaacaaacaacacaaacatagaatggtagacaagacagaccaacagaacaaacaatacaaaccaccaagataacaccaacgaacacgacgaaacccagccccgagacaaaaaacagggcataaaacacaaacaacagcacaggcaaccaccaggagaaaacgaagaatggcacgaacctaaccaaagaaacgaaagaacatcaaacaaagaacaggagagggcaaagaatgcgacagacggaccaacgctccacacgtatggatcaacatcatacgacaacgccaccacagaaacgaccgaccataaaaacaagcgctgaagatgcaagaccgacacacacgtatatatccgtaaagaatcaagacacagaacaaaagagaaaaaagaacaaaacacaaaaaaacgaaggaaagcaaggcaagaacaacg

SEQ ID NO: 696802 - DNA, 191 bp, Homo sapiens
tcatattggtgatttaaatgcacagtctctgacaggttctattagcgacggttgcataacattatctagtcataggctgtttcctatgctgtaaaaaattctaaagcttcatgactttttaaaacatcacttcttggctgggtgcggtggctcacgcttgtaatcccagcactttgggaggccgaggcggg

SEQ ID NO: 696803 - DNA, 651 bp, Homo sapiens
cctccaaattaaccaatgtcccaataagaagaggactccatactggtgctgtctcctctttgaaggaatctctacaggacttctgatgctgacggacttgggcattcagatggaccgcaacattgccacggaggtgtatggggactctatcacggggggcatggtgcggcaccatgggaatatcatgtacgtcagggacatccgcaacgtcacacagaatcatatccaggactggggcccattcgatctggtgattgggggcagtccctgcaatgacctctccatcgtcaaccctgctcgcaagggcctctacgagggcactggccggctcttctaagagttctaccgactcctgcatgatgcgcggcccaaggagggagatgatcgccccttcttctggctctttgagaatgtggtggccatgggcgttagtgacaagagggacatctcgcgatttctcgagtccaaccctgtgatgattgatgccaaaaaagtgtcagctgcacacagggccgctacttctggggtaacttcccggtatgaacaggccgttgacaccactgtgaatatagctggagctgcagagttttgagcatgcaggatgccagttcgcaagtgagacattatagggtcaattctctcaaggtccgg

SEQ ID NO: 696804 - DNA, 853 bp, Homo sapiens
  misc_feature (28)..(28): n is a, c, g, or t
  misc_feature (83)..(83): n is a, c, g, or t
  misc_feature (97)..(97): n is a, c, g, or t
  misc_feature (133)..(133): n is a, c, g, or t
  misc_feature (139)..(139): n is a, c, g, or t
  misc_feature (149)..(149): n is a, c, g, or t
  misc_feature (166)..(166): n is a, c, g, or t
  misc_feature (206)..(206): n is a, c, g, or t
  misc_feature (240)..(240): n is a, c, g, or t
  misc_feature (257)..(257): n is a, c, g, or t
  misc_feature (357)..(357): n is a, c, g, or t
  misc_feature (428)..(428): n is a, c, g, or t
  misc_feature (433)..(434): n is a, c, g, or t
  misc_feature (440)..(440): n is a, c, g, or t
  misc_feature (442)..(445): n is a, c, g, or t
  misc_feature (479)..(479): n is a, c, g, or t
  misc_feature (501)..(501): n is a, c, g, or t
  misc_feature (514)..(514): n is a, c, g, or t
  misc_feature (557)..(557): n is a, c, g, or t
  misc_feature (611)..(611): n is a, c, g, or t
  misc_feature (673)..(673): n is a, c, g, or t
  misc_feature (693)..(693): n is a, c, g, or t
  misc_feature (739)..(739): n is a, c, g, or t
  misc_feature (832)..(832): n is a, c, g, or t
ttaatactgacctatcatcccgacaggnatctttaacataaagccttgaccctgagaagcatgggtgcatcttgtcgtgagcnggttcatggctgtnctccatcctcagcccgctgatttttggtcttttgtncttggntccagcagtncccacgtggatgttgtnctgcttctgtccttgatgttgatgccgtgggcagttaggncccggcgcagggtgtcgcatgcttccagcagggnctgcctttctaggagcngctgccgccgggcgtcccccgtggcctcgggcatggccagcgcaaactgccggaccttctgccggaaccgcaccagcccgtccaccacaccatgcaaggnagcctcgctgccgtctcctgaaacgtactgttgatttgccagagaaattccaacagtttcaaaaaactgtncaaannaagacncnnnngcaccaaacacagcaggactcctcggccctccangttccttcagggacgccctganttttttttttccnttgttttctaggacattttggcatcaaccaccctgggtgtgtnaaagtcatctgccaaggccgccttcacggccctcttggtgctggagagcctctnccacagcatcgcttccctgacggagccgcagcagaccgccccttcatgtaggcacgtgcgtnctccaggaaagagcacagcnccaggagcagctgctgagcttggagcatggcgctgtcactgtagtngatggctgagcggtaccgctccgcagacagaagaaccggaagacatcgggcggacaaggtcttcagaaagtccttaatagtcatgtagtgctntaatgatttggacattttttc

SEQ ID NO: 696805 - DNA, 1809 bp, Homo sapiens
gctatatacagagactgaactgtaagatctgcattagaatttcagaggataatctgcctgggattacaggtgtgagccacacatgacaccggatcagcattttttatattgaggtgacgttttacaaatttgtatcttgtttcattataaattgagacacctgttcaccacagcagctggaagtgaagatggatgtgcatcatgtgctcccatgacaacacatcaagactccatgaggctacgggtgaatccatccgtgcacatcagacatacccaagaatagcataggcgaacacaacaagaatgctggcaccccaacaatgccgtgtgacaacattctctcaaaacttctgctacctctacttacctcctcgtcagcagcacacgaggatcatacaccataactgatctgcttcacgagcatggatcatgtgcaacctatcatatgagaggctatcaaggaggaggaccacccatacaccatgaatatatcagagaccgcatcactcatcatacaacactgctacggaccgcatcacggcagcaccatacaacacggtcatatacatatgcactaagtctacctacatgtcagacgacacgttcacacagaacacaagagagcagaatagcaccatatatgagtagagcataccaaccgatacaagcagattcagtactcccagccgacacaaccagtcgcaaacggatagcataacaatcacatatcactcgatcataaagaggacacagtctagaagccccactgaacctcttcgcaagaacaacatacacacacagacagcaatatcacttccacggcgcaaccatagcaaaagacacaaagagcacaccacgaccataacaactacgcagccacaacaagtactaacacaggacgcaacacgcgacattgggacacactaagcatcaaggcagagcaagacacagacaccacatactcacactcacaacggcacaatgagaagacagcgacgaaacaagcagacactagtaccaaatactaatcgacagccacaagctcaatcggcacgtcaagtagagcgtaatatacacagtcggagatagaaacaaagagcaaacaaagcggataatcaacaatcacagaaatggaagacctaaaaagcgagacaacacgaagtcagaagacagaaaacaatacagcacatagtaacacaacaagaggcagacaaaaactaacaccaaacaacacaacgggaagagatgaacacgagagagaacagcagcggccaaacgagagacacagcgcaacaccacacagaaacacgagaaacaaacgaaaacgacaggatcaagcaacaacaagaagaaaaaggagaacaacaaacgagacacacacacagagagagaaacgagaaagagacaaatgagcagaacaaagcgaacggaagacagagagagaatcagaggagcagacgaacgcagacgagacagccagaaacagaactaggcactgacaaaaggagacgaccacaagaaggaaacaaggaggacagacgagcaagacaggacacgaacggacgaaccacagaagaggagcagagaacaagaatagaaagacgaacggcgaagagaacagtcaacgaacaaagaacaaacagtgacggaacgtcaaccacgacacagagcgcatacagaaagcacgcagcagtcaaacgtagactgagaaaaggaacagaccacggaacaaagacacaccaagacagagagcgcgtaaacaaagaaaatagaagagaggagaagcagaaaatgaagagaacacagagg

SEQ ID NO: 696806 - DNA, 197 bp, Homo sapiens
  misc_feature (42)..(42): n is a, c, g, or t
  misc_feature (56)..(56): n is a, c, g, or t
  misc_feature (126)..(126): n is a, c, g, or t
ccctgtcagaggcgttagcccttgatcagcaggtcaggcggnttccgaaaaaggtnttcgaggcgcgatcttgtgcagctcctcgacatctcctggcaccccctgtggttggacctttgaccaccnttctctttttccaggcggtcgaacaggcggtagcgcttgtggggggggttccaaaggggcaatgcgggaac

SEQ ID NO: 696807 - DNA, 161 bp, Homo sapiens
gggccctttttttccccccccccctattttttaaggcccttgggggggggggggttggggccatgcctggggggggtttatggcccctggggctttgtccggtatttggtttaaggtttttggcctaatcttccaccaataaaattggggggtttttccta

SEQ ID NO: 696808 - DNA, 116 bp, Homo sapiens
ggcaccagtcagatatgcagctccagcagtcagcagcagcagcagatctctcagcaaccttacccccgcagccgccgcatccattttcacagcaacagcagcaggagcagcaagcc

SEQ ID NO: 696809 - DNA, 172 bp, Homo sapiens
gtactcaggaagcgcgtcaagaagcaattttccctgaaaatgaggtctgtgaccgccggcgacacgggtgtatatttctgtgcgagaggcttaccccggggcaaatattgattttttagagtggcccctattgactcctggtggccagtggaacccactgtcacctgtctcc

SEQ ID NO: 696810 - DNA, 230 bp, Homo sapiens
gcgtccgtcgactgatactctcccaggcgagcttgcagtgagccgatgagctagatcacgccactgtactccagcctgggagacagactccgtatcaaaaaaaaaaaaaaaaaaaaaagatgtgtttgggacaattatttttaatagatttggtcaagtttatatttttatgttttcaattccttttaagcccgaaaattttcggtgtaaaattggtcactttttgggtg

SEQ ID NO: 696811 - DNA, 175 bp, Homo sapiens
  misc_feature (166)..(166): n is a, c, g, or t
cttttgcccatataaatgctgatatttactggaaacctatccagcttcacgattatgactaaagtaccagaattataatgccagaatataatgtgtcaggccactcgttggagtgtctctgcactaagttttgtctctatcaaataactatactttgtatcattanagaacattt

SEQ ID NO: 696812 - DNA, 565 bp, Homo sapiens
cacgaggcgtttaaaccctgcttcacttggtgtgtatgtgaaggtgctttgaaatcaagtgctctgcaaactggagagaattactgcttgtattccgtgaaactacaagctcccaattccactcatttaatccctctcttgctctgttgcccaggctggaatgcagtggcatgatctcaactcactgcaacctctgcctccctggtttcaagcaattctcctgcctcagcctcccgagtggctgggactataagtgtgcgccactatgcctggctaatttttttgtatttttggtagagatggggtttcaccgtggtggccaggctggtctcgaactcctaacctcaagtgatctgcccgcctcggccttccaaagtgctgggattacaggcatgagccaccatgccaagcccttcccccctatctttaatgaaggtctaccatgtgcctgacacaggggatacccacccccacttctatgggattcaggcctggtttccagcttggccttcaggcttttcccaccacacccaaattgctgtccctgggcttgttggaggtgggg

SEQ ID NO: 696813 - DNA, 247 bp, Homo sapiens
tgggctataagtgtggcatatagaggtggccaggctggtctcgaatctatgcgcaaagtgctgggattacaggcatgagccaccatgccaagcccttcccccctatctttaatgaaggtctaccatgtgcctgacacaggggatacccacccccacttctatgggattcaggcctggtttccagcttggccttcaggcttttcccaccacacccaaattgctgtccctgggcttgttggaggtgggg

SEQ ID NO: 696814 - DNA, 348 bp, Homo sapiens
cagagtccaaacagtgcctgggagcttttaacataaggctaagcaaaagaaaatacacagccaggcacggtggctcatgcctgtaatctcagcactttgggaggccaaggcaggtggatcacttgaggtcaggagttcgagaccagcctggccaacacggtgaaaactcgtctctactaaaaacataaaattagccaggtgtggtggtgggcacctgtaatcccagctacctgggaggctgaggcaggaaaactgcttgcatcctggaggtggaggttacagtgagtcgaaatcatgccattgcactccagcctgggtgacaaagcgagactctgtctcaaataaata

SEQ ID NO: 696815 - DNA, 414 bp, Homo sapiens
ccgctaatatgtgaagcctggcaatcagaaaccgcagacttgaacccccctgaccgctaccgataggttctgtgagtcaacgacctacacatgggtcaaatagagcttctatttgcacactcgagatctatatatgtgtgatgcaaagacatctctcaactgttccccatgtgagcattctcattattgcataagcgggtctgcctcttcggccacagcccattcatatggcaccgacattgaaggctagaatgaccggtctgcgccactccgaacattctgccagtagtccatcagccctatgttctaacgcagggtctggtgggaatgaccactcctctatctcacctcccagagtttctctaaaggtgcccgtatgggtcagctttaagaaaacctcccgtatgaggttct

SEQ ID NO: 696816 - DNA, 328 bp, Homo sapiens
gcagacagggcagcagcgccgagtgaagagggagagacagggattgttgtttaatgctggatccaagcatagaggaagtcaatatggctcttctcccaagaataagtaggtatgatctgtccagaagggacctagagtagccaatgacccaacagacattgcttcccctcttcacccgtcccaccccgaaagaagtccccaagaattcaacaggggatcttggaagaggagagcaattttctgtgagtgtgaaactggagagaagcaagggtgttcaagtgtaaatcccctggccgggcgcggtggctcacgccgtcccaaagcacag

SEQ ID NO: 696817 - DNA, 481 bp, Homo sapiens
  misc_feature (6)..(6): n is a, c, g, or t
  misc_feature (9)..(9): n is a, c, g, or t
atgttngantgtgttttccccccacggacagcgcgctttggttttgccctggtgccccctgggaacccccagttgaggaaaaaggtgttttaaaaggacttcggccccataaacccggagggcccctgccccccgtgccaaaagcccaaccgcgccttcctgcccgcctttttgcccagtgacaacacggccgcgttgcccccccccccggtccccaacattgcctaccagttgcagttcattagccccgtccgccccagcattgtggagaagcgcttccccggcctttgggggggatttcatggggcccatgtacgggggtccccccctctgtcccccctgggcccctgcccctttggcccctgtgggaatccccctggggtgccccggccttgggaaagggaggggggaaggaagggagggggggggtggaaaaaactgaaggattccttttttaaaggtttttttttttgttccttta

SEQ ID NO: 696818 - DNA, 162 bp, Homo sapiens
aaatatttttcatagtggtaaaatttacaatacttggctgggcgtggtgctcacgctggtaatccctgcaatttggcagatcgacgcacgcgcactgcttgagatcaggacttcgcgaccagcctgggtaacaccgcaagacctcatcttcaaccaccacaa

SEQ ID NO: 696819 - DNA, 108 bp, Homo sapiens
gtaaggatctggcgttgccatgagctgtggtgtaggtcgcagacatggctcggatcccgcgttgctgtggctctggtgtaggctggcagctacagccgcttttgtgtt

SEQ ID NO: 696820 - DNA, 873 bp, Homo sapiens
  misc_feature (329)..(329): n is a, c, g, or t
agcggagtctctgacagccgcggcgccgcggagcttctcctctcctcacgaccgacgagcagtcattatggcgaaccttggctgcatgtgatgctgcgttcgtctttgtggaccaacataggatgtgacctgggcctcgtgcaatgaagcgcccgaagcctggagagatgggaacactgtggcggcagccagaatacccggggcacgggcacgccctggaggacaaccgataaccaacctcagggcggtggttggcctggagggcacgcctcatgaggtggtggcatgtgagggcagcactcattggatggatggactggcgggcagancccattgggtggtggcctgggagacagccgtcatgtgtggatgaggctagggtgtcaagcgagagtgagtactgcagagatcacgttggaagcggaagcctgatgtaagccgaataaaccgaactatgaatgcaatcatggtcatggtagctgcagtcgagcttggggctattggtgtggggggccattgagcgtgctacggtgctgggaagtgcccatgagcaggcccttcatacattctcggcagtgactatgaggaccgtgactatcggtgaaagacatgcaccgtgtacacccaagcaagtagttctacaggccctagtggtatgagatacagctaaccaggaacagacctgttgtgcacgaattggcgtcaattatcacaagtgcagaggcagccacacggtgcaccataaagcaaccagggggggaagacctttcacccgagaaccgagcgttccagcatgattggagccgcgttggttggagccagattgtgtatcacccaagtaccgagcaggggaatctccaggcgtattgaaca

SEQ ID NO: 696821 - DNA, 172 bp, Homo sapiens
  misc_feature (156)..(156): n is a, c, g, or t
agcactctagacgatcgcgttaagacacaggtgagggcatggccgagatggagttcaccgaggctgagagcaacatgaacgacctcgcttctgagtatcagcagtaccaggatgccaccgaaaaagaggaggaggatttcggtgaggaggccgaangaggaggcctaaggca

SEQ ID NO: 696822 - DNA, 340 bp, Homo sapiens
  misc_feature (3)..(3): n is a, c, g, or t
  misc_feature (26)..(26): n is a, c, g, or t
  misc_feature (43)..(43): n is a, c, g, or t
  misc_feature (183)..(183): n is a, c, g, or t
  misc_feature (249)..(249): n is a, c, g, or t
  misc_feature (251)..(251): n is a, c, g, or t
  misc_feature (286)..(286): n is a, c, g, or t
  misc_feature (292)..(292): n is a, c, g, or t
  misc_feature (315)..(315): n is a, c, g, or t
ganttcggcacgagccaccctctccntgcccccaaggaccgangtcctcctcgaaatcttgcaccgggagtttgcactcctgacccactcatcttacctccagcttgtccccacctccccgtcccagctttcccggccccacagccgactctaagcgggcatgccccggtttttttgctcgtnactcgaggggccccaggtttgccccggtaccaggaccctattaggctttcagggttcccgtgtctntnttcttcagtccctggccctgcgcgcctgtaatgtnagccanttggactagacatccgttccagngtggttctgctgttggcaaaacttc

SEQ ID NO: 696823 - DNA, 786 bp, Homo sapiens
atatcggtatgagtaaaaaaagtcaaacttggagaaacttggatttcaataagtaatgacaatgcttaggttagtatattgtaatttgaatcatttacatctaatgagaatgttagttgagaatgtttatctttaaagttggtatatcctataaataacggaatgaaaaaaaaggtctgtacaatgtgaaacaacaaatgatgcaagaattcctatttacgttttatatgtaccataaaagtaagttgttagtgcttacctaataaatctggaatggttatttaatgaacattattgagatgggtgatgtgtttcaaaaagatacttgctattttgttgaagaaataaggatttccagtcattaaacaaaaacttaaacaatcttattagatgggtgactgtgttttcaaaggatacttgctatttgtttgaagaaataaggaatttccagttcagttaaacaataactaaagcaatcaagatgttctatattaggaatctcaagatatgggtttgtttaaaaaacctttttaacagtctgtgatgtccaacggagttatgacgtatcggcttttacagaatgtgtttgttgtcatatattctggggcgtttaagaaattttaactcatcaaagtgaagattagaataaatttcagaaaatgtagaataggtatggattcttgtcctgtattagaatctcagtggagtttttggaaaactaatatggattctctgattataattcttaaatttagatttcattgggtacattttattatggtccaa

SEQ ID NO: 696824 - DNA, 140 bp, Homo sapiens
attagtggactgtcatgtggttaatcttttaagaccaattcattaactgtgtactgatactgatgctatagaaccttctaaaactaggatgctgcctggggggtttttagactaggtgctattgaaacttctaaaactag

SEQ ID NO: 696825 - DNA, 256 bp, Homo sapiens
taatctgtactcattgcgggagtacaggaagaaacagagaccccttaagatccgtatgctgtatgggactgtgaagacgatcatagtgtatgactctaatactgtcactgacatgctcatgaccatctgtgcccgttttggcatcaccaatcatgatgaatattcattggttcgagagctgatcgaccagaaaaaggaggatataacagggaccttaagaccggacaagaccttgctgcgcaatgagtacagatta

SEQ ID NO: 696826 - DNA, 141 bp, Homo sapiens
tgtctaggtctaccttgttctcagaataaagaaggaaaaggaagaggcggctaaaaaacggcaagaagaacaagagagaaagttaaaggaacaatgggaagaacagcagacaaggtagagccgagacaaggtagagccgag

SEQ ID NO: 696827 - DNA, 107 bp, Homo sapiens
cccccccccccccccccccccccaatttcccggttttcccccgcccccggggccttttttggccccctggtgggtttttttaaaaaaaatttggtggtttgttccca

SEQ ID NO: 696828 - DNA, 187 bp, Homo sapiens
attcgcggccgtgtcgacagttttgtggttaatagcaaattcttcctgaatttaaatcctggctctgccacttatctatgtgatcttgggcttgatatttactcactttatacctaagttcctcgtatatgaatcataggtgataataattagttcctacttcataggattgttgagaggattacat

SEQ ID NO: 696829 - DNA, 244 bp, Homo sapiens
gtgtggtgagccaacgattgtgtcattgcattccagcctggacaacaagagcaaaactccatctcaaaaaaaaaaaattctatattggatttcaagcctcaaataacttcggtaataatgactacccatctgcaagagtccttgcttggtgatcactgttacactctgtggtatggagaatgctctaagtcatatgttcaccaacatgctgtggccctttagcttttcccagcttgctccagag

SEQ ID NO: 696830 - DNA, 835 bp, Homo sapiens
  misc_feature (41)..(41): n is a, c, g, or t
  misc_feature (70)..(70): n is a, c, g, or t
  misc_feature (423)..(423): n is a, c, g, or t
  misc_feature (461)..(461): n is a, c, g, or t
ggacattttaaaatgagcctagtgaacatgatgaaataaanttatctgtataatgaaaacaatatggganatatcagcgcttgacattttcctctctggtgggaaacatccagatgactgcccagatctagtgattgtgccctggaggtggatcaggaagtgtgtgtcttagtgataagtctcaggtcttagtagtcaactgtccaaattcaggtcactcttggctactttctacaagtagctttctgcctactcttccaggagaccatgccttcagttaggtgatctgacagaggagcctagatagctatagcctacacattcgggcctaaacgtcggttctagacattcaagagcatggattccctctgactcacttgtgtaaaggctcatgcctctgctgctgctgaggtgcactttgantttggagctatttgacgacatccccaaatccctactcnaaaatgcaaaatagcattaatatactgtaaaagattaacttatgtgtaaattaggagttaatgaaaatgctttctcttcattttgagttcttttcaaggagcccaaatgaatcttgcttttggaatagcgtgtctgttacaagtgttgatttcccaagtgggtgtgattaaaacagtgaatgatgataggaagtatttacagaactttatagttagtaactgactggttaaatttttcaaactgatttttactcaactgaattagaaaaggactagaaagaaagtaaagatcgcaacgattgagggaacaagtggacaccaaggacttgtctaaatgtttttattagactaatggggttctagttcttagaggg

SEQ ID NO: 696831 - DNA, 108 bp, Homo sapiens
agaaaataaaaaatcgctacttccctgcctttgaaaaagtcttaaagagccatgggacaaggactaccttgttggtcaacaagctgagccgggtctgtacattcatcg

SEQ ID NO: 696832 - DNA, 984 bp, Homo sapiens
tccaaactatcttccctcctcccccacctccctgctgtcacctgtacatgcaggtcttcttcagggaacaccagcgattcagttccttgtcatcagctgaaaggatctgcatgaggaggaagatacctactgtgtggtcctggggctgcctctgagcctcagtgactcagcaggggtggcaagagggcgggggacaactgagttggtgttttgatattgaggcagggttgtttgaatgtctacctgtagctcaggctatcttggaattcccagcagtcccctcctacctcagcctctagtgctggcctccattaacagtttcagctgttagtgacagagacagcaccgaactccagatctccctgtctgacctcttcacagagggtgttcacctcctccagtcccttgcccctccctcaattttccctgccggcctggtcccaacctcctctgtgctgagcccgaagtcgcagggcaccacagtgcggtacttgaaacgacagggcaggtcgtcgataatgtcctcgtagtccagacggtagtactcatctaggtactcctcaaaggtcttgtcccctgcacaggagatgcacagcgggtagtatgtgttcaaagccccatgaggcacactgcccatcatgccatgcacctcaccagggtaccacacatgggctttcgtcctgcccaatgaggtggtcaatgggagactggtggcttctcctgcctgagggtggggggctccccggaagctatcttcacgtggttggctgggggccaatcgcttgcgtccaacactcagaagagccaggtcagaaccaagcccggtctaaagctttggagatccagaccacacagggagcgtgtcacaggcataacacatggtggctaatggcctgggccaggcttgaatttccgaaacttgttgaggcattaacacacaaggtcagtaaaggtccaagcctggccgcctttggtcccgtcatg

SEQ ID NO: 696833 - DNA, 165 bp, Homo sapiens
atgatctcgaggatccccagattattagtactgttgatacgtagaatgatggctagggtgaattatatgagattgtttgggctactgctcgcgggtgcgccgatcagagtcgtagatttgaagtttgatgctcagccctgatcagaggattgagtaaacggctag

SEQ ID NO: 696834 - DNA, 263 bp, Homo sapiens
accgaatctactctcactttactcctaaatccacattctacccttaactttcataaccggggtcagagggttgtggaatacaaaatataccccatttcttcccacctcatgggctacaccttgacctaccgtctttacgtgggtacttgcgcttactttgtaaccttcatcagggtttgctgaagatggcggtctataggctgaccaacaggtggtgaggttgatccgggtttatcgattacagaacaggctcctatacaggg

SEQ ID NO: 696835 - DNA, 362 bp, Homo sapiens
cagtcggacgctctccctatggtctcctagtctacgcttacagatatgcagttgattttttaaaacgcttaactaggaatctttctgaatacttgtcctattttgaaactacctgtctggtgggggtttggtttagttttcttttttttaatgtcagaggaatctatccatgtgaatcgaaaggcacaggaatctaggaactctgaggaatttattgtgaaggcattttgttcagggggttgcacagcagcaagcaacagtgtcaagtttggacagcaaggcatgtgcggtggtggcgcagtgctgcgggctatggcacaggtgcacttggcttttcagttaggatcacagtcagggcagca

SEQ ID NO: 696836 - DNA, 129 bp, Homo sapiens
acgcaggacttcgtgcgtcacttatgaactagttactccccactttagtccaaaatagtgagctttcaacgcttagtgccagcgtacttacagcaactacgctcaacagctacttgtactaggcacttt

SEQ ID NO: 696837 - DNA, 923 bp, Homo sapiens
taatacttctgcgagactcccagggtccacttccgaatcgtgcagatggagtggccaatgttgagcagcattctgaaaattgcgatcatctaactgatagagtggtatgagctttgtaaaataagtacatggttctcttatgtatattgttttaggtaccaggatgcaaatcagtctagaagatacgtccacatcatctatttttcaaccaggaaggattcttatagaggcaaaatctagttctccatgatagacctctcgtcctgtgggtgctatatgaactgttcatccgtggcaatcttggcttgagagacttatctatactatatccttactgctcgaccgtgtgcccttctgttctatactgtacgtaatcttgcagatatggtgaatgcattgagctggaagctccttttctccacactctctcaacaccactcctcaccgttatctggtaaccccaattgtagagaataaaagatcttatacgccagaatttgagcattaactcccttatttgccccggagtgagattgagtgcgctcagtgggattaccgcagcttttgaaggcaggctctcacacggggaacaatgctgtggcaattctaaataagttttgatcacttgggggaattgagttcgcatgattagaagtatggccaatcagcagagcggggtactaagccgatcggaatcaccggttcctggaagtagcgttaggaagggatggtggctgaggcaaaatcttacggtggaacgaatcccgttctgctgcaacccgggttgtccaacggtgcgcgttccaactcttttggcggttttacatgtagcgcccgcaaaaaaagaatggccccaaaattaacttgcggcccgacaaagttggcgagggtcaacaaggcccaatgtagtagaccccccatct

SEQ ID NO: 696838 - DNA, 1082 bp, Homo sapiens
  misc_feature (559)..(559): n is a, c, g, or t
gaagttacaagtgaatcgcataagactgctctgaaaggctctcttgggatctgctagatctattcggacgcatggaacggcattacgtgcacatatcagcaccgaagatgaaaaggattgcgcgctattgagcatcacgtaaccaggaagacattcatgactcgtctagtctcttgcatgggtactactgtggttgagatgctatgtctagccatttgtgtcatcctaatttcctgtctcgcttgaatagtggctgagaattgctcgcgagaattcgtgcgactggctaacctcgggaggagatcccaattatctttacgtgctctctaggcacgggtggtagctcaccctaaaataagctttgctaggtggtcgactaggcgccataggggtagtcgtgtgcatcgttaggaaggctagtagtgcgctccatttgcgccatcgttaccccggattccgatgcaaacgaaccagtaatgtatgggggtacccagacattcgaagaaccgggttaacacacatcccacgaggtatacactaaactattgtcataggtagntgtcctttgaattttcgagtactattacgaggggcctccgaaaattgttgggatggagagagagggctttaacaaaaaagttcgcgaaggagaacaccattaacaggggtaggttggtcaaacttaggttcgctaaacatataggattaaattttaatttcaacaaaaaattcttttaaaaattggttttttatgccaaaggggtgacatgattcgttggcactggaacatggcgtgcatttttggacatgaggacaatggggaacgaaggtgtacagcgttgggttgtcacgatagttgtacatggggcctctacggctggagggaactaaaaaaccgtgctttcctcttatgtcgcgtgttaacccaatgaaggcacggttttggaaaaacgggcttgtgcaaagtgacttattaccttgcaagacttatacgctggcgctttcgctccctttagtccctaacagggtacgaagtccacgaaggtcgtaagtttcctgaggccacttccgggcaacgggac

SEQ ID NO: 696839 - DNA, 830 bp, Homo sapiens
ggtcagaatgaatactgatgctcatgcaaattctagactgtcgatgttccagaatatgtcgatgttattctgaagggtggccacagatcctcgtagaagtggccccacgtaggcaatccctgcgtgaggtgatcttcaatcatcaatctagtgtataatcatcaagcacattcgttgtgacaacgtagaaaacacaacacgcatgagcatcccgaggatatgaacgaataatgagtgagagagtaagcaagaagaggaatcatggactactcgttcaggaacataatttggttatatcaatgtacaagaaccagttgagtcattggggtgctacatctcgtgggcttccagttgcaagagcaatgaagtgtctggtaggtactagacgttaactataccactcgatctaagcgtttcgattgagtccctggcgaagaaatttgggcgctcgtcatatggtatttgagacatctcggcacaaagttgtcatatgcgagtgcataggacatattaacagtctcgtgaggaggttgtcagtgcactgaagcaacccaagggtgctttgcctttgttgcaacgatatctcctatgaggccccattgacaatggatctcgaaaggttataggtcctatctgacaagcgtatagagtgagctaatttggacgtctttgggtttccccaatagtttgcgagccgagggcttttatgaatttcgaggcgaatagcctcaaaaacccacgcgtttaaatgcgaccggtgcgaattattcaggcgacaccttgttcaagcggattgggtaattctaattgtccatcctggaccatgaacg

SEQ ID NO: 696840 - DNA, 311 bp, Homo sapiens
agatttctccttcacatgcagggaccccttcacttcgtgtaccatgagtggaagcagcctgaggcactcaccagatgcccagtcctccagccagcagagtcatgagccaaataaacttttttttttttttttttttttttttttttttttttttttttttttttttaaaacccccccctaaagggggggggccctcaaaaatttgggccccccctttttaaaagggcctttttgggggggggtttttcaacccaaggggggggaggaaaatttttggccccccccccaaatttaaaaaacggggttttttt

SEQ ID NO: 696841 - DNA, 273 bp, Homo sapiens
attcctagaggtacccccttagactctaaatattcgcgatagtgtgctgagttattggtatggaatcattttcttagatgactgaaattttcgcgcagtgtgtgctgagttatttgtatggaatcattttcttagatcatgaaattttcggagtgtgtgctgagttattagtatggaatcatttacttagatcatgaaattttcggagtgtgtgctgagttatctgtatggcatcattttcttagatcatcaaattttcggagtgtgtgctgc

SEQ ID NO: 696842 - DNA, 870 bp, Homo sapiens
tggtgactgccatttggtcccctgatatagctgacctggctttttgaggtatcagtggagcgaagacgctcacccattccctaatgtcagacaaacataatttgctgacatgtctcttcaactcttttgctgcatggctcttttctgtcattcaggtggaatgtttgtgagtctctttcccatccatcttgtcggtcagctggttagtctcctgcattatgtcccttctctactcactgtactgctttgaatatcgttggttcaactacaactggacattgaaatgcaccagcggcttgtctaacatagcaaacggaacttggccttactactttcgggttctggttttgccccttggcttttcctcaacagcaaatgcagctcctcaatatattatcagctggcctgcctttattctcttatccttcttatcccttctattccatctatcaagctgcccaacttgaagcaaaagacccccttggccaaaatggcgtaatcatcgttcccatgctatgccgccctcgtttcttcccttgaggctgggtcctttccttaacgccaaccaatgagcttctttcccatcaaatggaccatgatcttaacccgttgtcgatgctctgtgcccctcttgcacgcaagtgccttccttcccttctccttgccaagcacggaaaggttatccccctatttccaaccccttgcaaattccccgcttccggcccttttgctccaaagactctttgaaacacttgccttaacccttgccaacgggttccaacgctctgaccggttctcgcccccttttacccatttcccccaaaaccggcgcggacttgttgaccgctgcaaattctgggacaacgcacg

SEQ ID NO: 696843 - DNA, 228 bp, Homo sapiens
ggagagggggtctcaaaatcggtgagaaagtttagggtcaaggtggtttccatgagaaaagtactggatttaaaaaactaataagctataaaacggccacacgcaaaaaaatgaaaaccaaaggggtccacaaaagatgctccttgccttctgaaggtttgacgatggcatggtgatcattaaccagtcttttgactacataaacttagaagggcgcaagttgaaaca

SEQ ID NO: 696844 - DNA, 148 bp, Homo sapiens
tagcgagccaatgaggtgtgcagcaaacaaaagctgtcactaaaaacaagtcaacaggccattatgagtatgagcccagcacgaaagcaccagcacggattcccttagcaccagcacgaattcccttagcaccagcacgaattccctt

SEQ ID NO: 696845 - DNA, 113 bp, Homo sapiens
ccggtacatctccgcttctcagcgaagtgaagtgttgtgatgatgcaatctaccgcggtagacggaaagacccatgaactttactgtagctttgattggactttgaatcgatc

SEQ ID NO: 696846 - DNA, 706 bp, Homo sapiens
gcaaagagtgcaaatgcacctccggcaacaaaagtaagtgggatcctctctttcctctaccccgttccctgtgctccaggctgtcccctctccaccacatcctcaggggaagtcaaagcaggctggggatgccccatgtgcgcggaaatagtcgcctcctcagatgatcctttatcagggagagccaggaatccgttaattccgctggtgtcgctaagtcaccgtcatactctggccggcatccatgtactagcccaccaggcttgctgctctctgctgccccgtgggggcttgtgccaaagctgtgcaccaagggctgcatctgccgaaaggggcagtctggacaaggtgcagttgtgctgctgccatgatgctggcgacagtcccggtcccagactgtagaagaatcgcgacgttcgcacaaaagccttggattgtgcataattgtacaagcccgtgagacggtgaccggttggcgtactattgcgcttatatccttagtggagattacatggtggaaggtgagtaagttaaccacgaaggcgttggaccttggacaagacagcgaaagggcacacccatgaaaagcaccaaagaaagcgggggccgcccgcgcatcgacgagagagcatccccggcagaggggcgccccacagtcacaggggtgaccccggattagggtcacgcagagggcggcgcacacagc

SEQ ID NO: 696847 - DNA, 345 bp, Homo sapiens
aactacatccatccttccacctgacccccaaccatgaacaggtctatgaaaaatgtcagtctatttccaaaggaggagaaacagccagaatgacacgcctccaaaatgcttgttgtataccggagaacaatgagattttacacgtttgttcttccctgatgcttgggctgcttcagaattaactgggattgaaaatcagactttgcaatagcaccataggggctccgagtattcgacatgtgtggtgtgaccggctggcgtgatgtgaagtgctgtgtacaacagtgctgcagcagctatgtcattactgattccaaagctgtacacgcaatacagtcagggttc

SEQ ID NO: 696848 - DNA, 1824 bp, Homo sapiens
  misc_feature (1237)..(1237): n is a, c, g, or t
  misc_feature (1303)..(1303): n is a, c, g, or t
  misc_feature (1753)..(1753): n is a, c, g, or t
cgcatgagagcattgagccagtaatgcctgtaatccggcgcatagcttccgtattctaaacgccatagttcgtctccccttcctctcatactcagtcgcaagctagagttcacacctcgagcaaacactccctagggctacaacgtaacacacatccttacataacgtcacttcgtcaactgccccaatgacacttattctaaatcatactcgtgactccaatcaagatcatataactcctagtaccatagacttctgagcagcgaatttaggcgtctaatcattgaagcttaagatgtactcaccccttacatatataatccggggatctgtcccaccctgtaatagtagcgtcgctctttacacacgcgcgcaatttgatacgaaaagactcacacgccatttccgtcgtagcgtgcttctaactcatgctcaccttctgcctccggctaagcttacccttcgtctaacgaacacttacgtggccgaagtatgaatgggaatgacgtacacgtgaacggcacgtgcagacacacgtgcaattgtacatcaagagtcctccaccctgacagcacacataataacaagcaattgaggacacttatacacttcatctaccgttgtgtgttgaacgtacttttccccgtatatggacgcgcttcaaataacacatgtaacttatcactccaagtcttaatcaccaaaccatcatattggcccccagtgacttgaatcatataccaactcagtaacctccttataaagaggtccgggctaatcttcaattatggtagaatcttaaactttcacttattcaaaaagatcctatagactccaaacaatattattggcacacagatcgcgcttcacgtgtacaccccaatgagacccaccctaacgttcagaccttcaccaaaaagcccccccccctctttttaaaccgggcgttttcggactcccggcgggctgccccaatgatacctactatccattagccaatttgataacttctgagacctcaccttgtggcaatcaatttccttccattccccccttaccgatttccatcatgaacttttgcctttggagctttaaggccaaatataattaaccataaaactttaaacggaaagaacggcgggcatacccaccatggatccggaccttccaattatattcccctgattcaccccagggggaggttgcgaaagagatgtcttaacactacgtcaacttntaattcaagcatattcttagagattaggaccggtattttaagaccgagagggcactccgcgtgtanaaaccgtttcaggccactgattagaccacgaccccagtgattagtataggagcccctacgatgggagggagagaaaaaaccctcccaccttggtaggggtcagaggtgtaaacccaccggtttcgctggcgagggaacacgaagagcacacagaattcgagcccacaataatgaacgcgagaagggcagaacagcgataatatagtgattacacaaggccggtgaattaattccaccggcttacgacatatttttgtgtgcagcacagcacaccaagtgtggtgttgacgtatatagcgcaccacactcatattaagtcacacgtaagaagacgtctcattgacagggagaagaacaccgcacgattgttgaacatacaaataagcacgcaaagtctcagatgaagcagaacccgaacatagaaagggagggtcactgcttgacagaacnagagaagcgccgccagaacacgacagcgagaagcaagaaccacgtgtgacgaaggaaggcagacgaagagg

SEQ ID NO: 696849 - DNA, 356 bp, Homo sapiens
aactacatccatccttccacctgacccccaaccatgaacaggtctatgaaaaatgtcagtctatttccaaaggaggagaaacagccagaatgacacgcctccaaaatgcttgttgtataccggagaacaatgagattttacacgtttgttcttccctgatgcttgggctgcttcagaattaactgggattgaaaatcagactttgcaatagcaccatgattgcccagagaattccactgtgggtgtgccctgctgaaatgaggtggctgctgtatccaacatgcacagcaccactgcccttcctgcttccaaactgttcaagcactttatctgcacctccctctctcctactcctg

SEQ ID NO: 696850 - DNA, 134 bp, Homo sapiens
cctcaaggattgttgcgaactcaagctcgaaggtacgccgcagatacgccggagtgaaaatcatcctcgacgtgacatcaacaaggacagccgggcggagaccacgcttgcgggattcgggatcaacaccaagc

SEQ ID NO: 696851 - DNA, 1089 bp, Homo sapiens
  misc_feature (673)..(673): n is a, c, g, or t
gccgagctcgggcagcagcgcagcgggccgggccacctgctggtgccctggaggctgctgacgccccggacggctgcctcgggcccatcgcggaacgacgggggcgagatgctgagccactcctctggctgctcgctgcgtggttctccttgttccatggaaggaagcggttggagttggatgacgacttagataccgagcggtcgccgtccgagaaagggagctcggcagtgggcccctagtgccagactgctccgcccttgcctgttgccccgtgagctcgcaccgtagctgcttccagatcggtgctaatctgcttgtggccatctgcacgtcccagtcattgtggcccttatgtctctccatggaagcgccgaggagggcgggcgggcctaccaaggcccatgcaacttgcccgtacaggctactgcaggtatacgctgctgaaggtgtaccgcctgtccgaggaagcccgtggcacgtgcgaggagccgctacgtcgcggatgcgccccggcacaagacatgtgtgctcggcccacttgaggtcctgggctggtacccagtctcctctacgcctttttcactcgggacccatggggacatgcacagactggtgcgaagccgtcacgtatccctgaacctgaggctgccgtgctcttccgacagatggncaccggccctggcgcactggtcacatgcacggtctgggtcctgcgtggatctcaagcctggtgttgctttgtcttcgctgaacgtgagaggaagaagctggtgctggagaaccgggggggaacctgggtgtgaccttggggcccgaatgaatttccctggggggcacacgccacgcgttgccccaggccaaacgtgtgagcccggggagaatcacgggccggcggggcgccataattcgcgcacaggggagcccaagtttggtgagccggggagggaggggccgcttacccaggagtgacgggcgacacacacgttacagagacatgaagactgaactggattgcgagatcacccggggggcatcacgcttagtgaggcctcggcaccaccaggatgatagtggcaccactcgagc

SEQ ID NO: 696852 - DNA, 428 bp, Homo sapiens
tcaaactaagaagcaaacgggttaatttataatacggggggccaggccgggggctcgtgccagggtgacatagggcatgtgggaccatgaggggagagaggctcagctctcgaggccaagatacagtgaagagggagggagcagcggggcctcaccgcgggtccatagatccgtggagggcccccgagggtataagtggcgtgacgaggtctcgcgggtgggggaagtgcgcgtgagggtgtggagggccacacaacagagcggctccttattgcgggggaaaagagaggccagcgagaggattaacggaggaaccacaatctcgcgtggcgtgggaaaataagagccttcgaggccaacccgaggtgaagtggaaagagaggggtggggtccggtgctcgtggggagggcctccacattgggggcgc

SEQ ID NO: 696853 - DNA, 864 bp, Homo sapiens
taacgggtgtgggttggtttgtttgcaaaatggccaaaaaaaaaaaaaccggtttccccgagcagctgccctgaaagtaggggtggcggcggaggcgctgagttttatacatttagttcagaacctactgggtggcattaaactgtttgaatgcaaactcgatttcagattgaacttcgtaagggagttaacgagggctgagtccagcaaattgctaaagtgttaatttcaaattatgcaaatttgggtactgcagttggttatgcaatattatattcaccaacccagtatcacaaaaactcatagaagatatcatgtaggcccgtgggcttggggggggtcccaaacttggtatgcagaaatgtgacgggttacagggtcagtacaacctcagtccttagaaccccttccacatttcagctctgaacccacttttcctgtcatttattatataggactgtagttatattaagttcgaaagccttccgaagctaaattatatctttcttggtaccttctttctaaaattaccaaagattttacacaagggtaaatcatgtcctcgtgttaatgcttatctgatgaagccaaatatcctctaaatggtggatcaaaggaggcaaaagaaatttagaggccattgacaaggcgataggtatggcaacctggagcaaaggagaacactggctcctttcctctggtaaactttacaaaagaccagagttagacttcatggaaccaaagtttggtaccttatacttaagtaggtttttgacccattatactatatggggttacccctctacgaagaaccaaagatctattctcttgaagaggataaagggggccaatggacaattacat

SEQ ID NO: 696854 - DNA, 126 bp, Homo sapiens
ctctacaggatcctttcccgactagcccgacagccagaacgtcgttagctcaagcgatcctcccacctcagcctggccaacatggcgaaaccctgtctttactaaaaatacaacaattagtcgggg

SEQ ID NO: 696855 - DNA, 780 bp, Homo sapiens
  misc_feature (70)..(70): n is a, c, g, or t
  misc_feature (77)..(77): n is a, c, g, or t
  misc_feature (105)..(105): n is a, c, g, or t
  misc_feature (168)..(168): n is a, c, g, or t
  misc_feature (284)..(284): n is a, c, g, or t
  misc_feature (780)..(780): n is a, c, g, or t
cgcagcacacgggacacaactcgtcgtgatccgcccgtagaatgcccctttatctggttggagctttccnttccttnccggatttgcaaagaaatgtctttttgngtgacttgtgttgtacctgtagaaattaggattttactttatggtttaaaaaaggcaggagancccttgtcgcttttcttacctaatcacgagtttgtgtagtgatttaaaagaaaaaaaattgttataagtttggagcaagggagtatgtgtttcaaaggaatctccttccttttttngtgtgtttttcctttgtcccaatggggaacctaaatctgttttaatgcacagacacatggacaaaaagtcatttgtatctgccaagtgtggtaccttccttgtttattgctattaaactgtttgagaggaaaaaaaaaaaaaaaaaaaaaaaaaaaaaacttgtggggggtttgggcctggaaaaagtttccaaaacacccattgcgtgttgggggcgcggcgggcgccccagggagtggtacgtggaccaccgttgggcaataagcggtgggccccaaagaagagacgactcggggggcagggggcacaacgtgcgtggggtttctttcccccaatataaaaaaaagccgcgcggggggcaacaaccgagaggcgtctcctgagacacaaactccaaagaagggagcgtctgagggggcacataccggggtctcaccaaacaggaggcgccaggcgaaggcgggattatcaaattaacgcccgagccgtgggagn

SEQ ID NO: 696856 - DNA, 523 bp, Homo sapiens
  misc_feature (1)..(1): n is a, c, g, or t
ngtttgttcattcattcaacaaatatgccaggcactaaataggcatagagtcatgatgggcaacatatagtccttgccctcattgagcttatagcctggttagggaaaaaaatatcacacacacacacacacacacacacacacacacacacacacactctattggaatatatgtatatatattcaattttttatgttatcaggaaaacagtagagtgctgtgaaatagcattagaagagaattagggagctatgtttacacgtatcactagaataatcacatttaaaaaaaacggaatgcgtgcatggtggtttgggagtccaggtctaacaatctaagagatgaggcagcatgggagaaacagagaaaatgtcctacctggttaggagaccaggatcctcatcctagctccatcaaaaactgcagaggttttcctcatcagcaaagaggtaataggtgtctttcattatttctccagggttataatgaaaatcaaatgatcacatacacctggattcacat

SEQ ID NO: 696857 - DNA, 104 bp, Homo sapiens
tatatagtgttaactaaaaacacaaaaaattaatggagtagtggaagtgctagaatacagccactcgggaggctgaggcaggagaaccgcttgaagccgggagg

SEQ ID NO: 696858 - DNA, 457 bp, Homo sapiens
gagcggtttagcatgtcactcataggttacgggtccttatggtgcacattttttttaatctgtgtcattccagtagaagagataccatttgacattttacagatggctgtatgcaaactcttaaaacatttgagtaagtacagtgcaccagggagactcttatgactatggggataacaccaagaattgggtatatgctccttactcagggtccccataaatcaaaccacctaaaatcaaatagattaaagaatgaattagataaagagtttactggcttaactaagtgggttttttggttaattccctacaaccaaatctttataatacccgatgttttctccatatgccatgttagcagctgcacagatacttaagataagagtctcatgatagtagagaagtcttgatctgtgatcttaggaaaagctgttcacattaaggatgccatcttctt

SEQ ID NO: 696859 - DNA, 283 bp, Homo sapiens
  misc_feature (188)..(188): n is a, c, g, or t
actctagcggatccttagctcagtgatctcaagtagaaagtagaagggaggaaataaccaacagagtaattcaagaaaactttccagaacagagaataggaattggcaggctgaaagagcccctgtacagcacgaactcactgaaagagcatctgtacagcaatgttccaatttcttgggcaccaatntcttgtataagtccattttcccacttaagtataaaagaactacctggagactggggtaattttatgaacgaaagagaggtttggactggaactca

SEQ ID NO: 696860 - DNA, 436 bp, Homo sapiens
  misc_feature (364)..(365): n is a, c, g, or t
tgtcaagactgtggaatcaatggtagtttctcaacatgtgctttggagaagaagggaagacaacttatctgaggttctctatattccaggaggcctgaacctctgggattggatccccaggtgagcagctgactcagttctcacacctgctgccctgccctcattctggagtgactgtcagaaggggattaagcctcagccacctggcctagggctagtcctcctctccaacaacccagatcctggagttgtgtgcctagttttggactctcctttccatcaaatgactttccctctagaaagtcctttcgtctctcctgcaggcagcatctgttggattcaccctagtccaggattaatctanngccagagggccacatccggaccactacctgttttggtaaataaaattttatcagaacgtaaaaaaaaaaaa

SEQ ID NO: 696861 - DNA, 117 bp, Homo sapiens
agcgtgcagtggacattcgcccttcacaaacgtttaaatgtgtttaatggaaaatgaagctaggcaacaagcttatcaggagcgacaagtaataaaaaatcattgattctaattatg

SEQ ID NO: 696862 - DNA, 955 bp, Homo sapiens
taatcacggggcctagtcaaactatcccgtggaatgcctccgctggaaatggtgccagagaacataaaagtggtagaacggggtaaaatatgaggatgtgaaagtcatggcgaaatcgtgcgttcccggcacacgtcagtggtaagctctgtgcccctccgttcttaggtccacactgcatgaagctcccaacatgacacaatcctgagcccctgggatttgaatgatagacagcacagtgcacggaggagcccctgtgaggttatcaaaagcagccatgtccagaggctcacccatgatgaacagaacttctgatgttacatatttcttctaacaagtctaccaatcatgaaaggaaatcgagactgacccctacccagagggagagtatcccatcgaagtctccagtgcctggggtggaccctgtactgtgagactcatcagtcctgtttgatctcaccatctacatgaggcaggcactggcaggcgaggttaatcgggagccaactgtcccacgcacttggatccagccatggccttttcacagggccttgggatactgtcagtcggactgacttacctgtttcagagacagctttcaccaactccaaggttacccaagtcagtatcaggctttactgcaaggttgagaacacaagactagacatagcttgaaatgattacattacctcacaacagatgccaagtgaacgttgcgtcccaagatgtggggctgaggactctcccaggagaggcagccactgggtctccatagccagcaaacaggaaggaacaattgcctggaccaaatggctccacaattaggctcgtccaggggaaaagcccccccagggagaaaaccgctttctggtgacagtaattctccagcgaaaacttatctcgttcggggccacacttgggctgggtgtgagacgagaccgaaaaggcgcatttt

SEQ ID NO: 696863 - DNA, 232 bp, Homo sapiens
tctctgctccctcttcatagaaatagattatttttataatacaaaaaaagaccaagaacaaaaaaaaaaacataaagcacaaggccgtagggaacatctttaagcgattactcagggccggctggacagttacacggtgggttggcgttcagtcccgtggtaccacacggcgttcaagccatgtttaaacccggattgcatcaacttcgaaaccgggcccgccgccggcgcc

SEQ ID NO: 696864 - DNA, 192 bp, Homo sapiens
agggttggctctagaaggatccccacaagctacaggatgttcagacgccaagcaatgcaatcaccataaaccacgtgaagagtgaagttcctgagagtccggctttcctcccattcttgtgtcctccatgctttgtctctctccgggccccggggctgctgctgccgcactcgtgctaccgctgccggagcc

SEQ ID NO: 696865 - DNA, 591 bp, Homo sapiens
  misc_feature (21)..(21): n is a, c, g, or t
  misc_feature (55)..(55): n is a, c, g, or t
  misc_feature (81)..(81): n is a, c, g, or t
  misc_feature (91)..(91): n is a, c, g, or t
  misc_feature (116)..(116): n is a, c, g, or t
  misc_feature (176)..(176): n is a, c, g, or t
  misc_feature (187)..(187): n is a, c, g, or t
  misc_feature (282)..(282): n is a, c, g, or t
  misc_feature (336)..(336): n is a, c, g, or t
  misc_feature (339)..(339): n is a, c, g, or t
  misc_feature (348)..(348): n is a, c, g, or t
  misc_feature (518)..(518): n is a, c, g, or t
  misc_feature (576)..(576): n is a, c, g, or t
  misc_feature (588)..(588): n is a, c, g, or t
cccggaattaactaatccctntttaagccaccttgaaaaagtctaattagcaaanatctctcaaaagtatccacaggcttntttcaaatcngactctattgttagtagctggtcantctccattggagtaatccatcgtatgtgcttattattcatatataattccggtactgcantcaaatatatnaaagctgctgaggcccaaaacttcaaaaacgaactgctccacagtggcagcctccatgtgtgcttcaccaggccctggtattcaaaggtgtctancaggagcttggcggcaccctcggaggtaacttctgccgcttctggaacgtctcnccnagctcccgntgctcgcccaggtccaggttggacgccgaggacgtcggggtcgcgggagtcggcggcggcggcggcggtggcgggagcaacgccagctcaggcggcggcggctccccggccctcctcctgggccctgcggacgaggcctcaccgcggcttctccgacgcggcttctccancgcctggctcttgctcccggcctggctacggagcgccgtgtgcgggtggcgctgggtncaaggcagcggncgc

SEQ ID NO: 696866 - DNA, 212 bp, Homo sapiens
caaacagccctatttacagttctatgtaccaagcttaagtttatcatagaagagagtataatggaataattcaacaaaagctaagtttaacatcatgaagttatacatgaataacctaacagtaaataacagtagcccaataccttcctaatatgaaatcaactgcaaactcaaataaaatattagtatgcattaaagtgtgagataatata

SEQ ID NO: 696867 - DNA, 499 bp, Homo sapiens
cccgttacttaccctgttgggaggctaggaacgtagtgcacaccacacggaaagcttggcaagaacagtgcccggggggtccatgaggctgtgcacttggaggagtcagtgagcaggcaggtaggatgtggcccagcaggaccagtgtcacttgctgcatgtccaggcagaagatggagtagagcagctccactgcccgcagtgtgtgctccttccgcgtctccttcagcagctccttaatcaggttgttgcagaaccagtagacgccgtccatgtgcagcagtctgtcaaagatgtggatggggcggctgtccacccagcccttctccagcaccttggcaaaaatgtcctgtcagcacctctttgatgggccgcttggggggcaagcaggttcccagtagggcattgtgtccaccccggtggagggaaacttgacctgcgttggttgtcttgcttgagcacgtcggcaacatgcgctccatgatcgagtcatgatcac

SEQ ID NO: 696868 - DNA, 106 bp, Homo sapiens
caagcagttatacagactcattgtctgtgttgatgtggtagcaacacgctgtgtttgcaattgactcgtggacacttgtgaagaagctggtctcatagtactaaat

SEQ ID NO: 696869 - DNA, 169 bp, Homo sapiens
ttatcgaatcgagctcggtaccgaacgggtgatgcggttggatggaagtctctcagacctgagcctgacaggggaggagccgttccctggaggcatgcccagggggctcaggctcagccctgagtgcccagtccactgagtgccctgtgaggggctacagtgggcgggg

SEQ ID NO: 696870 - DNA, 416 bp, Homo sapiens
cactcatatttgcaatagtactcagccaataggagccatgtctacatataggtgctgaaaaaggataatcttggtcacatggattcgcgttggtcgctcatgggctgatcattgtccaatacattcagcattatgacttcgaccctatagactctaggctcttccgtatgacattcgacaactgttccagcagcacggcacaatgcgttaccaatgctgtgtgacactgatgtcagtagcccaggccctatcttcctcctcactattcaagtcatacaacctttggtgctcctcaggctatgtctacttcgcaagtactttcttagtccgtaggtgtctgcacagagtgtgttacagtagtagcagttgccgttagagtcaacaatgctcggaactccttctcacgtagctctgag

SEQ ID NO: 696871 - DNA, 272 bp, Homo sapiens
  misc_feature (21)..(21): n is a, c, g, or t
gagtgtggatcactaggactnataaggcgggagcctgggcctgctatttagcctctttgattctcactttcttcattagaaaatagttttgagaattaagagagagagagaatgtttgtaaagggtatagcacagtgtcaggcacggggaatgcttctgtgctttaactgtcattaccaccaccaccatcaacatcactaccaccaccagtgtcatcactgccaccatcatcgtcaccatcagtaccaccatcagcatcactgtgtctatag

SEQ ID NO: 696872 - DNA, 478 bp, Homo sapiens
gtcgacctttcaggatttatttgcctttgattcatatttcattgttctgtttctacagcaacctgggacagagcctcaccctattcatacacttaaactttcacttacccttaaaccttatctctacctctatccctaccactaaccctacgccaaatctaacctcaagataaaacccaagaccaacccctacctctacttctattcctacccctatccctgatcttaccactaccacaaccccaattttaacccctacatcaacacctagccctatctctatgcctaaccataccactaaccccattactaccactaccccaatatcactaacctgactcctgtacctaccactgcccttagcattacacttacccaccatactctgacccatacccttacagttaccgctaccactaatcctaaatttacccttacctactcttacccaaaccttacattgtcgacgcggccgcga

SEQ ID NO: 696873 - DNA, 216 bp, Homo sapiens
cccctttccccaccacatacccacaaccgcacaggttaaaacagaaatcttgtcattttataattgtaatccacgccgggtgcagtagctcacacctgtaatcccagcactttgggaggctgaggcggttggatcacgaggtcaggagttcaagaccagcctggccaagatggtgaaaccccgtctttactaaaaatacaaaacggtctcacgaat

SEQ ID NO: 696874 - DNA, 140 bp, Homo sapiens
gctggctggcctcgttgcccgccgaggccatggggcctgccgccggactctgttcactgggtcttctgtctttcttggccgactttccagcgtcccttcttcttcttgtcgtccttaggcggtggccgctggctcggcgg

SEQ ID NO: 696875 - DNA, 585 bp, Homo sapiens
  misc_feature (115)..(115): n is a, c, g, or t
  misc_feature (127)..(127): n is a, c, g, or t
cagagaataaaaaaatataatttagtattaacacgtaatattagtttcaataataaatggaagtttccttggctggaagtcctagcccagccaatcggacaagagaaagaaatanagcacatcgganttggtaaagaggaagtcacactgtcactgtttgctgatgacatgatcgtatgcctagaaaacactaaagactcatccaaaaagctcctagaactagtgaatgaattcagcaaagtttcaggatacaaaattaatgtacacaaatcagtagccctgctgtataccaaacagtgaccaagctgagaatcaaatcacaaactcaaccccttttataaaagctgcaaataaataaataaataatacttaggaatgtacttaaccaaggaggtgaaagtcctctgcaaggaaaactacaaaatactgctgaaagaaatcatagatgacacagacaaatggaaacacatcccatgctcatggatgggtagaatcaatattattaaaatgaccatgctgccaaaagtaatctacaaattcaatacaattctcctcagaatacaccattattcttcacagaactag

SEQ ID NO: 696876 - DNA, 364 bp, Homo sapiens
ggtcccaaataccattgggggttggggcaaccatttttttgggcccggccccttttttttttttggaggagggcccttaattgcccccaaaagggtagggggaaaggggttgttttcccccccccctttttttttggggccccaaaaagggaggggttttcccctaaggggggaaacccccaaaccctggggtacccccccaaaaggggggggggggagaacaaaaccgggggctggccatggggcgggcccccgaattagggcccccccttttttttctgggaagggggggggggccttaattttaacgggccgttttttttttcttttcccccttgaaaaaaaggttttgtttcttccctta

SEQ ID NO: 696877 - DNA, 866 bp, Homo sapiens
atcctaacctatggttgcgtgatcgtgacgacaatctgctgcagttctcgcgtgctccaatctgcgacgcaccggtatctatcgtaaacgaactatcccacgtgcttatacttcgcacacgaaaccagagcaggaagacacaggagacatataccaggccggccgcggtgggctgtttgttggagcgtccactggacgcgtgctgaagtccccgggccgactgtctcgggcgcaggtgcgccgcatgggacgggggcacagccgtaacaactagagcgctgcaggagcacggtgtacggtagaaacacaaagccgtgaaggtcaggcccgatcgcggtggaagaagcacacgctctgatccttcgccttaaaaacaagtcaacgacacagactcgaacgcacgtagggacggtcgcacctggcagcacaccgaccagggttatccggtcacccggttttccccagccccattgatccatcccgcaggttgaatacccagcgatagtaggggcgattgaccgcgttaggccattatttccttgttgcgcccataacacaagggtcacgcgctgatccggaaaagtgcccgcgcagcaccggggcgataacccgttcaactcggccttccaattcgtcccccgaggttcgtacgccaacaacctacttctcctactgccttagccatttctgcgccaacaacgactaaccccaaaagaacacaaccaacgggcggcgaaccttcgcgctcatccacacaagcactagcgccttcaacccacccagcgttcaacctcctcacgacaagcaacaacaacgcaccctcccccccaacaagcaaccaccatcacacacccaaccttcttcca

SEQ ID NO: 696878 - DNA, 1489 bp, Homo sapiens
  misc_feature (475)..(475): n is a, c, g, or t
  misc_feature (692)..(692): n is a, c, g, or t
taattacttttatttaaatggctgaatttactccccgtgccataagttttggtttcttcagtttctctctgtgggatatattcttttttcttctctgtgggcaacctctcctctctttctgtggttttaaggaacaatctcgtgttctccttttctccgataaggattcattcctcaagtggtggcagggaagagcctcagtgttatgtgggtttaactccggaccatgtaagccctcgtgtgtaggtctccgggcgggcgcatctcttatagaggtgctgtgtgtgtctcaccttgtgcgatttgtgtcctcacatgtgaccgagaaaaagaactctatatcagtctataacacccccttataagttctcagagacattatatctctctctctgtgcggtgtatttaaagagacagtgtgtgtgtcagagacacacaataattctcacagacacctctctcttgtgtgtgtggncacacgccagagctcttgtgtgtgtctcccaggcccccacatagtgtgcctgtgtggcccctgtgtcggacacaccaccctgtgcacacaatctctcacaccacactgtgtgacgtaacccgtcctcgagggctctctgtgaacccacgagcacccacaatgtgggccgggtgtgtgcgacaaagaaacaaggcgcgccctttacagaaaagggggnggcgaaaaacgaggggagccccacagaaacaacacgagtgtggtgtgtgaactcccatattttcccctacagacaaacacgtcatgtgggggctcctgtgacgtgtcgtggaaaaagcccaccgtgtgctatagtgttttctcaaatatattatacgagaaaacctatgtgggggaacagagaccggcctccgtgttaacacccgaggggaaacctcccagagggggaaacccaaatagatgtgtggccatctctgtagaaaggggcgctcctccaagaggggggctcccggagagaagtgatttcgcaggacagctgtggaacgcctcccttgtgcccgtgaaatttgtgcggcgacacactacgtggctcgttgacaaccggtttgtgcgtcctcttttctcaagccaaaaaacatctttttccacagaggcggccgtgtggaattttcacagcgtcgtgaaacgagaatattcggttcccccacacggggcgtctctaacaaacaacaaaccgttggcgtcctctaggagcaataaaaaaatctttttcccccaattcggggcgcgaacgttgtgaggagatcctttttaaaccaccccgcggggtgtgagaccacaacaactttcgtggtggtgtttccccccacggatggggcgtccccaaacaaaaccaaaatgtttctgtgcgggacgcaacacacaccattgggtgttgttggaaaaagcgtccacaacagggttggatgaatatgtcttccacacacacactaccacccggccgaggggatgcacctg

SEQ ID NO: 696879 - DNA, 255 bp, Homo sapiens
ttatgcggtgcctttccttctgacatacatcagctcaggctcgacatctcccgtctgggatagccatgtccctttctccagttctggtgcttcatatatgacacatatatactatattttttgccttttaagcttaaacgctaatataatttggattggccaaataattaagaaattcagctggtctctgtaaagggttaataaaaatgtaaattgtgatataatggagaattaattgaaacactccaaagcaga

SEQ ID NO: 696880 - DNA, 231 bp, Homo sapiens
gactttgttaatcatcacaaacaataccaacaaccacggttagaaatgctgaatacctattacacgggtcagaacgtgtcaatcttaacacctgataaccgccgaactggggatggtagtgacgtgcgacttactcacccatttggtcgtgaaattgcagacttccaagctgggtttagtgttggtcaaccaatcagtattgacgtagatgacagcggtgcaaggcaatca

SEQ ID NO: 696881 - DNA, 311 bp, Homo sapiens
agcacaaataggaagggtccccaggttggggagagccaagtagagaacaataatgaacaattactgtatgaacaactgttagagacagctaatcacaaacaaccgcgggcacaatgacctcattccacacgtagcacccttcagcaggaccctataaaactttcctccagcccctgcctctttgcaggtagccccttctctgctgagctgcccactgcaacatattttcataatttctctaataaatctgcccttctttacctacaactatcttggtaaatggctttaccacctgcaaaactgaccctagg

SEQ ID NO: 696882 - DNA, 147 bp, Homo sapiens
agctcatacgcaggttgtgctgtcggaggttgtgctggtcgagttgtgctggtcgcaggttgtgcaggtcgccaagttgtgctggtgccaggttgtgctggtgccaggttgtgctggtgccaggttgtgctgggcccaggttgtgct

SEQ ID NO: 696883 - DNA, 290 bp, Homo sapiens
tgcttcaagtcgatctacgagtatccccgtcagacgctgtaactatgtgcctacatcgccagtacaaccgcttcgagtaagcgcctcatgaacatgtctgtacaccaacttcccctgctttagagcacgtccagattggtgacatcctcacagtgggccagtgccggcctctgagcaagacagtgcgcttcaacgtgctcaaggtcaccaaggctgccggtcaccaagaagcagttccagaagttctgaggctggacattggcccgctccccacatagttcagcgtctga

SEQ ID NO: 696884 - DNA, 336 bp, Homo sapiens
ttaagggacaaaccacagtgcttccattattcatgttgtgaatgtccctgtggggatgagcacagaagtccaggcaatctgtgaccccagagaagggacgatttttcgtgctgcgtttttgacattctcgggcaacattttcatattttatttgattttggtaagctactggagcatactgcttataaattggagctaatcgtgtagccaaactctgtaagttatcttcaaggattttttcatgtaagggagagcttggatcaattctaaatcttctggagcttgggcttttaccaaacttacagtcattaaagtacatactccatgaacagtcta

SEQ ID NO: 696885 - DNA, 236 bp, Homo sapiens
  misc_feature (34)..(34): n is a, c, g, or t
agcaggatctagttactggcatttcgcacacatncatatggatgtggatccacctgcatccctcagcccgccccaccgcatcaaaaccaggtctttcagaggctgcctgctcgccagaagaaactaatgactaagctctacaaaggagcccaaggaattggtccaggcgagagtttcacaatatgaaaagctaagactgaaagagctagagactcctctgccaccattacccctaa

SEQ ID NO: 696886 - DNA, 431 bp, Homo sapiens
aattttgaaaaaaaagtagtggtcttactaaagagatttacttgcatttggataatttataactgcacataatttataactgcattcaaactctcaaaaaataattcttgtaattatcaaaaagaaactgtaattgccgggctgggcacggtggctaacacctgtaatcccagcactttgggaggctaaggcgggtggatcacctgaggtcaggagttcaagaccagcctgaccaacatggtgaaaccccgcctctactaggaatagaaaaattagctgggcctggtggcagctgcctgtagtcccagctactcgggaggctgaggcaggagaatcgcttgaatccgggaggcagaggttgcagtgagctgaggtcacgccattgcactccggcctggggaacagagcaagactatgtcccaaaaaaaaaa

SEQ ID NO: 696887 - DNA, 279 bp, Homo sapiens
  misc_feature (151)..(151): n is a, c, g, or t
gactaagtcgtctcccatggtgctgtaaggaatgctgagactgagtaatttataaagaaaaggggttggctgggcacggtagctcacacctgtaatcccagcactttaggaggcagagacgggtggatcacttgaggccaggagtctgagnacagcctagccaacaggtgaaatcccgtctctgctaaaaatacaaaaattacccgggcatggtggcgtgcacctgtaaacccagctactcgggaggctgaggcacgagaattactcggacccaggaga

SEQ ID NO: 696888 - DNA, 447 bp, Homo sapiens
tgctagccggagaggaggtgcagtgagcgagatctggagtggcttcacctgggggtgaggagactctgtctccacaatacaatgaataaatacataaaatagattgtgatgacggatgcagaactctgtgaacatactaagaaccattgaattggatgctgtcaaagggtgagttgtgtggtatgataattctatctcaataaagcagttacaaagagaggaagagatggcataagaactggaagcacagtggcaatgggacagaattttaaggaatggtttgagactgagtggcaggcagactggggggtaaagctaagagaaccctaaaggaaaggggaccagcttgccccgtaagtggtgtggggctaggttaatagattggctaatgcccaggagatgtcagtgtgcccatgcgctggtccctgccatgtaggaacacgtagg

SEQ ID NO: 696889 - DNA, 175 bp, Homo sapiens
gaatttgacaggctgaaagctattttaaaagttttctttctgcttattcaaactcttagcccagcgtaccatgtcttgggcaatctgctgggctgtcttgctcttggatttctccttcttctcttacccctctttggcaggaggcaggcccgactgctgatgggagaagactgcg

SEQ ID NO: 696890 - DNA, 469 bp, Homo sapiens
agcggcggatctctcatcgctttgctcatcatcgccattatgccttttgccggttgtcgccccactcaggcagcccgtgtcaccaccaccacaccacgcgcctgctacaaggattgtgcaccagatgaatgcagcgtgaaaatgggtatttatttttctccttttttgttcaatcttcttcgaatcgaagagaagcaaagcgcacgctgcgcacagttttgagcctgtttttcgcctccccctcgctcaacacttggaagttgtggaagcttccggggatacgtttagaacggatacatttagattaacgcaggacagtggcaggcgtgggccagggcacataagacattaaacttaggcaacaacaagacccttggtaaacaggaacgaatagaaacgaatgtgaaaacaatattgtgttcggataaaacaacaacaaataaaccgttgaaaaaaagagtatactaca

SEQ ID NO: 696891 - DNA, 598 bp, Homo sapiens
  misc_feature (335)..(335): n is a, c, g, or t
tacttgcgcgggatatagtaccgtaaggcgaaatgattgacaattatcacctaagcataattatatccataggactaacccctataccttctgcatatgaattgacctagaaataactttgcaaggtagagctgcagcaatgatcccgataccacacgagctacttatgaacagctataatagcacacccttctatgttacgcataataatttccgcaagatcttatatgctgaggcgagcaaccctaccgagcctgtcttattcctatcttcttttcctgtaatgatattagttcaactttaaatttgcccacagaaccctctaaatcccctgntaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcg

SEQ ID NO: 696892 - DNA, 118 bp, Homo sapiens
gagctgaggagggtagtgaccagcacgatgttcccgatggtgctgatggcacgaacatgcactcggcacgtgtttcaaccccttggtctgttgatggctctgagtggtcggagcaccc

SEQ ID NO: 696893 - DNA, 652 bp, Homo sapiens
  misc_feature (43)..(43): n is a, c, g, or t
  misc_feature (132)..(132): n is a, c, g, or t
  misc_feature (151)..(151): n is a, c, g, or t
  misc_feature (154)..(154): n is a, c, g, or t
  misc_feature (176)..(176): n is a, c, g, or t
  misc_feature (190)..(190): n is a, c, g, or t
  misc_feature (200)..(200): n is a, c, g, or t
  misc_feature (205)..(205): n is a, c, g, or t
  misc_feature (240)..(240): n is a, c, g, or t
  misc_feature (242)..(242): n is a, c, g, or t
  misc_feature (289)..(289): n is a, c, g, or t
  misc_feature (325)..(325): n is a, c, g, or t
  misc_feature (351)..(351): n is a, c, g, or t
  misc_feature (374)..(374): n is a, c, g, or t
  misc_feature (377)..(377): n is a, c, g, or t
  misc_feature (379)..(379): n is a, c, g, or t
  misc_feature (386)..(386): n is a, c, g, or t
  misc_feature (405)..(405): n is a, c, g, or t
  misc_feature (417)..(418): n is a, c, g, or t
  misc_feature (420)..(420): n is a, c, g, or t
  misc_feature (438)..(439): n is a, c, g, or t
  misc_feature (447)..(447): n is a, c, g, or t
  misc_feature (454)..(454): n is a, c, g, or t
  misc_feature (508)..(508): n is a, c, g, or t
  misc_feature (567)..(567): n is a, c, g, or t
  misc_feature (622)..(622): n is a, c, g, or t
tgtaacaacgcatcttatatttggaatgactattaaaaaaacnacaatgtgcaatacaaaagtcctcggccacattgtgaactttgggggatagactcgctccaaccgactagctgttaccttcaccgttcnagtttttaaatcctgagtnaanccaaaaaaaaaaaaaccaaaanaaaaaaaaaaaaanaaataaagcnatgcnattttttttttgttttttgcgaaagttaggttttntnaagaaagggtgttcgcaacttagttatagtccgcctagaaacatttncggtggacgatggaggggccggactcgtcataatcntgcttgctgatccacatctgctgganggtggacagcgaggccaggatgnagncnccgatcnacacggagtacttgcgctnaggaggagcaannanatagatcttcattgtgannggtgccanggcagtnatctccttctgcatcctgtcggcaatgccagggtacatggtggtgccgccaganagcactgtgttggcgtacaggtctttgcggatgtccacgtcacacttcatgatggagtngaaggtagtttcgtggatgccacaggactccatgcccaggaaggaaggctggaanagtgcctcagggcagcggaccgctcattgc

SEQ ID NO: 696894 - DNA, 324 bp, Homo sapiens
  misc_feature (21)..(21): n is a, c, g, or t
  misc_feature (38)..(38): n is a, c, g, or t
  misc_feature (51)..(51): n is a, c, g, or t
  misc_feature (79)..(79): n is a, c, g, or t
  misc_feature (277)..(277): n is a, c, g, or t
  misc_feature (280)..(280): n is a, c, g, or t
ctgggaaataaagggcctttnaggcttccccctaatgnctggtggaaagancacccattttgtaaggcaccttttgaancataaagcactgtgtgaccagcgctgggatatccatggctttgggggggggcctctcccctgactcccatccccataataatgagttttgtttgggaattggaataaggaatggactggatggtttaggaaattataaatatttggtcacgtggcctctctgaaaaaattggacccctttttcttttttaaaattttngtngatcttcgtagtaatgtaattgtattttatgcctgcttttttat

SEQ ID NO: 696895 - DNA, 202 bp, Homo sapiens
cctagaacgagtacgcatctataaaacgttgttgcgccctacattggtggctcttttttggttcaaccttctgctttagatttccagttctgccggaaccaggctccctatgcaattgtctgtgctttcccgtatctcctggccttcaccaccgactccatggagatccgcctggtggtgaacgggaacctggtccacactg

SEQ ID NO: 696896 - DNA, 264 bp, Homo sapiens
cgcgctgacaccggtacgaggcaaagaaaaagaatctcttgctccagttcctgatggactcctccatgtccttcagcgagcgctcgtcctcctcgaacttgttgcgggcctactgggcagcatcgatgaagagcctgcgtctgctcgccgtagggcgtcattttgtcttcctcagcagggctggccgacttgggctgctccccctgcacctcggaatcctcctcctcctcctcttcttcagcctcttccttatgtgcgcgtgac

SEQ ID NO: 696897 - DNA, 854 bp, Homo sapiens
  misc_feature (10)..(10): n is a, c, g, or t
  misc_feature (76)..(77): n is a, c, g, or t
  misc_feature (110)..(110): n is a, c, g, or t
  misc_feature (147)..(148): n is a, c, g, or t
  misc_feature (166)..(166): n is a, c, g, or t
  misc_feature (168)..(168): n is a, c, g, or t
  misc_feature (205)..(205): n is a, c, g, or t
  misc_feature (233)..(233): n is a, c, g, or t
  misc_feature (264)..(264): n is a, c, g, or t
  misc_feature (288)..(288): n is a, c, g, or t
  misc_feature (328)..(328): n is a, c, g, or t
  misc_feature (361)..(361): n is a, c, g, or t
  misc_feature (384)..(384): n is a, c, g, or t
  misc_feature (428)..(428): n is a, c, g, or t
  misc_feature (477)..(479): n is a, c, g, or t
  misc_feature (848)..(848): n is a, c, g, or t
aatataatgnctgaagactgtcagcgtctgattcagctccagcatccttggccacctccccacccgggagtcaagnntcgtggttctgccttgaacaggccacaggcgtngctgtagagacgccagtcgtcacaatgacccacgacnngccgcggagcctggcttntnggaaggggaaggcccaggcctgtgccgggccccaggnctggcagccaccagctcctcttccaggnatgggggacaccctgacaggatccggaagtntccatttacccaaaaatgcaaganccatgatcagtcatggcgacactgcaggcggtactgagtnaccatgtccagtccggctccgtccctcccacangggggacaagcttctcccgaggnggcctggccaaggtggaacaaataccctgatgtcgaaaaatgtntaaaaatcccacagacggaattttcaaaaagaggagaaatctccccgtnnnttggaggcagcgagactccgaacacggtagcaagcactcctggacagactcatgtatgaaaaagtacatcatggtttcaggaaacaagcccccacccagggtgggctgcctggagatggatcccctttcccaaaaacccgaaaagccagaaggaagagacggggggtgaacggacggtgtgtaggggtgaggtgtcacttcagagaggttccctgggtttccggcgacgccctccttcaagcgaggccgcagtctccggaggcgtgcgctgctgctgggtgtgcagcccccgaggggtctcggcagcgcccgggtctggctttgcgtattacagttcatctttcacagctttctgatcatcgtcttccnccatgt

SEQ ID NO: 696898 - DNA, 258 bp, Homo sapiens
cgtttcaaatctgattataaagatgcatatgccctatatggcgaatactaactacaaccgcaaatgcaatgacactgtaaattctaaggtcctcacgagaaaatctcgagaataaccaaagtggcaacaatggaaacgtttggctggaaattagtaagttatatcagtcatctttgtttttgggtccatgttacaggatgcgtgtgaactcgatgtaattgacaattccccttttgatcatttggtgcttctctgttc

SEQ ID NO: 696899 - DNA, 187 bp, Homo sapiens
ctgctcgtgcattcctccacttgttagttcttcaattctgaggtcctccctgagaggaccatcgtcactgtaccctcaagatgcgttcactcccccgactcgttacggtagctgtctgctcttcccgcatgtgcaccagtgcctgcttgcgattgtttcccctactccaacttgctctcgatgacag

SEQ ID NO: 696900 - DNA, 371 bp, Homo sapiens
cccaagcgcgaaattaaccccccctaaagggaacaaaagttggggcccccccccggtgggggcccctctaaaaaaaggggatcccccgggctccaaaaatttggcccaaggcaaaacaaaacaaaatttgaaagctttttaaaacacccagggcaccccggcccccaggggccagcctggccaacatggggaaacccggcagtttttgttcaagtgacaactacccggaacagtggtgtgaagacctgtaatccccggtcccccgggggtttgggcccaaaattttttatgcctcgcgggcgaaggttccagtatcccaattttgcccccatgcccccccgtttggggcaacaaaaataaactttgtcccc

SEQ ID NO: 696901 - DNA, 232 bp, Homo sapiens
  misc_feature (38)..(38): n is a, c, g, or t
  misc_feature (212)..(212): n is a, c, g, or t
  misc_feature (218)..(218): n is a, c, g, or t
tggagctgcccccacaatggctggctctcccacaactntggccatcatgaagacgctggtgtcatctgctcagcttcccagtcccagccgacacccagcccagacacttggccaacctcacatgcatcaacagcaggatctgaatccagtttggccctgaggctggtgaatggaggtgacaggtgtcagggccgagtggaggtcctataccnaggctnctggggcaccgtgt

SEQ ID NO: 696902 - DNA, 108 bp, Homo sapiens
ggcactactcatttatagcagtttgttcattttcatttctgtatagtttttcattttaagaatacacaattttgccaggcgcggtggctcatgcctgtaatcccagca

SEQ ID NO: 696903 - DNA, 478 bp, Homo sapiens
acagatatgcatccagtgacagcagcgcccaccaaataatgagcatagtcgatacttatatacgggataatgcattacgagctggtactggttaacttgcaccttgactcgtagaagatgaattggtgaataaatagtctctgcccagccgcgttcagtgaactctggacgtgcatccataaaagtatatgactctcaacccttctactaagaggaagaatactggatccccagacaggaagccctcaaagaagtccaagacagacagctcttctcttagttcaccactaaatcctaagttatggtgtcacgtacacttgaagaagtcattgagtggctcgccactcaaagtgaagaactcaaagaattccaaatctcctgaagaacatctagaagaaatgatgaagatgatgtcgcccaataagctgcacactaactttcacattcctaaaaaaggcccacctgccaagaaaccagg

SEQ ID NO: 696904 - DNA, 158 bp, Homo sapiens
ggtatcttatcgtcttcaaatctccgacttacgttattgtttaacgaagatccttctaggcataatgcttcggctcttggttccgatcttgtcgccgatcccagaagtttcactctcgtagtggtgctactacgatatgccgcccggccagtccctcg

SEQ ID NO: 696905 - DNA, 719 bp, Homo sapiens
gatctattttgaatgaactctaaattagcaataaatgccggtcttgtatactgtgactgtgatctgctttgagaaaaccggttacttcgttattcatgcttgttgataaatatcttatgctgagtattttcacgtatcttccaagtactcagcgttattcgtatttcaaataaggtcagaccttttatacttttgaccatgatagttattttctatgttggacacttagttatttaccaaagcctccgatttgtgatgcagtgtttagtagtccttgtaaacaatatatacagactatacaagaattaattttatctgggcttgtcaaaaaccatatttgcattccagaaccaaatcttaaatgagaccaaagtccaggttagcacaggtttttatttgtacctacaggctaacattgagatatagttcacataaatgacttggagttttatgttcatgaaaaaattagggattatgttcagagtactatttttctccattttagttaagtagtacttacacctcattgtttagatgtaacttgctgtgtctgaggtataaatatagtctgtgggagtgagagggaaccagtcctacccaatttgatttgactattctaaatctatggaaactgctaaatagatatttctatagatagatatggtaattatgtagctctgtgggagtaactttgtaattgtataatcagaaacactatt

SEQ ID NO: 696906 - DNA, 245 bp, Homo sapiens
caggttctgtggtggtatagatatatatagcttttcgttcatggttcctggcttctcaattcccatacctctatgcatacatgtcatttgttattatattggtgtgtcaggcgtcaggaaatcaggatctctctcctgccctccattctacctgtctcaaggtcgagaactctgattcttctaccaccattctgactgtgggtcataagacccacccggagagagctcctatccataaccacctg

SEQ ID NO: 696907 - DNA, 937 bp, Homo sapiens
cggcgctcgtcttcttactacacggcggtctattgattcacgtcgtggttgtaccccttccttgtgggtggtgtctccgcctgtttggtcgaccactttattagtgtggtgttttcgtggctacaccagcagtgtgttccgtctcctcccgccccggttctttatgttgttgttgggtcgcccctccctcgttctgcgggctctgtccgccccgccccgttgtttagtagggggcctgttgtgctcccccctcgatgttattgtcggtgcctactaccttggtggagggccgtcctcctttttgctgctttacgctttcttgtgccgccacgcgttgttgtgtgtgttttcgcccccctgccggctctgccgccgcgcgtcgtggtcggctggcccgccccgccgctcctagctgaatatttgtgccgctgtcttttttctcttcccccccgcaccggttggttgttgtgtgtttcgatcatcatcacgttttcgttctttttatttgttaaatacaccaccccaccacctccgcttgcggtccctcctcttgttgttttgtgtgagggcgctccgccgcccggctctccccctcccccgccaatattttttttttttatacgcgaaaatatatattttttcctcctgacgtctcgcctccaacctaattctttgtgtgggataagctccttcgtcatttgttatggtacacccacaaaattatttttgtttttatagcgaaccactccctcctcttctgtccgttagacgatatttttctattgaactgcctggcttttagtgttggttgtgaagaatactgtttccccctcggcgagaaaagaccaataaacttttttttttttttttgttttttttcccccccccccccgttgagggtgaaaaaaagaaaaaaaaaaaacgatttatagaagga

SEQ ID NO: 696908 - DNA, 749 bp, Homo sapiens
  misc_feature (202)..(202): n is a, c, g, or t
ggtattcccgccgtcatatgttaccgtgtggggatgcctctccacccccctccctgtgggcccgctggcggccaccatccctcctttttagcgggagatacattttcgatgattgtggcgcaccttttctctctccaagcaacatcgcggggccccgggcatatctcagtgtcccctgggcgcaaacagtgggcgtgacccncaccaccctcgtgggggtctccccccacgtgttttgacttttcgccgcccatctccccccatgggatgcgggatttggtgcaggaccaacgacatggcggtagttggtgcgcaaaatgtcatagaggcgccactgatactctcctgagtaggacccccggtggccctctctggggtccccgcagtagtcgtctcacggaacccctcccccaaaccgagtctccaccgcttggggtcgctcggtggtgcacatacttgcgaataatgacttgtgaaccctcttgtatgtttatctattaattccccccctcgagtcacactcctcttgcgccacgcaacagaagagtcaccccctcctcacccccacctttgtctccccaacatccctcagaattaatttctgcgtcctctcacgcacacttcccctttggtgcggtcacacgtctttccatctcttcccccccacaccccatgaactgatagcacacgtaaagtttaatacgaacagttaatgaaaataaacaacaataaataatcgccacaaaaca

SEQ ID NO: 696909 - DNA, 229 bp, Homo sapiens
agctcgtcaagagatgtctgttataggtggacggctcccgcggtgctgcgggccttctcctgatgtctcgggtcttctgtccgaagaggcctgcgcagtgctctgttcccatgatcctgcaagacaggaaccctacgagggaggaaactagcaatgctgccccgtctcaccgcgctggaccacgactagaagggaatcagacgatgaccagccacagtgaagagcgaca

SEQ ID NO: 696910 - DNA, 254 bp, Homo sapiens
  misc_feature (31)..(32): n is a, c, g, or t
  misc_feature (68)..(68): n is a, c, g, or t
  misc_feature (128)..(128): n is a, c, g, or t
  misc_feature (139)..(139): n is a, c, g, or t
  misc_feature (168)..(169): n is a, c, g, or t
  misc_feature (177)..(177): n is a, c, g, or t
  misc_feature (182)..(182): n is a, c, g, or t
  misc_feature (184)..(184): n is a, c, g, or t
  misc_feature (186)..(187): n is a, c, g, or t
  misc_feature (205)..(205): n is a, c, g, or t
  misc_feature (245)..(245): n is a, c, g, or t
  misc_feature (248)..(248): n is a, c, g, or t
ctccttccaagagcgttctcttttttttttnnttgagacagtctcactctatcccccaggctggagtncagcggcgcgatctcggctcactgcaaccaccatctcccaggagaggcgggagatttttnagcagcacctnaagagcctgaagctgacccagtccagcannttttactnccagngncnngcagagctgacaccaggnttcagtggggctgacatcgccaacatctgcaatgaggctncgntgcacg

SEQ ID NO: 696911 - DNA, 327 bp, Homo sapiens
  misc_feature (322)..(322): n is a, c, g, or t
tgagatttttatttgttgagatgacccaagtgaaatttcttagaaatgtcttctgccagataccctaaattatctctttcaagttcaaagttccacagaatctctagggcattggcaaaatgctgctagactctttaaaagagaattttagaccaatatccttgatgaacattgatgcaaaaatccttaataaaatactggcagaccgaatccagcagcacatcaaaaagcttatctaccatgatcaagtgggcttcatccctgggatgcaaggctggttcaatatacgcaaagtcaataaatggttaatccagcatataanacaga

SEQ ID NO: 696912 - DNA, 227 bp, Homo sapiens
gggttttccctaggggggcccggggggggaaaggcccccgggggccaagacccttttgtttttcccacaaaagattttattttccccaggggggggggggaaaaaatcaaaaagttttcctccccccgggaccggggggggggtccggtcctccccccagccaggggcacggggaaggggaaaaagagaaattgcccctgaaggttcaaaaaagttgtttttttgga

SEQ ID NO: 696913 - DNA, 782 bp, Homo sapiens
taaaatttttgaggcggggtctcgctctgccacccaggctggagtgcgggtggtgtgatcttggctcacggtaacttccacttcctgggtttaagcaattctctcgccttagcctcctcagtagctgggattgcaggtgcgtgccaccacgcctggctaatttttgtatttttggtggagatggggtttcgccatgttggctaggctggcttcgggctcctgacctcaggtgatccgcccacctcggcctcccggggtgctgggattataggcgtgagccacagtgccggccctttcttttatcttttcatttaatcccttcatttagttcagtgggtctcagccctgttgatacattagaatttcctaaatgctttgtgtgtgtgtgtgtgtgtgtgtgtgtgtgtgtggctttttttttttgtgttgggaaatggggtctgtctctatggcttaggcgggagtgcaggggcacaaccagggcatacggaaaccccaaactcccaggctcaagacagacctcgtggccctaagcctccatgagtgacgggaaccacaggtgcaaatggccatgccgggcaaaataggggactagacatgtaaatgggctcacaaaacattgccccaggggtggcctatgaacgccgggggctacaaggagatcccaccgggcctggggcccccagaacgggtggaggatacacaaagcaggacgccaaaccacggggccacgcatttgaaactcaaaacgcgtcgtggtccccaggggacgacacaggacc

SEQ ID NO: 696914 - DNA, 197 bp, Homo sapiens
tgagactccacgtatcactccagacagcactaagtctactactgccagtctgtagctgatcctcgatctccatgctactgtggttcgagtgaaagacgataataaattctactcagggttgtcccatcatcacttcctggtgtacgttctcctgatccccctttactccctggacgattcccgtgttggcttccaag

SEQ ID NO: 696915 - DNA, 158 bp, Homo sapiens
tgggtattatcacttgcgttttcaaagcattagctctgaaggcataaccttttcttttttttttcttctgaaaaagacagggtctctttgcattgatccaacgctggagtgcagtagctaattccacaggcatgatcatcaagcaccacagccccaaa

SEQ ID NO: 696916 - DNA, 1543 bp, Homo sapiens
  misc_feature (558)..(558): n is a, c, g, or t
  misc_feature (1248)..(1248): n is a, c, g, or t
tgggaaaagtgggggtagggtttatgtgatgtggactcaaaacagagtgcggggccctctataaaataaaggggactcactcgtgaaattaactaaaaaagtgatatagctcttggcgcttaattttaacagggcgtagaggggtgattaacactctcatagctcagtgtttccctactcaaagagagacaccagagtgttacatatattgtgtgcgtactatataacacccacacagaagacacatatatgttatatacacccacacacatatattttttaacacattatacgtgggtgttctccctataccttataacactgtgtgtgggttacgacgcttatacgcgaaccttctcttatgagggaacacattgtgttggtacaagacgcgcgaggtgtataacattttataatatagaggggtgtcgcgtggattttttttgtgtgtgtgataacgcgcgggagaatatagtgtctttatacagagagtgtggagatatataacacatttctctgcgagggtataatatatacacaaacatgtgcgcgtataanataataatgtgagaagatatgttgtgggagggtagaaaaaaatgtgtctgcgtctggggagtatataaaatttgtgcgtggagtaaatatataattccccgtggtgtgtcgcgtggaaaaagcggggtgttaagtggggcccactaaatatatttttttaaaaatttctctatatatctcttggagggattttctctaaaaacagcgcggggcctctatatgggggataaaacactcttattaacatatgttcctcctatttttccccacgatgtgcgcgacgtgagagataccacccttttctctaaaacctctattaagaggtgggccccaaaaacagagcgccaagtgttggacttccgcagcgagagacactcttaaagcgggggggggacaacaacggcgcggtgccccaacacaatggtgggaaacacccctgctgggggacaccccattcccaacaaacaacggggcgtcggacaactgcggtgcgcacacttcaaacggggacaaacactcctctgcgcggtctgacaccaaacaacaacctttctctctctcttcagaacaaacaacgagaacacacaacaccacaaacaacagcgggcgggggggcgcggccaccaaaagaaaattaccccccaggagggggcgccacccaagatagctaacggctagcaaaccccggcngctgtgcgtgggcaaccacaggtgtgccccccaataatgaggggagcgcgcacaatataaacgacgcaagagaccctgggcacggcgtcatgacaacaagctgtctggagcgtcgccacagcacagcgacacagcggcgcgaacctctcgtgggagaggacgcaccacacatcggggggggggcacaacagctgggcaacacaccactagcgagatatagacctcccgggcaacaaacacatcagcggatagggggccgcaggcattgctgcgtcgacaagggtcgaggatagaa

SEQ ID NO: 696917 - DNA, 454 bp, Homo sapiens
  misc_feature (310)..(310): n is a, c, g, or t
tgtgtatgtactcagaagcagaattgttggccaggcgcagtggctcacggctgtaatcccagcactttgggaggctgaggtgggtggatcacttgaagtcagcagttcgagactagcctggccaacatggtgaaacctgtttctactaaaattacaaaaattgggccaggcgccatgactcatgccggtaatctcagcactttggcaagccaaggcaggtggatcatctgaggtcaggagtttgaaaccagcctggccaacatagtaaaaccacatctttactaaaaatacaaaaattacttgggtgtgnaggcatgtgcctatcatcccagcgccctccgccgcctcccccctccgaattggttgaacccgggaggtagaggttgcagtgagctgagattatgccactgcactccagcctggatgacagagtgaggctctgtctcaaaaaaaa

SEQ ID NO: 696918 - DNA, 404 bp, Homo sapiens
  misc_feature (384)..(384): n is a, c, g, or t
aggcaatgcccaagagagtgctgcccgccaggacgtagacctcatcaagcgagaactggaagctgcgattgccagtgatgtggagatggcctcaggcgcctatgaaaacttccgcattgctacagagggggctgaggccatggctcagaacgaggcacaaatgcaacgcgcctacgaattgggtgaggctgacctgcagtccctgctgctatctcgacgtcaagcagtgacatcggcatcgaatgcactgcaggcgcatgtcgatactttgcggactcacttgtcactgctgatcgatgcccattggatatgggggttggacgaaagctgagcacgctcgtttagcctgaagtgcccggcagggagtgccgtgccatctgtcanaatcgtaatgaacttatcat

SEQ ID NO: 696919 - DNA, 147 bp, Homo sapiens
gtgagatggcttaggcagctgagaggctgtagggacatttcacttggaaacaggcagtaacagtggccagttgtttctgttaataccatcaaaatatccctactcttgtggtgccttgaagaaagtccttcatttaactgagacatc

SEQ ID NO: 696920 - DNA, 391 bp, Homo sapiens
ggctattccaaaagcgcatatcgtggggtatctcagaattcttcgcactttctggcgcgtattaaatgattgggtagtgtttgtatcttgcctgtcattttctcatggcctgggcctctaagagtcagacaggtcttgcaccctcagaaagtccttgcacctttgagggtccgctgggcctgtaaccagggcttgctgcgtgtcccagccagcccaccggccgtgctccctgcagacgaggccaaagacagccaccagtccgatgtgtagagggaagacccccttcatgggagtctgagcacggcccctcggtctgccacaaagcagaacccactccatatggcctgtatatagggagagcacaggaggtgctaagaggcgcaacctgtcg

SEQ ID NO: 696921 - DNA, 564 bp, Homo sapiens
  misc_feature (18)..(18): n is a, c, g, or t
  misc_feature (79)..(79): n is a, c, g, or t
  misc_feature (101)..(101): n is a, c, g, or t
  misc_feature (165)..(165): n is a, c, g, or t
  misc_feature (232)..(232): n is a, c, g, or t
  misc_feature (510)..(510): n is a, c, g, or t
gcaacccagtccctccantccaggctttcccttaaccccttccccctagccagccagttcttcaattttcccccagccntggctacagtccccctacctanacccgcctccctaatctcaagtggatgacttcacttccctacttgatgaataaaattgaaatcnccagctagaagctccgtcagcttcctgctctctcccagcaaggggacctacacccacatccagtctnatcagtcccctttcttaaagtctcatgtacaagggtttcgaagctgtccttgaggtgccgtctcattgagacattgctctgccagtcattgccttgctctcctataatttcagtctctgtcttttgcttttgttcatttttttttttcagcaaagccgagaaatttgattttcagttactaaaatagatatctagcaagactaattggtgacgaaatggggggaaacgtgcaaacaagtaacactaggaacaaaacttgtgaacataactacaatagncattttttaaatcacaggattcagtgaacaaaaactatgaattacttcatgcca

SEQ ID NO: 696922 - DNA, 563 bp, Homo sapiens
  misc_feature (214)..(214): n is a, c, g, or t
gtggctccagtttgggcgacacgaataaacttgctatacacattcatgttcaggtttttgtgtagacaagttttcaacccaagtaagtaattatttagagcaattgctggattgtgtgggaagactgtgtttagctttttagaaactgccaaactgtcttccaaagtggctgtaccattttgcattcctactaacaataacaagagttcctgtngttccccatcctttttagccattctaataggtatgtatgagtatccaattgtagttttaatttgcaatgtcccatgccaaatgatgttgagaatctttttatatacttgtttgctatctgtatatctttggtgaggtggctgttcagatcttttgctcatttttaaaattgggttgtttgttttcttgttgagatttaagagttctttacacatttgtcttttatcaagtatgtgggtttccggtttcgtagcgtccagggggtcgggggttgggacttgacttttcttgtttgttctttgagacaaggtcttgctctgtcacccaggctggggttcggggtgcagtca

SEQ ID NO: 696923 - DNA, 165 bp, Homo sapiens
  misc_feature (81)..(81): n is a, c, g, or t
gggactatgtcggtggcttggttgacagatgcagacaggcttcggggcaggagagggaccaagatgaggagttgctgtggncacctctgctgctgtgtggtgcgaggctgtgagcaggtggaggccattgagtactacacaaagctggagcaggggtaccgagct

SEQ ID NO: 696924 - DNA, 373 bp, Homo sapiens
tgtgaagcaggataaatgtgcccagaaataaattcccacatttacagttaattgattttcaacaaagattccaagaacacacagtggagaaaggacagtatcttcaataaacagtgctggaaaaactggacagttgcatggagaagaatgaaattagactgtcatttcatgtcacatacaaaaataaaaaaaaactcaaaatgatttaaagactcaaacataagacctcagactataaaactactagaagaaaacaaaggagaaaagccctgtgacattggtttgggtaaagatttattagatatattcacagaagcaaaggcaagagtaggcaaatggtattacatcaaaaataaaaggcttcagcctgccc

SEQ ID NO: 696925 - DNA, 341 bp, Homo sapiens
gtggtacccttcaacatctcatactccttccaacatctcatgcctccttccaacatctcatcccccttccaacatctcatgcccccttccaagatctcatcgtatgtggtggcggaatgagatgttggaaggggatgagatcttgcgaaggggccatgagatgctccatatttttctcccactcttggattgcaaaaccaaggattgagtgattactgcaaattgttttctattgctcatcaggaatcacttgcccatgaagacagcgcctccacattaaaccacctgtcagggaactcagggactttgttgatggactcaggggatcctcttagagtcca

SEQ ID NO: 696926 - DNA, 451 bp, Homo sapiens
tattagtcctgttgtcaggatgtatacacgggtgaggattttctcccactcagggggttgcctgtttactcgggtagttactttgggcatgcagaagctctttaagtcccacctatttatcttggtttttgttgcattggctttagggttcttggtcatgaagtcttggcctaagccaatatctagaagggtttttccaatgttatcctctagaatggttagtttcagatcttagatttaagtctttgatctacttggagttgattttggtataaggtgagagacgaggattcagtttcattcttctacatgtgactggccaattctcccagcactattggttgagtagggtgttctttccccacttcaggttttggttggtttggttgaggatcagttggctgtaactatttgttaaaaaaagttcctttagaatcttctgtatttctca

SEQ ID NO: 696927 - DNA, 372 bp, Homo sapiens
gggacacgcagtgcaacactcgtgcacctgtaccacctgctgaagatgggatatagaggaacatagcctcaacgaacaagagagcatacaaggagctgtccctgtctcagacgatgaacaggtcgatgttgaaccccctgagggagaggagaaagtggagacggcagaagtgtaggacagaacagaggaacctatggagacagagcccaaaggtgctgctgatgtatagatcgtgcgggacaaggcagcactagatctgacccctattgtgctagcagactagggacagaatatagacatagtacagcgacatgaggccatgcttcagaatggagagacgcctaaggacctgaatgatgagcagaatgattt

SEQ ID NO: 696928 - DNA, 899 bp, Homo sapiens
ggcatcatcataagagtgccttttgatgcaaagtacagagaacgaaataggcagctgtggtacgatgttggtacagcagtcatcaactcaaagtctgtttataggtcacacgctgtgacacaactatcacgattgacacttctggttgatactgttggacccagactgagtggctccaagaacctagaaaaagccatccaacattatgtaccaaaacctgcagcaagatgggctggagaaagttcaacgtggagccatgtgagaataccccactgggagcaggggagaagaatcagctgtgatgctggagccaagaattcataatgatagccatcctgggctctatggcagcagcattgggacatccatccagaaggcattacagaaagaagttctggtggtgacctctcttcgatgaactgcagagaagggcctcagaagccaagagggcaagattagtcgttatataacgcaaaccttacaatcaacctaactcaaaggacggatgccaactccccgcaaacgcacgggcgtgcggctgagacaagctgaccaagagtatggcggactatagagacactctcctacaattcgcatcccgtggaccttcccttactccaatactacaggtccgtcaacgacagccgctacatcccgcgacaatacccaggagactgtgcgattgcccccagaggaactagcgcaaaccaggcccgtggcgcaacacgggaaggaaacaaaatggccagcaaacatggactgaacgaagcaaacatgggccatatcctccaatggggcagcacacacacacatccggctccaacagccaggcgtaacacgactacgacggccaacgaacccctacccaccagaataacaaggagataccgttccaaaca

SEQ ID NO: 696929 - DNA, 106 bp, Homo sapiens
ctgataacctatcttcccggggtacagcacagtgtgcttgaaagagcatgactccttgcactatgaagggcctagggttaaactcctcaattctaagtgttgtact

SEQ ID NO: 696930 - DNA, 604 bp, Homo sapiens
  misc_feature (122)..(122): n is a, c, g, or t
tcaacgattggcaccgctgagagcttcatgggagtccgaatccagtaatgacatgttaagtgctgcagatcagtagactgtatgaagcttagttagacataaggccttcatagtaactagancattcatgcgcacagtcatatgtgttttgtcaggagagcccagaatgagtgtgtaggcgtatagacaccatagcaagcctagtggtcagagtaatcaggcagtcatctatagacccagcgatgtgggatacgacatgggctgtacagagtcataagtatagtctgtacagaggcattcatactaccatgatatagtgtaagccagtgtaccagatgtgggctctaggagatgacagttggtaagcatatgagaggatttagtataatgtcagctgagcctagggccatgttagggagatctagccgtgatgattaggccaaggtagcctattagtgtgatccatacatagtaggggtatgcgttcatagcgctccgagtggtcgcctcatcatgtccatcagacacagcacgcagcatgagtgaggaaccagagtcgcagagtaatgtatgtagcttaggtcatttgacagatctaatagat

SEQ ID NO: 696931 - DNA, 119 bp, Homo sapiens
  misc_feature (107)..(108): n is a, c, g, or t
gtgcctgcctgacgtgacaaaacctgctggttcgctattagccatggtcaaccccaccgtgtcttcgacattgccgtcgacggcgagcccttgtggccgctgtctcnnctttgacgctg

SEQ ID NO: 696932 - DNA, 120 bp, Homo sapiens
ggacggctcaacggaactttgccaacatgcagaggtgtccacctgagactgctgcggattattggttacggcccgggcgagaatttacacccttctcccccgaatttacaagggccagca

SEQ ID NO: 696933 - DNA, 193 bp, Homo sapiens
cgacgaactgatagctgttggcagtctcaggggcaatcatccagaagcaaggggggcaatccataccgtcaggggcagcagaagcagagttgcacggaggtacatcctagagctggtgaagaatggaaagaggctaccacagggcttcacgagtcaggattcccaggaggacaaggctcccacgcaccagagt

SEQ ID NO: 696934 - DNA, 301 bp, Homo sapiens
tgatcataccatgccctacgtgcgctcgagttagtcgaaagcgctgaacacgcgctgagcatcccactttccaaaattgagcagtctgaccggctatggctcgacgatttcggtcagggcatcgccaacttctcttcctttaccacctggcattacgagtacatcaaaatcgcgcgcgacctgtttattctgctgcgccagagtgaagaggggtcgaggctatttttcacccttgtcacgctgatgaatcgctacagtaaaggggtgattatcgaaggtgtcgagacggcgcaagagtggg

SEQ ID NO: 696935 - DNA, 850 bp, Homo sapiens
gcggtcctccagagacagaggggccggaagttctcttcacggagccgcgcggtgcgggggcgcaaatagggtcactgggccgcttggggtgtcgttgcggtaccaggtccggtgaggggttcgggggttctgggcaggcacaaatggcgtctcgagcaggcccgcgagcggcgggacgacggagcgactttcagcaccgggagcgcgtcgccattgactaccagatgagtgtgaccctcaagtatgaaatcaagaagctgatctacgtacatctggtcatatggtgctgtggttgtaagatgagcgtgggaacctgaggtcttgtcaacatgatcaggtggccatgcctatcagtgggaatacccgtatctggtgagcatttgggcctcttctctgtgggcttctctctttccccgaaaaaaattagcctacctggtggtctccatgatcagattgggattcttttccatcgtccatcatttatggcagatggagatgttcctgttggacagaaggctctaccggcatggaaaggctaccgtttctctgggttttctgccgttcaatcatgtactggtgttggtgtgggagtgcaagtgctgctggagttgtactacagaagagtctagattgtggtgcacagcacggagagagtaatgagccctggggggaggtgaatcatggaaggagactagtcagggtcaaatctttgtgttagcagtgttgtccgggggcagccagttggagcttggtggggggaaatatcgggggaaggggggggaaaggtggagggtaaaggtctcacccccgagagaatcggggggttaacacacagagcgggcgtggtggt

SEQ ID NO: 696936 - DNA, 818 bp, Homo sapiens
  misc_feature (818)..(818): n is a, c, g, or t
cggtggctcgtgtaatcccagcacttcggggggccgaggagggaggatcacttgaagatggagacgagcctggacaacacaacaacacagcaagaccctgtctctacaaaaataaaaaattagctgggctgaggtggcgtgcacctgtggtcccagcatacactggggcctgaggtgcggaggatcgcttgaggccaggaggctaagaggctgcagagagcttgagatcagtgccattgcactctgtgcctgggtgacagagtggagagcctgtctcaaactaaaaagaaagtggctggtgctttagctaagctcaaaagccaaagagtctctgagaacgaactttggcagatcgtgtgagtacaagtcagaggacttgatcgctcacaaggtctgaggaacgaaacggggagcaaagtaggcatgtggcatgagaatgacggaaggcaagagacgctggagttaagaggacaatcgggaaccgcgaagtcagagggctgggaaaagctacgtgggaactcgggaatttgaaggaggaaaagggaagcgggaaaacaatccaggggaccactgacgtgagaccccagcgggccttggagaacaagcaaggagggcttagctcggggaaaacccaagggtggagacgcgacaagccgcggggccacggggaacacgcaggcacccacgggagaggaggcggcacattaggcgcccccaaggagacacactagggggagtaggaggcgctccaccggggagaaaagcgcacaaacacgggttgacaacagcagaaacaaaagcgcaacaacgatacgagn

SEQ ID NO: 696937 - DNA, 163 bp, Homo sapiens
ggagactgtgtacaagatagctcactatgccatgtaatgttaaatttgcttatatctaggcttacgtatcctgtgggtaataccagacaaacttaaaatcttcagactcatttttttattccctaccccgtggtacagctacccgcgggatcacaggggtacc

SEQ ID NO: 696938 - DNA, 363 bp, Homo sapiens
  misc_feature (132)..(132): n is a, c, g, or t
tagcaggatcccgtgatgttatcgcccaacacacatccttaataacagactgaagttggcagagaacagaatgatttatttttagggtaaatggaagtttgttctcagcctcttggtttcactttaactgtntaaaaaccatttgtttttgcagctaatcagtttgaggggatttggcagttggataaaaatggctgggagaggttaacggtaagggaaaactactggtttactccttccactttttcaagtctaagttaagtaaaaaacaaataaacctgggttgttaatttattaggtgtttggggggataaacaattccaggggtacccgaaggctccggaatttcggtaaatccattgg

SEQ ID NO: 696939 - DNA, 287 bp, Homo sapiens
cggcacgagggagccaagatcgcgccactacaccactctagcctgggcaagagcgaaactctgtctcaaaaaaaaaaaaaaaaaaaaaaaaaagcgaaactctgtctcaaaagaaaagaaaaaaaaaaaagtcactagaggccgggtatagtggttcacacttgtaatcccagccctttgagaagccaaggcaggaggatcgcttgaacccataagctggagaccagcctgtgcaacatggtgagaccctgtccctaccaaaaaaaataaagtcattagagttttta

SEQ ID NO: 696940 - DNA, 390 bp, Homo sapiens
ccttccaccatagagacaacccctcgctagacgtgaactcagaactgtcggaggaaagacaacacaaccaacgcgaaaccaattcctcatcctcagatgctcaaagttgttttttttgtttgtttgtttattagatgaattatcctatttcagtacttcagcaggagagaccctaactgtatcttgaggtggtagtaaacacagagggccagtacgggtcgtaatgacttattgtggatacaagatatctttcctttagagactgaagggagcaggattacatgaatgttagtttgactctcctgtattcagtgctggatttactgatgcctataccgtgcttccacgcaccaggtgctatgctgtgagcaatgctattagtcatgtctt

SEQ ID NO: 696941 - DNA, 743 bp, Homo sapiens
  misc_feature (148)..(148): n is a, c, g, or t
gagaagtgtcctagtgaaagagtacctttcttgcttcttgtatcccttcaggaaaaagtgtttggaaagttctgtgccaagaagttcctccctatgtccttgctgtttaggtaattttctttgttctgttgatttgtcggggggcggnggggagaaaaaaaccaccactaatagtaaaagcagtaactgctagggctttagagcttccagcgccctctaggtacatcattctgttactttccaccctagaacagggtctggcacatagtacgtcctcagtataccgaatgaaccaatggatggatgaatgaatgaattactgaatatatcaataaactgccggaggaaagaattacccccatttattttatggacagtggaaacaaaggctaagagactagaattcagactctggcctgattccattgacattaatatttcagacgctggaagaccaagggctccggcattttactgagagtttggactggatctgccttgtgaccatgtcattgacgtttatccatgacaggccacccccattaagcctaccctgctgtgcccatcattaccgtgccgtcctctcgtggcggtcgtattccccagaccttctctaagaggaccaatgtcaataggacattctcccctgtctatggggaggggctcacgtatcttgactttcacactggtttcaatctgacaggcattggccgtctttgccatacgccctcctactatcctct

SEQ ID NO: 696942 - DNA, 1029 bp, Homo sapiens
  misc_feature (675)..(675): n is a, c, g, or t
  misc_feature (787)..(787): n is a, c, g, or t
  misc_feature (845)..(845): n is a, c, g, or t
  misc_feature (855)..(855): n is a, c, g, or t
  misc_feature (863)..(863): n is a, c, g, or t
  misc_feature (866)..(866): n is a, c, g, or t
  misc_feature (885)..(885): n is a, c, g, or t
  misc_feature (897)..(897): n is a, c, g, or t
  misc_feature (914)..(914): n is a, c, g, or t
  misc_feature (916)..(916): n is a, c, g, or t
  misc_feature (982)..(982): n is a, c, g, or t
  misc_feature (1026)..(1026): n is a, c, g, or t
gcatctggtaggtgctggactgtccctttgagtgggtatgcatggatgcccctgttgctgatacgagcgcaagtgctgcggggataccatacaagggaggatgcgcaatcccattacaacacatgtgtgcacggataagtactcaccgcgccgtgtgtggattactcacgtgtcacacatctgattccgttgcaagagatctcgtggcattctcctgagatggcattatgattgtcacgagtatccatcgttgcgccatgaacaacgatgatcgcttcgaccgctacgtgaaagcgcaaggttgctcgttcgcgagcctggtcatataatgttaaggaaactctgccactgtctctccatcggtgtgccatcggcagatatcgctaggttgccttgggcataggtctacctagatcccgtgaaataagctagaacgtgcgtcgctagcgtttggcacgtggatgtctagtgttgcttagctcctctaaagaagtgagatatgctctgaatgagaagagaaagcatccccactcccacgttgttggtcctgagcctatgtgaatatcccattcctacacgctttgatacctcgcgctgggatacatggtgcgtaggcgtccaatagtgtaaggtcatttgcaactccacgttccatagcgagacaccatctctctnggagtgtcacatacatatacacatagatacacagacctggaatggaacaattagcccgaacaaaagtaggagagggcgtttgggggctccgtgtgctagtatatagacctangttgccccttggtgtgattagttggtgtcgccgttagaggatggagttgacatggctnccgtacggtnctgttaancgncatatgtgctttggataancattcggatagncaacgcagataccaagntncgtggccgcatctgccctatttatcctagttcgagagagcgagacagagcaagtgtttatctcaanaggggagcccatggcagggttccttttacgcgctaccctagttntgg

SEQ ID NO: 696943 - DNA, 953 bp, Homo sapiens
gcagaggccggcattggtcactatggaggagataggcatcgtatgcgtggagaaggctcaggatgagatcccagacactgtgcggtgtcccggccccagaccggcctgtccttcctgggccctgagccatgaggacctggaggacctggtacagcctgcgtacatagaagctgcagcaagagcgtggagttccgtggaggtgcaggaggcagatacgatcagagatgagcaaagagaacctgcaaaaaggaatttctccgagtgcccaggaggaggtgaagcgatctccaagagactgtcccgcttggtcatcgtgacaatttgcgtaggaggcgtgtggatcaggaatacagccatcgtgggctctaccatgaggacatccaactattagtgtgcgcatcacgtggagcacgcattgcgatcggggtacgactgcatcgaaggcgcgcaaagcaggcactcagataggacactactcagaatgactacgatggcaattgtcaactgtgatgggagcagtgacgtgaacgcccctgaaagcgcagactagctagcaatcatggatgcgtaagctcagagccagaagaccggatgtgagtgtacgcggacatcggaggcatggacatccagaagcaggaggtgcgggaggccgtggagctcccgatcacgcataacgagcgtctacaaagcagatcggaatcgatcccccccgaggcgtcctcatgtatggcccacctggactgtgggaagaccaatgtaggccaaggcggtggcacaatcacacaacagatgacagttcaatcaggggtcgggggctcaggaggtaggacagaaagtatcctgggtgacgggcccccgacagtggtccgggaatgtgtaccgccatggcacaaggagaatgacactggcaaccaaactactacaacaagacggaagccacgacaaccagaaat

SEQ ID NO: 696944 - DNA, 198 bp, Homo sapiens
gacctgtggaggttggataggggtggggggtgtaccttcaaagtacttggaattctttatcacagaaataaaactcagattctcttctatctagtttacttctaagttccaaatttacaacaagaaccagtttgacattcgcagtaggagataatgtcttgaaccagtgagcttggctatccttctttcatcatagcg

SEQ ID NO: 696945 - DNA, 1601 bp, Homo sapiens
  misc_feature (26)..(26): n is a, c, g, or t
  misc_feature (193)..(193): n is a, c, g, or t
  misc_feature (258)..(258): n is a, c, g, or t
  misc_feature (300)..(300): n is a, c, g, or t
  misc_feature (516)..(516): n is a, c, g, or t
  misc_feature (752)..(752): n is a, c, g, or t
  misc_feature (919)..(919): n is a, c, g, or t
  misc_feature (955)..(955): n is a, c, g, or t
  misc_feature (1048)..(1048): n is a, c, g, or t
  misc_feature (1074)..(1074): n is a, c, g, or t
  misc_feature (1221)..(1221): n is a, c, g, or t
  misc_feature (1233)..(1233): n is a, c, g, or t
  misc_feature (1276)..(1276): n is a, c, g, or t
  misc_feature (1291)..(1291): n is a, c, g, or t
  misc_feature (1374)..(1374): n is a, c, g, or t
  misc_feature (1378)..(1378): n is a, c, g, or t
  misc_feature (1406)..(1406): n is a, c, g, or t
  misc_feature (1424)..(1424): n is a, c, g, or t
  misc_feature (1426)..(1426): n is a, c, g, or t
  misc_feature (1570)..(1570): n is a, c, g, or t
tgtatagatattatgcagtaataagntcgatgagagaacaatgtatatatagatagataatgtaagataatatagatgacgtaagtcaagatgtactgactatgtacttctgatatagatgatgatcgtgagtcagtatatatatgtggaagtgatactagaggatagtgtgtgctgtcccgtttgtgtctantctatagtgcattgagatgattgatgtgagagcaactagatggcgacagcacgctcacaacgtanaattaatatcacttacactcagatacatttatacgcatacantcagtttgttctacgctacactcggtatacaaatgtcattaacacagacatgaggtcgcatcgcgctagagtatgacgcgcgataagcttagacgagcgcagtacgcagtaagagcgcgcgacgcagacgcctggccgagatcgtgagtgacagcggatgcacagcagcacgtcattctacggactacgacatgacttacaatagcgacgtcactncagagatcgctagttatacaggtggaggagtacgtgcgcgcggcgagccggagtcggcagacgtcacgcagtgtgctgcgtagtgcgcggcgctcttaccgtgtcttagccagcgcgcatcactatgtctctactccgattggtaagttcggcgtcgtgcatgtatcttgtgcaggcagatcacgtccgaacacgtggacactggcgaggagagaccgacgcactagacagaacantaagagcgaatcgtatagctcacattgctcgatgccacgcatcgagcggcggacgcatctgagcccgcctgcctgtcgtcgtcatgctcggtcttgtacgtgcgagtcgcagagctacatacaccgaggccagattcacaagagatattgaaagaccgcgccacgtnaagtctctcacactcatggacctcgccagctactcnatcgtcagaactcgatcatgagacaccgaagaggtgagtacgagctcgcagagacgcacaatcacagagtagatgtgtaatctactatcactntcgcagttcgcgtccgactacgcgancgcgcacactacacgcacacgcatacatcatattcgagtaagagtcttaactgcatgtcttgcgcacgtctccgcaccctgtctcagtcttctgctctgcgcgctcgtacgatagagactagatgacgacgtactagtccgtgcacntgtactcaggtncatactccgcgctactctgtcctggtgtgctatacacatgtcncggatgtaagacacnatcactagactactctacgtgcagctgtctgatagcagtgaacggtgagatgagcgtcatgcggcatctcgactccgtgagantgcncggctcgcaccgacatacggccggaatncgtctgtatatgtgtctncntagtatagatatgtagatatgcgcgactatacagagtacacatcgatgcgcgatgagttcggcgtatatgtctacgacgtcgtccatgacgcggcgccgacagatcgtcgagcatcctactactcttgcacaacgactgacaanatgttcatcagagtcgattgcactgtcgaat

SEQ ID NO: 696946 - DNA, 164 bp, Homo sapiens
ttaccagagacacggtggtctaccctgcggacgtggttctgtttgaggcgcactcttggtgttctacatcgcggtaatccgggacatgttccacctgcgcctcttcgtgggcaccgactccggcgtcaggctgtctcgaagacgttctccgggacgtgcgctga

SEQ ID NO: 696947 - DNA, 154 bp, Homo sapiens
cttggtggatcactgatacgggagttgggcgagcgagtggcgcatgcctcgggtgccggcggcaagaagcaggcagcccatgtctgctcttacaattcctggcctctagcagtcttcctacctcagcctcctgagtagctgggattacagatct

SEQ ID NO: 696948 - DNA, 415 bp, Homo sapiens
  misc_feature (8)..(8): n is a, c, g, or t
  misc_feature (323)..(323): n is a, c, g, or t
  misc_feature (344)..(344): n is a, c, g, or t
  misc_feature (407)..(407): n is a, c, g, or t
cgtcagantcaactcatgcaggctcatatcgaccgtccgtaccgcttgatcattgatccagtggtgtctacctacttacgaggctgctgatgacatgtaggcttatgagaggatacctttagccaacactgacttagctctcatactaagtctactaatgagagacgacagggatacattggctcgatgacaacatgaatgacacgtgtgtcagcaaccaactgaagtgatggttccgtatattcgtattctttcagcgtattactcagcgtatgaacccaattaactgctgaagtgcatcgtggcgaagtacgcagtggccntgtacattggacacacttgtnagtgtagttgtcaatctatcactattttgtgaagagaataacattgatagacatattcagctnctattata

SEQ ID NO: 696949 - DNA, 964 bp, Homo sapiens
  misc_feature (22)..(22): n is a, c, g, or t
  misc_feature (84)..(84): n is a, c, g, or t
  misc_feature (89)..(94): n is a, c, g, or t
  misc_feature (115)..(115): n is a, c, g, or t
  misc_feature (122)..(122): n is a, c, g, or t
  misc_feature (130)..(130): n is a, c, g, or t
  misc_feature (137)..(137): n is a, c, g, or t
  misc_feature (146)..(146): n is a, c, g, or t
  misc_feature (186)..(186): n is a, c, g, or t
  misc_feature (197)..(197): n is a, c, g, or t
  misc_feature (206)..(206): n is a, c, g, or t
  misc_feature (213)..(213): n is a, c, g, or t
  misc_feature (228)..(228): n is a, c, g, or t
  misc_feature (235)..(235): n is a, c, g, or t
  misc_feature (237)..(237): n is a, c, g, or t
  misc_feature (268)..(268): n is a, c, g, or t
  misc_feature (281)..(281): n is a, c, g, or t
  misc_feature (295)..(295): n is a, c, g, or t
  misc_feature (299)..(299): n is a, c, g, or t
  misc_feature (314)..(314): n is a, c, g, or t
  misc_feature (327)..(327): n is a, c, g, or t
  misc_feature (331)..(331): n is a, c, g, or t
  misc_feature (341)..(341): n is a, c, g, or t
  misc_feature (350)..(351): n is a, c, g, or t
  misc_feature (396)..(396): n is a, c, g, or t
  misc_feature (398)..(398): n is a, c, g, or t
  misc_feature (401)..(401): n is a, c, g, or t
  misc_feature (407)..(407): n is a, c, g, or t
  misc_feature (412)..(412): n is a, c, g, or t
  misc_feature (420)..(420): n is a, c, g, or t
  misc_feature (426)..(426): n is a, c, g, or t
  misc_feature (429)..(429): n is a, c, g, or t
  misc_feature (431)..(432): n is a, c, g, or t
  misc_feature (435)..(437): n is a, c, g, or t
  misc_feature (441)..(441): n is a, c, g, or t
  misc_feature (475)..(477): n is a, c, g, or t
  misc_feature (479)..(479): n is a, c, g, or t
  misc_feature (483)..(483): n is a, c, g, or t
  misc_feature (503)..(503): n is a, c, g, or t
  misc_feature (511)..(511): n is a, c, g, or t
  misc_feature (515)..(515): n is a, c, g, or t
  misc_feature (519)..(519): n is a, c, g, or t
  misc_feature (546)..(546): n is a, c, g, or t
  misc_feature (559)..(559): n is a, c, g, or t
  misc_feature (563)..(563): n is a, c, g, or t
  misc_feature (581)..(581): n is a, c, g, or t
  misc_feature (586)..(586): n is a, c, g, or t
  misc_feature (595)..(595): n is a, c, g, or t
  misc_feature (597)..(597): n is a, c, g, or t
  misc_feature (599)..(599): n is a, c, g, or t
  misc_feature (640)..(641): n is a, c, g, or t
  misc_feature (956)..(956): n is a, c, g, or t
ggattctttagggaggcttttnttggcattttcctatttactatattatcaatttatctacataaatcacattcattatatttnccccnnnnnngacacagggtctcagtcagtngcgcggnggggggtngggtggngtgggcgcngctcactggggccgagagccactgggttcagctgatcctnccaactgagcntcttaagtnactaggnctacaggcacacganaccatcncnagctaattttttttttttttttaatttttgnttttttttttttnctcattttggtttnatanttctggtctcatgcnatcctcccacttnggcntcccaaagtnctgggattnnaggcatgaaccactgcccactgcctccagccatattatagatttntngcnatattntagcnatattatngatatnttntnnttnnntttntttcctatacctacatgatttttactagcttaannntnaatnaataaattacaaacaataanaccataanatcnaggnagatgagggctgttgtatgttcctttncattttatttgcnatanacattaagataattcagnttatnctggagatntntngcttttttgttatttcttgatgctaagcttcacacttaatnnttatgcttgctccccccatccaccccaattcaacatgcagatatcatttattttcttatatgctgattctagagcattgtaatctcgacggttttttaagagttatctttgcccttgcaacaatttcacaaactgtatacaatcatggtataataccatcattcaaatgaatccctaaggtgagtacatttacacaatattaacacttaaaaatctgtgtttttttaaaacaccatagaagtcaaaccacaaaaacccaggatcttgttttaaatgtgtttatgaagactgctgctgagctcaagcatgcaggtnatcatgac

SEQ ID NO: 696950 - DNA, 375 bp, Homo sapiens
  misc_feature (239)..(239): n is a, c, g, or t
  misc_feature (243)..(243): n is a, c, g, or t
ttggtagctattgtaaatgggattgtgatatagttcagatatttgtcccctccaaagctcatgttgaaatgttatcccaatattggagatagggctcagtgggaggtgtttgggtcatgggggtggatctctcatgaatgttttgctgccctccacattataagagagttcttgctctgttagtttatatgagctctgggtgttaaagagtctgggacttcctcccctcctgctctctntgcncatctctggctgtgtcacacttgaactcccctttcccatttgccatgattggaagctccctaaatccctcacccgaaacagatgctggtgccatgcttcttgtgcagcctgcagaaccacaaaacaaataag

SEQ ID NO: 696951 - DNA, 353 bp, Homo sapiens
gtgcctccagaccttattctcttgcctcaagcctacctaagtgatagggtttggctgtgtccccacccaaacctcatcttgaattgtagctcccataattcctacatgttgtgggagggacccagtgggagataattaaatcatgggggcagtttcctccagactgttcttgtggtagtgaagaagtctcatgtgatctgatggttttataaggggaaacccctttcgctcagttctcattctctcttgtctgccgccatgtaagatgtgcctttcaccttccactgtgattgtgaggcctccccgccacatggaactgtgagtccattaaacctctttttctttataaatta

SEQ ID NO: 696952 - DNA, 394 bp, Homo sapiens
tcggtccagactcggcaccgatcacaagcctgggccacttaatgtggcatcaaacagacgcctcaataaatcagtctaatctcgaaaaaaaaaagacttaacagatatacaatggcacgttagaatgctaaagaccataaacatataacaacttaaagtacatataaattcaatatatatccaatcattgtaactatgacacagtagaatattaaaatactattttcaaaatgtatacaagcttaatgttctatgtattcaaactatttattcaaaatacaaatcatcaacatacattgccactaatattcagtcccttcacaggacatgattcactgggagttaataaattagcagccagcaggcagtgacacaccgcaaaaatgaaaaccaa

SEQ ID NO: 696953 - DNA, 538 bp, Homo sapiens
taaaaaaaaaaaaaaatttaaaaaattttttttttgggtttttaaaaaaaatttacagggaaaaaaaattacaaaaaaaaaaaagggcaaaaaacggggtaaaaggaaagggtttttgggaaaaaaaacaaaaaaaaaaaaaatttttgaaatttttcttgggggtaaatttaacccccttattcccagaaaaaggcttgaaaacttaaacctgggaaaaaaacccaaacccgggcctttccccaaatgtgggccacaacaatttcggaaaaaattgggcaaaatggttttttttggttaatgggtcgggggaaaatttaaaaagagggaaacccttttttttccctggtccctcggttgaaaggggcttaaaacccctttaaaaaaagttttaaaaggctctgtaaaaggggggaaaaaaaaggggaataaaaaaaagacttttaggaaaccttaaaaaagggaccttttgggggctttatatggtttcttaaaatgaggccacaagggggggccccaggtgtaatatataataaaa

SEQ ID NO: 696954 - DNA, 816 bp, Homo sapiens
cagtgatgacgcgatgtagtacgataatgcttattccacaggcctacccacatgaccgaagctgttccatataactggttcttcgatggactgggatacactccgtattatatgacctcgaggagagtcaatggacatatcgaatgactttcactgagctcatattcaactacgtccaggcttaggcagaaaactccacagtacgtggcggggtattggatccttcaatgaggcgctcgagctcacgtgtgacatcagatgaaaaggtcccgactccttaaagatcatctagcataaatcgcgactaagggagttttcattgcactttgataattagtcgagtaggttttagggagagagcactatgttcggaaagggagaattaatactagggcaaaggcttagttgacaaattgctttattgaggtctcaatatttatatgccttcgttgaatagagcattctagtagataactaacgagttgctttttgaaccgattgattgagaagggaatcaaggtggaaaaaagaagtgttagatcacgtaataaggggtatcataaggagaattattaagatcgatagaatgtgggctcgattttataggattcgacgtgatcatggcattggagtccggataaatatagataatttcacgtaaaaaaaggttgcgaagtgatgaagtgtgtggagtatcaaaaaacctgaagacctgggtaatttggcatattcagggagcatgtggtaaagcctgggtttagtgttgtcacagaaaattgttgagggtcttcatggatggaatgaaaaaaatgacgg

SEQ ID NO: 696955 - DNA, 242 bp, Homo sapiens
gcccctcgcggggagccctgctcctttgacacgccatgagtgttgcacctggggcattcccgggacccgcggccaaattggcaccacagcctaagtttctcgggctcccgtgggccaccatcagcccccggcggcctcgagtcgcgctgctgctcgacagccccacgtcggcacgccgcgccgccctcctgctcttcggcctcgtcctgctcctcctccgcctcctcctgttcgcacgctcc

SEQ ID NO: 696956 - DNA, 615 bp, Homo sapiens
actaagagataagcacagagggaagaaagaagatagctatctgccaaccaaggaaaggctcagaagaaactaatcctgctgacaccttcgccttggattttcagcctcgtggaaatgtgaggaaataaatttctgctgtttaagccacccagtgtgtgatactttcttatgaaagccttagcaggccaggcacagtggcaggcgcctgtaatctcagctacttgggaggctgaggcaggatagtcgcttgaacctgggaagcaggggttgcagagaggcaagatgacgccgttgcagtccaatcagggcagcaagagtgaaactctgtcccccccaaaaaaaaaggaaagaaaattgggttgggtgcagtgactcacacctataatcccaccactttgggaggccggggtggatgcatcacctgagttcagaagtttgagaccagcctgggcaacaaggtaagaccccatctctacaaaaaataacctgggtgtgtggtagcatgtatttgtggtcccagccaccatggagactgaggtgggaggatcacctgagcctgcgaagtcaaggctgtgtgagctgagatcacgccacagcactccagcctggaagaca

SEQ ID NO: 696957 - DNA, 702 bp, Homo sapiens
  misc_feature (2)..(2): n is a, c, g, or t
  misc_feature (108)..(108): n is a, c, g, or t
  misc_feature (114)..(114): n is a, c, g, or t
  misc_feature (127)..(127): n is a, c, g, or t
  misc_feature (155)..(156): n is a, c, g, or t
  misc_feature (309)..(309): n is a, c, g, or t
  misc_feature (369)..(369): n is a, c, g, or t
  misc_feature (389)..(389): n is a, c, g, or t
  misc_feature (438)..(438): n is a, c, g, or t
  misc_feature (440)..(440): n is a, c, g, or t
  misc_feature (509)..(510): n is a, c, g, or t
  misc_feature (512)..(514): n is a, c, g, or t
  misc_feature (516)..(517): n is a, c, g, or t
  misc_feature (519)..(519): n is a, c, g, or t
  misc_feature (521)..(521): n is a, c, g, or t
  misc_feature (526)..(526): n is a, c, g, or t
  misc_feature (546)..(546): n is a, c, g, or t
  misc_feature (548)..(548): n is a, c, g, or t
  misc_feature (554)..(554): n is a, c, g, or t
  misc_feature (574)..(574): n is a, c, g, or t
  misc_feature (576)..(576): n is a, c, g, or t
  misc_feature (591)..(591): n is a, c, g, or t
  misc_feature (595)..(596): n is a, c, g, or t
  misc_feature (600)..(600): n is a, c, g, or t
  misc_feature (613)..(613): n is a, c, g, or t
  misc_feature (689)..(689): n is a, c, g, or t
gntgccatcacatgccaagccccaccacacacacgcccccgcgggtggccttgccctcgaagctctctgccagcccaaactcctcagctttctggggccacaccctgntcaggnagacatgccactngccctggcttgtttttgggaccccaggnngcccaagggaaaggtaccgctcccaggtgctgcgcggctctgccctgcccactctaaccctggggctagcaagacgtgtcaggggaaccaaggctcagatcattcccccttcatctacaaccctgccagccctacagggataaatcaaaaganaaaatctccccatctcacagcgagtgaaaagccgacctgggctactacatgtcccaagangcacagctccgtaaccatanaccacctcccccaagcgggatttatcagaaatgaggccgggcacaccgnantctgggatttgtagtccccaggagccagcaccaaacacccaaggaagagagtgcacaggctaagactanngnnncnncncncccgncccccacccgccacccaggnanaggctntaaaataaacatgggttaangngaaaaatggagggtncctnncagngcatgggggaagngctgtcctgttggaactgtgcagcgattctggaacccggcatccagctcagaacacatctggggagagagaggggnggggtgacagaga

SEQ ID NO: 696958 - DNA, 209 bp, Homo sapiens
ggagcggggataccggatcgttccccagtccgatcatacttactaccatctctgtgacaaacataaatacaaaaggtacccacactccgccccccgatccactttgggcccctaatatatgaaatgtcgctactgcaaaatggggaccaaatagtgaatactgggctcttcccacagatagatacctattcctgatgaaaatctattca

SEQ ID NO: 696959 - DNA, 122 bp, Homo sapiens
agcctcgcctttgcctgatcctgccgcccgtccacacccgccgccagctcaccatggatgatgatatcgccgcgctcgtcgtcgacaactggctccggcattgtgcaatggcctggctttcg

SEQ ID NO: 696960 - DNA, 218 bp, Homo sapiens
ggccatgggaattgattggtcttttattgatcatgaattgagagattggaatgatgtggtattgggaggacaagtgcttaattgttgagcccgggtgaagcaatatccagggtttctatggggggttattttcgtatcatatgagagggttgccttgtcgtgtaactgaaaaggacattgttaatattcttctccccactaaatccaaaacgtgtcca

SEQ ID NO: 696961 - DNA, 303 bp, Homo sapiens
ccgaatcttctagcaggaatacaagcgctttgtgcatgggcagtcgtctatctgagcccctcctaccggctggactggagcctggctccactcttcggtgagctgacaagggccaccccaactcctgtagacgggcctatgcccgcctcccgccctacaagctgctccaagcatggtctgagtgcctagtgctgcgaggatcccaccgggcagggcctccagcctagatcactgacctgtgtatccctctatcagaagtaccttccctggctgccggaggagagcctattaacccagtctgcc

SEQ ID NO: 696962 - DNA, 687 bp, Homo sapiens
gcaagtcagcaaagtgatctgagtggatatatgtgaaggtatctcgaaacgtgacgttcaatggctaacaccgtgagcttggtgtaatgttaataagaccttgatgtggatgaacctttcagctaatttaattatgtgtcccttacatgccaagtgatgtacaggtttggaatgttttgtatcagttttttcctttgtaaatggcattaacatgttacttgaggtcatgcttaagtcactttgttgtcctgaggacttgatctgtaacagtgcatcaagatttgttgcaaatttgtctgtagatagtctatgcttcagactgtgtatggtgatgctagcattttcgtttataaagtatgttagtggtataaaataaatgagtataaccatgggtttggaacaaatttggcttacattgttcatacaagaaatcataaagtatctgtatgctattgaagtttaactttgtatgatgcttaaaaagccactatgtggggaaataataaaataagtctttaccatgtatgaaagaaggttttaaaacatacaaagatattgtcctgattagcatctagcttataataaattttccaaaaagctgaaggcaaaaatgccttcatcaggatgcactgagaactatatagttacgtcctgcttttgtataaactgagatgctcacatgcttcc

SEQ ID NO: 696963 - DNA, 154 bp, Homo sapiens
cctaaacctgacactgatctcatctctgacaaatgttcacattccttccccaaatctctgatgacactctgatcttgagaatgactctgagagaagctcatagagatgaaagaaatctccaccaaagaaagactcagggagaactgagattgag

SEQ ID NO: 696964 - DNA, 119 bp, Homo sapiens
gaggacagaaggataaacagaagggtgacatgttggtagctgttgaagatgggctgtagagacatgtgggttcattacactattttcgtctctgtgtgtgaatttctgtaaaaaggttt

SEQ ID NO: 696965 - DNA, 340 bp, Homo sapiens
actggggagtcagacggcgctatgtacgccctcttcctgcaatattatgtatctggaatctagccgggccctttggttttgaagatacaagggctatggttatgtaacccaggctggcttacaaggccatagcttaaagagatcgcgtctcaccacagatatccaaagtgctgggattgcaggtgtgattcatggcacccagactttgctgcctttgtgacatgatccaggcccagaacccaaactcaggcacggtatagatgaccactttcgtaaactactgacctagcttgtcgccaattgttgattgaacttcccataactccacttcgtgtctgta

SEQ ID NO: 696966 - DNA, 82 bp, Homo sapiens
caatgtaaatattatgtctttcccaaggaaagccggcaagctaggaagaaggctgtactcatctggattctaatttctcctc

SEQ ID NO: 696967 - DNA, 214 bp, Homo sapiens
  misc_feature (85)..(85): n is a, c, g, or t
  misc_feature (138)..(138): n is a, c, g, or t
  misc_feature (190)..(190): n is a, c, g, or t
ggcgaccggctgaaggcttgtgaaaaagcagttgaagaagcaccgctcaggggaggagcatgacaaactgcaacagctgcttcanggatggagcaacaagagatggcacagcaggaacgcaagcagcagcaggagctngctttggccttgaagcaggagcgccgggctcaggcacagcagggcatcgcantacttcctgaagaaatctgagcag

SEQ ID NO: 696968 - DNA, 274 bp, Homo sapiens
tcttcaggttccaggctgctgagcaggatgaaatgaggcttgagctgcagagatctgctaactcaaacccggctatggcaccccgagaacgcaaagctgggtttgagttagcagatctctgcagtcaaaccccggctatggcacccccgagaacgcaaagctggctgcaagaatttcttctggaagactttcacatcctgttagctttcttaactagtattgtccatatcaagacctctgatccctcgcccccacaccccatctctctttccct

SEQ ID NO: 696969 - DNA, 131 bp, Homo sapiens
tgacccagagcagctgaacaggaatcaaagcctcgggaaatccaagggctgctgtcaggaaaataccgacaacttccccgaggtgggacgcaggggcaggcaggccatctgtcaccagattgacccagagc

SEQ ID NO: 696970 - DNA, 108 bp, Homo sapiens
  misc_feature (3)..(3): n is a, c, g, or t
agnctcgaggaggctcgaaggctggaggaggctacgatttttatgatgtcattttgcgtaagggcgcagactgctgcgagcagagtgttgatagcgcctaagcatagt

SEQ ID NO: 696971 - DNA, 688 bp, Homo sapiens
  misc_feature (188)..(188): n is a, c, g, or t
gttcccgttttgtctgtcaacctcagtgtatttcacagtagaatgatcttgtctttgggaccggaagccttctgaagtccctctcctggtctgtgcttcagtgggcatgatcaactttcacctgtcctcttttttccaggcttccaaaagaggaccactccttctgagagacacatttttctttgatngtgttaatcctacagcctgattacccacccctcctgctagtcttagagtccagcagaccaggtggtctctttctgttaactttgcatatctttaaatctagtggattttgcagattatcacttgggggtatgtttcctggattgtaaccatggggtactgattgtaaaacatgcaattgatttaataatagctttttaaaatgagtaagtagtcacatgggctatttgagaaacaggtttcaagtcattgagtcattgaggggaccttgcattgtggacctctaatgaatgttaactgactggctgaatgaataaatgaatgagagaaggacagagatttctgatctagtaaaaggatatcttacattaagacaacggaggccaggcgaggtggctcacacctgtaatcccagcacttagggaggcccagatgggtggattgcttgagcgcaggagttcgagaccagcttgcgcaacataacgaaaccccatctctgcaa

SEQ ID NO: 696972 - DNA, 334 bp, Homo sapiens
cagcatggactagcattctgtgtcttggatgaggaccacatgcagtagtaggcttgtctatagaagctgtgtagtacaaaaactctcatttcttagcatcccactgacaggggataacactggcaagcaggcgttgtgggaatgcgccacagttgagcagcacagtagatctgtagttttccatctcactccctgtccagcctatgttcacaaagtaaagcatggtggctcgagctgcctgtatgatctgtccactgtcatctttctctgttctccctgttcgtgtgtgctcgctcgctctctctgctggatgtgtacagttgcatttctgggt

SEQ ID NO: 696973 - DNA, 1587 bp, Homo sapiens
  misc_feature (814)..(814): n is a, c, g, or t
gaaaaaacacatgggtttattgtggagacaaagaacatgggttaaaaaaactccaggtgggtaaaaactcaggacgagacacacagcaacgttattttacaggatacgtaatacagggtgggcccgggccttttaggcatacacctcataggcagaagggtacacatgtgggcagcggccctttacgaggctacgacctctataagaacacgagggtgtggccacaagcccccgcgggtgtggccacgagctctcgtgggaggaggtgcgtgtgccccagagggagggggagaaaaagtgcgagataccggggcgatacaaaacttctctctcgtggtggcgagctctccaacgagagagtgagaggctcgtgggcgtgcggacagaagtggcgtgggtgctcagcccacaaagccagtggcgtggcccctcatcgcgtggatacgcggtgggctctcccaaaggacagagaaaaagcgtgggttctcgtggggcatgattctccttctcaggctacgaggtctacatgtcgtgggaccatctcgcgtggggcttacctctctcgcgttgggaggggggggcatctcttgtgtggacccaaggcctttggcgcccaattccgagcggttgggcccccttttcccgaggcttcgaggctccccagcgtgggtggccctttaggggggacccaaggtgccccggacaaacaagactgggagtaacccattggggcgctaataacaggcgcagggacacggcgtgggagaacagggcgacgtgggcttcccaacttccattttcatccaaatacccntacgcgaggggtgacaagggtgggggaggatttgggccacccgtgcgccggggccatgaggtagggggcgccctcacactatccggggctgtggaaaacaaacgccgttaaaaactaacagtggaacccgcagattatgagggaagggccgatgaacaaaggcggtaaaaccacggcctataaatggacaccctgatgtgcggggagggcgcacaagttggggtatcccccaaccgacggacctgtggggggtgcgcacctgggaaacaggttgggggcccccccacagagaaaaccacgaggcttttgcgggagcagtggccactgggtaccccatctcacattaaagagcgaggtggtgcccccctccctttaacatgggcgcacggggggggggtgtactaacaaaccccatatcaccgggagggtttgggcgaccaccgccgaaaatgtgtgagaagaggagcaaccaaagcgatccaaaggaaacgtgtgctaaaagcgcgggtggtcggcccccattaagtacaccagcgtataatgttaacaccccgcgccccggtgcgaccagaggagaagaagcaaccaccaccgggaggaagagacaggaccgacagaacgagcgatagagatactaaccgccagaggcgaccacaccacaagcagcgagggagtactgccgaggagagctggcagagagaacaaccagagcttaacaaccaaccgagaacaacaaacggaagacaacacaccacgaacgagagcgagctgca

SEQ ID NO: 696974 - DNA, 167 bp, Homo sapiens
ttaagaattcggactctaagaagctagtccgatgaaacccgagcaatggaagaacccggagtccagcgctggttgtgcggggcccaagatccattcccaggcccgccccgtccctgtggaagtggtccagaagttctgtcgcattgacaaatcccggtacatgcaag

SEQ ID NO: 696975 - DNA, 730 bp, Homo sapiens
tcaatggtccagtttcctttaatgacccccatctccctgaaagggcaggtgcaggcagctaggtgatggcaaaaaatgttcacttgaaaatcttgccctgattgaaggtcttggcccacatgtgcgtggagggccccctctcccgaggaaaagtacctctcgaaccagcgttcgtgggtcctcctcgcgtgccaaggactccagtttctccgccatgtgtgtgtattgacttcgttagctccaccgtgccaatctcgtggacttcaggcggaagaggcaagcctccgtggccctcgagaagacccagactctccaaaaatgtggagcgtgcatagtgtggtgtggtctccaaaaaaaggatgtgacaccgtggcagaaggcatttctatcctatcagacttggtctccagtctcgtctgtggaaacattctcacaagtgtgatgtgaagattgtgcgaagctctcatgtgacaaggtctcgtgagagtgagttctctctcgagcgggaagcgaatactcgtgagttaccacgaggggaaccagcgcgtccttaatcaaaggtgcccccagaaatttggcagtgccaccagagagtggtgtcctcaatgggagtactggcgcttaaatttcatccaacacaaagggtactctgtgggcaggtgagcgaaggggtcctgtggccctggggctcagcaagccagcgcctgttccactttcatccatctcctcc

SEQ ID NO: 696976 - DNA, 110 bp, Homo sapiens
taatcagctcggtaccatctctccacactggtcaggctcatcttctacctggaaagggtgaaggctgtggacccctaagactggccgggagatcccttacacatttgagg

SEQ ID NO: 696977 - DNA, 393 bp, Homo sapiens
aacgcgctatcacgcgcagcaggatgctgtctctcggctgagtctaggagaccagtgctaaagtagagaggagtatctcgaatgctggcttgctgaagcttccaatgcaagtttctcgcggcctcccaggcaagtctttttcatcgtcatttctttttcccctgagccagttgatccccgtccaaaagcgctctcggaagctcaggaaagcgacttagctctcgtagcacttagacccctcatcctacaatgcaaagccaaaaacactgtggcctccaggactctctgtgggcggactcggccctaaggagtttggtcgcattttttaggtagcagggtaggaggccaaaaagcctgcagtgcaaacatacgggattggcctgtgaataaaag

SEQ ID NO: 696978 - DNA, 165 bp, Homo sapiens
  misc_feature (53)..(53): n is a, c, g, or t
  misc_feature (60)..(60): n is a, c, g, or t
  misc_feature (88)..(88): n is a, c, g, or t
cctcgccggtaggctacgccaccgagtgaagccggccgcggccaatcgcgcgncccgccntgctcccagtggcacggcctgggggcancgtccgccgggctggggaagccgttccaagttccaagggtcgcgggtgtaactcatgcccctcccagcacgcgccgg

SEQ ID NO: 696979 - DNA, 207 bp, Homo sapiens
cattgatgccccgtgtgatcggtgcatggcaagagccaagaggagggaaaagggggtcgagtgttgtctgtaactctgttcccacgaggcacattcaggaagtagaggcataaataaggagatttacaccattcctcctttcacaggtatgacagattaaataatacctgtacactgtagtataaactttgtaccttctataggtca

SEQ ID NO: 696980 - DNA, 293 bp, Homo sapiens
attcgcggccgcgtcgacgatcggcattttgaagaatagggtgggttggccagcacgggcggatcaggaggtcaggagatcgagaccatcttggctaacacagggaaaccacgtctctactaaaaatacaaaaaattagccgggtgtggtggcgggcgcctgtagtcccagctgagggactgaggctgaggcaggagaatggcgtgaacctgggaggcggaggttgcagtgagccgagattgcgccactgcagtccgcagtccggcctgggcgacagagcgagacttcgtctc

SEQ ID NO: 696981 - DNA, 144 bp, Homo sapiens
aaataacaatggttgaaattactataaaagaaataaaaaatacaaaaaaaaggatcaataaaaccaaaagctagtttttggacaagattattaaaatagcaaaactcagccgggtgtggtggctcacacctctaatcctagcat

SEQ ID NO: 696982 - DNA, 884 bp, Homo sapiens
  misc_feature (430)..(430): n is a, c, g, or t
  misc_feature (466)..(466): n is a, c, g, or t
  misc_feature (476)..(476): n is a, c, g, or t
  misc_feature (481)..(481): n is a, c, g, or t
  misc_feature (490)..(490): n is a, c, g, or t
  misc_feature (502)..(502): n is a, c, g, or t
  misc_feature (510)..(510): n is a, c, g, or t
  misc_feature (607)..(607): n is a, c, g, or t
  misc_feature (655)..(656): n is a, c, g, or t
  misc_feature (678)..(678): n is a, c, g, or t
  misc_feature (681)..(681): n is a, c, g, or t
  misc_feature (698)..(698): n is a, c, g, or t
  misc_feature (729)..(729): n is a, c, g, or t
  misc_feature (744)..(744): n is a, c, g, or t
  misc_feature (761)..(761): n is a, c, g, or t
  misc_feature (766)..(766): n is a, c, g, or t
  misc_feature (775)..(775): n is a, c, g, or t
  misc_feature (884)..(884): n is a, c, g, or t
ccttaaatacgtcccctctggctctgccgtccaggagccccagttaccgggagaggcgtgtcaaaggcgccatgagcaagatcagcgaggccgtgaagcgcgcccgcgccgccttcagctcgggcaggacccgtccgctgcagttccggatccagcagctggaggcgctgcagcgcctgatccaggagcaggagcaggagctggtgggcgcgctggccgcagacctgcacaagaatgaatggaacgcctactatgaggaggtggtgtacgtcctagaggagatcgagtacatgatccagaagctccctgagtgggccgcggtatgagcccgtggagaagacgccccagactcagcaggacgagctctacatccactcggagccactgggcgtggtcctcgtcattggcacctggaactaccccttcaacntcaccatccagcccatggttgggcgccatcgcgtgntggtggaacngcagntggtcctcnaagcgcctcggnagctgagntgagaacatggcgagcctgttggctaccatcatcccccagtacctggacatggatctgtacccagtaatcacttgggggtgtccctgagaccacggngctgctcaggagaggttcgaccatatctgtacacgggcagcacggggnnggggaagatcatcatgaggtgntgncaagcactgaccctgtnacgctggagctgggcagggaagagtccctgntacgtggacaagaantgtgactggagtggctngcgangctcgctgnggggaattcatgaacccaggtggtccaggacttgtgttgtgccccagaatactttcttctgttgaccctcgattccggaaaccccaattgggggaacctccaggaagtn

SEQ ID NO: 696983 - DNA, 480 bp, Homo sapiens
  misc_feature (433)..(433): n is a, c, g, or t
ccagcctggagcccaggactggaggtagaaagtgtgcaaaggaaaatgaaaagaaatctcagaacccctaacttctagagaccgagtcacaaaacaccaccagctttttcccaaataaacaacagttactttacaagctggtgtccaagcattccacactcaacaaactgtggcaggagaacagggagttagagtaaacgggggttcagcaggtgtagccagttcatataagcaaaagaacagcaggtgccgccggtttgtataagcaggagagcagcaggggctgcatacaggccacatcctcccgcccatggtaacaagccactccagcctctgatggactgcaagctgggtctccactccagcctctgatggactgcaagctgggtctccactgcagcctctgatgggtcgcaggccaatctttcatggngtgtagccaattggaggcctctgggcatggaggggtgttgccaggtt

SEQ ID NO: 696984 - DNA, 416 bp, Homo sapiens
cactgcagcccggtttgcctttctaaatttcatcttaatttaaggaggtaaagaatgaagtccacactccacaggataactacttctaaggagctggaaagctgtctggcttattgacacaaatttaagaaggaatatttcctccaaagtcttgggtgaaccacagcagcttgggcagtgtggacgtctggcgtcctgagcttgtgctgggctggaaggagagcgggggagtttgtaaggcaggttgcagtggtgtgggcgggagacaggggtggcgttcacagtgagagacggccaggggaggcccctaggaagaatccgcccatcacagtggatggaagccacgattggacgtgaggcttaatgtgagctctgtgtacaaacaaagcccagctcattctgtagaccagtattct

SEQ ID NO: 696985 - DNA, 323 bp, Homo sapiens
ggacaatggtccagccaaatcaggaaggactttctcaggtcctagaaatgaaaggagcagtggcccaccatcaaaaagggggaagagagggccatttgatgaccagcctgcaggcacaacgggggttgacctcatcaagggcagctctgcacaccatcaggaaggagtacctaagggtacaggacaaaagaactccaaagactggtcctgggaaacaaagagaagaccccaaaccaggccctaaaaaaccaaaagagaaggggggtgctctatcagcagttggatctcaccaattatgcaagggtggttatcctggaggatca

SEQ ID NO: 696986 - DNA, 533 bp, Homo sapiens
gtcgagctgttctatgagtatcccagtactgtgcgatccttgcagtgcgcctgcgtcgctgggatacaggcgtgcccgacacatgcatggtaaataataaattatatcgtagagatgagatctccctgtattgcccagtgtggtctctaactcctgggctcaagcaggactcctgtcccagcctcccaaagcactggaattacaggtgtgagccaccacactcagtcacaaactattatttaaaatatttaattatacggaaaatttccaacaatagaatgtacttactcaatgcttctcagccacagggtgatatagccctctagtggacattttgacacatgtctaaagacctcttatggtaaatcacagctggagacaggtattggctgcacaggaatgctcactaaaccatttacagtaacataggcaggccttccacagcaaatgagttacccgggcctaacaatgtcagtagtggccagcgagagaacccctggtatgtactagccccccatgtactcaacagcgca

SEQ ID NO: 696987 - DNA, 884 bp, Homo sapiens
  misc_feature (481)..(481): n is a, c, g, or t
ccaccatgggtgtttcctaagcccccatcttctcggcggccgcctccccgggtttttgtaatctcccccgagcaacgaatcccgcgggggtcaaaaacttctgggggaacgccgtctgattgtttgcgcaaagaactgcttgtcggataagccgccccgccatgttgaaaggtggggtgtccccctttccaatgaagagctcataaacatataatgtatgtgatcttcgtgctcccgggccatcattaaatatgttatcatacattatgggggaagacacacaccccttttacgaggacccccactatgcgtctatataccctccactccctctcggagcgatcaattcaattcctggttatttatgagggaacacacacagattatgggtgtctttgggatcccaggttcgatctcaccacccgcgtggatactcagctgccaccccctttgtgtggagaacacccaaggtgggagtgantgactacccccgtgtggacccccggcggcgatatagaaccacccccactgctgggggttccaaacgaagctgcgtatacacattcacactcagctctctcatcatatatatcactccacacataaaattcccgcgtggtctggtttaggcgcaagcctccgtgttgtgacccacgactcttacgcgggagctatgtgcgtgtgggagcggctgctctctgtgagttcccacgaggacgccaccatctccccactcgatgacgtggacgagtggcggaccaccccacctctccaccccgggtgaagcaactatgataacttttttgtaccaaacaaggaaaataaaaaaaactcaaaaatgcttttaaacaaactgatctgaaaattttccgaaaaacaaaaca

SEQ ID NO: 696988 - DNA, 257 bp, Homo sapiens
  misc_feature (42)..(42): n is a, c, g, or t
tccaattctcctgcctcagcctcctgagtagctgggactacnaggtgtgcgccaccacacccagctaatttttgtatttttagcagagacaggctttcaccatgttggccaggctgttctcgaactcctgacctcaagtgatccacccacctcggcctcccaaagtgctgggattacaggtgtgggccagcactcctggcaaggctgtttttttgttttgttctgttttcctttttttttgagaccgtgtctcactc

SEQ ID NO: 696989 - DNA, 198 bp, Homo sapiens
tagggaagaaaagaatgttgcttaagaaagaacatcaccattgattttaaatacacgtagcagggtattgcctttgattcactgttttaagtcctcattttctcaaactaagtgcttcctgttcccaatatgcaagaataacttttacactttttcctcccacacttcttgattggcttgcagaaataagttttaaat

SEQ ID NO: 696990 - DNA, 330 bp, Homo sapiens
cttatatgtattttggagacggatactcgctctgtcacccaggctgagtgcagtggtgtgatctcggcccactgcaacctccacctcccgggttcaggtgattctcctgcctcagtttcctgagtagctgggatcacaggtgcacaccaccacgcccacctaattttggtattttaagtaaagatggggttcaccatgtgggtcaggctggtcttgaactttggaactcatgatctgcctgcttcggcttcccaaagtgccgagattacaggtgtgagcccactgcgcccagccaagggataaaaacttctactcagccggggtctccag

SEQ ID NO: 696991 - DNA, 101 bp, Homo sapiens
agaaccacacgaagcatggtcacacaggaacagctgcacggccttgtcactggagctgctggctggtgtggtagccaggctgtcctgcaggtcccactggc

SEQ ID NO: 696992 - DNA, 457 bp, Homo sapiens
  misc_feature (14)..(14): n is a, c, g, or t
  misc_feature (65)..(65): n is a, c, g, or t
  misc_feature (72)..(73): n is a, c, g, or t
  misc_feature (111)..(111): n is a, c, g, or t
  misc_feature (212)..(212): n is a, c, g, or t
  misc_feature (221)..(221): n is a, c, g, or t
  misc_feature (227)..(227): n is a, c, g, or t
  misc_feature (233)..(234): n is a, c, g, or t
  misc_feature (236)..(236): n is a, c, g, or t
  misc_feature (240)..(240): n is a, c, g, or t
  misc_feature (384)..(384): n is a, c, g, or t
  misc_feature (405)..(405): n is a, c, g, or t
cccaccccagtgcncccctccccccagcctcgttaaaaatcgctgcgtaaagtcaggttaactgnggcgggnnccccctcccccctcccacctaagatgcaaactaaaagnccccgtccctcccctgcccccctccccccaccccgggggccattctggttcggtgtacagcactgtgctacctcgcccctctttccctaataagggggggngggggagtnggtggngagctnntntggngccaaaatttgtgcaaggggggggaggggggcttgaaagagggcagagttggggttctgaggggggaagagggaggtgaatgaggaggagagctagaaaatggaagatttagaggtttggggggggtgtggaggcgggtagtgnccctccctccctcgaaggggnctcgaggggggagaggcgggtacaggtgcggagatggggtgggggaattcgc

SEQ ID NO: 696993 - DNA, 212 bp, Homo sapiens
aagaatgagctggccacacgcgagtgccatacccacaagccccactcaccaaagtgcttgatctgtttctcgtatttttccacgaaggtctggtccctcggcgtgtgcagcaacaacttcgtccattatgatttgcaacaacttcgtccactctgacttctgagcagaccggtgtcactcagcgtgtgcagtatggtcactcggcgtgtgca

SEQ ID NO: 696994 - DNA, 352 bp, Homo sapiens
gaaagatggaatgtcacccgagatagtaaaaacaaatataaacctcgggggattatccacaagggagcctgttgcctttgctgctgcagaaattgcagagagccattgggcgcattgaatattagggagtgtgttttttagaagtcatgtggcatgcaaagtgaaagcaaagaagcagactttcacccaaggcagaaggtttgtgggcgtgaaaagccattttagacacacacacagaacacagagatggggggatacatttttggagaagagccattttagttggaagaaaagcagaggaatccagacattgcatggttttcggcctagcgtacactttatagccccattt

SEQ ID NO: 696995 - DNA, 1445 bp, Homo sapiens
gagagtgagggcccaaggtccgccctgctccgccacttagcgccgccccagatgcttccctcgtgggctgccacgcggcgtcgtggcgctgctgccgctggctcgcggggcctttctcgccgacgaccggcgacggcccgaagccagcgcgagccgatccttctgcgaagcggcggactgcctggtgccccgcacgcacgccagagatcgtacgcccgcgtcgagctctctgctagccttggcggcctgggaggcgggcgctcaggcggtcgcgtggcccggccgcagtgggcgccgtgtggtctggctgcgcgcggtagtgcttgcagttctgactttcggcccgcggagcagctcgaagccacgcaggctaccatcgatgcgcacctctgctggattcctccacttccatagtgtcgttccccacacctatgtgttagcgctgacgagccctcagaggccgtgctagtatgccactctccgtcgggagactccgggggacccttcgccccgacgtatccatcgcgtggacgtcttcccctttgcgtagccaaggcactgcggctcggccacggtggttgccacgcctctggcttccgattaggctcgcacgcaggttaactggtgcgggctgtccccaggggtccttcccattacacaggcccgattcccagtcacacatacgcatagaaccttcgttgttccgcgaagatacaaccgttgcgggtttcacgcaccttgcaacttgacaacaacctttgcggtcggtgaacaccggctgcgaaaacaagtgattgtcaatgaggtcgaagggggaagcacacactccccctttgtggaaaagagacctgtgaaccaacccgcagggtcgcattgggtgagaacgccgccttggccacatggtacaaggttgaaagcaagagcctcacccgcgaattgaggtgtgggccagccataggtctgccaccgtaccacccggcgttgtgcaccgcctggggtccgcatgtgtcgtagcccttggcgcgcctcttgggtgagctgccggtgtgtggcctgccttgcaggggcttaggccggacccttttggcacatttgtgttccttacaccccggggaagggtttggcgattgtcggggggtcgcaccggggcgcctggaacgcggcctactgttgaagtgcagaccgttgaatcggagagaaggcaaccacgtccagaggcgttgaggcaacgcgattgccataatggaacattggtaccctgaagctggcgtaatgcggacagacaaggcgccatcaactatccagtttttggaactgtgaatctccagtataagggatgggtctcttgtatcttcccccaaggtgttcgacgcaactattaagttccctcgatctgcgaaactaagaagtgaagcgaattccccctgccttaagcatggtgccct

SEQ ID NO: 696996 - DNA, 248 bp, Homo sapiens
ggcaaaatagtctcctcttgactagctgtgcaactccccaatcatactgtatgccacatcctgtctccactgttgtggtatagctaaccagaagggcacgtgtgacataccaggagattctgtcctccccaataactggcccaatataagtgtccttgccaacatgcgcaaacccagagggtacaggtggtttactccaataaactttttcccacaagaacaccagctcatttggaggagcactgaca

SEQ ID NO: 696997 - DNA, 402 bp, Homo sapiens
taaccatagggacagagtgggcaggtgaagatagcaggtaccacataaccaaggaactctagcgtaggtctatacccaaacacttccgcaagatgtatgtacaagaaaacactcgctgcaacattagtcgtgatggcaaagatttaaaaatagataaactctgtagcacttatttggtggaccacgattcatagctgtgatgaggagtgcctggcatacaagcactatataagtgtaagatgcacatcatcattgtcactgtcatcatcagaatagataaacctcaagagctgaagttcagtataaaaaaaacatcaccagaaagtggtacagggagtgtactgacaggtataccgtccatgtagtcacacacatcgcatggccaatgtggtacggcatact

SEQ ID NO: 696998 - DNA, 938 bp, Homo sapiens
  misc_feature (235)..(235): n is a, c, g, or t
gtggacgaggagctacagataagaggacaaaagaagagatggcatggtggcgcttattgcgggccacgtatgttttctgtgtgaagcacgtccactgttggagtgtgtggtttattgtcgccccctggtagatcgggcctgtggaatatgagactgtctgaacattcaaggttgccgcgcgtcacttacgatctggtgcgccccgcttgccgtttatagcccacagtgttccaanaaggtgaaatgttctccaacaacttaatgcggttgtcggtttgctagcaacctttcctgataagggaaatgcggcccctccactttttacggagcccccccgttgtgtcaaaaccaccgggaattgtggggagtctgatcccgtcccccgcaatctgtgggaccttttctagcgcccaatttatttctggtggtgtcttatgaaacccttgtatgaagaggaccgctaatttgccaccgaactgacccacggggaacacatcaccttccccagtcatacgacgtactaagtgcgcagagaataattggtctcaggaacccacggtgcccgagatccaccaagtccttggaagatttcgtctttgtcgtcgcccctttaaagaccacacatctttgctgtagaagaggcaaagagcaccctttgggcttcaaaaggtaagaaggttacatttatcccaccttttacaacaggggcacctcttgtcaaaaattttgattaaccttccatattcaatcgcccttaagagggagttggctctgtctactttgatcgtgtatcggttaaaactccctgctaagccgcttgtgtagaacaccctcccctcagcgacgacatcatggctggggccaaagtagatccccaagtagaggctggtttttcttcttccccatccaaaaacaatttcaccccccccaacaaaaca

SEQ ID NO: 696999 - DNA, 270 bp, Homo sapiens
aaattttcattttgagattttctcaattgtatctagttaaatagcacagtttggaaacttgttctgagactgactttatcaataatctaaccgacaaggatcatatccatgtgtatgttggttagacatttttatttcattgactaaccaggacagtttcagtgatgcacattgtgtgccctctggttcagctgacacagtcctcggactttcaaaaaccttgattaggctcccacagttgtataaattggacactttaggattttgaaa

SEQ ID NO: 697000 - DNA, 934 bp, Homo sapiens
  misc_feature (262)..(262): n is a, c, g, or t
tcttacaagcagatccgtgggcacacccctgtggccccgcggtttgcccccgtggagcgctggtcccttccccgcgacgggtgtttccccgccctccctgtccaattgtccgcccggttgtcccccgtgtgatgggtgccaccccggagcaacttgcaagcataacttgctctgctgtaagaaagcgcatgtggcccccccttgttgttaaacaccggcgaggtgtccccccatatcttctgcagttgtgttagggccaccnccccgcatggctaatcagggtcttgcgccacgagaccccccagatttctagggagccttcttcacgctacaccccacgctgggcggcccccccatgccggtctgcggatacaatacaaggaacgcacgccacccctgcgtgagtgcggtgttctatccgaaaacaacgctgggcccacacacaacatggtggccaagtcgaatgactacgaggcatcacaccaacttgctgcctcacatcaccatttattacaagcgacgccagtactattcatattgtccgcacctaacactaccgcgccaccgcccccactccttaacacccactctaggggtcggagaaaccacgctcatttaccaagatatggttggcgcctcatacacgcggtgcccaagccaaacgctcacattttccaaaagaaactcggtgaattgcctgtacagcaacgaccgtccgccgcactttactacgatcaagaagaagcaatatttggtggaccacgcccttcggattctatcttggttcgggtgaggcgccccatgttagatatgagtcgtttcccaaaaacccagaaatgtgtcttattagggagagcacgactttgccccgaccaacactgtgtttcccgacgtctaggcccccccgaaaaaattcaaacagacatagaccaaa

SEQ ID NO: 697001 - DNA, 986 bp, Homo sapiens
  misc_feature (28)..(28): n is a, c, g, or t
  misc_feature (63)..(63): n is a, c, g, or t
  misc_feature (66)..(67): n is a, c, g, or t
  misc_feature (70)..(70): n is a, c, g, or t
  misc_feature (89)..(91): n is a, c, g, or t
  misc_feature (113)..(113): n is a, c, g, or t
  misc_feature (124)..(124): n is a, c, g, or t
  misc_feature (131)..(131): n is a, c, g, or t
  misc_feature (133)..(133): n is a, c, g, or t
  misc_feature (136)..(137): n is a, c, g, or t
  misc_feature (139)..(141): n is a, c, g, or t
  misc_feature (143)..(143): n is a, c, g, or t
  misc_feature (152)..(153): n is a, c, g, or t
  misc_feature (156)..(157): n is a, c, g, or t
  misc_feature (162)..(162): n is a, c, g, or t
  misc_feature (165)..(166): n is a, c, g, or t
  misc_feature (168)..(169): n is a, c, g, or t
  misc_feature (173)..(174): n is a, c, g, or t
  misc_feature (179)..(180): n is a, c, g, or t
  misc_feature (182)..(182): n is a, c, g, or t
  misc_feature (185)..(186): n is a, c, g, or t
  misc_feature (189)..(191): n is a, c, g, or t
  misc_feature (193)..(193): n is a, c, g, or t
  misc_feature (195)..(197): n is a, c, g, or t
  misc_feature (199)..(202): n is a, c, g, or t
  misc_feature (205)..(205): n is a, c, g, or t
  misc_feature (210)..(211): n is a, c, g, or t
  misc_feature (213)..(213): n is a, c, g, or t
  misc_feature (216)..(216): n is a, c, g, or t
  misc_feature (225)..(225): n is a, c, g, or t
  misc_feature (231)..(232): n is a, c, g, or t
  misc_feature (235)..(235): n is a, c, g, or t
  misc_feature (242)..(242): n is a, c, g, or t
  misc_feature (247)..(247): n is a, c, g, or t
  misc_feature (290)..(290): n is a, c, g, or t
  misc_feature (292)..(292): n is a, c, g, or t
  misc_feature (297)..(299): n is a, c, g, or t
  misc_feature (303)..(303): n is a, c, g, or t
  misc_feature (305)..(305): n is a, c, g, or t
  misc_feature (312)..(312): n is a, c, g, or t
  misc_feature (352)..(352): n is a, c, g, or t
  misc_feature (356)..(357): n is a, c, g, or t
  misc_feature (359)..(359): n is a, c, g, or t
  misc_feature (362)..(364): n is a, c, g, or t
  misc_feature (367)..(367): n is a, c, g, or t
  misc_feature (374)..(375): n is a, c, g, or t
  misc_feature (378)..(379): n is a, c, g, or t
  misc_feature (385)..(385): n is a, c, g, or t
  misc_feature (391)..(391): n is a, c, g, or t
  misc_feature (436)..(436): n is a, c, g, or t
  misc_feature (439)..(439): n is a, c, g, or t
  misc_feature (446)..(448): n is a, c, g, or t
  misc_feature (451)..(451): n is a, c, g, or t
  misc_feature (453)..(455): n is a, c, g, or t
  misc_feature (462)..(463): n is a, c, g, or t
  misc_feature (466)..(466): n is a, c, g, or t
  misc_feature (469)..(470): n is a, c, g, or t
  misc_feature (477)..(478): n is a, c, g, or t
  misc_feature (490)..(490): n is a, c, g, or t
  misc_feature (518)..(518): n is a, c, g, or t
  misc_feature (541)..(541): n is a, c, g, or t
  misc_feature (547)..(549): n is a, c, g, or t
  misc_feature (561)..(561): n is a, c, g, or t
  misc_feature (566)..(570): n is a, c, g, or t
  misc_feature (572)..(572): n is a, c, g, or t
  misc_feature (640)..(640): n is a, c, g, or t
  misc_feature (657)..(657): n is a, c, g, or t
  misc_feature (664)..(664): n is a, c, g, or t
  misc_feature (669)..(670): n is a, c, g, or t
  misc_feature (711)..(711): n is a, c, g, or t
  misc_feature (717)..(717): n is a, c, g, or t
  misc_feature (735)..(735): n is a, c, g, or t
  misc_feature (849)..(849): n is a, c, g, or t
  misc_feature (897)..(897): n is a, c, g, or t
  misc_feature (985)..(985): n is a, c, g, or t
caagctgagtggaaccagaggcggctcnctagcaatgttatccacaggagtcccagtctgcgnatnntcnttaatctatataaaaatannnttaatatgtagtcatataatanttttattattntataaantnttnntnnnantttttttannatnntaaanatnntnncttnnttatnnanttnncannnantnnncnnnnctnacctnntntantataaacanctcttnncantctcctnctctngagggctggttcccttccccagaggaggcaccggtggaggacntnccagnnncccngncctaacntcctgctcagcctctgcactcagccccaggtcgggccctngcanntnctnnnatnacccacnnaanncacttngctggngcctgcaggcccctggaggatgcggtccgtggctcagtagatttnggnggaccannnaanannnaaccaannaanagnnaaccaannagctgagccctngtgggtggcccatcccagggtgggcttngctgtggcattggcaggcctgantcctannngctcagagcttngcccnnnnntngctctgcagcagggcacgcatgtccaggagcgccttctccaggtaatgcgccaggcgggcggcgttgntctccgcgcactgttgntaggccnacagnnagaagttgatgtgggcctccatggggttatagcagacaccntagccntcggggaccacgggcccnaagaacatgacacagtctgtcttggcagggacctggctggtggagaggtggaagtgcatggcgatggcgtaggaggtgtccatgaagatgtcgggcatgctcaccaggtcctcnatggcctgcagcttcaggcccagcaggtgtcgatcaaaggcctcccgncggatggcccggtcgggtgtagcctcgggtgggcctgcacggccttccgcagcagctccaccttctggtgctccgtgaagctggagtna

SEQ ID NO: 697002 - DNA, 410 bp, Homo sapiens
  misc_feature (184)..(184): n is a, c, g, or t
tttttctttttatctttgattacattaacctcccaaaccttagggaggcaagtattactatttagtgttaaataagcaagaaaaaggtcacatttcagaaacatgccagtgggctcacaaatttcttagcaagcatgagagaatccgaatcccaaatgtaagatgacacatttataaataaaancaaggacaaatgtctcctttattctaaatataccatcacactctgagtagctggggttaactatttttacccacaccggctcttttgcatctcaaactcatgtaaaacaactagatccgtggacacgaaggggaagctgtgggccttcagcacttgacgattgtgcgtttatcttctcgcgattatagttacacaggcgaccgaatggtgctcatgtgttgtcctg

SEQ ID NO: 697003 - DNA, 199 bp, Homo sapiens
gacagcaacatttcagatgtatcaccacaaaccagactaaacagaatactttggcttgaaaccggaacacccagggttactgaggacattatgctgcctgacctgattagatgatacatggaggtatctcccgaatcatacaaaattaaatgtgaagaacgtttatgcataccttcatgtgcctgacagtcttggcttt

SEQ ID NO: 697004 - DNA, 480 bp, Homo sapiens
  misc_feature (184)..(184): n is a, c, g, or t
tttttctttttatctttgattacattaacctcccaaaccttagggaggcaagtattactatttagtgttaaataagcaagaaaaaggtcacatttcagaaacatgccagtgggctcacaaatttcttagcaagcatgagagaatccgaatcccaaatgtaagatgacacatttataaataaaancaaggacaaatgtctcctttattctaaatataccatcacactctgagtagctggggttaactatttttacccacaccggctcttttgcatctcaaactcatgtaaaacaaaaacggtgagaaatgaaaatggaccctggaccaactgccccggcggagtcaaagggtttgtctttcagcactagatccgtggacacgaaggggaagctgtgggccttcagcacttgacgattgtgcgtttatcttctcgcgattatagttacacaggcgaccgaatggtgctcatgtgttgtcctg

SEQ ID NO: 697005 - DNA, 482 bp, Homo sapiens
  misc_feature (4)..(4): n is a, c, g, or t
ccanggtcctatgagaagtggggctggaaaatctctgtgtgagaaacagtatcacttgaggaagtcttaaggcttcttagagcggtttcaggttcgaagcaaaattgagagaaacatagagagatttcccataaactcctgcctctgcacacatgcatcctcccccatgatcacctttgcccactagagtggtacctttgtcagaactgatgagcctacacgggtacatctttattatacagagtccagggtttacactcgggttcacccttgggctcaatgtgtttcaaaagtgctgcacattccttgggtttgaccagtgtataatgacatgcatccaccactatcgtattgtactgagtcgtttctctgccctaaaaatcctctgtgctctacgtattcatccttctctacctagtaacccttggcaaccattgatctctgtaatgtctccatagctttgccttttccaaaacaccata

SEQ ID NO: 697006 - DNA, 540 bp, Homo sapiens
  misc_feature (141)..(141): n is a, c, g, or t
gcagcatcgtgacgctgctgccttcctaatctgatccccctcagatcatcatatgctgtaccctgtctatagcgtgctcagccatgagctactggacttgccctttaacaagcgttcttacttggaaaaccccttggcggnggtacgtgacaggggccgcatgcactggtggtcagagagaaacagaacagggcagggagtttcacagcgttcttctatacaatgtctggaatctatgaataacatcggtttttaagttatgagttgatttttaactactgggtttaggccaggcaggcccatgtccagttttgggcctggtgccgggctgcctgtctttggttttacttccctgttgtttttttcttagaacaggtactgagtataaaataatatgagagggtctttctcttccttcataacaatgattaagattgacagccagcccttttattttaaagtaactttttttcacattttaaaaaaattccttttcaaagttgacatgtaacatgtatttattatacacaacatgctttc

SEQ ID NO: 697007 - DNA, 111 bp, Homo sapiens
agctgacatagcaccactgcactccagactgggcgacagagtgaggccctgtctcaaaaaaagatgacacgaggaaagagtaaagagtgagccatatgtagataacatacc

SEQ ID NO: 697008 - DNA, 566 bp, Homo sapiens
  misc_feature (465)..(465): n is a, c, g, or t
  misc_feature (478)..(478): n is a, c, g, or t
  misc_feature (492)..(493): n is a, c, g, or t
  misc_feature (500)..(500): n is a, c, g, or t
gcctttcttcttattctttcttccctttcactaatttatcccgatgttagcacattctgtctcgttactagcggacgcctgtaggttgctacatgggatcattactgatcacggtgactctgaagtctgaactgaaggcggaatgagaagtgggaaaacttttttctctaaactctctgttttttaaaaaactattattctcgatgcttgttaagaggaaaaaaaaacctttggtgcttctgttgtgaatgtgaaacattattttccagctgtacagtgacacattttttttaaggagaaaaggactgattcgtttgccaaaaggggggtggggaggtggaataatgttatcgagtgattattctggctgagatgtgttatttggtttcttccttcttgatcatttggtgtttaagtaaaatgaggcacaggcttgtttgccgagtggagtgggaaaggcatttngatttgtggctanttaaaaaatgatannggattanaaggaaaaggtggacctggactgagggtgtaaaatccctggacacattcgtggggcagggaaaaga

SEQ ID NO: 697009 - DNA, 246 bp, Homo sapiens
gtagccggacctttcaaagcggagatgctggttctgtgtgctctgggctgcgtgtacagcagaggcagcaaggtgtgtgggattccttgtggcttgcaccacaaagtgactgtcttttgaaaactggcactttgatttctgggaaagcgcccattcaacagttaccatgctgcctgcctttaatggctgcggtcctgaagtgatgaggcacactagcccaaggaggcagcatctccgctttggaaa

SEQ ID NO: 697010 - DNA, 1491 bp, Homo sapiens
  misc_feature (404)..(404): n is a, c, g, or t
  misc_feature (726)..(726): n is a, c, g, or t
aatcaccatggcgtgctgggaccctgtacactgtatcctgaatacactgggatgggccttcattggctctcatcgctgctcagtacagcggggctcagtgtccgcgtagctctccgcttccaccccagtttccattttggcacgaataccgaagaccgcgaccccgtgtaagtttctcccgcgataatttcacatgcctggcacaggtccctaggactatcttgatggtgtgatggatcggcattcatgttgtgtgtagagcagcgacatccaattgcctacgtatgtgagcaatgaggagctgctggaggacacgttactccaggaaggacatgcaagcaccacggtagtgttgctaagtccgtggtagacgcttgttgctaagatgtacctgattatatgtngcctccccaagactcaagtacctaggggttgtttccactcattctttgagagccttccattgcaaccctacagatcaaagaaggtccattaggtacgcaatagcccaaatgcgcagcgcaatgtaggcaaggccggtacatttctagtggtgctgcttccggtatcgcattatactttcgcaccagcacccgcatgggcactgtttctcctttggttcggcgcggagaccggcacgtttgactcatctaggcgcttggcaccatcagacacgagatttagttcttagcaccccgtcggtttgtagtgccttccatagtaggnggtccatgaagtgatacttgataagaaaggctcatttccttttgataccgtgcaccaacggcgccacttttgattctctcaaaagtttacaccaaaaccactgggcttggggttttctctttcgtatctcttaggcaatttaatagcaccatggggtccccatggtattccccaggggtcattggtcctttaagggggagggaaaacggtcagaaaaagccgtgggtcagtccggatggaaaggcgacttgggtacccccaagattggtcgaaatttggccatatacagtagcatggtctttatgccagagagaagaagcgcccaaacgccgttaagacaaacatgtgtacaacaagcaccatccgggtacacacgaacgtacacgggggctcttcacccgggggggagcacgaacggacacagccggagtaaaaggcccccccatagggggccatatgaaaggtccagggacagggcgcacggcgacgtgaacaacaacacagggtgtcgtggactttgtcccccccctggtgctatcccatttgtcacgcgatagtgtactgacgactgggcgaatggcataattgttatgactagcccaaaggcttgacattaggtggacagtcgcgtggcatgtcccccaagtgggcaccaggagaaccccattttacaggttccaaaaccttggcccaaaagaattatccactttgtgatgagagtacgggaactcggaaattaaacggacagcacgaagtatgatctaa

SEQ ID NO: 697011 - DNA, 438 bp, Homo sapiens
ctgaccacaatggaataaagctagaagttaataacgagggatttttgaatacatggaaattaaacaatatgttcctgaatgacaaatgggttaatgaagaaattaagatggaaattaaaaaattttttgaaacaaatgataatggaaaaccaaaacttatggtatacagcaaaaacagtactgagaggataagtttacaactgtaaatgcctacatcaaaaaaaaaaaaaaaggaaaactttcaattaaacaccctattgatccttcttaaagaactaaaaaagcaagttctttggggtcccaaccccaaatttagtaaaagaaaagaattaataaaattcagcgcagaattaattgatttggaaatgaagaaaacaatcacaaaagtatattgaaccaaaaagtgggtttcctgaattgacaaatttgacaaccttt

SEQ ID NO: 697012 - DNA, 937 bp, Homo sapiens
ttagctctcgcggttcatttttggttccccgcgagctggtctgctttttctgtgactcgtgaagccagtgcttctgcttaaactcgggtgggccccgcaccgtgagtaagtgcttttgcccccatcgcgaggggcattggccaggacggcctgtggccaggaggtgagacaggtgctgttcgccggactgactggctttttccccgggggcctctggaagatttggtgggcaggacaagagggcactgtcccctgtccccgtccccaggaggtaccgacagtccctgtgcgtggttagactcggagcgctgcacaccgaaagcccaaatcgggagctctgcctgccggctactttgctgatggggtgtattgctgcttctggggggtaaggaaacaagttacagaaattaccgcgttctgtgtgaagggtctgagggtgtggtgtctttggtcagagggtcatttatagagagagccgccccagcccctcgcatcgcctggacttggggtgtcattttgcgctggcggaccaggcactactagcttcgcctgaccccgggcactggggctgttatctggaccgctgattactcagaacaacctaccagattaccggcattactagcagtgggacaagaccggggacgcacaggtccatccttccttgtcggcagggactctttatttattcccattgctctagggctttcggtttccccgttcttccggtaggcgcgcgtagaggcatgcagccgggataggttatcccgctggtgaccccatcgtcggccatagagggacgctccctgccccatcccggcatgtgggctgggccgcttgcctctgcgtcgccctgtgctgtgttcatccagctttgtagcagcagcctgtacatacccaggcgcatgtaccaaggtattaccacgtgggattttcg

SEQ ID NO: 697013 - DNA, 116 bp, Homo sapiens
tcctcgtagagtgttttgttcgcttatccaaagagtttgggcaaactaccactctgggatcagcttaatctaacttcaaggattaagatccgtactcggaggctgggctgcaattc

SEQ ID NO: 697014 - DNA, 319 bp, Homo sapiens
tgatggttcagcggagcaatagtacaggtgctgcaagagaaacagcagcagtttttgaagcttcagaaacagaaagcaaagttgggaacgcaagttacattagagaaacagtgcagagttgaagaagcatcagcagtaggtcctgttcacaactctgtgccttccaacccagtggctgcccctggattcttcattcatccatctgatgtaattccacccattccaaaaagaacacctctttttatgactccaccattcactccacccaatgaagcagtttccgtggtgattaatgccgaacttgcacagctaattccgg

SEQ ID NO: 697015 - DNA, 938 bp, Homo sapiens
tattaaaagtgtcttaaggaataaccaacatatattgtgttgcatttattaatcaagtaaattttatactcatctctgtcaaatatattgtgtcaaaattggcataggagacacaaaactataaacccagcccaaatcagaatgatcttgtgtaatttttaataaattagacatttatatgggtttaatgaaaatagctgcatcttgaatttagtaagattaccttaacttctaatcctgtggttttaggcagttggttcacagccaataaagaggtttatttgggaaaggactcttattgtcttgtttcaaagctaaactttaagttcctctcaaagttacttggcctatgcccaggaatgaacaaggacagttggatgttaagagcaagacggagtcagttaggtccaatcttttttcaccgcctcaattataattttccaatggtagtttcataactttaaatcatgactatcacagttttcataaataatctagataaacaattacaataaaataagtaaatgtaatggaataaatacttgtagtcaaacggtcttatttagaatatatggttatatcacattaatgataagatatttcatattgagtatttcaataattttttctgtaggaaaacattcttgctaacagaaagtgtccttctttcacaaaaggtggaccacgttcggataactcacaacttccttcaacgatgatgtttaaacaggtaaaggcaccgggaggttacaatttgacaaggacgtgcaaatcaaagccacggctctgaggaaaaccggacacatatcaacacgacccccacgagtgagcaaaaaaagtgtgacacgggcggaacaactacggaaaaacgaaacaagtcatcaaaaacaatcgtacgaatcacaacacagaacttcttttcctaatatcgcttctct

SEQ ID NO: 697016 - DNA, 191 bp, Homo sapiens
tgtaaacacacacacacacacacacgcacgtatgtcacacacgcatgcacacacacacacaccccacctaaagaccagccatggagaccaatacgtggaggactcaggcctatacaccagtgatgcccatgtatggaagcagagaaatagagtccaggggtggctatttgttagtgggttatggggccata

SEQ ID NO: 697017 - DNA, 374 bp, Homo sapiens
aaaaagatcctgaataggtgtgtttctagaggcagaaattagattactggttgcatagtgcagggtgaatgcagaaatttggtggggagatgagaactaatacacaggagttttttgtttttttagataaaactgattgttacgttgaatgcacaagtctgtgaatttactaggaaatacttaattttaaatactaattgatgaatcatatggtatttgaattatactccaacaaagatttacaagatattcattgaaccacgatattcaaaaatgctgtttgcattgtacaatcatttcatctcttattctgtgtcaagggctctgcaggactctctcacttgccactgttcttgacactattataaagtagg

SEQ ID NO: 697018 - DNA, 381 bp, Homo sapiens
  misc_feature (221)..(221): n is a, c, g, or t
tccctcagctgactgcaagagggtttattgtacacgagctacacttggccacaagagaacagagctagtccagagtgccgggggtccagggcagagggactgttttggttgtaagaaaggcggtcatttctccaggcgatcgcggcgaggtgacgttccaggtctactgagactcattaccgatggcagcacacagtccgatagcttgtcccggccctcancatccctcacttctgctcctgcaggcgtcgtaggtgcacgggctggcttacttggacctctgcctcatctttcttctcttgcgcttcagcctgcgcattctcttcttccgccacttcgctctcatggcgcaggagtctcaaggaagatggcctcgtgccg

SEQ ID NO: 697019 - DNA, 1035 bp, Homo sapiens
  misc_feature (312)..(312): n is a, c, g, or t
gacggcgtgcagaagctgtgactcagcaaagttttctcgcaagaaaccggctgatacgaggcggaggcggagaagatcctgctagcggagaacccagttgacatgcgcacgcctagaagtttgcgcttggaatgatcaggctgagcatgtttggcaataattcgacgccattaagaaaggacaccatcattagaagtgcgcactcatggaaaggagcagcagacgacggccatgtgcatcgagagcaatcctgtacatgtgacttatatgttccacgttccgccagtccgctagagcttcttcttggttggntgtgttcactgggtgaggaactcagacacgacacatggatgcaacggatgggtctatatggccctgagtgtatatctctcgccaacaactgagaacaatcagtacggtcggctgtagacagatatacctcatatctacatgtatatgagattaatccttcgagctgcccagaatggcctggctcgaggaaaagttactagatgtcagtgttttttgcgtccttcacgaatgtgtctccgtagtagttcaaacggtcacgactcttcaccagctgtaattcactttcggtggcactcaaagggatttatatagaggttaaaaggtcaggcgacaaattgtatctctcatttacgcacttagtctgcaaagcagtccatctaaaccgaaaaaagcacttggtagggacccaaaaggtggggacttgacgtgtgacacggtccaagcaaatcaacgtttcccagataatgacaccgaaacggtcggttattggttctgggccttgtaatgccttgttgtgagtccaacgcgtttgaaaccgaattggacccaagacgggagtggaagggctttggtggttagtaaaccacttttcaaccactttgggacattggttcagaactttaccttttggggcttgggttcaatttgcctccaattgaacaaacacagcctggtgccaggcacattgtttcgccgggacgcctttatatattaattccagag

SEQ ID NO: 697020 - DNA, 306 bp, Homo sapiens
gtcgaccactgtaaatatgttcaaagaaataaacgaagccatgcttaaagaataagggaaggtaggctgggtgcagtggctcatgcctgtaatccccgcactttgggaggccaagaggggtggatcacctgaggtcaggaatttgagaccagcctggccaacatggtgaaaccccatctctactaaaaatacaaaaattagctgggcatggtggcaggtgctgtagtcccagctactcgggaggctgaggcatgagaatcacttgaacccaggaggcggaggttgcagtgagctgagatgtcgacg

SEQ ID NO: 697021 - DNA, 291 bp, Homo sapiens
ctagcgaaaacaaagcggaattgttctaggaaaaaattacttgaacagcggaggagactttgccctatttgatatggaaagcgcagccatgggtatggatatcagagcctcagagttaggagctgctccaagccttcttccctagatgcctcacacccctcctggacagcttccaagtatcacagctctggatggccgctcatcttctgtgtacagactccaacccagctgaaacccatttcatgaaatgtactttatataaacctaatttattaaagagttgcattcatt

SEQ ID NO: 697022 - DNA, 104 bp, Homo sapiens
aatcacaagcgtaacacgcccacttattctacatatatgggtctccctctgtagtccaaggctggagtgtagtagtgctatacgcatctgactgcagactacaa

SEQ ID NO: 697023 - DNA, 803 bp, Homo sapiens
gaagagaaaggggatgcagatcttgctaagagtgatggatttctgggttcagcctacatgagtcatcttccatactacccctggacatgctttccttggctgccaattttctattttataaatttcaggaaagagagattatggttgttaaaaccattcatgacaatgatcccactttagagaaaacaacagcaacaagcaaagaagatggtgtggagatccgcacattccacatcttttaattggtacccattaaataacaaagggaaaaagtaccctcagaccacaactctccaccttgtgtggaggccaaggacccagcagggagaaggcagaagattaggttctccactcatcctggctctcagaccactgaactcacatttgggttctaatggaatggtgattggaagcatattctccaataggaggtttttaaaagttctgtgccatcagccaggcagcatctgtcatttaaaatgactggccagttgcacgtttaaaagcaaagataaaattgctaatttatacttactgaataaacatcagcagtatccatgaaggtacctaccctaatagcaagttgtattctcatcccatggtggtggcgaagcttgccaggaaaaccaaaggcatcagttctttaacttaccatctggttagtcactgatttcatactcacaatttctctggcttccttagaaccaaagagccctacccttggaccctgctgtatcattagacactgggaacagtccctgggcctacaatcaggcacttgcacaggactcggcaaacacctg

SEQ ID NO: 697024 - DNA, 305 bp, Homo sapiens
tcgacaccatcagactactcatacacaccaactacgccctggaccgtacgccataaaccagctaacattactcgcaggccacctactcatgcacctaattgcaatcaccacccaacaatgacataaatacaactaacctcaaaacaaataataaccataaacaaaacgaaaaaaactctacctctctatactaatctccctacaaatcaccttaattataacattcacagacacagaactaatcatatataatatctacatcgaaaccacacttatccccaccttggctatcatcacccgatgag

SEQ ID NO: 697025 - DNA, 721 bp, Homo sapiens
agcggggggtgtggctctgccggcccaggcgcgatgaggcggctgcccgctgggtggcgccgatttcccggggaggtcccttctgggcccccgtgcggaggtgggagagagtcaggcaggagccgaggccggggagccctcttcgtcagctggttgctcacttgcgccagcgccagctgcccagccgggattcacccgcagctccatgcttgtgcccggttcgattcgtccaatcctccaagaagaggcaggaattctaagagtgcccagggtcttggctgggtcttcgaaaccttgggaacacgtgcttcaatgaactcaaattctgcagttgcctgaggcaacactcggggaagttgacgagattacttgctccagaggctctacatgcggggaccttgcaccacggcagcaatgcacacaacagcctcgtggaagaagtttgcaaaaagtaaattcagaccatatggacttcaatccccccaatgatgtggtgagcccatctgaagttcaagacccagatccagaagatacgcaccgggctttgtggctataatcaggaggattgctcaggagttccttcgctttcttctggatgggtccataaagaggtgaaccgagtgaacttgagaacctaagtccaaccgtgagaaacctcgatcatcttcctggatgacgagaaaggcgacagatgttgcgcacacatatcttagaagggaga

SEQ ID NO: 697026 - DNA, 178 bp, Homo sapiens
ggcgcggctgtcccctttcctgcgccgtcggtcgccccgtgctgctgggccgaccgccggccccgtccgtcctggccgggcccggtgcccgttcgaccgacccctggctctctgttgtaccgtgtccgtctacgacggtctccctgccccgacgttcactcccctgacctgccgacct

SEQ ID NO: 697027 - DNA, 284 bp, Homo sapiens
ctccgcctagagaaatttagttacactgttgactccttccctaaatttttaggattgagggagacctcttcttttgcaaaaggcagtttaaaaagccaggtaagcataaacagaaaacaaaagtgagggattttttttgttgggttgtttggtttgggaaggggaggtgctatggaggttattgttgtgacatgttgcttcgaaatctataaaccacacaacaggaacaactgtttttctgttttctgtgacaaggagtactgcagggacaacctcacccagag

SEQ ID NO: 697028 - DNA, 403 bp, Homo sapiens
aatgtgcctgggacctagtgagcgattcttctcacttattattgttttcgtcatcatcgacatcatcgtcaccattacttttcattgtctttggaaatttggacagagaccacaggcagatgcggtgccgtatatccacagggctggagcagcgggatgacacggcagttaggagcttctctgggccttcaggcagacggtctgggctgtgtccatgctgtgccttttcccagccctacctgcagtcctacacatcttctccacctccagcggcttctccttctcacatccaccctctgcgaaggcataaatagtagcaactcccttctggattctatgaggtgataattacatgaggatgcagagccctgagcacgggagctcctcagtgaaaaaaaaaaaa

SEQ ID NO: 697029 - DNA, 457 bp, Homo sapiens
attcgcgggcgcgtcgacgccgtggctcgtgcctgtaatcccagtgctttgggaggctgaggtgggaggatcacttgagaccaggagtttgagaccaatttgggcaacacagtgagaccccatctctaaaaaaattttaaaaattaggcaggcatggtggtgcatacctgtaatctcagatacttgggaggttgaggtggtaggattgcttgagctcaggagtttgaggctgcagtaagctatgatcactgccactgcacaccagcctggtagcctgggtgaaagggggagaccctgtctcttaaaaaaaagggctgggctgttatcccagcacctttgaatggcaaagcgggcggtttattttagcccaagtaattatagtacgaggccttgggttaaaggcaaaaccctgttgtttccgtaaaaatatacaataaagtaaagctggtggttggtg

SEQ ID NO: 697030 - DNA, 125 bp, Homo sapiens
gccgactactactactactactactactaaattcgcggccggtcgacccagattgtgagccagacctccattttatcagaggagttgtgataattatcacatttgtctacaataatggaacagta

SEQ ID NO: 697031 - DNA, 466 bp, Homo sapiens
ggctccccagagcacctgtccgcccaactgcccgtagctgttctgggatcatcgctgacagatcacgggaaacaagcatgagtccgctcgcacccgcggactgctctcccggctcggcccagggaaccgcctctgtctccagggccacacgaggatggcgactggcacagtaagccagagccgccgcgtcccggcgctttccaggagccacaggcccggaggaggcgaaggcccacagagcaaaggtggaaacacgtgcatacgctgtaaagaaatcctgttccagagcatacctgtttgtacaaacagacacatgttcctaacgagaggagtgacgtattttcatcaccgctttaataattttgttttcttacgggtttacgattttgaatttttcttatttggttgaaagaattttgagtctatcagcctgagtgagttcaagtatcgcgaaaggatgtaagtt

SEQ ID NO: 697032 - DNA, 202 bp, Homo sapiens
  misc_feature (177)..(177): n is a, c, g, or t
ttacagtagaaaaatagcagtatagaaatatagtaggaaggtaaaattcggtacttttcgaacatcagggttaaatgataattctttccctttccggctttatgcagttaatatttatttgctactaattaataaacatggtcttttaatgtcctgaatgtccatcgagattacaantgtttatgaagagattctaatacca

SEQ ID NO: 697033 - DNA, 213 bp, Homo sapiens
  misc_feature (20)..(20): n is a, c, g, or t
  misc_feature (30)..(33): n is a, c, g, or t
  misc_feature (35)..(35): n is a, c, g, or t
  misc_feature (55)..(55): n is a, c, g, or t
  misc_feature (75)..(76): n is a, c, g, or t
  misc_feature (82)..(82): n is a, c, g, or t
  misc_feature (129)..(130): n is a, c, g, or t
  misc_feature (142)..(142): n is a, c, g, or t
  misc_feature (144)..(144): n is a, c, g, or t
  misc_feature (151)..(151): n is a, c, g, or t
  misc_feature (165)..(165): n is a, c, g, or t
  misc_feature (188)..(188): n is a, c, g, or t
  misc_feature (206)..(206): n is a, c, g, or t
  misc_feature (210)..(211): n is a, c, g, or t
cacaggcatgctcataaggncttgttggtnnnncnagatattgggctgttaattntcagttcagtgttttaatcnnccgcangcttatgcggaggagaatgttttcatgttacttatactaacattagnncttctatagggngntagattntctctctctctctntctctctctctcgtctctctctntctctctctctctctctntctnntg

SEQ ID NO: 697034 - DNA, 772 bp, Homo sapiens
agcgggttcgtctgcttcccaccgggcagcgtgccgaccgaatgacgcgcggccgcgcgcctctccgatgtggagcttcccacctgcatgtaccggcttccccaacgatgcacggcaggagctacggcccagcgccgggcgctggccacgtgacacggaagagtctaatctgtctctagctagctcttgagtcccgccaagatgatattctaaaacgtctgtatgagttgaaagctgcgagttgatggcctctgcaagatgattcaaacaccatgatgcagacttggatgtaaccaaatataatccaagcggatgagcccacgacgtttaaggcaccaatgcgctggacttgaattcagtgcttgggaaggattacggggctgctgacaagagcatcgctgatcaacggcaaatgctcggcctccgcgcgtccccgtctccctggcttgttggctggcagcaggcgtgctcatgtgagcacttcaggagtcctggtccacggatgcacacgcacttcctcggtcaatgagcgtgcctgagaaaccttctcaaggtgctggtggagaacgagaataaacaaacagcaccgctcgaagactatcagctgggattcactttaacttttgggcagaactgtgccgacatacgccagatgaaattcagcatccagacgaggtgccccatctgaatggctgaagggaacattgcgcgttctgtgtactctcgtgtgtggccagaagcataatgctgtcaacgcaagccttatagatag

SEQ ID NO: 697035 - DNA, 344 bp, Homo sapiens
gttggcgccacatctgtctatgtattgccgtagttctagattcacctcatacgatgtctcacttaggcacaagcgcgctacatagacttctaagcacggataatcgccctgagccccaggctggagtgtatcgcagtgaccatagataagtgcaacctctatctcgcggtctgaagggatcgggcagccacagcctactgagtggctgatgatacgattcgaaccattttacattgattggcaaggcagatacaccgcacccgtacacgtgaagctcttggcacatctgtctcacacactggctcggacgcggcctgttctctgatggcagagtcacaccacgg

SEQ ID NO: 697036 - DNA, 283 bp, Homo sapiens
agatagtagaacaattctgtgtcgaaatggaactacttgctacagttatgaatgtcatatgtgtcaccaaaatttacagagttgaaatccataactcccatagtgatggtcttgggaggtgggtctttggaaggtgattagggcatgagtgaggagctgtcatcaatgggatcagtctcatataaaagactaccttccactatgggaggacacagtgagatgacatcatccatgaaccagacagtgggcccttggcagacaccaaatctactagtgcactgac

SEQ ID NO: 697037 - DNA, 135 bp, Homo sapiens
gacagcataggcttaggcagaagccctattactttgcaatggggcccttcaggaagtcgcatgggctcagaatggctcttagtcgtgcttaagatgtgagcctttcgaatgagactaatttctctcggaccattg

SEQ ID NO: 697038 - DNA, 910 bp, Homo sapiens
  misc_feature (25)..(25): n is a, c, g, or t
  misc_feature (58)..(58): n is a, c, g, or t
caattcccgccccgtcgttcccccntttcttatgaacccccgggttctcctccgccanattctctccctctcttcactcgtcgctttaaggaggctccccctccccctcctacttttcaaagaacaaccttgggttagttgttcctccattacgacctcatctaaactgtgcggcgcaccccaccaccaaacatggtgagaagaaacaagaataatgttcttcacctcgaaggttttcatataggcgccgcatattactcccccgcctctctctccctccttgctgcacagtgttaacacagtacgttcccctctcttgagtgcacaacacatctcttcccaacgaatacactttttctctctttggtgcgaccacctcgcgcgcacagttcccacgagccccacgccaagctgtctgcggctctaacgcgcgcccctgtgtggactcgctcctcccgcctccactaagacaatgtggggcaccacgcccgctggtgtgcacacatcatgtaaggtatgtgctcgcctctagaagagcaacgagctcatcgccgagggctagacatacattaaagagctggtcgtcattcagtctgcgccccacaaatctagtctgtgtgatggcatagacaatgttgaacaagactttggtttctactgttacatgcatccctggagatgcccgctatatagtggcgaagctgttgggtgttaggagaagaaatggatgttgcctcgttttcccaagggcccactaggttcacactacttcttttatgctgacccgatgcaatacaagatacccctgggagcacccttatgcccctatgtggctcactgttctgcttcgtgttgacccaacagggcgactatagaacccctcaaggatggtggcgccccacaatagaca

SEQ ID NO: 697039 - DNA, 115 bp, Homo sapiens
ttctagaggatacccccaggtcccttagccatttaactataccataaacggccaccagcctgtgtaacatagcactgtatggctgtagtcccagctactcaggaggctgtggcgg

SEQ ID NO: 697040 - DNA, 135 bp, Homo sapiens
ctccaccttactaccagacaaccttagccaaaccatgttaccgaaataaagtatatggcgatagaattgaaccttggcgcaatagatatagtaccgcagtgaagatgaaaattcattaccaagcatattatagca

SEQ ID NO: 697041 - DNA, 185 bp, Homo sapiens
gagaggcccgaggacctaaacttgcccattgccgtaatcaccaggatcatcaaggaggcgctcccggacggtgtcaacatctccaaggaggcccggagcgccatcttctgcgccgccagcttttttgtgttgtacggacatcctgtgctaaaactttgcaattaaaggaaagcggagaggtgaat

SEQ ID NO: 697042 - DNA, 146 bp, Homo sapiens
agcggtcctgtggcaggagtcaggtcagtggtgttcacacattcatgctgttgtgcagctatcacttccatctccagagcccttttcatcttaaaactgaagctctcccatcacacagtgacccttcatgtcctccacaacctcgt

SEQ ID NO: 697043 - DNA, 498 bp, Homo sapiens
  misc_feature (7)..(7): n is a, c, g, or t
  misc_feature (20)..(20): n is a, c, g, or t
  misc_feature (37)..(37): n is a, c, g, or t
  misc_feature (60)..(60): n is a, c, g, or t
  misc_feature (79)..(79): n is a, c, g, or t
  misc_feature (155)..(155): n is a, c, g, or t
  misc_feature (493)..(494): n is a, c, g, or t
  misc_feature (497)..(497): n is a, c, g, or t
caaggtnggaaccaatgggnaacctgaggcctaaaanttcccaaaagtgttttggggttnggggggcttcttttccccnctgtctctctctctcctctctctctcttttttcctctttcctctgtctctttctttttcccctcagcagattcctnattctctatccctctcccctcccctcccccacatttcctttcctttccagaaatttttaaatgctggcccaggtgcgatggctcacaactataatccctagcactttagtaggccgaagtgggcagatcatttgaggcccaggagtttgaggtttgagaccaacatggtgaaaccccatctctactaaaaaattagccaggcattgtggcaagcacctgtaatgccagctatgtggggatctgaagctcgagaatagcttgaacccgggaggtggagtttgcagtgagtccagatggcaccactgtactccagcctgagtaatagaatgagactgtcnnagnt

SEQ ID NO: 697044 - DNA, 183 bp, Homo sapiens
tcgagccggtaccggttcgcatgtgccctaatgtcctaaatacccacacgggctgggtgcagtggtttacgcctatatcccagcactttggtgaggctgaggcaggtggatcaccatgtgtgttgagagttcaagaccagtctgtccaacatggtgaaactcgtctctattaaaaatataaaa

SEQ ID NO: 697045 - DNA, 438 bp, Homo sapiens
ctaccgactgacagctgtgctcccaaagtgctgggattatggtgtgagccaccgtgcctgacctttttcttttcttttttaaacacgggctcttgcgctgtcacccaggctggattacagtgacaccatcatggctcactgctgcctcaacctcccggcatcaagtagtcctcccactctagactcccgtgtagctggaactacaggcatatgccaccatgctggctaattagtttttgtatttttttatagagacgtggttttgccatgctgcccaggctggtcttgaactcctgagctcaagcaatctgcctgccttaggcttccaaagtgctgggattgcatgtgtgaaccactgcacctgactacaaccaatccttttcatgaagtttgcctttgttccaagtgtatgtaacttattgaggcacagattgcagt

SEQ ID NO: 697046 - DNA, 162 bp, Homo sapiens
ccgggggggggaaggggggggggggggggggggggcacggttttataactaagggttttgttgggaatccccttttttacccctgggggggtcccccatttttttttttatgccccccccctcccttgtttttgccctttttttttgcatttacccttcccc

SEQ ID NO: 697047 - DNA, 114 bp, Homo sapiens
atcgatgctactccgtgcttcggatcgactgtcctacgaggactcccgttattgctattgtcgtgcctgtaaaagccttactagaagtgtgaaaacgtaggcttggattaaggc

SEQ ID NO: 697048 - DNA, 918 bp, Homo sapiens
  misc_feature (452)..(452): n is a, c, g, or t
agcgggcggtcccagcgtcgctccggacgctgccaacctgtcctccagccgtcgctcgacgttgccacctactaagactcccacttgcaatactcgaggttcgaagtaatgctgtctagaattacacagactgagactcaacgacatggctgacccagatgatgctcacacaaggtggcagctgaaatgtttcctgtgccacactcttttggcactaagagatatcgaggtcataacgtcagatccctttatgtgtgttcgttcttgaatacaagtggtctacaggtggtatgaggtggagcgcgcagaaaggattaagaattgctatgaatccccagagttttccaagacatttagtcattgattactacgtttgaagtggttcagaaatttgatcattggaggggtttatagaccatcgacgacaaaactattgatgcatgatgtgcacngcatgactctctgtagggtgactgtgatactgtacacttgggaaccacattgtcatccatgcgaagtagagtctcacactcgaccatctggttgatgcatgagactggtaggacctgtcagcgagaccgtgcggagctaacttccacgaatcttcagccgtaggagaagaaatgtgagagatgatcagcagtgggtctctgtatgaaagtggaacgcccatgaagagactggataactaaggactctattcggaaagtcagacccaatacctggaaattccagcgagcagaagccactctgagtggaaaactggctcaatgagtgcagtcggagcgaaggttggttagaaacccactgggaatcgctggctgggagggctcttcaaagaatcttccctttattcactgggttacgggagaattatggaccaaaccgattaaggtgggagtgtcatgacattggcca

SEQ ID NO: 697049 - DNA, 196 bp, Homo sapiens
agcttacaacagctagctgtaaagaaggatcacttgtctgtaacaaataacaagaccacgtagagaagattaatcctgttttgttctttcgttgattgaaacataataagttgttaatattctctagcagccttctttttcttccatagcgtatcttccttctaatagttctggctttctgtgtagctctcgataa

SEQ ID NO: 697050 - DNA, 117 bp, Homo sapiens
tgctgctcaggttccttgctcaggtctcctgccttgccagctctgcctggcccaggccagctcagttacagctcagctcagctcagcccagcccagcccagacctgagcaagccagg

SEQ ID NO: 697051 - DNA, 136 bp, Homo sapiens
catgttgcagcacgtggtcgagtggtggaggctatgcgagtgagaatgcaggcatgagtagcgaaagaagggtgagaaacccttccgccggatgaccaaggttctagggctaggctaatccgccctgggtaagtcg

SEQ ID NO: 697052 - DNA, 1063 bp, Homo sapiens
  misc_feature (223)..(223): n is a, c, g, or t
acatgacaaaaactagcccccatctcaatcatataccaaatctctcacctcgactagacgtaagcgcgttgcatcctcacgtctctcaatcttatccatcatagcaggcagtggaggtggattaaaccaaagccagctacgcaagaatcttgagcatacatcctcaattacccagcgataggatgaagtaatagcagttctgaccagtgacaaccacttaacnatcaaacgattcgtgtgaagtttaacgtcattgtaatattgatctctaactaactacgcagcattcctaactgactcaaacattcgagacatccaagcaccgacgaacccgtaactgactatctcggcaccttgaaacaaagctatacatgatctaagcagacacttaaatttccagtcacatccactacgcttctactcgctaaggaagggcctagcgcctccgataatccgagtctatttttgactccaaagttgagggccattattcgaatgaacttgcacagagaaaaagcaagtacgcactcgatcatgccccagccattcatcgggcctaccatcatccacttccttaaacctgctactttctaacctatgctcctaatctacgtccactctcaattcacagcgtactccccatagtctaacaaaggtaaaaaatgacacatgagcagtttgtaaacataacaataacccatccccaattttcctcgcccatattgcagtcgaaccttaatcaacgtctatctccatacgctattcttaccctttttatactaagtaatcttaaccggaaaacatggggactgacagacagggagagaacgcgtttttgaggagagaggatggggcaacgacgaaagcacacacccttcacacacacaccctggcgtcctgggagacggcacgagacaacacgcacggtagaaactcagcaccgaggccaagacagggactcccaaggagcaacccgcggacaaaaaaggagcgcgcagatacccaccaaaatataaaaggcccgggagaccgagtggtcagaacaaaaccacaggagccacga

SEQ ID NO: 697053 - DNA, 218 bp, Homo sapiens
tcagggccgagatgaaacggagctaccagtgactcagcgagtgaccatatcagggcaggcaaagtgagggtggagctcattgtggttctgtcaagcttcagtataatgaggcttagacgaagtcttcaaaccaaaaatatatcaagtattacagttcacacatggcaaagttttcaaacagaataatcctgtattcagatttatagcggattgaagtt

SEQ ID NO: 697054 - DNA, 763 bp, Homo sapiens
ggccgggcgcggtggctcacgcctgtaatcccagcactttgggaggccgaggcgggcggatcacgaggtcaggagatcgagaccatcctggctaacacggtgaaaccccgtctctactaaaaaaaaaaattacaaaaaattagccgggcgtggtagcgggcgcctgtagtcccagctactcgggaggctgaggcaggagaatggcgtgaacccgggaggcggagcttgcagtgagccgagatcgcgccacggcactccagccggggcgacagagcgagactccgctctcaaaaaaaaataaaataaaataaaataacacttaaaaacaaaaaaaaaaaaaaaaaaaaaacaacactattttcggcgcgcgcgcccgggcgcccctgagagaaaacggcttctcgagacacacacaccgcggtgggcgcgcgcgcggggcgcccagaggagaggactagagtgagacacacacggggctcaagagaagtgtgtgctcccatgagagagaacacccggggccaagagaacacatagggcgtgggaattcttccacccacaactgaaaaacaaagcgccgcgcggggggcgaaaaaacgagagagaggcgtcttgtgtgaagacaaagatctgtcccgaagagagggaggaataccgaggaaggggctaacaaaaactgcggggaaaacaacatataacgaccaaggggagcgctctaaaaggagagagagaccgcgaaatataccacaagtgtcgcgcgccccgt

SEQ ID NO: 697055 - DNA, 233 bp, Homo sapiens
  misc_feature (200)..(200): n is a, c, g, or t
ccaggaagtgatctacattatggcgtgctatatcaggcatttctctgtcatacttcaatgcacttagtatttggagagcaaagggaaatcagtctagccgctaacatcaagctcaaagaagtataaggatgctatttcatagaaaacatcctaagtgttgattctacttatgcatgcttgacaaagctcagaaattccanaactccaacgaaggaaagaggaaaacaatgaat

SEQ ID NO: 697056 - DNA, 565 bp, Homo sapiens
  misc_feature (11)..(11): n is a, c, g, or t
  misc_feature (38)..(38): n is a, c, g, or t
  misc_feature (135)..(135): n is a, c, g, or t
  misc_feature (180)..(180): n is a, c, g, or t
ggagaaaacanctgtggaactcaaacccccccgaaaanaaatcaaaagaaaacgcggtttggtgcttgtggggtcctccccaccaaaattccccgtttgttttttttcactttcaaaaaccaacaagcccgcgcnacatgtgagaaaagcctgtgtttcctcccctcctcaccccccggngagaagaagggttgtggggtgttcactagtgggggccccccatctcccctcatcaccccagggaaacctttgtgttttgccctggaaaacacccgaaatttttgtacattgaaaggcccttttccttcctccctccccagaaggtggtttttgtttaaccccccccctttttgacccatgtaaatcaaataatgtgagaaatcatcggcctgaaaaaagactttgtgcggattattgggaacattgaagcggtttttgtgttttttcttcccttgtagtttggttttgaattaaaaaaggaaaaaaaagtaattatgatccattgtagtttgtgtacaaaaaatgttgaaaacggttttattaaaagggacattttttttccgca

SEQ ID NO: 697057 - DNA, 332 bp, Homo sapiens
  misc_feature (30)..(30): n is a, c, g, or t
  misc_feature (111)..(112): n is a, c, g, or t
  misc_feature (216)..(216): n is a, c, g, or t
  misc_feature (276)..(276): n is a, c, g, or t
  misc_feature (297)..(297): n is a, c, g, or t
cccccctaaccccccccaaaagaccagaancctaaaatccttgaagaaagaggttaggaagtagatattgattacctatccataattccagcacctaacctatgacccccnncatcatacctaaaccttcaccctcattatcctcaccttagtccctttatcatccttaaaacaattctgtgacatacatattatctcattttacacaaagggaantcgggcatggtgctcatgcctgtaatctcagcactttgggaggctgaggcagaaggattncctgaggcaaggagtttgagnccagcttagccaacatagtaagacccccatctctt

SEQ ID NO: 697058 - DNA, 619 bp, Homo sapiens
tgacagaatcacactcaaatgccttcaatcaacaagtggataaagaaactgtggtatatatatatgatggaatactactcagtcataaaaaggaatgaattaatagcattcgcagcaacctggatgggataggagactattctaagtgaagtaactcaggaatggaaaaccaaacagcgttatattctcactcataagtgggagctaagcttgggatataggtgcaccaaaatatcacatatcaccactaaacaacgtactcatctcaccaaatgccacctgttccccaaaaacctatggaaataaaaaattttacaaaaagataattattaatccagtttttggtgaatcagtgagtgacagtggttatagtagtggtggtttaaatcaaggaataaatgttttcaaagtgaaaggagcacatcctaccacacagttcaaaaacaatcacaaatatggcaggcttgctgagagctttcatacatcattcatcgtcatgcacttgtatgattattgtataactgtacacatttctattcaacaatgatttgtatcctccaatgcggttattgcagttcagtgtgatacatggctggggcctatctggtagctcggcgca

SEQ ID NO: 697059 - DNA, 417 bp, Homo sapiens
tcaggggaaaatatttttttggaaacccccccaactgaaaattggtcccgggttaaacccctttttctcttggaatgggttttttcggggtcccaaaaatgttttttctcctccggtggttcgggaagcggccgagggccaacattgggggggtggtgtacagtgaactttagggtcaatcattctaccagaagcccgccgtttcgttctgcaccagacaaggactgggggagggtgaccccccgttttttgggtccccaccagacagcttttacagcaatgacaaatattatgggtcattttcaccaatgatgggacaaggccccccaggagggttgatgctctgtgtcagataggtcatattatggggaggcatgtgtcatagaatcatcttggcccgtcctgatagggaacccg

SEQ ID NO: 697060 - DNA, 884 bp, Homo sapiens
gctctcgccaggcgtcctcgtggcaagtgacatcgtctttaaaccctgcgtgaaatccctgacgcaccgccgttgatgcccaggaagacaggcgacctgaattccaatacttccttaagatcatccaactatgtggatgattatccgaaatgtttcatttgttgggagcagacaaatgtgggctccaagcagatgcagcagatccgcagtgtcccttcgcgggaaggctgttggtgcctgaatgggcaaagaaccacccatgattgcgcaaggccatccgaggggcaccctggaaaaaacaaccccagctctggagaaaactggttggcctcatatccgggggaaactgtggcgcttggtgttcacccaggggaggacctcacttgagaatcaggcaccattgtttgcttgcccacataagggttgccagctgctgcccgttgctggttgccatttgggccccatgtgaagtcactgtgttgcccacgcccaagaaaccactgttctcgggcccgagaaagacctccttttcccaggctttaaggtatcacccactaaaatctccagggcaccatttgaaatcctgagtgatgtgcagctgctcacgactgagacaatgtgggacgcaggcgaaggccacgtgttgacttgtcaaattttcccctttctcttggctggtcatccagcaggtgtcgcatggcgtctacacctgatggttgttcccagcggactctgctcccgtcgggggtgccgcatgtgcggttgctgctcgctccctgtgctcggcccttaatagggacggctgctgttgggaggtactccccgggacgcgttggccctgtgccttgcatttttccctgccaggcgtgtttttcccttctcaa

SEQ ID NO: 697061 - DNA, 962 bp, Homo sapiens
gcttgggctgatgtgacccaacaagcagggctggtgaagtctgaactggaagcacagacagggtctccaaatcttggcagacaggagtgggacagagggaggaggcagctgcagtccttccccaaactgcgcacagcacctcacccatgcgctcagtgctgctcactctggtggccctggcaggtgtggctgggctgctgggtggctctggctgtggctctgtgtgtgcggcagcatgcgcggcgagcaagacaaggagcgccatggcgagctccatggggcctgagggggcccatggtgacacgtacctttgagtaccatggacctgtggcgtcagcacatggccacgaagtccttgttcaatccgggcagagggtccacgcggagccttcacgggtgagcagtgtgtcctcccagttcagcgacgcagagacccaaggccaagacccaggtcccacagcagcattcccgtacctggtgcgaggattgccggccaagtgcaacatggacatctccatcgggacacatgatgctggcatacatggaggatcacctgcggaacgggacgcttgccaaggagtggaggcctctgtgctaacaagcagagcaaaactgtggcaccggcagggggagggaaatcaaaaagaacggattctgattctgcctatgagcatgccgcataaaactgacgtggagagagacttctcggaggaataatcaacgcagccatattgagatgacctcggatgcaagcctaaatagcagcgggccggtggtccatacatcgaaaaattctggacaatggtgggaaaagggggcaggatagtagtgaccgggggggaggggtaaaggggcggtggcaaagggtgccaacagttttaggagagggggtgacatggagagtgggggagagaaaaaaagaaaaagaaagcaatatgtaagaagacagggaagaaaaggga

SEQ ID NO: 697062 - DNA, 112 bp, Homo sapiens
cacgaccttgaaaaccaagccagagtccctggtcgctgagggtaaaaaggctgccttgatccccaaggaattcacgctggacaagcagaccacggaatacaccattgaccag

SEQ ID NO: 697063 - DNA, 205 bp, Homo sapiens
acagtcaatccagggaagataccttcaataaggaataagctaatcactaatagcaaggcttgggagattcacagttgaatagaagtctttagtaaactgttagacacagatctatacaatgcattaaggagatccactaaagaaagaattttaacaaagcgggggggtacccgaggtttcgaattcggtaattcatgggtcatag

SEQ ID NO: 697064 - DNA, 1239 bp, Homo sapiens
  misc_feature (514)..(514): n is a, c, g, or t
  misc_feature (1239)..(1239): n is a, c, g, or t
agcgattgatacacggctggtcttaggcccttctataaagagtgtgagaaagtgtacccggaactggtgtgaacaacctgcagcatcatggagcgggaaccctgaagttcatcttatgccctgctctcagcgcatctatgcacacgtgaaactggtggtgtagacgtaagccgactatccatggctcgttgtacttcgccgacgacttcccatagcagtatctagcagttgcccgaataggagtcagattgggtcgcctggttgaggagggctagctgagtggtgcatcatggcatggaaggacatcgcatagccccgcgaagtgggcacgcatgggcgccgagtggctcgcaaggcccacgttatgtctatcggctagggatctcaagcacaacgtgttcttctgtgcctgggccaggggaaagcttcttgcgtgaaacatgcagtggcttgccttccgtggcatggtgtacatggaggcatcgtccctgcgtaaaccacgcttgtattgcgncggtaacgctctgggcacctaagtcttccccacgccaaaggaggtcgagtggcgaacggggcccatgtgtgcgacgaaatcgaggggctgtcgtgttctcatctacctctcaggaaaaaacctattggagcaccggtgggcatagggtactactgggacattgagaacgatcccttttatttccacaaggaaacccacaattagaccaggttaacatatcacttgggaggcacaggagtcgctcaccatagggggtagtttgttggcccttccaccccaagtttggttttaagccttcgagaatttcgcctaagacttttttccccggccaacttcgttgaagggcggtaaccccttcggcctttagttggagccggaattggcccacaattggggccaaagcacacgggtctcttcacctagcaaggagattggcacttgctaaacagctaagacgcgagggttgcggcgccactatgagggcaaaaagacccgagagcgttgaacccgcagaaggcgacggcttgcaggggagagagcccccacaaacaacttgcgtagcgttgggcgccattttaacttccttaccattggtgttggccgcctttgttctcaggggaagaaggaaaaatttgcgggcgggaacgaactaggacgctaatttgtagccacctttctcaaactcttcaaagcataaccccacccgttgagagcttcgtgtgggn

SEQ ID NO: 697065 - DNA, 202 bp, Homo sapiens
gtaaccatccacttgacaagtacgccgaggacccgatgggaggtggtcttgcactatcatggtggggctacccacagtgcaagctgtcagccatggacttgggtcagctcctcaggcaggctgggctcatgaagagtactgaacccggagagcagcctgaaataattccgctggcttcagatcaccggatgtagaaacacgg

SEQ ID NO: 697066 - DNA, 231 bp, Homo sapiens
  misc_feature (110)..(110): n is a, c, g, or t
tctagagtacccctgcggaaccctatcggagtacaatactatatggattttgggagtgactcaagaagtgaagaatgcacaagaatggatcacaagatggtatttagcanaccctagccttgcttgttacaattttcttttttaagaatatctgtaatggtactgactttgcttgttttgatgtagctcttttttaagtgattatttattttttttgttgtgctacaccta

SEQ ID NO: 697067 - DNA, 346 bp, Homo sapiens
cttgaatcaaaatttttggggggtggggcccaaaaatctggaaattttttttggttaaacctcccccagaaccccctggttccgatgcccctgggtggggggcctgcttttaaatgcttgtttgcaaagtccccccacccatgaaacccttatggctgggcaaatgagctttgctttaaaattgttgccattcatgtttttgagttccaaaagtgctaattccccacatgtaattgtgtaagtaaaccttggccctttcctacttttttatgtaataaaagttataaccctaagcttatataaaacctgggggggtattaaataaagggaataaaaatgaatggga

SEQ ID NO: 697068 - DNA, 202 bp, Homo sapiens
aaataactcctggactcctacctatatttacaccaaccacccaactatcttaaacctagcctggccatcccttatgagcggcgcaggatatagcttcgctctaagataaaaatgccctacccacttttaccacaggcacacctacaccctatccccatactagtatatcgaaaccatacctatattaaccatacccggccga

SEQ ID NO: 697069 - DNA, 686 bp, Homo sapiens
aacacttaaaattatgcacacttatgctaaaatgaactgctaaaatttcgtgcattcacaaagggatctcagaaagatagacacaggtgaacatcattcacatgcgacatatagaagtcatataccaagatggtagatttaaattcaaccctgtaatatgagtaattacattaaatgtaaatgcactaagctatccagttacagacagcaattgtcagtctgaattaaaaagagtcaccataatctgaacacacaagggtacatcaagatatgtagatatatcatgtatattagttatatgtaactgcaggataatttatcgccataatttatcagctaacaatgccacacacttatttctctgttcagtctggttcatctgtgggaaatttggttacaagctcactccccagctcaagagagtgagatagacacagaatccccaataaaaacctgtcatttcttaaaaattgattctgtcatgtacatcaatattaggttcccctcaaaatcaagcagaaggcatacattggcataccattatcacccaaagtctgtaatctacgttaagattcactcttggtattgtacattccatggatttgtcacaaatatataatcacatgtgtccaccattatagtactgcacagagtagtctctctgctctaaactatcctctatactc

SEQ ID NO: 697070 - DNA, 220 bp, Homo sapiens
tcagctctgtacctgatcttcgtgtccgccctacattatcgtcactcagttccactatcaacttttctcatacggggctatcacccactatggccagcgtttccaacgctgttttgataagtcgacttgctaaagaggactaggctcctgccgatttcgctcgctcactactttctggaatctcggtttggacacgaaatgttcaggggcgatcctctta

SEQ ID NO: 697071 - DNA, 992 bp, Homo sapiens
  misc_feature (413)..(413): n is a, c, g, or t
taaccccagggtagtaaaccgtttacatgggaaacgggtataaaaataagggccccccaagctttagggttcccttggggtaacagtttggggggtggctcttagggtttttaccaaaaaaaaccaaatggacaaaaaccagaccttaacaagacggaggggttcctaaaactagggaagccggaaaggggctgagatcacaccggctggtgttttcacaacccagaggccctaagccgccacgctcaagcaccctcatgcgctccaggagatacgcgggattttggcacggcacactaactggcggatacataacaaaggatgtctcatcttggaagttcttattcaccacatgtggtgctcttcatggaattacaaccaaataacaaatgtcccacaatctttggggaggngcgcgtggctataaaaaatatctatcaggagaatctctcctggcaatgaatctattaatctaaccagatatacaattgcgcccacaaagaggcgtccagaggaaaaatcacgctctggaaaaacctggggtacgggtgcacttataccttggggggaaatttccaccctagaggatatggtttatcccgcggggaaccaggtatggtccctcctgctccaaaagaggtcttttccaccacctgttgtgaacacaattccccggaagtgtccccggacgcaggggactcggccctgtgacactctagttacaggcgtaaagaaacaaggcttccaagaggttaccacagagcggggagggggggacacaggggagcgcctctggagctaggaggcgccgaccccatttccccgaggaaggtttcaacacagggacggcgaggggatcaccacttcggcagcttataggatcccccagcttatttctcaaaacaggtgtgtctaacaagcaggtataaaaagagacgcgcgtgaccgtaaccacaaagtactcacacaggaacggaccaacgatgtagata

SEQ ID NO: 697072 - DNA, 391 bp, Homo sapiens
  misc_feature (313)..(313): n is a, c, g, or t
ttgtagaaagaaaaatcaactcactgttcagagctgagaggggatgtaggcccatgggcacctggcctccaggagtcattgtgttgggagagccggccacgcccttggctttagagctgtgttgaaatccatttgggtggttggtttttaacccaaactcagtgcattttttaaaatatttaacaatccaagttgagaacacttgaacacacacaatggagaccccgcctaacatcgattttcagttacgggccggaatgcgaaccaccagccaatctgttcccatggggaacatgaggtggtggtggcgcancacactgcgatcaattctgcatgggcacagtagagatccccgctactcgcttgctgttgggtcaccctagcttccata

SEQ ID NO: 697073 - DNA, 683 bp, Homo sapiens
  misc_feature (8)..(8): n is a, c, g, or t
ccccaagnaggcctgactgggctggtctgcctggtctgcatactctccgccacctgcttcacgctgcagtctgggaactactggctggagattttcgacaattttgccgcttccctgaacctgctcatgttggcctttctcgaggttgtgggtgtcgtttatgtttatggaatgaaacggttctgcgatgacattgcgtggatgaccgggaggcggcccagcccctactggcggctgacctggagggtggtcagtcccctgctgctgaccatctttgtggcttacatcatcctcctgttctggaagccactgagatacaaggcctggaaccccaaatacgagctgttcccctcgcgtcaggagaagctctacccgggctgggcgcgcgccgcctgtgtgctgctgtccttgctgcccgtgctgtgggtcccggtggccgcgcttgctcagctgctcacccggcggaggcggacgtggagggacagggacgcgcgcccagacacggacatgcgcccggacacggacacgcgcccagacacggacatgcgcccggacacggacatgcgctgaagccggccggagcggggcctgcatgggcgggtctgtgggggggcttggcctgatggtgggcggggccccgcccacagggccgaccccaatacaccagcgactcaaccttgaaa

SEQ ID NO: 697074 - DNA, 372 bp, Homo sapiens
tgtgcgagtatggcacgagcgtcagactctcaagcggatgtgactacacgtgcgcgcgaccacacgtgtgtataattttgtgtgtgtagtgtagacacgatattactgtgttagccacagatagggtctatatttctgagcttacacactgtgatggcaggactttgagagggtataagcgcgagaactggttgagttccggagtgtaagaacaggctgggttacacaatgagacacctgtgtctataattattaattaatggattaattaatttggatgacttgggaagaataggtgtagagagttatattaaacctttggaaggaacttaacaaatttttataattagttttttatacacgagtacacac

SEQ ID NO: 697075 - DNA, 223 bp, Homo sapiens
actggttacgtcgcaacgtaaagaacggcagaaggtgagcggtgcgtgactagtggcgaacgaatcctcgtcatcgttcttgtcgtcgacatgtgctcgccactctctcagctccaaggccgcagcagattcgttgcgcgtgacggctttgatgagatgaagctcgttctctttgaagaccctgtacatgcccttgttgatgatggccatgttggacagatct

SEQ ID NO: 697076 - DNA, 505 bp, Homo sapiens
  misc_feature (210)..(211): n is a, c, g, or t
tttttccccccccccccaaaaaagaagatgttttttttcctccgcagccctctcttcctaaaaaaaaaaagcgggggggggcctcctttctggaggggggaaaaaacacccccccgcggggggaggtttttttttcccccccccccaaaaaaaaaaaaaaaaaaggggggtttccccccctttttcccccccccgggaaattaccccccnncccccaaaaaaagggggggagaaaaacccgggtttttttaaaacccccggaggcccccccttttggtgaagaaaaaattttttctcttttaaaaaacaccctcttttttccccaaaaataaaccccccaaaaaaaaaaaacactttttttttaaaaaaacccccccctcccccggaaaaaaccccccccccccccttttttaaaaaaaaaaggtttgtttaaaaaaaaattttttaaaggggttttagggcccttttaatcaaacccatccaatttttggttgggccagttaaa

SEQ ID NO: 697077 - DNA, 541 bp, Homo sapiens
ctgagagcagcgtgcatatatgcaacaaaaagagcgagccccagtacccgtcagacgtgggaccgatagtgtgtcgcgaagccacataagcgtggcttcgggatgggaggctcatgctcaacgacctgccctcaccccccaaccttcgagggcggggaagaggtggtgagcttccggggacgaggtcgcgagcgaggatttggtggcgccaaccatggaggctacttgaatgccggtgctgggtatggatgctatgggtacggaggcacctctgcgacagtaggagacagtgactgtgccacagactgctacggctatcatgattttgggtcttcctagagcgtctaaaagtatcgcacacaaaatcaactttttcctccaatttcctccaactccaaaacccaaagtgtccgtgctgtgtccctgtgcttcactgggtttctcaagcgtggcttttcaccgcagcttgtctgaaactcttagcctgcagaatataagacaatgacagtttcaatcgtgattggcctttgaacttggtcct

SEQ ID NO: 697078 - DNA, 323 bp, Homo sapiens
  misc_feature (45)..(45): n is a, c, g, or t
  misc_feature (315)..(315): n is a, c, g, or t
tagagactgagtctccctctgtcgcccaggctggagagcagtggngctgacttggctcactgcaatctccgcctcccaagttcaagcgatttttctgcctcagcctggcaagagctgggattatagataggcacatgccaccacccgtggctaatttttgtatttttagtagacacagagtttcaccatgttggccaggctggtctccaactcccagcctcaagtgatccagccacctcagcctcccaaagtgctgggattacaggaatggccactgcgcctaccctattttatttttttaaagcacttgtttanttatcacc

SEQ ID NO: 697079 - DNA, 397 bp, Homo sapiens
agacaggatgaacagagaaactcagtaggaagagagaaagaagcaagaagagcaggccacacgccagccataagaagaagcagctgctcagcattaaagacatacaagaatccattcagcttcatcatgaagcttgggaacgacatcatttaagaaaggaacttcgtagcaaaaaccaaattgctccggacagccgaccagaggaaaacttcttcagccgcctcgactcaagtttgaagaaaaatactgcttttgtcaagaaactaaaaactattacagaacaacagagagactccttgtcccatgattttaatggcctaaatttaagcaaatacattgcagaagctgtagcttccatcgtggaagcaaaactaaaaatctctgatgtgaactgtgc

SEQ ID NO: 697080 - DNA, 223 bp, Homo sapiens
gagcacagcaatcatccctgtcggtatctaatatccagcactagtagacactataaatccctaccacatttcccacaaaacagaccgtgtgattatgcaaacatcacagcctcacaggctcttagtgaatggactttccccgtgtggcaacgcgtgacatgatttaaacaaagtccctgatctctacacagagatgttcgtaatgtgcgcagcgggcagagtc

SEQ ID NO: 697081 - DNA, 170 bp, Homo sapiens
tccggtagctgagcttcgtggaagacggtgtttgacgaaccagacccggcttcccggaggcaggggatctacatgagtgacaactacaccgatgtgaacggtggagaaggtgcttcccaaggcatgacattagagtgcccacatggcgctggaagttgggaatgatgagg

SEQ ID NO: 697082 - DNA, 110 bp, Homo sapiens
ttagcgtaggttacaaccagcctgctgaaatctctttacatgaagagtaagaacaggaggagcacgagaaattagcatctgctttttggcattggtgtaaaccatgcttc

SEQ ID NO: 697083 - DNA, 1163 bp, Homo sapiens
  misc_feature (639)..(639): n is a, c, g, or t
aacggtttctctcgcttacgatgcgtcaccccgctctgatcaggcgcaggacgtagctcgatgcccctgtaaaacagggaggtgatggaattagattagacccaatctttgccagatgtcggtagtctcacgtagataatcgtggcgtagttgattggaagttgtccaagtctgttggtgagaactctactgatctacagaatggtggtcaacggtcaagtaccctctacggagtaccctgaatggaagagatgtatactcgattcgtgtctcatatgtgatcgcataaatgatgagcagagatagctgtggctagagtgagccgggttttgtctcttcatttggtctataactcacagaacacatgcaccgacaaaacttcctgtcctgttctacatttgatgggcttggactagttgacttggatcgctatgatggagaagggtggcctcattaactggagttaccaggcgcatgagtgaactgctctgttagtctgcaataatacagtgctctgtgaagtgagcacttcttttgcactcatatgcgagctctggcgctctctgaaacgaagtagactagacttgtctacggcgacggtgtagacccgagaataggtggtaaggactcccgttagtntccgatgactcattactatacttcatggcacaggtggaagggatgctcccagggggtataagacccgtgattgatgggaaacattgacttggggccacccagattcctagtacgactttgcaagcccgtcatgaacacacaggggctggtacctgagtgaaagtaagcccaagcggcaggcactggcatcgccagacacttcttccaatccgggagtggacattgccataattgatttgtttggtatcatatgttggcacaatttccctggggggagttacctcaggcagttctacaaatagaaagaaacgccttgttaccgcgtttcaatagtttcacgtagaagcttgggtcacttgaaacacactcttgagcaacttgcaaacgtggtttgacaatagcccaaccggtttccatgttagtcgtgccttcaccaagcaggctgagtgtgttcttagcctgttgaatacacacatttcactgtgacgctaacagagcgtaaccattacagcacagcgaaaaaa

SEQ ID NO: 697084 - DNA, 384 bp, Homo sapiens
  misc_feature (67)..(67): n is a, c, g, or t
  misc_feature (140)..(140): n is a, c, g, or t
  misc_feature (230)..(230): n is a, c, g, or t
  misc_feature (365)..(365): n is a, c, g, or t
acctgaaaccctgggaagacggaggttgtggtgaagcccattgaagctcccaccctgggcaacaaanatttaaactctgtcttaagacaaacacacacacacagatgcacacacacgcacacacacacaaacaatgaaanaaaaacatctgtagtcccagcagtttgggaggctgaggcgggtggatcacttgaggtcaggagttcgcgaccagtctgggcaacatggtnaaaccccatctccactaaaaatacaaaaattagccgggcgtggtagtgggcgcctgttgtcccagatacttgggaggctgaggcaggagaatcgcttgaacccgggaggcggaggttgcagtgaatggaggcgtngctgctcagccctgccgcc

SEQ ID NO: 697085 - DNA, 515 bp, Homo sapiens
tcaacttcactgtttgcatcccacaacgtgatcttcccatcattccctccagtaagcaacaaataggattctgggagaaagcaaacctgggatacccctgaagtgtggcccttaaatcccagttcctgttcacacttaacttccatcacccgaaagattccaaccttaccatcttttgcaccacaactaaaaattttaccacaccgaaccccccaagatagaaaggggctagggcagggattaaaagctgaccaagtgaacctggggccttccatttctattgtttaatccccactgaaaatattccaatccaaaaatggcggggcttttatgtaaaacttcccattattacactgcgctttcccttaggggccggcattgtgcccgcaatatcttggccctctggaggcctaaaattccctaaaaggtgagggcgtattaaatatcctccaataaagtacatacccctttctccctttgggaaaaagagtattccgcttcaaaaattccaccct

SEQ ID NO: 697086 - DNA, 376 bp, Homo sapiens
gcggccgcctactactactattaaattcgcggccgctcgaccacggatgtgtccagggtggcctcgtcgatatcgatctcggtcgagtccgaaagtacggcccacgattctcgcgataattcgatgaacggccccggttcggtgttgtcgtcgtcaacgggagtgatgggggtcaagttcatcgggcgcctccgaatggttggtcgtagtgactgtacttcaccgcgacgttggggacgtggttaatgcgacgttgatgggcacatttccgagtagcgtcgagccatgcccatcgaatcttgctggcgccctaactgggcctgaatgggcgaatggtgcaggtgaccggggcggcccgctacggggtccgtcgacg

SEQ ID NO: 697087 - DNA, 368 bp, Homo sapiens
tcctttattatgtaactgcatttcacagcagcatcacttattttatttgtattcgatgattaatgctgtagaaagtttagtccttttctaagttcattgagtttttcatcatgcatcttttctgtaaactagtcaaaattctcaccatggtttgtttcataatggcatcttcagttgtattcttttgacacagacaaagtttggttacatattgaacacataggactatacttccacaaagaaatatgcttgctcccacttctcttgaaacacgcggcgctatcaatccatctttcattttcccacttttgatagagacataggaacaaaaagagaattcacttttctttaagagaaacaacagcgca

SEQ ID NO: 697088 - DNA, 1777 bp, Homo sapiens
  misc_feature (1620)..(1620): n is a, c, g, or t
  misc_feature (1636)..(1636): n is a, c, g, or t
  misc_feature (1642)..(1642): n is a, c, g, or t
  misc_feature (1644)..(1644): n is a, c, g, or t
  misc_feature (1650)..(1650): n is a, c, g, or t
  misc_feature (1660)..(1660): n is a, c, g, or t
  misc_feature (1665)..(1665): n is a, c, g, or t
  misc_feature (1669)..(1669): n is a, c, g, or t
  misc_feature (1671)..(1671): n is a, c, g, or t
  misc_feature (1692)..(1692): n is a, c, g, or t
  misc_feature (1703)..(1703): n is a, c, g, or t
tcaacatgatttatcacaattatctcatcaataattaccctatttatcttatttcaactaaaagtctcatcacaaacattcccactggcaccttcaccaaaatcactaacaaccataaaagtaaaaaccccttgagaattaaaatgaacgaaaatctatttgcctcattcattaccccaacaataataggattcccaatcgttgtagccatcattatatttccttcaatcctattcccatcctcaaaacgcctaatcaacaaccgtctccattctttccaacactgactagttaaacttattatcaaacaaataatgctaatccacacaccaaaaggacgaacatgaaccctaataattgtttccctaatcatatttattggatcaacaaatctcctaggccttttaccacatacatttacacctactacccaactatccataaatctaagtatagccattccactatgagctggagccgtaattacaggcttccgacacaaactaaaaagctcacttgcccacttccttccacaaggaactccaatttcactaattccaatacttattattattgaaacaattagcctatttattcaaccaatggcattagcagtccggcttacagctaacattactgcaggacacttattaatacacctaatcggaggagctactctagtattaataaatattagcccaccaacagctaccattacatttattattttacttctactcacaattctagaatttgcagtagcattaattcaagcctacgtattcaccctcctagtaagcctatatctacatgataatacataatgacccaccaaactcatgcatatcacatagttaatccaagtccatgaccattaactggagccttttcagccctccttctaacatcaggtctagtaatatgatttcactataattcaattacactattaacccttggcctactcaccaatatcctcacaatatatcaatgatgacgagacgtaattcgtgaaggaacctaccaaggccaccacactcctattgtacaaaaaggactacgatatggtataattctattcatcgtctcggaagtatttttctttgcaggattcttctgagcgttctatcattctagcctcgtaccaacacatgatctaggaggctgctgacctccaacaggaatttcaccacttaaccctctagaagtcccactacttaatacttcagtacttctagcatcaggtgtttcaattacatgagctcatcatagccttatagaaggtaaacgaaaccacataaatcaagccctactaattaccattatactaggactttacttcaccatcctccaagcttcagaatactttgaaacatcattctccatttcagatggtatctatggttctacattcttcatggctactggattccatggactccatgtaattattggatcaacattccttattgtttgcctactacgacaactaaaatttcacttcacatcaaaacatcacttcggatttgaagccgcagcatgatactgacattttgtagacgtagtctgacttttcctatacgtctccatttattgatgaggatcttaaaaaaaaaaaanaaaaaaaggggggggnaaaatncncggggnccatttggcncccgntttntncaagggccaaggggggaaaanaaggggggggnaaaagggggaaaggggttgtggaaccttggggtggggccaagaacgggaaaagtgggctgggtggtataaaaac

SEQ ID NO: 697089 - DNA, 800 bp, Homo sapiens
tcaacatgatttatcacaattatctcatcaataattaccctatttatcttatttcaactaaaagtctcatcacaaacattcccactggcaccttcaccaaaatcactaacaaccataaaagtaaaaaccccttgagaattaaaatgaacgaaaatctatttgcctcattcattaccccaacaataataggattcccaatcgttgtagccatcattatatttccttcaatcctattcccatcctcaaaacgcctaatcaacaaccgtctccattctttccaacactgactagttaaacttattatcaaacaaataatgctaatccacacaccaaaaggacgaacatgaaccctaataattgtttccctaatcatatttattggatcaacaaatctcctaggccttttaccacatacatttacacctactacccaactatccataaatctaagtatagccattccactatgagctggagccgtaattacaggcttccgacacaaactaaaaagctcacttgcccacttccttccacaaggaactccaatttcactaattccaatacttattattattgaaacaattagcctatttattcaaccaatggcattagcagtccggcttactaggagggtgaatacgtaggcttgaattaatgctactgcaaattctagaattgtgagtagaagtaaaataataaatgtaatggtagctgttggtgggctaatatttattaatactagagtagctcctcctgattaggtgtattaataagtgtcctgcagtaatgttagctgtaaa

SEQ ID NO: 697090 - DNA, 765 bp, Homo sapiens
  misc_feature (47)..(47): n is a, c, g, or t
  misc_feature (61)..(61): n is a, c, g, or t
  misc_feature (64)..(64): n is a, c, g, or t
  misc_feature (116)..(116): n is a, c, g, or t
  misc_feature (154)..(154): n is a, c, g, or t
  misc_feature (187)..(187): n is a, c, g, or t
  misc_feature (191)..(192): n is a, c, g, or t
  misc_feature (223)..(223): n is a, c, g, or t
  misc_feature (242)..(242): n is a, c, g, or t
  misc_feature (262)..(263): n is a, c, g, or t
  misc_feature (269)..(269): n is a, c, g, or t
  misc_feature (318)..(318): n is a, c, g, or t
  misc_feature (462)..(462): n is a, c, g, or t
  misc_feature (468)..(468): n is a, c, g, or t
  misc_feature (503)..(503): n is a, c, g, or t
  misc_feature (507)..(507): n is a, c, g, or t
  misc_feature (518)..(518): n is a, c, g, or t
  misc_feature (746)..(746): n is a, c, g, or t
aaatataatttaagaacccacatccaagcaccggcgtcctgtttctnggttccaccaccanccnccgcccttttcactacctcaccccacaccccttcataggacacagctatggnggtcccaggcgggagtcacagggagatgtgggatgatnaaggtcactgattctggaaacagacatgatgangggnncctgtttcaacttgggcaaaggaggccatantgaaacaggttccctccancacaaagttatttttttgtnngtaganaaacaaaacgaagaaaacaaaaagagagaacggggagaaaaattaagancaaaaacaaaactcaaaagccttcaatatgaaggcagcagctgggggaggggcatttacaagggaaaaaaatgattgagtttggtggtgacagcagcaagttgagagactacaaaccccaatgattttgtcactgggccctganaccccntcttgccccctgggacagcccccccactctggagntggnaagggagtcanactctctttggtctgcgggaacgcacccatcaaggtgaggggggcacctggagagaggctgggagatgttgggcacttccttttcctctggtcacacccagtcctgagggaaaggcgccctcacccttggtctggagttccccgaggtggctggggggtgattttcccctcctattatggcagaacccccaaatcctgtctctccaaattgccaactcctcaccccangggctcaaagtgcaatcca

SEQ ID NO: 697091 - DNA, 1570 bp, Homo sapiens
  misc_feature (69)..(69): n is a, c, g, or t
  misc_feature (369)..(369): n is a, c, g, or t
  misc_feature (1413)..(1413): n is a, c, g, or t
  misc_feature (1429)..(1429): n is a, c, g, or t
  misc_feature (1435)..(1435): n is a, c, g, or t
  misc_feature (1437)..(1437): n is a, c, g, or t
  misc_feature (1443)..(1443): n is a, c, g, or t
  misc_feature (1453)..(1453): n is a, c, g, or t
  misc_feature (1458)..(1458): n is a, c, g, or t
  misc_feature (1462)..(1462): n is a, c, g, or t
  misc_feature (1464)..(1464): n is a, c, g, or t
  misc_feature (1485)..(1485): n is a, c, g, or t
  misc_feature (1496)..(1496): n is a, c, g, or t
caggaagagaccctgtctcaaaaaaacaaaaaaacaacaacaaaacccctaggtggacagagccaaagnctcaacacgcacaaacatctgcatacacacctcaaaatggaagcctcgttgccttgccttgatcataagttcttgctaccccaccattcccagaaataaccgctattcctaagtttcacagttcttttgcctgttgttttagtgtttactgcctctgtatgctcaggccatatatgctgttttatctgatgtaaatggactcatacagcttgcgtcctgtggctacacctttgttaacaatacatttgcagtttgtctacactgatgcgcgtggcagctccgtgccgaattcggagaganaaacaattagcctatttattcaaccaatggcattagcagtccggcttacagctaacattactgcaggacacttattaatacacctaatcggaggagctactctagtattaataaatattagcccaccaacagctaccattacatttattattttacttctactcacaattctagaatttgcagtagcattaattcaagcctacgtattcaccctcctagtaagcctatatctacatgataatacataatgacccaccaaactcatgcatatcacatagttaatccaagtccatgaccattaactggagccttttcagccctccttctaacatcaggtctagtaatatgatttcactataattcaattacactattaacccttggcctactcaccaatatcctcacaatatatcaatgatgacgagacgtaattcgtgaaggaacctaccaaggccaccacactcctattgtacaaaaaggactacgatatggtataattctattcatcgtctcggaagtatttttctttgcaggattcttctgagcgttctatcattctagcctcgtaccaacacatgatctaggaggctgctgacctccaacaggaatttcaccacttaaccctctagaagtcccactacttaatacttcagtacttctagcatcaggtgtttcaattacatgagctcatcatagccttatagaaggtaaacgaaaccacataaatcaagccctactaattaccattatactaggactttacttcaccatcctccaagcttcagaatactttgaaacatcattctccatttcagatggtatctatggttctacattcttcatggctactggattccatggactccatgtaattattggatcaacattccttattgtttgcctactacgacaactaaaatttcacttcacatcaaaacatcacttcggatttgaagccgcagcatgatactgacattttgtagacgtagtctgacttttcctatacgtctccatttattgatgaggatcttaaaaaaaaaaaanaaaaaaaggggggggnaaaatncncggggnccatttggcncccgntttntncaagggccaaggggggaaaanaaggggggggnaaaagggggaaaggggttgtggaaccttggggtggggccaagaacgggaaaagtgggctgggtggtataaaaac

SEQ ID NO: 697092 - DNA, 309 bp, Homo sapiens
aaaaatgttggactcaaggcgcatatgtatctggcaacataaaagaaacatttacttcaatgcttttacatggaggagaacgtcattaaacgtattttaattttagtactctcacagtaggacagataatagtctggcttttacacagggtctccagaaattccgtgtttttccgtttagataaattggaccttcatatgtcaagaagtctcagtggtaacagaaaagggtatcaacaatactctatatttttggttttcaagctcaatttccccacaaaggttaccttcagactattctttattccgc

SEQ ID NO: 697093 - DNA, 268 bp, Homo sapiens
atacacacaccagaggatctatccctacctggtcctggttgtgcatactgtcaatcttaacatccgtgcgcctggcactgaacaaggtggagtatcgctcctggaacatccacaaggtgacaataggtcggacctttgcaagctgaagagtgttgtcacgagcataaggggagtgaaaaatcacagagctggctgtctcccatgcatgcaacacatcaaatacacaaccaaactgacttactgagtctccagtggaaaaacactatgt

SEQ ID NO: 697094 - DNA, 145 bp, Homo sapiens
agaaggcgagggggcccggaccagggcaagaaggccgaggggaccccgaaccagagtaaagggctaggagggtaaagggctacccggagggtaaagggctacccggaggttaaagggctcccggaggataaagggctacccggag

SEQ ID NO: 697095 - DNA, 250 bp, Homo sapiens
  misc_feature (31)..(31): n is a, c, g, or t
  misc_feature (116)..(116): n is a, c, g, or t
  misc_feature (165)..(165): n is a, c, g, or t
  misc_feature (187)..(187): n is a, c, g, or t
  misc_feature (197)..(197): n is a, c, g, or t
  misc_feature (243)..(243): n is a, c, g, or t
aagaaattgaaggttttgggacatatatgtnacagcaataggttaagaaaagcaaagcagagaaattgaagatttgtgtcaacactgctttaagcaaatcttttggcaccattttnccaatagcatgtgcccattttgggtctctacattgcattttggtaattncttgcaatatttcaagcatttncattgttatnatatgtgttatagtgatctgtgatcagtgatctttgatatattatngtaattg

SEQ ID NO: 697096 - DNA, 270 bp, Homo sapiens
ctggggaagcagaaggtgaatgagtagcgaagtaacgtcttacatggtggcagacgagaggatgtgcaggagaattcccctttataaaaccatcagatctcatgaggcttattcactatcatgagaacagcatggaaaagacccacccccatgattcaataatccccacagggattattacaattcaaggtgcgatttcggtggggacacagagctaaatcatatcattacacttacacaattgtggtcttcaccatcattgggcagaga

SEQ ID NO: 697097 - DNA, 1440 bp, Homo sapiens
ttgcgtgcctcgctgtgagcccgattgattattggttctccttgcgctggacgtggtctctcgtgcgtgcctcagcacgcgctgttgtggtgtgttgtcggcgccgtgattctgtcttcttcgtggcgttcgtttgttggggagtgtgtggtaatcgcttgcgttctttgcttgtgggggggggtgtggtgtctgcaccgcttggtgttgtcttgatcgctcagggtggtgtgttctccgcccgtgctgttttttgtgtttgatgtttgttgtgttcctcggttgtgttctcggtcgtgctctgttctggtgttgttttgtgttgatccccgctcctctcttgtgttttttcggttcgctgcgtggcgtgtcgccgtcgtttggtggtgtgcacgtaccaagctttctttttgttgggggtggtggggcttttcgtcgcccgcctgctgttttttgcgttgcggctgctttttttcttctctctccctcccttctgtgagaggggcggctccccacaactcgacttttggtgtggtttgtgcgtggtctgggaggtgtggcgccccccctcccttttcacgtcagtgtgtgcgtgctctccccgccgcgggctgtctctccgcgccgctcttgttgtttttctcgtggtgggggttgtcatatattttctcttctcctcgcgcgctctgctctcgcgcgcgtggtatgtctcttctctcgctgcggcggattgatgtgtgtgtctctctcgtatgtagcctcctctgcgcggcgtgggtctcgtctctctctctctctttctctcgcgcgcgcgcgcgcgtgtgtgtgtgatatttatatttgtgtgtgtcgctgcgcgtggtgtctgtgtctctcttccgcacaccacactctcttttctctctctctcactctcgcgagagctctgtgtggagtctctcactccccccccctcgcgcgtctctctctcacgcgtcgagagttgtctcttctctctctctcattgtgcttgcgcgccctctctctatagagagtgtgtctctctctctgtggagtgtgtgtgtgttgtgtataggagcgtctcttctgttccccccgcgcgcgtcttcttcttgtgtgtattctctctctctcttataaactctcccctcccctccgcgcgcgcccctcctcccccctctttctcccgagagagagaggggcgcgctcccctctctctattataagagagatgtttttgtgtgtacacacacacacacacacagaagagaaatttctttctttgtttgtggtggtttccccccctctctctctctctttttattttgtgtgcgcgcgccccctcctcctctctctctgtgtgcctcccccccccccgtctgtgttttgcttgtttttgttgttttgttgtctataaaagggggggggtgtgttttttta

SEQ ID NO: 697098 - DNA, 234 bp, Homo sapiens
cacagccctgcggtcacatacagccctggggtcacacacagccctggtgtgatgcctggccctgcggtcacacacagccccagggacacatatgggcacacgatcacacagggccatatggtgtacatacagccctgaggtcacacatagccctgaggtcacacacagccctggggtcacacacagcgccagggtcacatatgggcacatgatcacacacgggcccgtggtcac

SEQ ID NO: 697099 - DNA, 283 bp, Homo sapiens
tgtaatgggagactagccagtgaattgatcttctggggcagcaaggagtaaagcgagaaaaaggtgctagcggtgaaaactcagctgtcctgtcgggagtggtctggcagtcagtaccctgaggcctgggcttgaagtttactacatgtggtaccatggagggacacatttgcgactgacgacgtggcaaaccttcttgatgccgattgtcttcatgccgcatgactggttactccaaatggaagggcccatgtacaaatgtgggtagcttggcacttgggca

SEQ ID NO: 697100 - DNA, 336 bp, Homo sapiens
agcggaggaaagcggagatacataaaagtacaaagtgaagcagcaagtgctgatgcagaagctacagcaagttatacagaagatctagctaagtggctacactaaacaacagatttggagttttttttatttttatttttttgaaagcggagtctcactcttatggcccaggctggagtgcagtggggcgatcttggcttattgcaacccccgccttcccaggttcaagggattctccggcctcagcctcctgagtagctgggattactggcgcctgccaccatgcccagctaatttttttggtgtgtgtgtatggtcgggctggggatcctctag

SEQ ID NO: 697101 - DNA, 1007 bp, Homo sapiens
cttaggggcgccaattgtgttgtatgcccagcgtctcgagaggctccctttctcaggtagaatctttatccaagggtgttcataggccatgggatggtgcgaaagacgcaatacgtggtgtacacgagtgaagatgttctcaagggcctctctctggcgcacaccacattgggccatgaggaaaaactttgttggtggcgcacattttttctccggtcacatttggtctccctctgggagggggggtcacacacctcctgtgtgtgtgagagcaccccccttttttgggcgccccccctctggctcactgtgatgagcacatttttgtgcacagcacgcacacacacgctcgtgtcgcccctgtgtgggggtgtctcacaggcgtgggcccgcacctgtctctgcgcacgagaccgcgaagggttctttgggggggaatctccccaccacagcggtggataggccacacatctcgcgtgtcacaccgccacgggtgtgtctccacagcacggagctctccccagcacccccccctgtgagattttgtctcctgtgtgtctctcgtcgcacagtctccctgtgacggtgttctggcctctttgcccacactgggcttgttgagttctctttgtatattcctctcttggggctgtagaagcgacgagtcccgacgtgttctccccctcggctacacccccagcttttgtggggggagaccctcgtgatgtttgttgtgaagcacaacatctccccagttctccccaccctggtctctccccccgttctccacatgctgcaccacattttatacccgccaatatgtgacgtcttgtgcgttgttcttgtgtttatattctctgttgtatatataaatggaaatgtttgttggagaatgaccccctcccctgtgcccgctggttctctttccccttttccctggtcccggctactccatggaaccccggacccctaagggacccttctggtttaaaaaaaaaagaccaata

SEQ ID NO: 697102 - DNA, 150 bp, Homo sapiens
  misc_feature (63)..(63): n is a, c, g, or t
  misc_feature (80)..(80): n is a, c, g, or t
ggatgacacataatggctgggacattgaaagtctaacataatttgagtcattttctcccggtnggccttggggttcaggngtgcctccgcgagcagggtgggatgctcttcaggggcaacacgaagctcattgaagaaaagagtgcttgg

SEQ ID NO: 697103 - DNA, 678 bp, Homo sapiens
ggctgcctcggctccagcgccatggagccctccaggtaagtgcttcgtaggtggaaactggaaaatgaatcgggacggaatgcacagtctggctggagctcatcggcgaatctgaacgctggccaaaggtgcctggcactgacagccgaggtggttcagtgctcccccatactgcctatttcgacttcgcccggtatgattagctaggcgtccctgagtaatttgctgtggccgtgcgcatgattactgctgcggatgtgagctagagtggtggcttccactgggcgagatcatgtcctgggcactgtactcaagagactgcggtagtcaccgtgggtggtcctggcggcgctcagagagagtgccctgtcttgtggggtgtcagactgtgctgattgtgcaagatggtggacccatgctctggactgacggactcggagtgactcgctctggagtggggagatcttagaatgaatgggccaggctcggcgatcgaactggatgacggttagtaagcgattcgaacaaagcgacgtcggagtatatcgtgagccgtctggcgcaatgcttgtcctggcctatgagcctgtgtgggccatttggtacttggcaagactgaaaacaacccaaaaggacccagggaagtacacgagaagctccgaggatggctgaagtcca

SEQ ID NO: 697104 - DNA, 100 bp, Homo sapiens
gactgctgtagacatttattgaatcatctgttgcaccaacagcacattgtatttcacagaagattggccacaggcaaaataaaataacccaccacaaatc

SEQ ID NO: 697105 - DNA, 319 bp, Homo sapiens
  misc_feature (48)..(48): n is a, c, g, or t
  misc_feature (75)..(75): n is a, c, g, or t
  misc_feature (84)..(84): n is a, c, g, or t
  misc_feature (104)..(104): n is a, c, g, or t
  misc_feature (119)..(119): n is a, c, g, or t
  misc_feature (127)..(127): n is a, c, g, or t
  misc_feature (131)..(131): n is a, c, g, or t
  misc_feature (133)..(133): n is a, c, g, or t
  misc_feature (135)..(135): n is a, c, g, or t
  misc_feature (144)..(144): n is a, c, g, or t
  misc_feature (166)..(166): n is a, c, g, or t
  misc_feature (170)..(170): n is a, c, g, or t
  misc_feature (266)..(266): n is a, c, g, or t
  misc_feature (282)..(282): n is a, c, g, or t
  misc_feature (295)..(295): n is a, c, g, or t
cagcaactggataggccatttaataggggtaaaggggaccgccagaanattttatagtgattcacaccatttganaagagagcnacatgaaaaggaatgggagnaagaatctgaaaggnataaacgnaganananaagccaagnaaggacagagacagaaaaagcngggnggaagggaacaaagataaagagagggcacggttatcacatggtgatcgaggaacagatggaaaagcaagcagagatagtaggaatgtagacaagangccagataaacctaanagtgaagactatnagaaggaaaaagaacgagaaaaaa

SEQ ID NO: 697106 - DNA, 790 bp, Homo sapiens
ctaaaggccaactcaacatatgtgatgttatatggccctcggatccttagtatgtgtgatttgcccccggtgacagtgtcttgtctaaaatggtctatgaaagcagggaggaaatacctgccaagaggaagtatgtatgagcattaatcaggggctataactaatattctcctgttcagaataatacttattctacgtgtgaaagcagagagtggatgtgattcccaactactagatattttcatgacccttttattgtatacaaaatgaactaccataacagttactgtggttagacatcaaagtcgtgtgtgcatgacttatgtgctgtatccacttaagacaataggtagaaaaggggatcgtgagaaattatgtaatagggaggtgggaataaaactacttaattcctgtgggcaggttatattgttaagttcaaattgcattgctttaagcctatggttactttgattgctgtgaaagcagaattgaagaaagagtattataccagagtgtagtaggctagggtgatgtagagaactctgtaatagaatgtcatggtggatgttacgctttttcagatccaagcgatatgaaaagccgtgtatatttttgtaaagaacgactatcttaactccaagctttacgatattaataagaagtcgaatggttcctcttggtaaggatattgcttacaagtgctaggaaataactcactgatactggttaaatacttggtttgctaaagaggggcattgaaagtgaaccaaggatattcagaaggtttaga

SEQ ID NO: 697107 - DNA, 1002 bp, Homo sapiens
actaattcaaccactgtggaagacagtgtggtgattcctcaaggatttagaaccagaaatatccattactgcatatagacccaaaggaatagaaatcattctattacaaagatacatgcacatgtatgtttattacagcactattcacaatagcaaagacatggaatcaacccaaatgctcatcagtgatagactggaaaaagagaatgtggaacataaacaccatggaatactatgcagcaataaaaaggaatgagatcctgtcctttctcagggacatggatggagttggaagctgttatcctcagcaaactaatgcaggaacagaaaaccaaccaccacatgttctcacttataagtgggagctgaacaatagaacacatgggcacagggaggggaataacacacactggggccagtcagggggtggggggtcaagctgagggagagcattagaaaaaatagttaatgcattctgggcttaacccatttatgcctagtgttccatttctggaatgctaagcatgtggaagttctttatatcctgctcaaggtcattgccaaggtctgatttttcacattcaacaaattgcaactctggcataaatgggttaatacctaggtgatgagttgataggtgcaggaaacaccatggacatgttatcctatgtaagaaaacctggacatcggtacaacatgtaccctggaacttacaaaatttacatatattgttatatattaatatggaatttaacaattactatgagtttttgcacggtaattgctcaacgcttatgctggaggcaagatcggagtcacatggatccgggcgaagaacgaaaaaaggtagcacaggtaaaaggcgggtaccagggctaaggttaggaggaaccattaacatggccgttaagataggcagcgaaagtgaaagcgtgacaagaaaaaagggcgaacgggaacataagacgaagggagagaacggaatagataggcaacggagat

SEQ ID NO: 697108 - DNA, 601 bp, Homo sapiens
  misc_feature (171)..(171): n is a, c, g, or t
ggcgcggccgcaggattcggatccgcgtgcctcggcacctggtgggccccccctggacgtggacgggcggcggcggtcggggcccccgagactcccgtcgtgcggcacatccccagtcccaagcgcatacgagccaccccgaggaaaagcccggtctggacagacggtcantggctgccagctgcccgttacaatggcctgtccaccatgccctcatccttctgaggtggtccccggattgcatgccttcatgccacaagatgccttggccatgcgagcccttgcgatagggagggccactggctgctggcctcccagggctagagctacatgcacgacatgtcatctaacagtatggagcgactggcggaatgcggaccgtggcctgagtgaacacagttccttcatcgcgtcccagccactgtctacaccgccaaactgtgcccacctgaatgcgagtcctcgactgtttcatggcttataggggtgcagctcgcgacccatgcagcacaacacaggacacgacgcccccggtcccaggcgttcagtagtttgcccaggtgttcttgctggacagacgcttgcctgtggcatcaggttg

SEQ ID NO: 697109 - DNA, 160 bp, Homo sapiens
gaaatgatcagactatgaccaaagagggatcaaacccagcagagtgcaagcagcagttaggcaggatgtatgtggccttaggataacctccactggttacctctgcttcctggaaggatgatttacatcatttgacagcctattttcaagtatttgtggt

SEQ ID NO: 697110 - DNA, 163 bp, Homo sapiens
tagcctggtccggccctttgagatgtgattggatcgtaaggctgtgctcattcatgggttaatggattaatgggttatcacaggaatgggactggtggctttataagaagaggaaaagagaactgagctagcatgcccagcccacaaagagccaccccaggag

SEQ ID NO: 697111 - DNA, 968 bp, Homo sapiens
ttctgtagagctatcatagtgaataactcagttctataagctacctgtgtgtcacagttttatcatagttcataattatctcacgtgcaatcctatttggaggccctgtcagactctgaacaatcccatccatatctgtaattctctgatggcaagaatggtagtggagcattctgagttaagcgagcgcatggacacgtcatcgtactgggtgtcataaactctttatgaatggtaatattatgtaaattgaaatctggccctcaaactatattgcagctttcagcagctatggttcgaaggcctctttggttcaatgtattctgtagatgtctcgaattatgttcttgagtggttaaaacagcaatcatcgacggcttgataatctatctattgggtaaagtcaggaaattgtgagtgccaaagaactaatggtctttgcccctctggaataaaggcacctaagctattgctaattgaattgctgctacgaattagaaattatgctttagaactagaatcggtatttctgtgattcttttgcttcttggtatcttctcttgtatctatgtatctagtattgaggctgctctttcatgtggcttaatcctctctttaatagctgttgtaaacattccttgatgtactggctggttcaggatcagttgcccaactctggtttagggttagattccatccaaggtaatcctagttgggtgttaaatccaagctgtataacacctggctttgggatgtaccacccttcaattccattttggcgaatatcagacaccctgcaattctctacatgatggtcacctaaccacacccaactggctcactgtcccaactgcgttagacccgcccttttgtttcccgaccgcgtgcctctggacccccaacgatttcccgcaacaccccaacacacggttaggcgaccaaaaacgacacacccttcacctaaccgc

SEQ ID NO: 697112 - DNA, 1385 bp, Homo sapiens
agcgggagcgcacggggcagacgctcggttccgctcgtcgtgcctcctcgctggccgcgctccctcccgggtgccggcttctctgagtgcaccagagcgcttgacggctggccctggcgcggcctgcagcacccgggcaggaaactatgacgaagaatcgaacgcgcccgttggtgacactaagccacgaatacgatgtctacgccaaatggtgcctctggtccttgggatcactctctgaagacaagcacaggacgccattccaggaaggctggtgagtagctcgccaccccttcaggatcatcacgagcatccaatgaagaaaaaaggtttctatgagaacagttcatgtatgactgaaagtcagtcattggtacgatgtcattgagaacacgtggcagagtctctgctcgagtcgtgaacgcttaaatgaaggaggccagacgtggggttgctcatctgcattgagctagaaaggcctaccgagcttgcttcgtgttccgctttgagcaacaaggttactttcccatacattgtgtattttacactcgggactgcaaggagtatcgtacctgaggacacttaaggcgagaaatactttggattgaatcttattttgaacatcgaagaacgaaattgtccatcagagcaacctatgacccccagggggtgggtcgtagacatggctctacagagtgttcgcgggaaagtactctacgatttctattcttagatctttcagatttgaaaatgaatacaaatcatgttgttggcaaattgtttgcttttatgaagtaagggtaagtgcctcttaattggtaggaggaaccatagggcattgactagaatcgacagttttctttgtacggcaaaggttgggggttaaccacaccaacgacttagtcggacgaaaaatgataagcttgggcccgtgttcattgttgatttaaacctaaaagggaggggttagttgcgtcgttactttttatcttatcataatcgttcgcccgggcaattgtaaaaaggtggtttttgggggcgtagaggattgcccaagaatcgtgttgtggcgcatttccttcccccggtgggaaatcgaaaggttgcggacaactcctatgggcaattgtgttttccctttttttgcacattccctctaaaaacacacaagcacgttgtgttctcacatatgcttggaaggggacaccattgatatttgccgagcgatgggactttcattcccaggaagattttttcaatccccggtggtcgtgggaaacacaatctttttaacccacggcaaaaggttgtttagcacatctgttgttccatcaccaaattgtttggggcctgtcgttcgagggaagaaccgctggtgtccataa

SEQ ID NO: 697113 - DNA, 203 bp, Homo sapiens
gaagcaagggtctaagcacaaaagtagtatgaccgggggctcagtttggaatatgcagcttctgataacctttaccccaggtaaggaggggtgcctgctggcagttcatggcgctctggtagacaagcatttattcacagctgatgtcccctctagccggatgcatctgctgtggacttcttaagctgttgatgctggacgat

SEQ ID NO: 697114 - DNA, 115 bp, Homo sapiens
  misc_feature (14)..(14): n is a, c, g, or t
  misc_feature (56)..(56): n is a, c, g, or t
  misc_feature (92)..(92): n is a, c, g, or t
  misc_feature (97)..(97): n is a, c, g, or t
  misc_feature (109)..(109): n is a, c, g, or t
tttgtgttctgacnagtcctttcgtccacaaggcctttccttgtgggcctcttggngagcgggaaggtctggtgcgctgtccttattctttnttgcnttctctacttanaggcct

SEQ ID NO: 697115 - DNA, 147 bp, Homo sapiens
ttatctattgtagctgtaggaactcactaacgtctctcatatctattgtaactgtagtaactaactaactctctcatatctattgtagctgtagtaactaaattagtctctcatatctattgtagctgtagtaactaactaactctc

SEQ ID NO: 697116 - DNA, 149 bp, Homo sapiens
agcggctacctgcatgcagaacgaccggcagcagacgcacatgctgtatgtcatgcaggaccacttcagccgcgcggccagcatcatagacgagctcctccaggacaggttcttcacccgggagcccaggatacctaccactacctgcc

SEQ ID NO: 697117 - DNA, 286 bp, Homo sapiens
agcgccctataaagcggtagaatggagttttagtgggaaccaactccacatatggcactttgacagaacctacctgtgtgtagcccacatttgtaccattcagaataggagctttccaatgtctatgtgttccaaaggaggacattcacgtgaccgcttatctgagcaacttcatagttagtttaagtaaggggtaaaaatttctcgtttacaatatttcgcatatacctcgcatacacgctccagatatcttatgtccccgtggagccccatgcgctctcgtgca

SEQ ID NO: 697118 - DNA, 114 bp, Homo sapiens
gtgtccattccagcctttcttcatggccccagtttagccttccgaaatgcgacatggtcagacagtgcccaagcatatatggtccctcgtggcctctcattctcatcgatccag

SEQ ID NO: 697119 - DNA, 201 bp, Homo sapiens
tagatgctgttcttccactaacctcattgcaactcccctccaagtctccgaccactaccttgtatccttttccctctcgctctcatccaacacttcccacgctgcccctactcggatggtatcgcgccgtcccaaccttcgctctctctcccccgctactctctcctcttccatcctatcatctcttccctctgcgtcgac

SEQ ID NO: 697120 - DNA, 219 bp, Homo sapiens
gtccctggacgggtggatttaattagggaaaaagtcgaggcagcagccctcgaggccctcccaaatgtttaggcaggcctcatttcatcacccagcatgtgcaggcctggaaaaacaaaaccaaatttcagggaagtccttggttgatgtatttgggtctcctttggagccctttgccctcctgtcccccagtaaagtaaataaacttccttggctcca

SEQ ID NO: 697121 - DNA, 131 bp, Homo sapiens
gctacggacgcactgcggaaagcattggcgccacggtacatcgccaggtggtcggcgcgtcgaactcagccagaaagcgttcgctgataccttcgtactttcagatacttgcttgcaagacgccgatccaa

SEQ ID NO: 697122 - DNA, 193 bp, Homo sapiens
  misc_feature (125)..(125): n is a, c, g, or t
ttttttcccccccccccccccccaaaaaaaagggggggtgggggggggggccccccccgggaccctttttccgaatttttaaacccccaagggcccccaaaaaggggggttttgggggggggggnccctttttgtttttaaaaaacccgggggggggggtggggggggccccccccccccccccccaggggga

SEQ ID NO: 697123 - DNA, 103 bp, Homo sapiens
ctcgggctcctgtgttggctggcctccgtttttcactgggcatcgtgttttacccgggaaccgtttttccctggccaccgtttttccccggggaccctttttc

SEQ ID NO: 697124 - DNA, 160 bp, Homo sapiens
cagctgcagaagctggaagcgcggggtgcgggagctggagagtgagctggaggccgagcagaagcgcaacgagagtcggtgaagggcatgaggagagcgagcgcgcatcaaggagctcacctaccagacggaggaggacaggaaaacctgctgcggctgc

SEQ ID NO: 697125 - DNA, 376 bp, Homo sapiens
agcgggggcagagagcgagcgcgcaacggcggcgacggcggcgaacccaccgcgcatcctgccaggcctccggatgcccagagcacacagagagcatgaagccttgcgaacgagcgcaaagccagaacacggcaaccacgcaacgacgcgatcgaaatgaagcatgaacataacacgccgctgacccacgcagagacgaccggcgaagaaacggcagaagcacacgcgacgaaactcagaggcgcagcagaagcagcgcgacaccaagaggtaagcacacgtcagcctacacccgggaaacaccacaacaagaacaggagaccggagacacaaaacacaagaaacacacacacacacagtaaagaaacaaaccaag

SEQ ID NO: 697126 - DNA, 313 bp, Homo sapiens
cttgaccgtatttctcacttctgagaagattgtagcagtaattcaggtctttgtggaatctccacactgccttccacaatggttgaactaatttggacgtccaccaacggtgtgtaagtaatttctttgttccgcaaccttgccagcatctgttaattcttgactttttaataatagccattctgactggtgttagatggtatcacattgtggttttgatttgcatttctttaaggatcagtgaggttgagcttttcttcatatgattagccgcatatatatcgtctgttgaaagtgtctgttgatgtcctta

SEQ ID NO: 697127 - DNA, 474 bp, Homo sapiens
  misc_feature (123)..(123): n is a, c, g, or t
  misc_feature (136)..(136): n is a, c, g, or t
acagatagggagcggtgtcttctctctctataggtggcttccactgatgtggctggatctcttcacagcattttcctaggactggcagctgttggtcttcttataaaatttaatgatgttgtnaggagctctgttnatgttgaggttcttgattctcactgtcagttggcgggcagtctagcaggttagaaggtacgtgctgattagagggttaagaaactccgtcccttccaaaggattcagtccaaaagctaacaaatagtcctcagccttggtgaagaggatcttatccaggggattctttgccttcagggaacacactggaagtaactatggatacatgaaaacctagcttgtggccaggactccaagccacattgctgttggcaaacagggaaattcattggcagtcttcttgacagttatatgagggactgcagtcaatgactgaatgtgtgccgagtccgctgcatt

SEQ ID NO: 697128 - DNA, 443 bp, Homo sapiens
gaaggagtgtttcgacaccactacagaaggtgacataaacatacataccagagtgtgctttcaggagcagcacgctgctgaggggatgtgaagctaacctgaccggaacacccatggtacaaagagagcagagaggcagaaatagcctgggtttgttttctcatgtcagtagagatctataaaccgctgggcttttggaagatattttaatagaggatgacttatcaagctaaggctgtgtgctgacaatagtgctgtaagtttatcatatttatgactcccagattttatttgaaggagttgactgaaagactagagatgggctctttccctgctaccatgtaaagttagctttcgcctctggacagagtgtagatttgaagtcaaggctggcgtcttagggctgacgtcgacgcggccgcgaatttagtagtagtaggcgg

SEQ ID NO: 697129 - DNA, 481 bp, Homo sapiens
  misc_feature (277)..(277): n is a, c, g, or t
  misc_feature (321)..(321): n is a, c, g, or t
ggacacaaagatttcaattaagatgttatcgagtctggggcatggtgtctcattcctgtaatcccagcactttggaaagccaaggcaggcagattgcttgaggctggaagttcgagaccagcttggccatcatggtgaaacctgtctctactaaaaatacaaaaattagccacacgtggtgttgcacactggtagttgcagctactcgggaggctgaggcatgagaatcgcttgaacccgaagaggcttgaactcaggatgccaaggttgcagtgangccgagattgcaccactacattccagcctggatggcagagtgangactctgtctcaaaataaaaaagatgctatcaaaggaatcttatagatgattgatggcttagactacagtggtaatgggagaaatagatggattccagagatattttaggagtttgtaaatgactagaatgggtaattttgggggataccaaatttaaga

SEQ ID NO: 697130 - DNA, 276 bp, Homo sapiens
  misc_feature (101)..(101): n is a, c, g, or t
  misc_feature (251)..(251): n is a, c, g, or t
gaccggcactacgatgtgcatagactattgtgagtcagccatctcacccttatagatatctactctctttgaatcagaacggtagaagataagaggttgcnacactacgtatggcgtatacctgagcacggatatacgtcttggtcattgacgaaaacacgtagtattagtttcaactaatcttagcaagacaaaatcttaatgcttgttggaatattacagcaaggtggacctctatacctctggacaantgaaaaagtaaagcaggtttgccat

SEQ ID NO: 697131 - DNA, 256 bp, Homo sapiens
  misc_feature (2)..(2): n is a, c, g, or t
  misc_feature (231)..(231): n is a, c, g, or t
  misc_feature (251)..(251): n is a, c, g, or t
tnctagatccttatcagagagatgatttgcaaacgttttctccaactctgtgggtagccttttcactgtcttgataatgccctttgatgcacaggcgtatttctcaagtgattttattcccacaaggctaaacgttaccatatttctcatacttcacttttctgacaaaatcctgctgaaaactttaacaatattattgaagtttggtttgagccttttcccccaataaancacacagtcctcaaggtttntgatt

SEQ ID NO: 697132 - DNA, 104 bp, Homo sapiens
catgcgcaaagcccttctgtcctaaaattaaattcccctaaaaatctttgaaaaggggcccggtatttaccctatagcccccccctcttcccccttttgggcca

SEQ ID NO: 697133 - DNA, 233 bp, Homo sapiens
ctaagcctgaccagtatcttggaccacaggctggagtacagtggcgtaaactctggtcactgcagcctccatctgccaggctcaagcaatactcctgcctcagactcccgagatagctcggattacaggctaccacatactgttgattgtgatgaaatgccagttgaagcacctgtcctgcgagcttatgggtgctacaagttgaccactgcagcagtaaagatgactctgaa

SEQ ID NO: 697134 - DNA, 763 bp, Homo sapiens
  misc_feature (380)..(380): n is a, c, g, or t
  misc_feature (386)..(386): n is a, c, g, or t
  misc_feature (389)..(389): n is a, c, g, or t
  misc_feature (461)..(461): n is a, c, g, or t
  misc_feature (621)..(621): n is a, c, g, or t
  misc_feature (637)..(637): n is a, c, g, or t
  misc_feature (663)..(663): n is a, c, g, or t
gagagaagggaagccctactacgaggtgcggctggcttctgtgcttggctcagagccttccctggactctgaggtgacttccaagtctgaagagctatgaattccggggaagccctttccaggtgaccctggtgggactacgcgcccatcctccatgaaggtggtgtgagcatgctgtgagaaagcctagatggcctatgtcagtctcaacagcacagccaggaggcacgattggctggcgccagatagtactagaagagcgttcacgccatgggctcacatcggaaggctccacatacgacggggcttcccagcgttcctggggatccagtcgacacaagtgcccctagtcggtcggatgacgtgtacgactcggaggntatcantcngaaggaagcctaccacgtcggacgctccttttggcattccctggagagagacagtcttgaagggtctatccngtgacgcgtgtgggtagacaccaaagagcgcatcgatgctgtccctacatgttctgacgtcggttgctggattggccgcagcagtcgatgcagctacgacttgggcgtggaaggggacgcattgcacgcataggtcactcgcacaaaccatgttcgtagnaacgagtaacatagcnttcacttcgaacctcccttggaactntcaacccatacctcgtgggtactgtatcctccatcgccgttcagcgtgggcatcccgagcgatcacactgtccgggtcaatcgaagcgataccgcacgaa

SEQ ID NO: 697135 - DNA, 142 bp, Homo sapiens
cagccaagcatgaggactgctagttcccaaagtgctctgctttttgtcaaacttatatattaggagagagggttgtagtggccatgaatgatgaatcataaaactgctctctctggtgaacgggccagcatagaaaccactg

SEQ ID NO: 697136 - DNA, 258 bp, Homo sapiens
acctatatccccagtgctttgcggggttgaagcaggaggatcacctaggccaggaattcatgaccagacctgcaacatatcaagaccctatatctaacaacaacaaaaaaattagcttgatatgttgacatgcatctatagtcccagctacttcggaagctgaggcagatcacttgagccctgaagtttgagttacagtgagccattatcataccactgcactccgacctgagtgacaaagtgagaggctgtctctaa

SEQ ID NO: 697137 - DNA, 262 bp, Homo sapiens
tgagttcactcagtggagaaccctggcaagcggcaggaaaaggggaggaaggtgaaaaccctccatttctaggtgaagtcccacggtggggtttcaagtcccaggatcaagttttcgctgtgtctctttttcccgtaaagtggttgaaatctgaagctgcatctgcaagtgtcatcgagtcattgaatctcccagtctcaactgataaaagtttttaaaggttgtctggttcacctttctaaaaacataaacatgaagaata

SEQ ID NO: 697138 - DNA, 215 bp, Homo sapiens
atgcagtggtctaaggaagaagaagcagcagccagaaaaaaagtaaagaaaactcagctgtgcgagttcttcttggagagccagttaagtattaagagagaagcttgttaattcttgggcacacatttacacagggttcactataggattaggttttcacagggtcgtaatttgctctttaggggattttctcacatactctcacattatcacaa

SEQ ID NO: 697139 - DNA, 1361 bp, Homo sapiens
  misc_feature (216)..(216): n is a, c, g, or t
  misc_feature (573)..(573): n is a, c, g, or t
tccagcccgggtacgggacccgggcagccgcaaaaatgtggatgcctaaaaaagaaccgggatgggccatttatgagaactccttttaaagggaggggaggtcatggggggccaaagaagggatgtccacatggctctaagcacccgggagctgggcaagacaaagatatgtggcccaactcttacagtggtcgcatgagaagggcacatggacangttcttctcacaagtgtccccggagggtctaacctgtgagaaggagaaccaggttgggctcgggagagaactttttctatcggggatactcttaacacaatggagggggttatcccatgttatctctccgcgggatatatacactcttcacattctgggccccgcggagaaattggtggctctggccacaacccctaagcggcgcgtaaggcgcgtccccagaaaaagtggggcagagggccctcgcgggcctaaaagagggttctgggaagggggtggaggcggacctctggggagagaaatctccccacaagagaggggggggaaaccgctgaggaacaagaagagatacctctnaaacagagagggagggtgggctggtggcccaccccgtgtgtgcgcccagacaagagaaaaaggcccagagggctgtgggggcgctgtggggttccaagaaaaaccagaattttcccaatggttaaaaagaggggggggggattataggggccctgtggggaaactgtgtgcgtctcagggcacaccctctacatgttacaaaatattgggggagaaggggaatcacttttttagggctatttgggatatataaaactttttaacagggggcaaaaagaaaaaccccttttaaaaagaaacaaacacaaaagagacaagacaaaacagacgacgcaagacaagagacaaaacaaacctcgccgggggagggaaaattaaaaagggggggggggggcggagagaaaaaacaagggagtatcatacaaaaaaaggggggccaaggggtgcgacacaacatgtgagtggtactccgtcgcaaccccccagagttcttgtgggacgacacaaggggggggagaacaacgtcgggggggcacccccacaaaggggggagggggacaaaaaaaactgcaaaagaacggggggtaccgatcagagaagctagcatcagacaccaatactaacgaagagcaaagagacaagacagagaagacaaagcgagaaggaaaaagacaagagcgcggagagagcggccaacaccaaacaagcgaaagacaacagacagcagagacaagacacaaacagaagaaacacaaacaacacaaacagcaaaacacacagtcgaacga

SEQ ID NO: 697140 - DNA, 439 bp, Homo sapiens
agcggcgcccttttttttggcagcggggggaggtgttaattttggagtatgggggacatatttttttttttggaggcgggtctgaccgtcgccagccgggagtgtaggggcgcgatctgggctcacggcaagctccgcctccggggttcacaccattctccggcctcagcctcctgagtagcggggactacaggcgcccgccaccacgccgggctaagttttggcattttaagtagagacggggtttcaccaggttagccaggagggtctcaatctccggacctcgtgatcggcccaccttttctctttagagctactaaaatgaataattatattaatagatttttaaatattaaaatatttttctatccgggagtaaaccccactttgggctctatagggttttcctgggtaaattttaaacggggttttcaaaaaa

SEQ ID NO: 697141 - DNA, 412 bp, Homo sapiens
  misc_feature (257)..(257): n is a, c, g, or t
gttgaggaaaagttaataataatattattatatcattactctgtgaagctgggagtgggatgaagacagaacctgggaaaattttatccaccaccacatggcacacaaaagggtgggcacacaccacgcccaactaatttttgtatttttcgcagacagaggattttgccttgttgtccaggctggtctcagactcctgacctcaggtgatccgcccacctctgcctcccaaagtgctgggattacgggcgtgcacncatgccctggcaacctgttacattttttgcagagtaattctcaggctctgtcagcattgctttcctaagtcgttctctgcccaaatccctctgcctgctttctttttatccaaatgtaacctgttcactggagcctcccagagacttaggggaag

SEQ ID NO: 697142 - DNA, 821 bp, Homo sapiens
ggcaagagggctagatttcctcatttgttatgagactagatggtaccagtagatcagctgcctagcgagggcaggtttcttctttgcatctgtgtggcttgcattccagtctggcctgtcgctttccagctgccttttgtctagcctgctatggggggccagattatcttgataagagcaggtgatcttggggactagctgggttggcaggaaaagagctaggatggatctcttgggacaggttcccccaggtagtatatacgcaaggagccaggattgtgctgtgctgccaaggcaaacagtagatgcctgttctgagttggcagacgagggccttggtcacctcttgacatccaggcaggtctcgtgaagatgggggcacatagccacgtggggaaagcagaagctccattcgtcaccgtctatttggagcttcagtgctttatgtcagtatgaggaagacagcaacatacaaactgaagtgcgcttgccgtcctttcaaaggacaactgtcgggaagggagagccgagtagcgaggtaaggaggggagcactggcacgggcagagacgttcttgactcctctcttccctggtgtgtggtgatccaggggaatgacaagaaatggaccctggattggggctctccttggacttaggaatctaacgtttacctttccagaaagttctccacaggcaaggaccagctgcccattctgagcccagggcagcctcttccagcattaatggtctaacctgggtgtcagggaaacaagcagacctttcacaatgggccggctgctctattcatggacaagtaatg

SEQ ID NO: 697143 - DNA, 802 bp, Homo sapiens
ggttacaggcgaggggaggctgtgtgctgtcagggtccagagcagtggtcctgcggtgatggagtctcatctctctcctgctctcgtctgtggctatccactgtgtccctcttgtgagcgcatctgtcccaagtcagttgcaggttttggtcactggctgatgatgatgcaaggtggtccatggcgcggcaaaggaacggcgcaggctgcagaaggttactggggtgttgccacgtaacgccagctaggagctcattgctgggacactgtgcccagccgtgtcgggctctcccacaggtagaaagaagatcagctccattgtgggacgaatcgatgaaacggatgtatgtacaccacttgatctcagcattttcagcttccagccaccagtgtcttctgtgcgtgcgcagcggcgatgtggagcgtcccggcacagcgtccgtcggcatggggtgcgggagcatgcgtatggctggtgtagagcatggacttcccctcgcgcgtgacgggctctccgctgtgatcagactgtcacagggttctccaatgttccaccatgaggaggttcagttctgtttgtagttgcgtccctacccgatttgagtacagttgggttgcgactaagttgagagtaaaaattaagtgtcgggtcaatgttatagattgtcatgaattgttagaccatggcagcctatattctagtgtgtggctaccagcatcacagtgcaggggtacggaacaggttgcacagaccaaatagtagattaagtcggatcgttgagactaaacgaatacaacacca

SEQ ID NO: 697144 - DNA, 136 bp, Homo sapiens
aaggcaattttataactttatttgatctgacgatcagcgattagaattaatccacatattcagtcagcatagtttggaaaaaggcatcaggtagacaggtaccccaagtacatagattatgtgcagatttttcagc

SEQ ID NO: 697145 - DNA, 458 bp, Homo sapiens
  misc_feature (31)..(31): n is a, c, g, or t
  misc_feature (112)..(112): n is a, c, g, or t
gcattctcagaaagttaggcatcctaccctntaggattgaattgggaccctttccttgtaacatatttctggtgacccagaagggactaatagtgcagaaacgttgacccancggctacctttgcgtaagtgttggggtcctgtaacatatttctggcaaaccacagaaaggatgatactgaagaaaccccccaaaccccaaaggaatagactgcagcactgattggacgactttgggtaagtgatggggtacccgagtaacaaatgggattgggttagaggcccaacttaggggagttggagtttctcctaagacagagtgagttagaggcccctcttaataaaaggcaaggacacttgactgacctcaggttagaggttactccatcctactctatggagtagctgtcctttcaccactttactttcttaataaacttgtttttgctttgcaaaaa

SEQ ID NO: 697146 - DNA, 253 bp, Homo sapiens
cattaatatcatagtctcctcacaacatgtctaagaggtaggcacggtattgttcccattttgcagatgaggaaactgaggttcaagagagggcacttggcttgcccaaagtcacacagcggggaagtggcagaggaaagtcaggttgggtgaaccccagtaaacttgtctcagaggctgggtgatgaccgggcttcctggcttctctggaataaacctttgccaccatgtgcttcatgttggttgggtaccg

SEQ ID NO: 697147 - DNA, 174 bp, Homo sapiens
  misc_feature (19)..(19): n is a, c, g, or t
  misc_feature (62)..(62): n is a, c, g, or t
tgcgccgtgggaccccttnggtccgcgtgcaccgggacggccccgcgctcacgcccgcagangcccgccctgcaggagcgctcgtactctccgaccgccgccattcgccgccccctctccctttcagagctcgttctgccgccgcagcaataaagctcctttgccgcgaaaaaa

SEQ ID NO: 697148 - DNA, 155 bp, Homo sapiens
tagtagtccacaatcttgtacctgatgccgatattcaacgctatcggaatgagtttgaaaaaatctgcagacaggaggtgaaaccattaggattaacagtcatgagagatgtgaccatttcgaaatccgaatatgctccggaagaagaaaatgat

SEQ ID NO: 697149 - DNA, 127 bp, Homo sapiens
agcctattttttcacatccttcaatacgtatccttatttccagcacctatcacaagacttacatttaatttgatgtctcagatcacatgcttgttaaatgactattagcgatggaacagggggatct

SEQ ID NO: 697150 - DNA, 178 bp, Homo sapiens
gttaatacagagggacattgttttcaggagtgttgtcagcaccgaggagggagttgtatccttgtggtgtgtgccctgtggaatttgcatggcaacataagttgtatttcttcatgactcactgccataggaagagcagccaaaacataccctcttctgtaacccaaatctcagcatg

SEQ ID NO: 697151 - DNA, 708 bp, Homo sapiens
  misc_feature (3)..(3): n is a, c, g, or t
  misc_feature (173)..(173): n is a, c, g, or t
  misc_feature (215)..(215): n is a, c, g, or t
  misc_feature (416)..(416): n is a, c, g, or t
  misc_feature (431)..(431): n is a, c, g, or t
  misc_feature (468)..(468): n is a, c, g, or t
  misc_feature (518)..(518): n is a, c, g, or t
  misc_feature (520)..(520): n is a, c, g, or t
  misc_feature (538)..(538): n is a, c, g, or t
  misc_feature (585)..(585): n is a, c, g, or t
  misc_feature (610)..(610): n is a, c, g, or t
  misc_feature (675)..(675): n is a, c, g, or t
  misc_feature (694)..(694): n is a, c, g, or t
atnctgcagaaagagcaatcgcattaaatcttagttcatcagggtggcgctccaaaaacttcttgcaaacttctatggcatcctctaataaagtttcatcactagtttcaccatggttaattggaaatggcttccgcccatttaattcatagagatgcccatctacatgaacnaatgcaataaaatgaagacctactttctcatctatacttggngcctcagtttgaccttcatgggcactggtcttatgagttactgggatggcatcatagttctccagggatctggctcgttcttcagggctcattgacaaaaattcctccaggaattttttcaaggttgaaccagaatcaaagtgcattttgtctttattgtttgcaatagcatgaattagttcaattgttccacaggcattnctgaatgtttgcttnaagaaaaatactgatgaggtgacaacttgtccctganaatttattttttcttcctcttctgttctgaatacttcaaacttttctgtnanaggaaagagaagtgagantgcacagactggtcttggtaccatgctaaggagttcaggatccattncataaacatcaacgaattgccagtnaggatgtagaactaattgtttaagaaactggttggtgaactcgggatttgcctccagcggcaccnagccttgaccctccatggncgcggtgcccggcc

SEQ ID NO: 697152 - DNA, 353 bp, Homo sapiens
tacatcttcatagagtgtgtattcaaatacattaaaaacttttaatgtgttattctcttaaattatatagacaacaaaatgtgaagttacgaaccaaagatacagtaatactagctcttagacttacaacttttgatgtattagtctactaaatcatgcaaaaaatggaattgtacactattactgcaataatgctagcttttataattgcctatgtatttattttactcagatatttatttcttttaatgagttactttataatgattttgtttgtttgtttgttttgttttgttttgttttttccatttcaacgtgcaggtctccttgagcattttttgcagggtcgacgc

SEQ ID NO: 697153 - DNA, 835 bp, Homo sapiens
gttctagatcgcgagcggcgcccttatttttttttttggggtgcacttatttattcttcactaatagtaaaatagtttgatttttacctgacagtgttggtcaaatttaaaatcatgaatattcaattttatacaaacatttatatttatatatatatagattggtgtatgttatttgccaaagcacagatataaattacggggctttaatatttaggtgcaaggaataaataaggtgcacacaaaaaaaaaaaacaaaaaaaaaaaaaaaagaaaaaaaaaaaaacaaaaaacaaagaaaaaaaaaaaacaaaccaagagagaaaaatacacaacaacacaaataacaactcacacaacaacagagccgaacaccaaccacaatacacgatacacaagagggcgacaacaacaaggagggcgcccacaaaataacaggaccatcacagagagacagacgacgagcccaacagagaagcacagagtcaccacaacgacgcacaccgcgagagagagcaggctcgggggggagcgaacaatcttgagagggaacgccgagtcgaaccacacgaggggggggcgcaaagatacagccgagcagcagcttgtgcaccgggcgtcggcacgaggagccccatcagctagcgagttcaacgaagaagtgcaaaaaatggggagcgtgctgatccaaccatgggtggtcaactaccgacagcaggatcaatcggaggagaggtaggcaggagcgagggttgctaaacgcagaagatattaagacaaactcgcaccgcagaggcatcagcatgacacccgttccaccagcccaagatcagcg

SEQ ID NO: 697154 - DNA, 338 bp, Homo sapiens
  misc_feature (316)..(316): n is a, c, g, or t
ccggagatgccagtccacgacacaccacattgattcgcggcagcagtgccgtcgtcaaggtggttgtacgacgctttcgctcaaccgcgtgtcggtggttgagcagaatacccgggttgatttagctggttcacagggtgcgaaacacaaggtcgacatcggttttgaatcctactctgccgatttttactaccagaacagtcgggtaacagcagtctatacagcggaatcgataaagctcgggcgttgatgccaccgcaggtactgtccgccgttaacactagcaagtctggccgggtcgcgggctgatcgcgtntactgcgtacacctatgagcat

SEQ ID NO: 697155 - DNA, 599 bp, Homo sapiens
ccattgctcagaatactgtgtcgttcaccaattctcatgaggagagggaacatgctgagaaatctgatgaagctgcagaaccaacgaggtggccgaatcttccttcaggatatccagaaaccagactgtgatgactgggacgagctggcgctgaatgcaatggagtgtgcattacaatttggaaaaataatcgctgaatcacgtcactactggaactgcacaaacctggcctacgtgacataaaatgacccccattttgtgtgacttcacttgagagcacattatccatgaagtgagacaggatgaaagccatcaaagtacttgcggtgaccacggtgaccaactctgcgcaagactgggagcgcccagaatcatggcttggcgtgaatatctctttgatcaagcacaccctgggagacagtgataatgaaagctaagcctcgggctcactttcccacatagccagatggggtgacttacctggtcaccaaggcagtgcaagacgagtgcgtccgcttccgatctagtatctaaaaaaggcgtgcctatacagtccacgtttgttcattagaatcgtgccatcgcttatctccgcctgc

SEQ ID NO: 697156 - DNA, 125 bp, Homo sapiens
gtaggcagtgtgaaatacctcacctgggtgtgccaccaaggagctgcaggccccggctccagtgaaggctggtgctgctgctgccctgtacaggacggctctgcatcttcctcccagaagcccag

SEQ ID NO: 697157 - DNA, 306 bp, Homo sapiens
  misc_feature (303)..(303): n is a, c, g, or t
ctgctattagccttcccttaagcatatttcctgcctagttattcacaccaaggttaaaagctctcccataatgcaaagtaatttctgatcccctacaagtaaaaaacattaggtaacacaatgcaaatcagagcaatgccttggattttgagagggatttgcttgccttcaattcctggggttccatgaggaaaacagatttttcccaaaatggagcctgtggtgctccctcagttttttctaaggaagcccaggctgttagaaatgatcttaggtcctctcaatgtgggcatcaagagtggnaag

SEQ ID NO: 697158 - DNA, 202 bp, Homo sapiens
  misc_feature (16)..(16): n is a, c, g, or t
  misc_feature (140)..(140): n is a, c, g, or t
tacgtaaatgaaacanctcaagtggtagtgactccagcagactcaattacattttaaggaacactgcctctcctttttttttcctcctcgccttctcttcttttttcctctcttcttcttttcttttttaattcttcccnaaaaccatcgtgattcgtcttctcatgcagattagctcgacttcactgccaggtttcctctg

SEQ ID NO: 697159 - DNA, 730 bp, Homo sapiens
ggtcactccggaggatgcggctgcaaaatgtatcgacgtgcagatgtagctgcgaagattgctgtccgtgcgcgttgctgcggccgtggtccgcgcccttcctcgccgggcctgactgagtctccacatgatgctttgtgttcatctttcattgctttgctaatggaacattccagtgccgtctagcaacttcagtcgttcagatagatgactgggacatgctgcagatgtgcatctattccttgattgagcgtattctatgcgcagctgataccgtcatgatcgatcgttgaagaaaacatgggcggtgtcgtctaatgtattggctgattcggtattgcccgcgtacatggcgcatgaggaagtgtctcataggacataaggaaagattggtagagatcatcgtatcggagtcgttagtaggtggtattgtgcattgatgctttggtaagctgaacaaatgtaggatgtgtagtcgggtgaggagacgtgagtaaagactcagatttaacggaaaggtgaagattatatgctagacagtaagcgatccgggaagacccattgtggcgtgacgctccccagcttagtggagtgcgctgatagcgttcagtagttgcaattcgaatgtacccaatgattgacagtgccttacttgtacgctcaactggctcaaaagggatatcgaaacacggcctactgcaccctcgtgcccgaacgaactgtgggaata

SEQ ID NO: 697160 - DNA, 760 bp, Homo sapiens
  misc_feature (386)..(386): n is a, c, g, or t
cgctttgcgtcgcgacgctgtcctacccgcactatgaacatgcttctcgtgaagtggatctcttgaatccctctctagcaagagcagactaggaaacacaggtaagaaccgtgctgtctgaaaataaccaaattgcctcacttgcagtgggatgtgatgactgcctgagggatgcctaatatacattgaccacagtctgtgagccagtgatcgaacgggtcagctagtgggtgctgtaggttgcagcgcagtgacgctcatgctgatgccttacaggtaggtgcacgtccaggcttgaccgatgaagaggatgtacgcaattccggtcgtcaagcagcactaaaaagcaactcttgagtcaaggatgcagtgcggacaaccgattntcaaattaaacgactattttggcacttccaagttatagagaaccacgcggccccaagtaaaggaaacgtttgagtgcggggggcataggcgcgtccccaaaaggaagtatccgagaggaccaagtggcaggagggccgcgggagccccccaccaagtttaaaaaaaccccgctgcgctgacaacacggtatgccgttcagaggaaaccacgtgccaaagtggcaagtccggcgggcgcccattccaccgcgatttaaacaaaccgcgcggggccgaaagccgagcctgttgtccaacaatatccacgggacggtggagagaagggcaacacggggatcttacaacagagggccaacgcacccgatataaatacg

SEQ ID NO: 697161 - DNA, 107 bp, Homo sapiens
agctcggtaccgattacgctctagacgggcaggatgatcattgagcccaggagttcaaggttacagtgagggtaataatgactggtgggtgattgtagatattgggg

SEQ ID NO: 697162 - DNA, 150 bp, Homo sapiens
ataacaggactacaagctctattcctacagctacctcgggctcgggtgatgtcggacgcctgggatactgggcggcgtgtaggggagctgttaagggatggaaaggagttggacagcccttgctatgtaatcccagtttcaaacggagag

SEQ ID NO: 697163 - DNA, 243 bp, Homo sapiens
  misc_feature (103)..(103): n is a, c, g, or t
cggcccctttttacccctggggggtcccccggccccccctggggtgggctccttgggacgtggggaagttatttttttttttggtgtttggcccgttgggcgncggtttaggccttaactggggacccccggccttcctgttcccccttggttgcttttttggcccgatgccccagttgggctcccgggccgggttgggggggcccggggttcccctttttttatttaagttgatttccccca

SEQ ID NO: 697164 - DNA, 231 bp, Homo sapiens
cagacaaatcccaataaatatgctgatctaccacagcatgaataaatcacagaatataacgccaaaaggaacgggcacataacagattatccaagatccaaactcactaaacagacagggagggagacctgcccaaagtcacatgactaaaaggagacggggtggactaggaataacagatgtactgactatctacgggtcatatcatttaatgttgccttacggagaaga

SEQ ID NO: 697165 - DNA, 173 bp, Homo sapiens
tggttcacaatgcccagaacctcatgcagtctgtgaaggagtctgtgcgggaacctgaagctgaatcaatcaaaattggaacagatgctggatatacactgcgttggcttagaaagactccctggtaccagtaggcacctagctgggcctgactggcactgaatcctctacta

SEQ ID NO: 697166 - DNA, 269 bp, Homo sapiens
  misc_feature (79)..(79): n is a, c, g, or t
  misc_feature (260)..(260): n is a, c, g, or t
  misc_feature (268)..(268): n is a, c, g, or t
cttcctcaaagggggatatgagaccttcttccagggttgcatggatgtaaaactcgtttcactcgtttcaaagtgaganagctctcatcagccagtgtggaaagctagtagtgctaaacatcaactacaggccagcttatgatcagggtggtccagttgaaatcctttcctccctctaccttggaggtgcctaccatgcatccaagtgcaagttcctcatcaagctatacatcacagccagctgaatgtccccttgtggncctggctnt

SEQ ID NO: 697167 - DNA, 495 bp, Homo sapiens
catgtggatggagtaaatacctggttataaattcatgtacagcctttgttatggaagcagtaactgtaaactgtcaccctaacaaattttattagctgatcaattttaaggtagtgatctgtactggcagaattgaatacagacaatcccatcaccagggaaaccacatttagggtataaagtgaatttaccctttgtgtgaacagagtgattagtttttaaaaggtccttaattaattttcctgtgtactttttggatagatgatgacaagtaaccataaaatgtatttttagtagcaatttgccatctctgaaaataagtcagtttcaaacatcggttttcaaaaaatgttaatgtggaattagttaatagcagtcatttccaaatgtttttaaagcaatagagtgggttgtttgtgagtaaaaatattagatacttactgtgtaagaacaggtgaagttggtgttttatgagagcagatttactttagaagg

SEQ ID NO: 697168 - DNA, 166 bp, Homo sapiens
ccctacttccccctatatacaaaaataaaaatggttcaaagccctaaatataagagctaaaactgtacaactcttggactaaacccttgccttaagtctttatcccctgggattaggcaaaggtttattgaatgtgactccaaaaaggattagactgacccgaata

SEQ ID NO: 697169 - DNA, 151 bp, Homo sapiens
cgcgttccaaatgtttgtaaaatggagaataagaacatgcctttgagtcttaccccacagagtctgagactattcacaagtgagtttacttatttcaaagttggtcgcaggtttcccaaagactagactatagtcgcacgtggtcgacgcg

SEQ ID NO: 697170 - DNA, 166 bp, Homo sapiens
ccatcgccagccgtttgcgtcaagcgtctggccaacacgctgttaggctgcatgatgaaacgatatctcattatcgcagtcgctgctggtcggtactcgtctgtcactgcgataacgatgcgttccaccgcgcggcaaagcgaaggcgcgccggcctatccgccgg

SEQ ID NO: 697171 - DNA, 121 bp, Homo sapiens
cgtggtgcactagatagatggacgtcggcaactcccggcacctgggtgtcaggagcccagagtgggacaccccccacaggtctctatggtcactctgccgtctaccacggccacccctgct

SEQ ID NO: 697172 - DNA, 412 bp, Homo sapiens
tgtgatgtgatccactaattgtatccagttagaatttgatcctgagtgcctttccaagaaacatgaggctcccgacccattcactcctaatctaaaggtggacatgttgagtgaaattaacattgctcccggattctcaccaatttcactggagtaatgccacctccagttcaaaaaggatttggattctatcttaaaactcgatcacagtcactttctgtctgatctgcggagaccctacaggtatccaatgaaccttgggattggtacaacctccagctcatcaatgcactggtgttttatgttggggcttaggccattgcgacaatcccaacaaggggggcacaacttcaatgggcccatcattacttagcaaatgggtatttccagatttggtttggcttggcaatga

SEQ ID NO: 697173 - DNA, 634 bp, Homo sapiens
  misc_feature (286)..(286): n is a, c, g, or t
atgccacatgcagcgcaagtaggtctaccaagacgctacttcccctatcatagaagagcttatcacctttcatgatcacgccctcataatcattttccttatcgtgcttccgctagtccttgtatgccgcttttccctaagcattgcacagacaacaagtaagtaagtactaagcatctgcaagaggctcaggcaactagagaatcgtctgacatgtatcctgccggccatctatcctagtcttcatcgccgtcccatccctacgcatcctttacataacagacgnaggtcaacgatccctcccttaccatcaaatcaatgggccaccaatggtactggaacctacgagtacaccgactacggcggactaatcttcagatcctacatacttcccccattattcctagaaccaggcgactgcgactcctgtgacgttgacaatcgagtagtactcccgatgtgaagcccccattcgtataataattacattcacaagagcgtctgggcactcatgagctgtccccaattagggtttaaaaaaacgagttgcaaattcccggacgtctaaaacaaaccatttcaccgttacacgaccggggtaatactaacggtcaatctctgaaatctgtggagc

SEQ ID NO: 697174 - DNA, 484 bp, Homo sapiens
  misc_feature (275)..(275): n is a, c, g, or t
  misc_feature (284)..(284): n is a, c, g, or t
ctgtaatcccggctacttgggaggctgagacaggagaattgcttgaacctgggaggcagagattgtggtgagccgagatcacaccattgcactccagcctgggcaacaagagtgaaactctgtctcagaaaaaaaaaaaaaaaagaagaagaagaagaagaagaagaagagggccaggctagaatttgtcattctttctttcattaacaattgctattaagttggagacctattatgattctccacttcagcagatttggaaaacttgaggcacntgggttgcnttaaggaattttgctttaagattggaacaggccagggacgttggttctaaccttaaggccggtcttaactcccgtgcctcgtgtgaaattttaacctttgttgcactgttcccacagccttcgtgttttacattcactgtgaagattggcactttgaaaccttcacgttttatttcattgcaattgcttccacattgggc

SEQ ID NO: 697175 - DNA, 91 bp, Homo sapiens
  misc_feature (68)..(68): n is a, c, g, or t
  misc_feature (73)..(73): n is a, c, g, or t
ttttatactaatcatttttcaagaggcatattagtatgttattaaatacttgcttttagtatactagnatttnaaagggctacaggaattt

SEQ ID NO: 697176 - DNA, 287 bp, Homo sapiens
agaagtatataactgtcccttttctccacaacctcgaccagtactttttagtcatgaaagaacatcatttccaataaatagaatcgaacaaatttttaaaaactaaactagtgaaaaattagcaagaaccctgctcagacaagtgaaagtattatggagagataaataattatacaagtcagataacaaagaatacatattattcaatttatttaaggatttctatggcaaatttgaactttagaatcagatgtcagagtagtggttacccttcatgaggaaggaga

SEQ ID NO: 697177 - DNA, 168 bp, Homo sapiens
  misc_feature (64)..(64): n is a, c, g, or t
  misc_feature (73)..(73): n is a, c, g, or t
  misc_feature (154)..(154): n is a, c, g, or t
ttcttagtattatgtacggtgatgactcagacttactttcgaggtaagaatacatttagtcaantaccttcanaaataaaaatattttccagagcagttacttcagatcagatcaagccaagtttcttttttctttttttttttggaaatgganaaggcccaggtttg

SEQ ID NO: 697178 - DNA, 123 bp, Homo sapiens
cgttctcccccgaccccccccaccacaaccacagctcactccgtggcgctaacgcggggagcagtgcacgcatgtctggctcacaccactcttgtgaatacggaagccatggcgtggactgtg

SEQ ID NO: 697179 - DNA, 134 bp, Homo sapiens
  misc_feature (21)..(21): n is a, c, g, or t
gtccagaaggacggagactgnaagcagggtgtagtgaatttcccatatgatgatttcattcaatgtgtcatgagtgtttaaatcaagaggaagctgcatgaatgtaatcaacattccaactggagctctccttt

SEQ ID NO: 697180 - DNA, 355 bp, Homo sapiens
taagggctggcagagtccagtttcagaaaatacgcctggagccagagcagttgactcgagtgccgaccctgcgtcctcactcccacctgttactgctgggagtcaagtcagctaggaaggaagcaggaccttttttccaaccacaagtgggggcccatggaactgaatctttactccttggtgccccgcttttgtcgtgcgttgccctgctccgtttttcccaaaaagccctgggttcatcaaggccccccacgatttcctgagtgccctgggaaatttgggtataggtcaggcttggcagccttgatccccggagagtactaatggtaacaagtcaaataaaagggcatccagt

SEQ ID NO: 697181 - DNA, 107 bp, Homo sapiens
acggatcggtcacttcgccgtgcacagcagctggatgcgcatttctccagcgcttcagcgccttggtgcacttgcccagcaggtcggtcacgccggcgtcggacgtg

SEQ ID NO: 697182 - DNA, 140 bp, Homo sapiens
atcgtccagctgcccggcaagaagcacgtcaaaccactgacggcgttctgccgcgcttaatgtgttctgctggcgtgcttcattgtatagcgtatctgcctgggaccattgtttcttttagattgcccgttgcagcagat

SEQ ID NO: 697183 - DNA, 468 bp, Homo sapiens
gtgtgtacgagaagtgcaaacgtgcctgaaaggacctggaaacagtacttaactgacaccaggtaagagactgtcagtacagctgagtctaaggggaaactggcacttagggtgtgtcagctgagatagctatgtgtaaggtcctcccccttctaccctgcagactttacttctatttttcatacctattccacatgaaagcccctatgtcccaacaccaaatgtcttagctgaaggaatacccatttctcttaatgcaaggcagtcggcaagaggtagtggaagaaacctcatctctgtaattacaagagatctattccggacgccacatattggacactctaaatacaacatcacctggcagaacatactggtatgactacggaagtgagaacgtattatgtcacacaatctttggacaactactatcattggggtactgcacttactcggtacacacggggtacc

SEQ ID NO: 697184 - DNA, 124 bp, Homo sapiens
aggttacgaatgtttagagtttgctagagttgtttagagttgtgtaaggagtatgacggtgcaggcacgtagagtaagagtacatagcaacgcgaaatggcaacaccgagggccacccgagagc

SEQ ID NO: 697185 - DNA, 443 bp, Homo sapiens
caagacttaactgaagatatatgtacaccgagtaactgaccaagatgttccttgctgaagggctcataaactcacctgcctcttgccgtctttactgtaccatcgggactgtagagcaagctgagaactggatggctgcccgggagccttcttgaataccgaagacaaaggagactcactgcgacagcgtagaggctctgatcaaaaaacatgaagactttagacaaagcgattaacgtccaggaagagaagattgttgctctgccaggcctttgccgaccagctcatcgctgccggccattatgccacaggcgagacatttctagccggcgcaatgaggtgtaggacaggtggcgacgtctggaagcccagatgattgagacaaggtcaaagctaggagaatctcaaaccctccaacagttcagtcgggatgtggatgagat

SEQ ID NO: 697186 - DNA, 1749 bp, Homo sapiens
  misc_feature (317)..(317): n is a, c, g, or t
  misc_feature (355)..(355): n is a, c, g, or t
  misc_feature (631)..(631): n is a, c, g, or t
  misc_feature (638)..(638): n is a, c, g, or t
  misc_feature (679)..(679): n is a, c, g, or t
  misc_feature (1213)..(1213): n is a, c, g, or t
agtgtatctgtgattgtgtatgttgtgatattgtgtgtcgatgcttactatgttagttgatgatttatgatgtgtattgtagtgtctgtatagtgagatgtgatgtttgttgtcgttgataggttgtctggttgtatggtttggtgcttgcttttgtgattgatcttatgtcttgattcagtgtcggtatggatgatgtagtgtaatggttgtgtatgtgtcgttggttgtgttgttcggtttcgcgtctgtgtagtttctgatgtattgtatggttgtgtgtagtttgccccgggctcgccggcagccggcgcggnggggggtgtgttttcaaaccacggaaagctgtcctgtnttgtagtggtgacgcccgcgtgtccgtcgagtcttgtctgctcctctggggcgggacggcgctcctctgatccagcacacgccgcgtgtgtgttgttcggcgcagccgccccccgcctatatgatggaagcaggacgcactcgcccgggggcggctcgcgcgggattttcctacagctccttcttctcgggggcttgttttgttgagccccctgtatgggcgcccccgcgggggccctcggggggtactccacgcgatgtgtgtcgtcaacccccnccggggnggacccaggtccgtttattggtgccgccccacttgttaggncccccctttatattttgtagggggtgcgacgcaccgctaatttgatggggcaacccccatgagtggtggtggtgaccacacacaagagaagaggccccagggtcgcggtggggtaccaccccgggggtcctctcggggagaattttctctccccgccggggggagatatatttctcgtgtgctggaagacctcccacacggcggcgtctctcacggggagaacatcttgtggggttttatagggtggccccccgccgctcgtgtgtggcggtggccgttctcgtgtgggttggagagatgctttatgagagatccccgggtgagtcgccgcacacagcacacacattgtgggacacctgggagaggacgccgagcgcccccacaaagaagatggccgcttattcgcccgagaattctcccgtggggagagatctctctgtagagagagagagagaggagaagagaggagaaagagagagagagagagaaatattataggtgggagagtcccccctctgtagcacacccccaacntggagagagagagcgcacaatttgcgagagcaaccactctgtgagagagaaaatagtgttgaaaaaagggcccccgcgcgagagacgcgcgctataagagcgctctcttgttggatatagagaggcgctggtatattcctctctctgagtgtacacccatacacacgcagaagaagagagattttccccgcgagaggagagctttcttgagactttttgcacatcgcgagggggagaccacctggcggtggggcccacacacaagactttttaacacacacaccttgtagaaatataaatggtggtggagacattaaatttcaccccccgctttttcacatacacattcgtgggcaccccgaatatttcctctaatggtgtttggagagtaccacacttgttttttatatttgtgtgaaactcgtaaagttcacacacacaaaccccactgggtttggcttataggctggtaagcttttatatgtgaaatttccacacatgagttccattttaaaaaaaattttttgactttgcca

SEQ ID NO: 697187 - DNA, 517 bp, Homo sapiens
ggcccttccaccttttgtgggcactcaagttcggacctctgggatcggcgattcccctctggccagggctggttttaatgctctccgtgggcgggcttcggttgagtttggtccgcttttcctttctgctcctcaggggagcattgcttccttctctcgcagtgaccatgacgaaattagcgcagtggctttggggactagcgatcctgggctccacctgggtggccctgaccacgggagccttgggcctggagctgcccttgtcctgccaggaagtcctgtggccactgcccgcctacttgctggtgtccgccggctgctatgccctgggcactgtgggctatcgtgtggccacttttcatgactgcgaggacgccgcacgcgagctgcagagccagatacaggaggcccgagccgacttagcccgcagggggctgcgcttctgacagcctaaccccattcctgtgcggacagcccttcctcccatttcccattaaagagccagtttattttctaa

SEQ ID NO: 697188 - DNA, 241 bp, Homo sapiens
catcatttagtcaagatgattgttttggtgataaatatgaataatttgcttgcctctggacttctaaggcttcctgaaattacatgcaaacattggtgcagtctcatgtactggttattgtattgtgggctggctattttgggtcgaggaggtgcatatgcttcatcagcttctctaggggatttttcagacgtacacggagaggctctggctagtatatgacagagctacagcgagcagc

SEQ ID NO: 697189 - DNA, 497 bp, Homo sapiens
ggggttgacctgagaccgctgtgctatcatcgtctacttgtgcatgatgtctcaaagaatgcccataataagaaagtatcaagtcacaaatgaaaaagcagccctttgtagcaaatataatcaaaaagaatcatattcgacacagggtctcgctctgtggcccaggctggagtgcagcagtgcaatctcagctcactgcaacctccatcccccagggtcaagcagtctgcccacctcagcctcactgagcagctggaactacttagcgtatgacaccacgccagggtaatttggtatttgaagtagagacggggtttctccatgtgggtctgggtggtctcgatctcccaagctcaggtgatccacctgcctaggcctcccaaagctctgggattacaggcatgagccatcggtggccagccgaggaagtgacttcaatgtcgagaggtaagggaaggaaaggagtaaggcagggaagagggggatgacaagcattc

SEQ ID NO: 697190 - DNA, 460 bp, Homo sapiens
  misc_feature (56)..(56): n is a, c, g, or t
gaactacaactcccagaaggccgcgcggaagcggaacgtgaaccagggaggacttncggccgccaacatccgggccgcgcggggaaggggagacgtggggtagagtgaccatgacgaaattagcgcagtggctttggggactagcgatcctgggctccacctgggtggccctgaccacgggagccttgggcctggagctgcccttgtcctgccaggaagtcctgtggccactgcccgcctacttgctggtgtccgccggctgctatgccctgggcactgtgggctatcgtgtggccacttttcatgactgcgaggacgccgcacgcgagctgcagagccagatacaggaggcccgagccgacttagcccgcagggggctgcgcttctgacagcctaaccccattcctgtgcggacagcccttcctcccatttcccattaaagagccagtttattttctaa

SEQ ID NO: 697191 - DNA, 388 bp, Homo sapiens
gactcgttgtaacagcagcgagcccattaattaacagctgtccaataggtaacacctctttccgtcgtcgctcctgacgtagccaaccatctgtgcgtcagtctcaagagaagccagcaacattaatagtgatagcccccaccctcctatcgccctgtattacattatgtgtttcacctcagcgtcttcatggtgcgcagcgccgccacctcacatcattatgtgtatacttcccccgacaatactccctcacacacactctattctctctcttctcttttcaccccgccctctattgaactagtgtattacaccaccctcactgtgtcccactccatggcgctctcctctctccgccccccatacaattagatacacaacaatatac

SEQ ID NO: 697192 - DNA, 486 bp, Homo sapiens
  misc_feature (56)..(56): n is a, c, g, or t
gaactacaactcccagaaggccgcgcggaagcggaacgtgaaccagggaggacttncggccgccaacatccgggccgcgcggggaaggggagacgtggggtagaggggagcattgcttccttctctcgcagtgaccatgacgaaattagcgcagtggctttggggactagcgatcctgggctccacctgggtggccctgaccacgggagccttgggcctggagctgcccttgtcctgccaggaagtcctgtggccactgcccgcctacttgctggtgtccgccggctgctatgccctgggcactgtgggctatcgtgtggccacttttcatgactgcgaggacgccgcacgcgagctgcagagccagatacaggaggcccgagccgacttagcccgcagggggctgcgcttctgacagcctaaccccattcctgtgcggacagcccttcctcccatttcccattaaagagccagtttattttctaa

SEQ ID NO: 697193 - DNA, 150 bp, Homo sapiens
ctcctcctcgatattttaatgagaatattgtggtagacctgaacagcggcttcaatctggaagagctggaaacgaacaatgcccagcgcctacgatccatcaagggccctcatctggccaatagcatccttttccagccttccgctctga

SEQ ID NO: 697194 - DNA, 752 bp, Homo sapiens
attcctgttttcagttagtggattcatcctgctggtattacttatagctccctccatgtcaaagttgggcctgagaaaagctcatacatgcctcatgtgaagtgtccaccctctctgaaaatcattctcattgttcaaaacagcaatcgacatatctgtgttaacttttaacggtgactttgggaggaggggagttgggaaatgtaaaatgttatagattgttgtctatttcctgctgaaagtaaatgtttttaaaaagtatcatataaagctgatatacaaatcggttggggggagatcctttcctacccaagagtcataaatatatgctttacgtgcctagtggaaatgttatagtgttgcctttcacattcgtctttagtctgtcctgaactgatttcgtgaaaattatgagttagaaattcaacttaacatttgtgcatattcgaagtggtgtctctgtactattgactgagaagttcatcctttccccagtgattgtaacactgactctttcatacaattagattttgtgtatgtagtgtgggtcttggatggtttctatactgactgaagatcaatgttgtactaatcttgtaggcggtacagtacagtccgtgattactgcaatttaggaaaaaggtctgataataaccagatgctccaaattttgtcactaattgtaaccaattcacctctgttccgtatccaccccaagtgtgcttctggagaggtgggtattttagcaacgg

SEQ ID NO: 697195 - DNA, 823 bp, Homo sapiens
  misc_feature (56)..(56): n is a, c, g, or t
  misc_feature (823)..(823): n is a, c, g, or t
gaactacaactcccagaaggccgcgcggaagcggaacgtgaaccagggaggacttncggccgccaacatccgggccgcgcggggaaggggagacgtggggtagagtgaccatgacgaaattagcgcagtggctttggggactagcgatcctgggctccacctgggtggccctgaccacgggagccttgggcctggagctgcccttgtcctgccaggaagtcctgtggccactgcccgcctacttgctggtgtccgccggctgctatgccctgggcactgtgggctatcgtgtggccacttttcatgactgcgaggacgccgcacgcgagctgcagagccagatacaggaggcccgagccgacttagcccgcagggggctgcgcttctgacagcctaaccccattcctgtgcggacagcccttcctcccatttcccattaaagagccagtttattttctaaaaaaaaaaaaaaaaaaaaaaaaaaaaaaaaggggggggggggccaaaagtttcccccggaggggggcccagaggtttagcgcgcgatacccgagagtatcctgtgtggtccaagggggggccccataataggggagtcgatataaataagcacaaggacagcgggcgccgagcgtattataacacagagctcgtagacttggggaaacactttgggtaccattgaggagactcttgggagaagagaacctttaattcgcgggggggggagaccaataattggggcgcaaaattaccttaaaggaagattttaaaaccgtcataagggtaaattttaacaatttcaaggtgttaaacgggggan

SEQ ID NO: 697196 - DNA, 553 bp, Homo sapiens
  misc_feature (56)..(56): n is a, c, g, or t
gaactacaactcccagaaggccgcgcggaagcggaacgtgaaccagggaggacttncggccgccaacatccgggccgcgcggggaaggggagacgtggggtagagtgaccatgacgaaattagcgcagtggctttggggactagcgatcctgggctccacctgggtggccctgaccacgggagccttgggcctggagctgcccttgtcctgccaggaagtcctgtggccactgcccgcctacttgctggtgtccgccggctgctatgccctgggcactgtgggctatcgtgtggccacttttcatgactgcgaggacgccgcacgcgagctgcagagccagatacaggaggcccgagccgacttagcccgcagggggctgcgcttctgacagcctaaccccattcctgtgcggacagcccttcctcccatttcccattaaagagccagtttattttctaacttcgtttagtttgagtatggaaaacgggtattggggattttatgtactaacggtcgagaagtgaatgtgaaagaacccccttcttgaggcca

SEQ ID NO: 697197 - DNA, 443 bp, Homo sapiens
  misc_feature (358)..(358): n is a, c, g, or t
  misc_feature (443)..(443): n is a, c, g, or t
ctccacacaagactctttgctgctgtgcctatgcgctgtggttgggtggcaataggaggggactgtggtaggggcggaggcacctgctgtcactgacctccatttccccaagtctcttgtcccggcattgcctttcaggtggtgtgggacactgggagaaggtctccaagggagggtgcagcctcttgcctgcaccctccctgcttgcacacttccccatctttgatccttctgagctccacctctggtggctcctcctaggaaaccagctcgtgggctgggaatgggggagagaagggaaaagatccccaagaacccctggggtgggatctgagctcccacctcccttcccacctantgtactttcccccttcctggcttccaaaacctgcttccttcagtttgtaaagtcggtgataatatttttgggggcttcccttttn

SEQ ID NO: 697198 - DNA, 883 bp, Homo sapiens
ggaggataagatgacaaattgagcccaaagaaatttttggttactacagaggtaaccaaagatttccagtgatagtgcttttgtgagctagtttataaaagtagatatttttaaaataaatgattacaggattaggggacaaaagtagaaccatgggttgacccaactgtctaccccaagcattggaattaatttagaaaaaagccagcagatgcatgtaacatcttgaaaaagcttatgcaagtcttcccaaaacacaaaggaaaaatataacacaggacaaattactccttgaatgtctgatgagatatgaatagccacaacaataaaactgtgtgctaagattaacgtctgagtagctttaaagtatttttagttcttttaatctgaaatggtttagactatcttcagagaaacttctcaactgttttcttactggaaatagttgaaaagctttataaggccaaggttacccaggcagttgatttatatcttctttaagagagacagagcgagagaagaaacgaagtaacagcaaacatttgtcaagcaaagggctgagagctttgcagagaaataacagatacatttgactatagagatcttccaccttcgtttctagaaatcaggtttgcttggtgtaccttggagaagtaggcgctttcaaatggtcctcccacaagtctcagcagccaaccaaagccaatgattctcagccaactaacccaaggagttctttaaagttaaccaggacctctccacaaaatctcatacaaagtcctgtaacaagaagccacagaaatctcataaaataaaatgcagtaaattaaatgtaagaccagtagcagcccttgagtgttataacaggaattaaataaccaaa

SEQ ID NO: 697199 - DNA, 1694 bp, Homo sapiens
  misc_feature (174)..(174): n is a, c, g, or t
gaccaccgtcagtgcatccacggcttacatcgagctggagggctcgagcgatacgtgacatgcgagtctgcctaggtgaccagaagactcgtggtgcgcatggtaccagaagatggcgtgtcaccgtgtccagttgtgcctgcagcctggggcatatgtctctgattgtacagncatgttgtgggtgcatgacgtcttcgggtcattcacgtcctcgctcgctcgcacaccgtgtttactgactccctccgagaccatgttgcagggtgagtgacaggacccatatagtgtcgtgggccgtcgtaggtggtaccgtttggtcttgtcgatgacgatgactcgcgtttcacgtccacgagaatacactcatcgatcggccaagggcatggatgaatgggatgcattgcgctaagggaagatagagttatgtctgtacgtcaagtagatcgactggtccgtattcctgcgtgtgggagcacgctgtatatacgccatgaccgcgcagttccatctaacaattggaattggttcctggttggtgcgaacaagccgcggatgggtggacatatggccatgtgcacaaatttctgtaccttgttgaacccgaacattctcataccctatgagaggtccatttaacttgaaatttgcccagggcgcgaaggtattaaagaaggatgccaacgctctgttccgcttgtcaatcccaggttcgtccccagaagagtggcacactggggcactgtgtgccataccacatttgaggttagaactccttagatcaccgaaagactttttccactcttctaaagaagaggacccatccaattgtgagtctgtttgcaactcaaattttacgttcagatacggccattggggacacatttgctcatcttatggagcgcgcaggaacttccgagacggttgtggaccaatatacccccccaatctatttccaaaaggagttatgggtttccataacgacgtgtggcctcttacaacattaagcttcctgtgggaaatccctagaatcccttttgggataagcctgcctaccgttgggaccacatttcgacagttttcgagcagcgaactagttcctacaccgaggcccacccaatgttcaaagagggcaactgataaggggattacaaaggttataaccccggtttagagttaatacagaaggcttgggagggtggaattacgagtagcagaaaggcaaaaggggaggtttaagagagccggtagcggaaagaggaccgccttagaaatgtgtaatcaaattgtgaagtgagctaatgtgaacgtgagataggggtataggactatagaggtgtaccattgaagcgtgtaatgtatacgttgcagcttcgcaattggacaattgtgagaggcgtttcacccagattccaatgaatttgttattgagagttgtacacataaaatcgcgctttgtggaaatgaggaggtatagagtgttgaggggacgatagggataattgagtccgatatgacaattgagaacaaagttaagcttacagtggaggcgacacatctttggactaaacgatagagtctaagagagaagaagttcaaagatagataatttgtctcgaagaaaacaaggaatcgagctgtgtgagatggaagaaatctagtagtattctgtagaaaacagtgaatgcttgagg

SEQ ID NO: 697200 - DNA, 751 bp, Homo sapiens
  misc_feature (470)..(470): n is a, c, g, or t
  misc_feature (551)..(551): n is a, c, g, or t
tggtgtaagggcccaaacggctgcaaacagaggggtgatagcccctaagcttagtgttaaagttgggaattagggggctatttcctggctagggggtgaaagcgggatggatgtaaagaagattcctggctaacaactatatagtggcttgatgtgggatgaagggctggaaactggggtgtagggcgccttctaatgggctggaggggatgtctagggtgtgggagcacctaatattgggcgctgagatttggcctggctagctgagctaagagagagaggccatagttagtgtgggggtagaggctgtggattatagcggttataaaaggggcataattgggtggggggctcctcagtgagttgtggagtgtgtaggaataacactcagtgcataagggcggaggattgaacaccgattttcgccgaatacggtgtgggtaataaagagattgcgcttgagatatggngctggctggtgtgtgatgggctatatctgcgcgtcccaggggctgttattccactcaatctggtatgagagcaaaagaaanggggagtattataattcccataaaggccccctctatcaaagccgcgatgtagaaaccacagttgtggaaataaggggttgtgtgaaacgcgggggtaacacttaaaaaattttaggtattgtggggaactttcaggggaacacgaatgaggtagcaatttttttggggagaacccttggaataaaaggggagggggcaaa

SEQ ID NO: 697201 - DNA, 235 bp, Homo sapiens
cacacaggcgcaagctgtctttgtaaaaaatagctgagactctagttgtaaataaatagctgagatgctgggcgcagtggctggggcctgtaatcccagcactttgggaggccaaggtggatggatcacccgaggttaggagttcgagaccagccttgccaacactgtgaaaccctgtctctactaaaaatacaaaaattagctgggcatggaggcacacacccctgtgcgcaag

SEQ ID NO: 697202 - DNA, 188 bp, Homo sapiens
cacgaggcggagcggaggtgcagctcggcttcctccggcacccctccccctcgggcgccagtcccaaccttccgccgggcgggccgacccccccgtactatcccctgcggcgcgagcccggggtggctccaagcgtcccccatcagctccccatcatgggcagccatagctccaaggctccccggggc

SEQ ID NO: 697203 - DNA, 917 bp, Homo sapiens
gcttccttcccatctcgctcttgggtcatgcctggccagcagaaagcagctccataggggaggagagccacgcaggatctcacagctgcagtctaatagtaacacagaggattcagcagtggccaccatgggttctgtgaattccagaggtcacaaggcggaagcccaggctggtgatgatgggcctggcactcgcgccgggcaagaccacgctcctttacaagctgcaagggccaccagctgctggagaccctgcccactgttggtttcaacgctggagcctctgacagctcctgggacacgctgtcactgacctctctggcgaaccgttgcgaggggcaggcccccgcatcagagcccagcctggaacggactatctggacaggcacagatctccctcgtgctacgctgactggcacagccacagatgaagcccgacttacccgagctcaagccggctgagctcacagaagtcctgaacgaccccaacatggcctggcgtccccttcttggtgctggccacaaagcaggaggcacctgatgccacttccgcctgcttaccgcatccagacaccaggctgacgtctacgagaagaataccacggaccaacatgcacgggagctccgagggcatgacgagcccctcacccggcgccacggcgcatgccggaggcacctgcagtacgcctgctgcagccctccctgcacatcctcgccaagcccagcaacgctgccctcgacaagggcggcacgagccccccagggagcgctagaaccagccggcacaccggcggacgaagacacatggaacccaggacaggagcgcggcgcgatccgcgaggcgccaatccccaacacacggcgagaagcccagcgggaccgcgggagacaaactcgacgacgacagacacaccgaa

SEQ ID NO: 697204 - DNA, 1582 bp, Homo sapiens
  misc_feature (845)..(845): n is a, c, g, or t
  misc_feature (976)..(976): n is a, c, g, or t
  misc_feature (1039)..(1039): n is a, c, g, or t
  misc_feature (1305)..(1305): n is a, c, g, or t
tgtgtggaccacaatcataatattctttcccggggcttttccatcgcatctgtgttcacctaggtcgtgggatttctccccctctttgttgtcgtcctcgtgcttcctctgggtgttgtctcagtagtttctgtcgcacctcctctccggggtcacaacatgatttttccggttgtgaatcacccgggtggctatacacattcatcgggggcattacattggtccaacaccttgtgcaacaccaaaattgttggatgttatgcatcccatcgggggttttctacaccaagttttctggggcccacccttaccacatgtttggttgcatccctcgccaataagtgggcgttttctttatcatccggggtaccctttcacagcacagaatgtggcctgctgactaccacgttttggcccgtctgcacaaatttggggggttgtataaactctttgtagtgggagacttatgagaacaaatatgttgttggctcgcccccctggggggcagcaaatatatagcgcacacacaccaccgcagcgttgcaacatggtcctttatggctccccctccttctccggtagaaaatcctctgggggcgatattattacgccgccctcgtctcgggatcgatataaggagcaaaattttggtgtcccctcttgtgaaagagcctccttgttgtatttccctggagatagtttcaacgccaccctgtgggaattttgttaaggaaaaccatcttgtgttttgccctcgagatggctttgaaaccccctctgtgaacattggaaagatgtttaaagcctgggtgtgccccccccctgggggtaaaaattcgcgttgnaaatataagcccccctcgggagacacaatatgtctcttcttggagaggtgtttcacacccgctcctctaaggttacacgcttgtgtggcctcctctgggtgccacacttttctcgcttggggctataaagngtgataagagacacggtggccctcttgctcgcgagaagacacacacagtgtctctgtgtgtgnctcttgtgtggagagttctctgttgtgggcccacaccacagcctctcttgagttctcgtggacacaggggtgattaaaacagtgtgtctcacagggctctgagagtgtttctcgggagttttctctctatagagaggctcggcacaagagaccccacacttggttttttgtgtcttggcgggttctcgttcacgggttgtgaaaagttccacaagtccgctaggagcccacgtgtttcctctttcttaagctcgaatgttctcttngggccacagagaacacccgctggggctcgttaactctggctcttagaagtttggagaagtcggtttggcacatttaacgccccgtataaatgtaattcactttcttaaatttaatgtaaaggttttttgttgtaacgcacaatttctcgagatttctttgaaagaagatgaccacaccacaaattttggtttttctaactgcttaagtgagaaccattaggcccccagccaacacgtccattgtgtaagggaaaataaaagtgctgccgtaacccca

SEQ ID NO: 697205 - DNA, 1536 bp, Homo sapiens
gatggacccatttcgccaattgaagccgcctaatcaaaattattttgaacggctcattcgattcgactgtcgccacctcaggtccaattgatctccggggtgtatcgaatacttcgagagtcactgcttgcgacggtcgatgcgctgcatgccgtccatgtgtctcccaatcgtggagatagtatcccttagtccgagtgactcgataatgtctaccgagtacgtcctcaaaatcgctcttctgacatctgtattcggtcacacattcgactccgagcacagtgccagttaattgagtcttgttggatcgacgctaaatcttacgagcagcctgaatggggcgacgcgtcacaatagtatactctctgatgctcaggcatatgtataccgtaaaagcatatctgtttgctggagagctctcgaataagagacgggaataggtatgtgcttcgtaacttaccaaatataaacggatgaggaacttcagttctgagataactttgatctccttctcaatgccttatgcgacatcggttctatgtgttacaaaagagtcctgtgttctaatcaagaggacattaaattgatcgcgttacactcggtttagacaagaggtctaatgatatatatggatatactgaggagtggggggcccatacagtaggcctaggtttatccacagaaaatcttatataggtaattcccggagcaccatgttcgtaatcgagcataaggacgtggccagtgcaccacttccctgtattccacgatggaaaattcactcgaggggaagtgacttattcttacatagcaattgaccaatggtttgacaaacctcttgtcaatcaaggggaattagcgcttcactacgcattttgccgagggttcaatttccttgggctcccggtatcaggtataggtttcgcaacgacttaattatgtacaacggcaaattatcagcagttcctacacgtgaaatttggttttgcgacactagaatcaaacgcgggaacttcaatgatgggatgccccgcatagaggaaagtggaatccgttccctcaatgtttccaggccatgtacgaactttaactttaatacagggagcatttttagggtaagaagaatctcacaaaaggcacagaccatattagggccattaacttatcttcaattacggtatactggtcctataaattgactatattataccaagcttaattaacatttcacgcatgagaacgcttcctttaaaggttgagaactcggagaagcatgggtagagtagggcagctaacagagcagaaaactgcgcagtttagagaaacgcgccgatgcatcgccgagatctaaagagccgcagaaatggtaaatgacatcataccgatatcttagccggcataaacagcaaagttagtcacatagtccgagatcgctgtaaacagtacatataggagggagaggcacaatggcacctatataagtatagtcaccaaccgggagtacataaggaagagtaacccacagccacaccagaa

SEQ ID NO: 697206 - DNA, 604 bp, Homo sapiens
  misc_feature (37)..(37): n is a, c, g, or t
  misc_feature (78)..(81): n is a, c, g, or t
  misc_feature (87)..(87): n is a, c, g, or t
  misc_feature (113)..(117): n is a, c, g, or t
  misc_feature (135)..(136): n is a, c, g, or t
  misc_feature (138)..(138): n is a, c, g, or t
  misc_feature (146)..(146): n is a, c, g, or t
  misc_feature (166)..(166): n is a, c, g, or t
  misc_feature (169)..(169): n is a, c, g, or t
  misc_feature (171)..(171): n is a, c, g, or t
  misc_feature (173)..(173): n is a, c, g, or t
  misc_feature (175)..(175): n is a, c, g, or t
  misc_feature (203)..(203): n is a, c, g, or t
  misc_feature (210)..(210): n is a, c, g, or t
  misc_feature (219)..(219): n is a, c, g, or t
  misc_feature (221)..(221): n is a, c, g, or t
  misc_feature (223)..(223): n is a, c, g, or t
  misc_feature (227)..(227): n is a, c, g, or t
  misc_feature (235)..(235): n is a, c, g, or t
  misc_feature (248)..(248): n is a, c, g, or t
  misc_feature (256)..(257): n is a, c, g, or t
  misc_feature (259)..(259): n is a, c, g, or t
  misc_feature (272)..(272): n is a, c, g, or t
  misc_feature (289)..(289): n is a, c, g, or t
  misc_feature (296)..(296): n is a, c, g, or t
  misc_feature (307)..(307): n is a, c, g, or t
  misc_feature (309)..(309): n is a, c, g, or t
  misc_feature (313)..(313): n is a, c, g, or t
  misc_feature (317)..(317): n is a, c, g, or t
  misc_feature (324)..(324): n is a, c, g, or t
  misc_feature (373)..(373): n is a, c, g, or t
  misc_feature (381)..(381): n is a, c, g, or t
  misc_feature (388)..(388): n is a, c, g, or t
  misc_feature (421)..(421): n is a, c, g, or t
  misc_feature (474)..(474): n is a, c, g, or t
  misc_feature (512)..(512): n is a, c, g, or t
  misc_feature (514)..(514): n is a, c, g, or t
  misc_feature (519)..(520): n is a, c, g, or t
  misc_feature (575)..(575): n is a, c, g, or t
gccgttacagccctcctctccaaggctcagggctganaatggttagcatatcgaatgatcagtaaaaacatgtaaaannnngaaggntagggaaaaaggtgcattcccctaannnnngggggttggaatttcagnngngagggggnaggggggggaggtgccaggnggntntncntttccctctgtgttatctttcataacanttccaancttggtgtntncnatgngctccacntactcagcggagnccacgggnngngccccgtgggcgngactgagcagtgacctngcctgcnccgttcctcantngccnatcncattgcnttgactgaggggaccctgcttgtgctcctggggggcaggactgggggtnctagctcnttgcttntttggttccattcagagaacagttgtgcttganggactcatccccactccccaaactccaagctcctgctggtgggctgaaggcantgacagagtccctgggacacccccaggtagccaccttntnttgtnntctggtgggtccctccctgggcacatcgtcccatcctcagctcaagccccaggtntaggaatagggacagtgaagaaagtgtat

SEQ ID NO: 697207 - DNA, 723 bp, Homo sapiens
  misc_feature (218)..(218): n is a, c, g, or t
gggcgcagcctaacttttcacaagatggacccttcatttcaagcttaggctggcgttacttttgctgtctagtcaggactaatcacggtgtttcagtgcggagtgccaagagtcctatcctgacgtcaggctctgggtgtcaacctctgacttattctgcagatgctctgtgtgtgtgtgtgtgtgtgtgtgtgtgtgtgtgtgtgtgtgtgtgcggngagagggtgcgtccacgagggcttgatatatcggcagtgtgggaaatgcgacgctattttctcatcgatcatcatctctgatacagatcatgtcgtcgtgtagtgtcagacgagacgacagtgtcctctgccatcaggtaggaggttatatcacgacaagagtgttttttacagtagtatcgctgcgttaccatatcatacatctctgtgccgttgtcagcctgttgaaaggcgttgggtctgctcaccaggacttggatgcttctcagggcaccttaagagggacgctggttagtcgtaggggcagagagtatctacttgggcactctcttccaagaaagaccgttgtctccattctcattagacaatgcttcgtgtgtgtgttctggaatatcttctatatggaatgcttgtcgcactgtcccacgcgagtggctcgcatgagcacctgaggaccacacttggcgagaccaaatcatgtcctacaccagtgtgccttacaatc

SEQ ID NO: 697208 - DNA, 1038 bp, Homo sapiens
gcacacagtccctcacaatcagagatgctgagatgggaccgctagattggctgtcaggaaatgctatagatatatggcgtgtgtggatccgagtgttgcgtggttgtccgaggaacgtggccatggcctaatcactcgtgattaaatcgatagaagcctcgagtggtgaaagtggctaacgccgacagcgagcttggacgctccgaaggcagttatgcggtgatgcacttgcgtcagatatctcccaatggttctctgcctcgagcaagctcctcgtgttgttgaccctctcagccgtatgagcgactttacgatttgacaacacttcaacgacaagcaagcgactctccatgaaatacatggctccaggcgtatggttgagggttgatggcacactgtatgacaggcggtgatgccatagtggttggcagggcagaaaatggagcgtatgggataagctatcgagtagaagaagcagtgttcttcacctgcctgtcatctgtgcactgtgtccatgcaatcatttctctcagggttgcattgaagactcattgtcgacgcctgcgaagtgctctttcctctgtaacacggtcgacatttgtataccttatcctgctgataatactgcaatccttgaatgtacctggcacatggttgtatgtccgtgaggattttacaggtgctgtgggaaatttattggtccaaagtctgtacaaagactaaattttggtaaagggaaaatatttcccaccatttgaaaggaggagcacgacgcgctggcgtctgttgcacgtgtttgggaagttctgaaatccactcagtgcttgttgtcgggacatgaggcgctgaaagttgttgtactgcccttcatggcccgtctttttattccactgtgtaccatgttggttctggccttttggctgccttgtggcctaaggacttccgatgttcttatgatcatttttttcccttacctcggttgttgagtatttccttgtagcgccagtttccaagagggggggcgcgctctggggactc

SEQ ID NO: 697209 - DNA, 605 bp, Homo sapiens
gcagtgggaacacagcaaactgacaatgggactaattaaagagcttctgcacagaaaagacactatcatcagagtgaacaggcacctagagaatgggcagaaaatttaggcaatctatacatctgacaaagggctaatatccagaatctacaaggaacttaaaacaaatttacaagaaaaaaaacccatccaaaagtgggcaaagaatatgaacagacacttctgaaaagaaggacatttatgtggcccacagtcatatgaaaaataactcatcatcactggtcattagagaaatgtaaatcaaaatcacaatgagataccatctcatgccagttagaatggcaatcattaaaaagtcaggaaacaacaggtgctggagaggatgtggagaaataggaacgcttttacactgttggtgggactgtaaactagttcaaccattgtggaagacagtgtggcagttcctcaaggatctagaactagaaataccatttgacccagccatcccattactgggtatatacccgaagcattataaatcatgctactataaagacacatgcacacgtatgttcatgggcacacggtctctcaggggatcctct

SEQ ID NO: 697210 - DNA, 299 bp, Homo sapiens
  misc_feature (64)..(64): n is a, c, g, or t
  misc_feature (76)..(76): n is a, c, g, or t
  misc_feature (82)..(82): n is a, c, g, or t
  misc_feature (91)..(91): n is a, c, g, or t
  misc_feature (127)..(127): n is a, c, g, or t
  misc_feature (142)..(142): n is a, c, g, or t
  misc_feature (182)..(182): n is a, c, g, or t
  misc_feature (190)..(190): n is a, c, g, or t
  misc_feature (197)..(197): n is a, c, g, or t
  misc_feature (202)..(202): n is a, c, g, or t
  misc_feature (205)..(205): n is a, c, g, or t
gagccggctccggcatgtgctgtaggccagcgtgaaaaggagatgcagagatgttacagagacntacaatgctcanagatgncaatttccnaagaaagagaggtgaaggcagctcaggcagtggaancatcaacctctcaanagcacaatgtactgaatgtcctgaagctattggggaaaanaaaagatnaaaaggncaatncanttaagtgggaaacacctgggctgggagatgcctgtgcttcttcctagctccgctggcgatactagcacatagccgggtaccgaactgaacgtgt

SEQ ID NO: 697211 - DNA, 225 bp, Homo sapiens
tcagctcgggcctccttttattcaagcagtcgtaggctcactggtcatccgcggaggaggcgcccgtcgggcccaggtcgcagccatacatcctctgtatgatgtgagacccggcctcgctctggttgtagtagccgcgcagtttccgcaggttcactcggtcagtctgtgcctggcgcttgtagttctgtgtctcccggtccccgactgcttggattacaagga

SEQ ID NO: 697212 - DNA, 260 bp, Homo sapiens
  misc_feature (9)..(9): n is a, c, g, or t
  misc_feature (24)..(24): n is a, c, g, or t
  misc_feature (100)..(100): n is a, c, g, or t
  misc_feature (103)..(103): n is a, c, g, or t
  misc_feature (115)..(115): n is a, c, g, or t
  misc_feature (192)..(192): n is a, c, g, or t
  misc_feature (218)..(218): n is a, c, g, or t
gaatgaagnccgtttacactcatngttattattgataggtgaggacttactaccgccatttagttgttttttgttgttgttgtcattttgttagttctcnctncctttttttttntcttcttgtcttcctttcttatataagcaattttctggtaatgttttaatttctgtcttttaatttttttgtgcccntgttaaaggtttttgctttgtagttnccattgaagcaaaaaccttttaacagggacacaaaaaaaaaa

SEQ ID NO: 697213 - DNA, 303 bp, Homo sapiens
  misc_feature (94)..(94): n is a, c, g, or t
  misc_feature (113)..(113): n is a, c, g, or t
gggattggcgagcgtgagcggcagaaggccctgcttcttcaggttcgtttcgtggatacgcgcgaaggatttcacgatcacggccacgccgccnaggaaacgcgggctcatgnccgcgtgctcgcgggaggatccttcgccgtagttttcgtcgcccaccacgacccaggttttgcccgccgccttgtactcgcgcgcgaccttcggcgtttccgcttcggaacccgtgaaggcgttcttcactttgcccggcgtgccgctgaacgcgttcacggcgccaaggaacatgttgttcgagatgtt

SEQ ID NO: 697214 - DNA, 121 bp, Homo sapiens
tctccctctctcacgctggtttgtcatagtttcacaattaccttaaacagatcccagactgggcatggtggctgacgcctgtaatcccagcactttggggggctgaggcgggcggaacacc

SEQ ID NO: 697215 - DNA, 771 bp, Homo sapiens
tggggacggagtcttactggggtcacccaggcgggagtggcaggggcacagtctcggctcacggcaacctcagcctcccgggttcaagcaattactccggttctcagtctcccgagcagctgggattacagggtgcccgccacaatggcccagctaattttctggtatttttagttagagacagggtttcaccacgtgggccaggcgggtcttgaactcctgacctcaggtgatctggtccccactctgctctggcttttctaagtcattggtcttactcaccgaaagtgtctggtcatttcctggtgtttcactggtgggcaataatggcctactgatatgtacaggggttgggcgctctggttacccgatggctttccagctggtggtctgggttcccattcattgctggcctccagcaacggataacgtatacggcagcacctccttatttggagtgcaaaggtccggtggtaatagaggtagatgattctggggggggggccggggtcatggcgtatggtgtcgggtaacatgtcatccgacgtcggccgtccacaagtgttctgcgctaagaatggaccctcagctgctgacaggcacgaggatccagctaagtagggccaagtgttgcagccgagagagggttgtgcagaaaaacctgtgctctcccaggagcaggggacagcgacacaggggccacgcggcacacaacgattatcaccagggcacgggagagggtatcaccaccacaaaccggagaagggaata

SEQ ID NO: 697216 - DNA, 922 bp, Homo sapiens
  misc_feature (193)..(193): n is a, c, g, or t
aggctggcgctcttggttctgggggttagttctccctgtagttgggcgtcctacaacgacctgtcacatttgcgggcattctggtcgtgtccagcgactcccgtcctttgtgacaaggtaccttctccgggtggtcctcgcccccttggggccaatctccccgccaagggggctttaacctcagtccgcgggncttctacggtggttctcccgcctctaacggttgttggcccaaacccagcggggtaccagcccggctctccccccaggaggattggcgagcacaattaaccgttcggtgggtaccaccacccctgtaacgacctggtaactcccccccgcgccctccccccaagcggttttgtgatgtcccctccccccactccgcgttcttcaattgtccccgagataaccctacggcgtctgtcttcccccacgcgttacatatgataatatcctttttctaatcgcctgcgccctcatttttggtgttacccacaccagcctcccgcgccaatttcgccccactataacttcttaaagagaaaattagaatagtccatttttgataaccagcatcttcatcactattgcacagtactaagccaccacaaggagtccattattacatgtacccatgcagatattaccgatactttttcccactcgctcccgcacctccaaatatgagcgccacctctcttctcctctgttgacttctggagtaatctattgtaccacactcctcgcaacacacatctctctatctcgtctttcttttccatacataggtaaagctcacgcaccattcttttcaccacacaatacaaccagtcgccccagtaggttggtaacataccccactaacagggacgatctcctcgcccctccccaaaaaaaaattttgaacaacccacataac

SEQ ID NO: 697217 - DNA, 224 bp, Homo sapiens
gtgttgtccctctacgccgtctgggcggcgcactgtcattgtcatggactctggagacgggtcacccacacggtggcccatctacgagggctacgccctcccccatgccatcctgcgtctggacctggttggccgtgacctgaccgactacctcatgaagatcctcactgagcgagtgttactgtttcaccaccacggccgagcgggaaaatcgtgcgcgacat

SEQ ID NO: 697218 - DNA, 394 bp, Homo sapiens
gggcacgagggaggacagagggttaaatccatgaagtttgtggatggcttgatgatccacaggggagcccttgttaattattacgttgacactgttgtgcgccaggtgttgttcagacagggtgtgttgggcatcaaggtgaagatcatgttgccttgggacccaattggtaagattggccttaaaaagcccctgcttgaccaggtgagcattgtggaacccaaaaatgagatattgccccccccccccatttaagaacaaaagggtgggaagccagagccgcttgccatgccccagccagtccccacagaataacagggtttctttggcagttgtattttggagtttggatgttgttttttaaagccctttaataaaattttgtacaaagcca

SEQ ID NO: 697219 - DNA, 412 bp, Homo sapiens
agaccaggagtgaacaccaggaggtgggttcctggggatcccattgtctttatggtgtcgagctgaatccatgagcagagcctctcattgggtcaaggcttcttcatggtcttcaggaacctcttagagctttcttcacagagatgtggaatttttgaaagtttaattctaagtatatttagctcttcatgtccatgggtttcaaatccatgaatttgatcaactacagatagaaaatatttaccaaaaacaaaacaaagcaaaacagtaaaaaataagaacacagctgggtgtggtggctcacacctgtaatcctggctgcttgggagactggggcaggatggtcacttgagcccaggagttcaagttcagcctgggcaacatagcaagaccccatatctaaaagaaatat

SEQ ID NO: 697220 - DNA, 510 bp, Homo sapiens
tctcataggcctctcactgttgcttttacagaacctggagcaggttgaaaacaggcttcaggaacttgaggaaacaaatagaacatgccagaatgtatggaattcccgtagtagtggccgtgaatgcattcaagtacgtgtagagtgtaagcgaacaggatgaatgtggaaaatctcctggagctagattgtacagcactgcattaagcttaatatagtaattcagttactgctatcggttctagcctgtggttttagcctgcactgtgacaggcattgcatacgtcactgcgggctcaccacctcagccactgagggtcccaaagtcagattcagctcctatgggcccttttcctttccactgggggaagtacacacacaagcctgcaagtcaatgttcctttttcatctttcagaggccttttatgctaacagaaggtcataggcctatagtgttccatccatgaactagatctggtgggatgtcgactagacaaagaatcgggcata

SEQ ID NO: 697221 - DNA, 416 bp, Homo sapiens
  misc_feature (21)..(21): n is a, c, g, or t
  misc_feature (51)..(51): n is a, c, g, or t
  misc_feature (59)..(59): n is a, c, g, or t
  misc_feature (76)..(76): n is a, c, g, or t
  misc_feature (120)..(120): n is a, c, g, or t
  misc_feature (125)..(125): n is a, c, g, or t
  misc_feature (253)..(253): n is a, c, g, or t
  misc_feature (403)..(403): n is a, c, g, or t
gaattaaggggaaaaggaccnccggaccaggggacccctggaataccaggnccccgganaaccctccaaggaccanccccacgggacctaagaacctttccaaaaattttaaatggaacnggccngataccctccatgaaattccagacaaagaagaaaaaaactccctgttattggacctaaataatcaaaagcataatgttttccataattttcctatttgaaaatgtgcctgattctttgaatgttttantctccagatttatgaactttttttcttgagcaattggtaaagtatacttttgtaaacaaaaattgaaacatttgcttttgctctctatctgagtgccccagaattgggaaactattcatgagtattcatatgtttatggtaataaagttncctgcacaagttc

SEQ ID NO: 697222 - DNA, 80 bp, Homo sapiens
aattcaagcttctaacgatgtacggggacatgccactgcactccggcctgggcaacacagcaagactccacctcaaaaaa

SEQ ID NO: 697223 - DNA, 325 bp, Homo sapiens
  misc_feature (30)..(30): n is a, c, g, or t
  misc_feature (44)..(44): n is a, c, g, or t
  misc_feature (51)..(51): n is a, c, g, or t
  misc_feature (191)..(191): n is a, c, g, or t
  misc_feature (197)..(197): n is a, c, g, or t
  misc_feature (201)..(201): n is a, c, g, or t
  misc_feature (207)..(207): n is a, c, g, or t
  misc_feature (210)..(210): n is a, c, g, or t
  misc_feature (231)..(231): n is a, c, g, or t
aacagcccacttcactgcttttctaaactncccaaaaacccacntgtaggntactgcattaagtcagcatctcagaaacagtggtgtgagtaactgagtcaaattgtcaagtactttggatatacatagtgtcgagctttagattggtatgaaattaaacagcaatgcaaatagatttaattcctaattanttttangatngaaaancangttcattttcctacttaaccnggtgttcaacataaagctgatgttgtgtccgttttgtattttatcttttgttaaagatacataaatgacaatacttaactgtgagtggtttgta

SEQ ID NO: 697224 - DNA, 140 bp, Homo sapiens
  misc_feature (41)..(41): n is a, c, g, or t
  misc_feature (101)..(101): n is a, c, g, or t
  misc_feature (118)..(118): n is a, c, g, or t
gacatcctgcagcccaaaggagatgatgtggcccggatcanctggtacctccgtgacatcatcactcgataccaggcgaccttcaacgtcatcgagaggtnccccaagcccgtgattnctgccgtccatgggtgctgcat

SEQ ID NO: 697225 - DNA, 1251 bp, Homo sapiens
  misc_feature (247)..(247): n is a, c, g, or t
  misc_feature (293)..(293): n is a, c, g, or t
tggaccgctgtatcgatggatttcgtgccctctatctctcttcgtcctatagttacatgctgatctttgattcaatgactccctatcagggctggccggcccgtattcatggcccgtcggtattccatcctagaggatatggagtagtgtaaagacgcagagcgcttctgacgccttcactcctgttatccccacgtgcttgttctctctctggctgttgctcgctggccggtgcttgcttcgcgantggctcacgcctgacagcttgtcatgtgtattgcatgtcatgaganggctcagaaacggtgtgagtctacctcgtgtcgagatgctgacaggacaatagacaactcttgtaatgaccatgtttcctagtgtgtgagcatcgaggtgtggctgtgcgtaggagccctcgagcgaatggctacagcttgaggcaggaattgaagccaattggagtttgcgggcttagccaggggagtctgcatccattgactggtcgcctttgtgggctacgtcgctccacacgaaaatgcaatcctaaggggagcatctcagttggcgaacatggctagtatttggccttccctaggggggttataatgtcctcacagccaatatggttgatacttcctaggggggctgccttaaaccaaagaaaagtgagcccccttcgtggaggcacccacggggtatgttctcgcaaaggccactaggacattctttgacacataccattccttgacgtggcctcgttgtccttttgtcaccttggggggctgtgtatgtcaatcacacgctctagtggcattccattggtcaccactataacgttctaaaggcgttcaccttgtgttgttagaactctcgcttgttggaaatttcgaaaaatcatctcgttggcctaaagcgttgtcgcaactcggcgcgtttttagaccatcgcccggaaggtttccccacaatgggcggttactgcacgacattaacgggcccccgtgtggcaccgatactaaaatttgctaacacgacgacgtctatttgcggggactttttaccgacaccgccatagaggcggcaaaggatatcctctgctcaacggcacgaaagtttgcgttacttcctgttaggtgccgtgtggttgttgacacgcaacatgctgttgcggtttattctacacactttttcagaatggagcaacactttacaccctgttggcaacacacactatcaggacatttcattttccaca

SEQ ID NO: 697226 - DNA, 231 bp, Homo sapiens
cggacccacatccattccagcgtacgagagttatacttcatcagttgaaagtaggaaaacacgtaatcacatcataatcatcaatacttaactccatagatctacagtcgcacggttgcatgtctttataccgtatagagaataaccataagaaaatactacgtcaccaagtaatattccactgggagtaggcgaccagacaatacgaactgcaagtatgttaagatctat

SEQ ID NO: 697227 - DNA, 116 bp, Homo sapiens
ttcgtttcgctcaatggcctttaataacgggaggaggagagtgagacaggaggtgagggagaaagagaagggaagggaggaaagaacaggaggtgaaacatttcttggcaagagtt

SEQ ID NO: 697228 - DNA, 1266 bp, Homo sapiens
tgtttgcaacactagtgtctggatgtggagtgtgatgggtgtgtgctgtatgtgctgccatgccatgtgtctgtgcacatccctgtctgttggtctccatggccactgtgtgacttgggacccttgtgtgggaatgcctgcccatgtcgggctgtgtggaggctgatcagtgacgtgtgagagtaggcttccctatctgacctgactcacccactccctgacctgcccctatacctatgtattaatacctacctactggtctccaccaaggcttcgtatagccaccacaacccatgacctaggcagatgcacgcataaccccataccaaccacacagccagagagacggccacacgaacccaatacagaggaagagaatacaagaaacaaagaacggaccagagagccacgcagcacacctcaaacataaaagagagacagagcaaaagcgaaccaacctggagaaagctcacaaccgagagacacacacacaaacaacgaacaatcacacaaaaaaaacgaccacaagcacacaaacagagaacaaccgaaacaacaaaaaaagacacacccaccctgcaatgacatacccactgggacacccaccgcggacaccggccacgggccagcaccaaggccgcggacagagccccgagcacaccccagcacgaacgccacgcagcccagaagagaccacacggccgcacggcaaaccacaccagccgccacagcccgaccacaccagcgaagacacacaaagaaggaccagaaaaacgccacaacaacaaaaacgtcataaaaaagacacaacaaagacaaaagactacagagcagaagacaaacaaagacaggtactaagaactaacgtgagacccagaacctcgccctgagcaaactggaatcgcccaaagacaataagacaggtaatgaacgacagcccgcaccgccatgcaaggaacacgcacaaaagaaagatgccgctccgacccacggacacccgcacttgcacacaacatcggcgtgacgcgcctcacccccaagatggcgtgcataaaggaaagagaagaccatcacaggagcaccacccatcacgcccgttcgcgccgggatccaacccgcgtcggaggcaccacccgagaccatacgccaaaaggcgcaagtgcaccacaacgcccccgcaacaggcgacagcgccatgacatcacccgcgagacggcaacgacgcacacgcacacgcccacgacgccacccagcgccccctcctgt

SEQ ID NO: 697229 - DNA, 131 bp, Homo sapiens
tgtagaggatcccaggagtcaagacagccgaggcacatatgagactcacctccacaaaactttttcaaaattagctgggcatgctggcacatccctgcagtcccagccactcagggggctgaggcgggacg

SEQ ID NO: 697230 - DNA, 459 bp, Homo sapiens
aaagtgtcaaggagcctttttgcaacctcctataatattgaaacagattctgtgccctttaaaggagataaggtaactaagatctggggagcgctttacaatctgtatgcaaaaggcctttcacacaaaggccatgtttcatcttgcgacaacaagtcttataacaactacgatatatctgttcccatttccccaatataattgaaacggacagcgccgaatagatatctcctatagggctcttcaacactgtggtcaacctctagtaaatgatgttgacatgtcgccagtgtgatcattccattttggcctgcctttgaatcgcagattgtcatttagcaaaaacttcgtggacagatgatgtcagcttcggttcagagagcaggattactaaggtccccaaagtctctctcttacggactctcacaaacatggtaccatccctaatgaagtcaaacg

SEQ ID NO: 697231 - DNA, 954 bp, Homo sapiens
gataagaaagggagtgggattggcgcctacggtgggcgatagtgggacgcgccgagccggacggctgcaggatgatgcggttcatgctattattcagccggcagggaaaactgcggctgctaaaatggtacctggccattcggacaaggaacggaagaagatggtggcgagctcaatgcaggttgtcctggctcgaaagcccagatgtgctgttcctgggattgtagggaccttaatgttggctataagagatatgtagcctctatttcatgctgttccgatcgagggctcaatgaccaatgaggtctatctacatctggagtctgatccagcgatatgtgaagctgttagacgaatactttggagttgtgtgcgagcttggacattatctttaactttgagaagggctacttcatccgtggatgagttttggatggggggggatgtccaggaacacttcacaagaaggagtgtgtgaaaagcccatcgagcaggattgaagctattgcaagaggaggatgaagtcgccacggagtgtgctgcaggaggattgggtttggcatagtcccatggtgggccagggttgtggtgatggggtctggaagatgttggggggaacggttgtttgtacttggcgaaggccaagtcttggtgggaatcggggcccgtcttgatggctagcgttacggaagtgaatgtggattagctcaacaaatttagttcgttttgtccagaaaggggtggagaacgttccccaagaagagttttaacaggaagaagaagtttggaaagaggaggaaagataataaggtgtggagtattaggaaaagaattacaaagaagagtaaaaagttaaaacgaagtgcaacgatgagaaaaataagacgaaagaaaggagaagaaatgaagagagcaaaaaaaagggaaaatatataaagagttatattatcatga

SEQ ID NO: 697232 - DNA, 449 bp, Homo sapiens
gggcggccctccctttcatcagtcttcccgcgtccgccgattcctcctccttgagtcgccgctgtccattggctggcgtcagcaaaaatggctcaccacacacttccctagcacatgcagcaagcatcatggttcgcaccaagttccaacatcatgacgcacgcagcacaaggcagcattctcacgcagcagcatgcaccgggcctgtggcaggtgcctcccgccaggagaacaggagccagcagatgatccatccgtgacattgcagagagccagagagaacatccagaaatccctggctggaagactcagagcacccggggacctaccagcggcaaccaagcggaagaccacggatgagctcgtcgatccggattgccagtctggaagtggagaaccagagtctgcgtggacgtggatacaggagactgcagaaggccatctccaag

SEQ ID NO: 697233 - DNA, 1468 bp, Homo sapiens
agctcttcatatctctttacgtagttcaagtaaatgtagaagcagtatctcgaagaatggcaaatttagccttttgtatttggatagttgcttctagcctgatccttcttcagtagtttattactgggtgatataattttgagtttgccaaatttctaattaaaggagctctagtaccatgttcttggaaacttatccagtcacctgttacaaataaaaagcattcagaatctctagtccctgaagccgaaagaatggaacccagtctttgtttaatcacagctctaaacagaaaacagttaatatttttcttgctgtcaaatataacaactggcctgatcaacctgatggtagatacattacacagcagtaccttgtgggccttatttgtggtcaatctctatatgttttccaactgtttaattgtatatgtactatatttgcaagataagactgtacaattttggtgatcagcaggagtaggatatataagtatttgggcaatatttaatgaggaatattaattgtaaagaaattgtgcttttggcaacagtgttaaccatattttattataaaatagtttcagtcatctaaacagcagtgatgcttaattatttttttttttgagacagagtcttgctctgttacccaggctggagtgtagtggtgccatctcagctcactgcaacctccacctcccgggttcaagcaattctcctgcctcagcctcctgagtagctggcactgtaggcatgtaccaccatgcccagctaatttttatatttttagtagagatggggttttgccatattggccaggctggtctcaaactcctgaactcaagtgataacacccaccttggcctcccaaagtgctgggattacaggtgtgagccaccacactgggccaatgcttaatattttaatgtatctcaacaataaaaccaagaagaaacaaagccttttgacttgttagaatgtattaagtagtattttaaagaaactttatagttgtgacattgaaagactgttggggtggggggaggaaaatttttactttccatcttaatgtaaccttatgctattctgtatttttactgtatattgcttttacaataaatataaaatgaaatgtttatgttgaaaaaaaaaaaaaaaaaaaaaaaaaaaaaaaaaaaaaaaaaaaaaaaaaaaaaagggggggggggggcaaaaaatatctcccgagggggcccaaattgacgtcacacccttttttgtgcacaaaggggccccaaaagggaggccgataaaacgaaggacgggcggccggggacaaaagcgctgtcggcggaaaccgcgccctgggaactgggggagggacccacttggcgggccacccgggcacacccccaaaagatagagccgggcacaaacctcgcggtaggggtcacagcgcacgcgcgcgcaaatcgccgactataaaatca

SEQ ID NO: 697234 - DNA, 361 bp, Homo sapiens
tgtgctgtacggccggagtatgggcgatgtcggaccaggctgtcggtgccactctggggcagtcccactagtgattgggtgaaggtgtgtggcaacagcatgctggagcggtaggcaagctcccgcgagatcggccctgagccgcactcagtcctcaccgctgccgcagatgtccccaggccctgcagcagctggtcatgcgaacaacatgcagccagcagttcctggacgaagcagaagcatgcagcagctacagcgtgggcaagatcctcaccaagacaggggagctgcccaggcagccacaacaccaccctgaggagacagaggaggagctgacggagcagacaggaggtcttgctgc

SEQ ID NO: 697235 - DNA, 595 bp, Homo sapiens
tctgggcacgtaaacagcattacaaacttattctatctgtctaaaacgcatacaatgcaatgcaaataatgctaatgtaatcaggaactaagatgttcagcataagataaatggggtacaaaaattaaaatcaaagaaataaaaactctgaaatcttaaaaattaattgaaaacaattaatttttcaacttcatttttctcttaaaaagctcatattccctagctttgtacttttaaagaactataggcactgaaaacacagggcagtgagcactcttggtgtctagtttagtggtctcttaatgccatttcccattaaaatgaaccaaggcctagcggggtgcggtgcctcgtgcctgtaatcccagcactttcggaagctgaggtaggcagataacttgaggtcaggagttcaagactacagtgagctgtgcttgaaccactgcactctagccaggcgacagagatggtgtttagttgggttgagtttttttaataaagcaaacccaaagatcccctttattcctcaataattagtatgtgcctctaagaaatcattcttatcacaccttaaacatgaagaattcttttatag

SEQ ID NO: 697236 - DNA, 109 bp, Homo sapiens
acggccgtgtattactgtgcgagaaggcccggcgcgaagcagcgggcatattgtagtggtggtagctgcccctactactactacggtatggacgtctggggccaaggga

SEQ ID NO: 697237 - DNA, 908 bp, Homo sapiens
  misc_feature (27)..(27): n is a, c, g, or t
  misc_feature (77)..(77): n is a, c, g, or t
  misc_feature (228)..(228): n is a, c, g, or t
  misc_feature (233)..(233): n is a, c, g, or t
  misc_feature (238)..(238): n is a, c, g, or t
  misc_feature (242)..(242): n is a, c, g, or t
  misc_feature (257)..(257): n is a, c, g, or t
  misc_feature (261)..(261): n is a, c, g, or t
  misc_feature (269)..(269): n is a, c, g, or t
  misc_feature (276)..(276): n is a, c, g, or t
  misc_feature (287)..(287): n is a, c, g, or t
  misc_feature (361)..(361): n is a, c, g, or t
  misc_feature (417)..(417): n is a, c, g, or t
  misc_feature (454)..(454): n is a, c, g, or t
  misc_feature (467)..(467): n is a, c, g, or t
  misc_feature (621)..(623): n is a, c, g, or t
  misc_feature (638)..(639): n is a, c, g, or t
  misc_feature (644)..(644): n is a, c, g, or t
  misc_feature (648)..(648): n is a, c, g, or t
  misc_feature (657)..(657): n is a, c, g, or t
  misc_feature (665)..(665): n is a, c, g, or t
  misc_feature (699)..(699): n is a, c, g, or t
  misc_feature (701)..(701): n is a, c, g, or t
  misc_feature (718)..(718): n is a, c, g, or t
  misc_feature (736)..(736): n is a, c, g, or t
  misc_feature (747)..(747): n is a, c, g, or t
  misc_feature (757)..(757): n is a, c, g, or t
  misc_feature (787)..(787): n is a, c, g, or t
  misc_feature (791)..(791): n is a, c, g, or t
  misc_feature (804)..(804): n is a, c, g, or t
  misc_feature (807)..(807): n is a, c, g, or t
  misc_feature (814)..(814): n is a, c, g, or t
  misc_feature (888)..(888): n is a, c, g, or t
tttttttctctctaacaagcactcaangggcaaggatatgataaatatttaggtacacccctccccaccaagagatnggggggtgaagagctgggcacgcatctgacatttcttcctctattcctataaaaataaaaggaagcagaaatctgcttcaatgagttaacaagtcacctacactccaaaataacccatgcacactgtttctggggagggagatggccaggngaggngagtngggncacatgatggggganattnactctgcnacctgcngcacccctgtnctggggaggggtggccagtgccacagtggactctgagatgaaagggtgtttcttccactggcctttggcctgtnaccagcctcctccgcggtggcaggcagtacaagagtgatggcaatgtgactggaanagaaatagtttctaccaggcacacaaaagctcctgtnagctccgtagttncatcctgcaaagggcctcagtgggaaccaggtctgcagacccgagtgggcagagagacgggtggagagcaggtgccccagatggtcccgcaggcgtcaccgtctggtttggagaccttaagggagttgtgcttcaaacttctctcccagggtcnnnggtggagaataaggnntttgnactnaaagtcctnccaagcanagcccaagtcttggtacacaatctggttttaccncnttttaacaaaagacaangtcttctcttcctttcanaaaaattcatnaacattaaantcttttcttcgggatttcttctttcccgcngccnctcccattttgtnccnaaagaangcgtctttccccgaggtctaggttcccacaattggccccagaaaaagcatgttcctgtgggggttgtgccgggnccaaaaaaagcaaggtctgt

SEQ ID NO: 697238 - DNA, 266 bp, Homo sapiens
gtcaataaacaggtagcataattggggaaatgcgtatattagaaaggagagcaaagtgatattctttggtaaaaaaatgaagttcaatgactcttatttttctcactcctggttttttttttagacggagtctggctctatcaccaggctggagtgcagtggtgggatctcagctcactgcaacctgattccctggttcaagcgattctcttgactgagcctaccgagtagctgggactacaggcacgcgccaccacacccagcta

SEQ ID NO: 697239 - DNA, 397 bp, Homo sapiens
cctggtatagctggggccaacccggccttaaggtttaactggggtgaaccaatgccctggcccctaaacatgttcaacaggaaccgtgtggatacatcccccccccctgttttttggcatgtcatgtgtatgcagcttttcggtttcctggctttcatgatattcatgtgctgggtgggggacgggtaccctgtctaccagcctgtggggccaaaccagtatccttccaataatttgtacctggaacgaggcggtgatccctccaaagaaccagagcggggggttccctatgagatttgagggggctttgtgggcttttgggtcctctaactaggactccccccttcctaaaaatttacccttaatgaaatccctaataaaacccagggctgggtta

SEQ ID NO: 697240 - DNA, 212 bp, Homo sapiens
ccatgtggagtcttcttcttcctcctcagccccgtactcctacctcctccaccacttcttactttcgctctttccgggcttgcctactcctccaccttctccttcttctccttcaggtccttggcgctcaactcggccgctgcctccaggcttatctccgacatggtgccgggtgtccggggccggggctggcggggggaagcaaggaggct

SEQ ID NO: 697241 - DNA, 1047 bp, Homo sapiens
ttgatgccagcaagttagtgttggcagtgtgaacagtgctacttcacaggcttagttctgttgtctttaagttaccaatgtgtcatgttatacgtataaggatctgttctttttgggcaaggtagttaaattcttattcattcaacgtgaatggttggaaaaatgtagttaaatttacgtctttacgttaattccttagtaatgtttcatagctacaattctggtttctcaggacaacatttattatgctactgggagcaacaagtgaagaaaggaagctatactttggtgaccagacgctgtgagccctgtagtcattgcaagcatctacggttattcaggtaatattaccagaatatagaggttggtaacgttccgggcaagtgtgtcacatgccattgtgaagatccgttggcccgaattcacagaagatactaagtcgacctcatgccagtttacgaactctgtacttcatcctgctgtgtgctatcggatagaaatctctaagagctacattacaagatttgttcaaacaggaagtgatcaacgagtaagcagggcaccaagtgtaaaggcatgttgctagctgtctgtggaacagatttacccatttgtgtttgaaagcaggaaagaaattttataattcaccacttaattggttagtatctctgagatctgagcaccttttaaacatggcatgcacattggactcaaaaggaaaactggaccaacgaataaattgaaggaaagtagactcttttattcattctacggctagcagtgtaagctccagtgccctcttggattgtttattccaagaccttggtgtaactatgaaaaggaagtttacaagagcatgatattgtctgcttttacataaaggacagtctatttatgttcgcagtaattctgcatgtcccgataagcagagctgtcacagtgtgcactacctgagattgttttaagtgtcggtcattgttatgtgttttccatatttgagctaatgtgttttatttgtgaatagtcttttaatttgtgtaggcgata

SEQ ID NO: 697242 - DNA, 637 bp, Homo sapiens
  misc_feature (621)..(621): n is a, c, g, or t
aggacactaaagcaagccaagtggacagtatgaggggattcccatggtgggattcatttccctgccacttcgattgggtcagtaacccagatgacctacaggggcacagtgttgacccggaacccctcgtgactcaacatctgcctgccatgtttgggctctcacatgacatccgatgactaggtgacgtcggtggaggacatcgctgctcctttcagcagtcgactgcctgaccagacactcaagtcgtcgtgagtgcttgagatgactgggacaaatcgctccatcagatacatccctcagggtgatagacaccactgtgtactgatgttgggccaggatagaccggcgtgtgcccttcaagcagggcatgtagtattaccgtgccctaaagacccggaatgtcccctgttcggctcctgctctatcccaaaagcacctacgcattataagaggtggaggtcgagtcagacagcttcatgaatgctgtgctcacggctacgcacacacttgcgcagactgaacccctgccattcagcatgatcatgatcagcctgtgccacacttcgctcttgaggagctcaacggtctggcagggcagcaggaggctttataactccnagtccacagtatgctg

SEQ ID NO: 697243 - DNA, 866 bp, Homo sapiens
  misc_feature (866)..(866): n is a, c, g, or t
gatttttctcaatggtgatttgccgacagaagcataggtgtcgatgaaaactatcccctgataagtcgcaatatgggagaggagtagattcattggtcaacattgtctgttcattggcatctacgtagatttcggggacatgttgatgcagtagcgtggtacatcatgatgtattaaagtgcggtggctattcgtatgaaaatgacacgcagttgaaaaaagtttgtaagaacggagtgcttgttgaggagtgggtaaagggtgcatccgtttcaaatggtaattgtcccatagtgggaattcctatgttgtaattaaagaaacttgggcaaacatggcttgggggacgacggttagaaaacccgatttgagttaaattctacgtcaattatcggaggtaattgcatacactgtgatggaggacactagtgtttgatgaaactcaaaggtctaaacgcttcaccctaaagtgtttgaaatcattaactccaaattgggattggcgcgcccgaaggggtaccaacgatcaaggaatcatttatgatacgaaaagtagattcaattgttattttcaccgtaagagggatagctatacgttaccaaggagtcttttggaatctcggggacgatggtctcctcatttgatttatgttaattggacttggacttgcgggtgggataaggggatccgaaaactattttggaattaaagcttagggggtaaattcatccttctaggatttgaaaagtttgtggcggccagggaggtcctcggtgagagggaagagccaaattgggcttctgcttatccgtttggggcttttctatagcgaagtagcaatggggtgtgttggttaggaaaagan

SEQ ID NO: 697244 - DNA, 158 bp, Homo sapiens
catgccgtatgaccgtgtgcaagtgccttctcctgatttgggcatctgtcttcttgctctgtaacatcaatggggctgggcgtggatgatctctcatgcgtcttccaaccgtctatggtctaatgacggacttccccactccagcactgcctcaaact

SEQ ID NO: 697245 - DNA, 993 bp, Homo sapiens
  misc_feature (195)..(195): n is a, c, g, or t
gtgcgccggcgcacccactgagggtctgaacgatcaccggcctgggatgatgagcactgtcctgggcatcgatgaagatcccacaatattgaaggcctcgacccccagtgatgacggggacccgacggaacatgcccggtcggtgggtcctctcgtgcgaaacatacacaaagaagtggcatccactatgaaatnatgagaggcgatcagaatgatcggaagacacaaggactggaacaaagcagatgtggggtgagacaggtgtccgaagatctatgggtcagacagaagtgctgctaaacacgcagcgagaggaggacgtgggacgaggaactgctgtatactcatggacaatgcccccggtgggcaacacgaaactatctgtcatacattatgcgatagcgggatctcttcaacacccaatccagagagattcatccctgaagtatgcattcaggaaagccacacaggagggtaatttccgacctatgttgttcatggaactcgctacaaaaggaaatggaaggtggactatggctgcgacttgcacaagccaaatcaatcaggccgtggggccacaattttttaactccagatctcagtggagaccaggagcacttctgattcaccaggaccagtctcagacctataccggacaacggcaagttcttagagaacctcaactcgacaacacgtgtgccacaaggctagtcctcagaggcgatgacgtcgggcacgacgatgactatacaatgggaggtccatatcaagggggacgggtaagagaaaccacgtggaggaagacaaccatcgcacgcacgagactggacgagaacacacaacaacaaaccaatacaggagccaccggcacgtacaaacgcagcgagacagaacagatacaaagcacaaagggacaacccacatacacaacagagccacaacgacggaagcacacaaagcagacaacaaacgacacaacgcagaacaaagcaa

SEQ ID NO: 697246 - DNA, 561 bp, Homo sapiens
gattcctgaagctgacagcattcgggccgagatgtctcgctccgtggccttagctgtgctcgcgcgtgactctctctttctgcgcctggagggctatccgagacgatacatccgaaagattcaggtttactcactgtcatccacgcaggaagaactggcaagagtcaaaatttccctggaattgcatatgtgtctggagtctcatccatccgacattgaagttgacttacgtgaacgaatggcagagcagacagttgagaaagtggagcagttcagacgttgtcttatcagcaaggacgtggtcgttgtctactcgtcttgtactacactgaagttcaccgcccatcgtgaagatcagatgagtatgcctgccgtgtgaaccatgtgactttgtcacagcccaagatagttaagtgggatcgagacatgtaagcagcatcatggaggtttgaagatgccgccattggattggatgaattccaaattctgcttgcttgctttgtaatattgatatgcttatacacttacactttatgcacaaaagtgtagggttataataat

SEQ ID NO: 697247 - DNA, 110 bp, Homo sapiens
gactttaaactggtattttttcttttgaatctcgctcagccctcacctctggtatccattgttcctcatctaattcttttcgagcctctgcccccttctgtcgtcttctc

SEQ ID NO: 697248 - DNA, 199 bp, Homo sapiens
tgacctcctcaagcctcccaaagtgctgggattacaggcatgagcacatgagcctggccctagcccacatgcttttataacaaacctttttcgtattgtggtaaaatatacataacaaagacttactgtttaaccagttatttatttgtttgtttatttgtttttgtagagacggggtctcaccatgttgcccgggaca

SEQ ID NO: 697249 - DNA, 228 bp, Homo sapiens
atagccctgctacagctgactctattggtccttacaatcatttctctactgtaagtcgcttagagtgcaactttcgcttaactagtacttagactgtatctattagtgtcctacagcaggagatgaagatttaaactatcacttcctgtatccctatcttcccaatatagttacatcatagtcaatgtttacttccttctgaccatgtaaactctgttcatagctgag

SEQ ID NO: 697250 - DNA, 108 bp, Homo sapiens
ttctatctgctacgacttacccactttacaggaacactcttggttcggtggttacaactaacaaaaatggccgcctgctcattggtacctcacaaatctgacactcac

SEQ ID NO: 697251 - DNA, 125 bp, Homo sapiens
ggagcataacacagagctagtcgtccaacccagcagtcgtctttgtcacccgaaagaaccgccaagtgtgtgccacccgagagaagaaatgggttcgggagtacatcaactcttatggagataga

SEQ ID NO: 697252 - DNA, 238 bp, Homo sapiens
  misc_feature (147)..(147): n is a, c, g, or t
ttgggtggattgcttgaagtccaggagtaggggactagtctaggtaacatgatgaaaccctgtgtctacaaaaaatacaaaaaaattaaataggcatggtagtgcgtgtctgtagtcgcagctactcaggagactgaagtgggaganttgcctgaggcaccggagtgtcgaggctgcagtgagccatgattgtgccattgtactccagccttggcaatggcgtgagaccctgtcttta

SEQ ID NO: 697253 - DNA, 383 bp, Homo sapiens
tccccatttggtttggggatttttggttttggttaggtttagggttaccacaaagaggaatttatttttcagcagcctaaaactgttgtgttttttttatgggtttaaaaaccccctgtcattgataactccccttttcccttcccttttcccgggttggtgatcacttttttaagcctgtgtattcaagggggtttgtttcccccccgtttccagggggtcgaggcaaagggccggggcagcttttctttcagtcattgtttccccccctttaaaattcagacaaaaaaactttgctttaaaaattttatgtgtgggaaccccagtttctggctgcccttttcctggggatgtgttaattcctttattaatattgcagggga

SEQ ID NO: 697254 - DNA, 759 bp, Homo sapiens
ggtaacagctcccctcatcaattggttaccctgaagtatagttcatataggaatagctgcataaatgctgccttttcccctttatcacttttagaataatgagtcctgtgtaattttaaactgaagtaagtcagtatagagtgattctatacctgtggctttgaggtctagaataagagtgtttgctactaggagaaaggtgtttcggtttgtttggttttgtttggttgagacggagtctcgctctgtcacccaggctgagtgcagtggcgcagtctcagctcactgtaacctccacctcccgggttcaggggattctcctgcctcagcctcctgagtagctggtaatacacgcccggctaatttttgtattttaagtagagttggggttttactgtgttggccaggatggtctcgatctcctgacctcgtgatccgcctgcctcggctcccaaatgtgctgggattacaggcgtgggccacacgccggttgtttgttttttaaaagagatggggccgggtgagtggtcagcctattaatctctgtacttgtggaggcctagatgggcggatcaattaaccctcagggaattaaagacagtttgggaataatggggatacggggtctctacaaaaaaatagagacgaggagagagggtggagtgtggaagttggaggtgggaggatcacctggccagggagtcgaggctgtgtgggaatgattgggcatgaattcagtagggaagataagaccgttcg

SEQ ID NO: 697255 - DNA, 957 bp, Homo sapiens
ggagagagagagagaactagtctcgagttttatatattttttcttttttctggggccctaaggggggtcacgagggggggctctagggtcacccaaaaaaacgaacaggtacacaggaataacccgaacaacagacaataacgaagatagcaaccgaagaaaatgagaagtgagacaagaaagaaagaaacagacagaaacgacacagcaaccgtgaaaaacacaaacagggaccaaaacagacacacagacaacgcaataaggaaaaagaaaacacgaagaggcagcaaacagagagacacagacacacaacagacgactagagagagacagacacgcagcgacaacgacgagacgaggaaccgagacaaaggcacaagagacgaagcgacgaacgggggagaggaaggagaggggcgaccgagcggggagcgcaggccgtggcggcggcgcgggcaggagccggcggagaagggaagggagcacgcgggcgagggcgacgagaagcggcgggcagggcaggcggggggggggcgacagagggaggagggacagggcggagcgggagcgagaggggcgaagggcggggggggggtacgtgccggcgagcggagaaggtcgcaagtagcgtccgaagagacgagaaccgagggaagcaggacacacgggagagcacacagaggacgaaacaggtaacgacgcagcaagcgaacaacagggcacaggggcagaaaagcagcaggaacgaaacgcaataggagaaaatacgagaagaccccgcgagcgagcggaggaggagtcgagaggtagagctgcagccggtgaccggaagcggggtcgagacatgacgcgctagagccgacagcgacaggggacagcacaaggagcagagccgcgcgtgggaggcacacagaggaagagagccgagagccagacaccacgaggcaagatgccaat

SEQ ID NO: 697256 - DNA, 342 bp, Homo sapiens
tgaagaggtaggagccgatggagcccttctcgaacatcgcgcggtagttatcgcgcgtccagctggcgtcggggatcagcgcggtcgggctgcccaggtcggcgaagatagtctcgctcggcttgaagccggcggcgaacatgaacagcatcgggtaggcgaacacgacgccggccagcaccatcaacgcgacatgcagcagccgaccggccacccgcgcccattcggcggatcggctcatgatcccaacctttccacgaccttcttctgaccgaaggagaacagcagcacgaacaggaagaagaacagagtcatcgcggagccgtaggcaatgtcctgttc

SEQ ID NO: 697257 - DNA, 332 bp, Homo sapiens
ttcccatgaagatcgaaaaggggccctgcttccaatttcccttttccattccccgaggtactccaggggttaaaaaaatgcttttggtctgtgggtccagtgttgtttgtcatccctttaagggttccccctttcaagtgacaatcctttccttggccctgccatagggcagagcatgtttggcatagcagcctgacttttatgccctaatcttgagttggggaaatatatgccccggggtcaaaaagatgtttttatttttggcggtatataaaagaagtttttttgttttttttgttttcctttttggggcaataaagtttgttttggca

SEQ ID NO: 697258 - DNA, 320 bp, Homo sapiens
caaatgggacaattttaattcaaccacaagtcaaattgaaagaagttaaaagaatgtttatgcaaacacatgagaaaagaagggtgcctatgaaaatgggggttggggagagaattatgtggattaaaaaaagagggaaaagcaagggaaatttctggtaaaacataatggaggtgttagaaaatagcgtatttgtcccacttgtcctgtgtttaaaaaatattctttttttatttcccttaaaggtttagttttttaataacatttatatttttttgcttgtgattttcaatatatttttttccttgattttgttccaa

SEQ ID NO: 697259 - DNA, 204 bp, Homo sapiens
tgagattatcgattacagaacaggctcctctagagcgataggaaacactgccaggacctttgagttttaagctgtgactcgtagtgttctgtcagagcagatctgatgatttaactgtcgaggcttaccgctaagcatagcagtgtatctaatcccagcttgggactcagctatcgtgtgttcagatatgctaaagccactttc

SEQ ID NO: 697260 - DNA, 141 bp, Homo sapiens
tatagggggcctgactgcacccggttcttataggtctgttttttgagattagacccttcatcatattcttcttcttcttcttcctcttctttcttctccaatcccgtgatgaggctgaagctttggtacatcatccactgt

SEQ ID NO: 697261 - DNA, 374 bp, Homo sapiens
ctgaggaatgtgtgcatatggcaatacaaatattcatagcgctatgcgtgtctgtgaatgaccatacaaatggtgatacaaatactgatttaggagttataaatcatttaattttaatattagaaacagaacctcactcttgagaccaggatgactgaagtagaagaggaataatctcggatacacctgaagtctcagccatccgtgggtcaggcatatctccgtgcctcagcctcctcagatagctgggacatacaggcgcccatcaccacgccgggctatattttttccgtgcatttttaagataaacgagtgggtttcaccatgtgtacgccaggagggactcgatctccgtgacctcgagatccgccgtg

SEQ ID NO: 697262 - DNA, 451 bp, Homo sapiens
ctgtaagtcaacatatacgccgttgatcggcaatggtaactgtgcagaatagtggatgctgacgcatacgctactggtgctggctgggccatgggccaagaatccgtgcgtggaacctctgagcatcctattcataacgatgcttcatctctctaacccacttgtgaggctcagcacgcgctctggagcacatcgttctcgctgaccaactgctgtgtctgccggtgtcaggcttacattgccttatcatcggtggtatgctgtgcttgccaccggatcctacgcgtgacgtccgatgtgtacctcccgagctgagctgaattctgtgacgactcgtatcggcgacgactgcgactgtgccgtgatgttctacgggtgccaagctggacgaccaccgtacgcacctgtctatacgcagacgtcgccggatgtgtcttgatatgccaggacg

SEQ ID NO: 697263 - DNA, 1047 bp, Homo sapiens
ggtttgtcttgtgggtagtatgatcggtgtggccgtggtatcaagtttctgatctgtggtggtcctcgggtccccttgaatttggttttcatgataatcgcttccaactgttctttgtagcctgcttgaagaattaatcgaacgtagggagcaattgccacaagatgtgacgtgttgtaggaagcaccaggctagtgtgttggtaggctagtgtctgtcggccatattcggttgataaccaggagccttgcagtgcagaaaattcattaatctggaacgttctttctgaatgttggcatgatctaatagctacgagcaccatgtggggagttcctcctctggacagaagcctggagcccagtgctgcacttgagaccgcgttgggggatctgtatgggtttggcgttaccccgccattggccgccatcaagtgcacgccagatgatatttgctctgctaaaaggcctccttcagtgagcaaggcatcaacgagatttctcagggtagctctcttttggcgcgtggctccacggcacctgtatggaggcggggctttccctactcatcgtttgagagagagtccttgggacggcacgggatggctgagcttcccgtggtggatgactacttgacctcagtgatgtggagcattgatgacttagggaaagatgagttgtgagagccacaacagaggcttcagaccattatcgttttacttgggagccagtggatttgttccagcagatgaagggacattctctacactcagatgactctatccagtggcctctttgaagctcaagagagtagtagcttgtattggtcactttgagaaacactgcaacagtgaacttttgcatctcagagaattaacagtgctaaattctatgaagttgttgtagaccggtgaattgagtcgtattctgtcacagtaacacttatgaagaaaagcttggactagtcgaaacatttttctctctgactgctgcttgaatgttcaatggaggctgtttcttatgtatgggttttaccaactgtgtcccttaa

SEQ ID NO: 697264 - DNA, 245 bp, Homo sapiens
  misc_feature (23)..(23): n is a, c, g, or t
  misc_feature (60)..(60): n is a, c, g, or t
  misc_feature (224)..(224): n is a, c, g, or t
ctctggccatgtagacaaatttnctgacttcatggtgaaagacgtaaaaaatggagaatnttttcgtgctgaccatctattaaaagctcatttacagaaattgatgtctgataagaagtgttctgtcgaaaagaaatcagaaatggaaagtgttttggcccagcttgataactatggacagcaagaacttgcggatctttttgtgtactataatgtaaaatctnccattactggaaatgatctat

SEQ ID NO: 697265 - DNA, 406 bp, Homo sapiens
agattgcaggaattgttcttaataatggcagatcaaactacacatgggggaatttgcacgttttgataaggccaagctgaagatatcggtgtcgcaggatatgtaccccctcccgtccaaaggctccattgagcaggagaaggggagtgtattttcttatgttcgtggagttttcctacccccgtcctttttaaagccccatttgtaatgtggaggaagagccccctgcaagatggacacgagccccaagttgcattgtgaacttgggcattccgcgcatatgccaccggcctgtgggtttttgaagggccccccccccaatcggactgccaaattttccggtttgccccgggatattatagaaaattatttgtatgaataatgaaaataaaacccccctcgtggc

SEQ ID NO: 697266 - DNA, 418 bp, Homo sapiens
agcatcgaggagcagctgtggtggctatcagccacaggggcagcagccacaataggcagatggatcagcacaatgaatggccgttgaccttttcagctagtgggaaggtgtaatccgtctctacagacaaggccaggactcgtttgtacccatcgtataatagaatgaggttctggtgcaacagttgggtagccaatctgcagacagacactggcaacattgcggacaccctccaggaagcgagaatgcagagtttcctctgtgatatcaagcacttcagggttgtagatgctgccattgtcgaacacctgctggatgaccagcccaaaggagaagggggagatgttgagcatgttcagcagcgtggcttcgctggctcccactttgtctccagtcttgatcagctgcacatcactca

SEQ ID NO: 697267 - DNA, 372 bp, Homo sapiens
catgtctcgatcccagtagacggtcttgggctcggccatactggcatgcttaactctgcaggcgtatgtatcagtctcagtgggggtgaattcagtgtgagccaggaattagaagacccagtccttgtcaaaggacatatctgacatctccactttaggaatttttttcccgttcttcagcatttggatttcaatgtgaggcgggtggaactgtgttacgtagcagttcagtatgttcggcttcccattctccggtgggtggcgtgagtatacttgaatttgaggggttttctggatagcatacaggccggtcagtgagacaagcaccagaaagaccagggtcaccgagcgagccatgctgacgactgaagc

SEQ ID NO: 697268 - DNA, 345 bp, Homo sapiens
acggttgcgagaagacgacagaattcataggaggggttacttctacttctcaaagctgggttcaggtggccatttgttttcgtccttggtgtttctgaatgtgcccatgtgcctttccttaccctttttttgggcgtgagtgtgtggttgcatccagctggctttgccttcaacatctcaaaggtgtcttcacttattgtcctttgtgtctgcttggcatatctgtcacatgcctttagttgcatctcaagaatgtacttcactattcgaaaggcgatcatattgagaaattttaatagaattaaatatctaaaagcattatgtctcaccagttgagtctaagaa

SEQ ID NO: 697269 - DNA, 376 bp, Homo sapiens
  misc_feature (71)..(71): n is a, c, g, or t
  misc_feature (83)..(83): n is a, c, g, or t
  misc_feature (89)..(89): n is a, c, g, or t
  misc_feature (97)..(97): n is a, c, g, or t
  misc_feature (168)..(168): n is a, c, g, or t
  misc_feature (209)..(209): n is a, c, g, or t
  misc_feature (235)..(235): n is a, c, g, or t
  misc_feature (259)..(259): n is a, c, g, or t
  misc_feature (299)..(300): n is a, c, g, or t
  misc_feature (303)..(303): n is a, c, g, or t
cagctgtgtactgctggaagcttgtgcactgtgctcgccaggcccgtgacgctcctacagggactatgcgnaattgtggtcanatattnaggagttnatgcgaacatatcatacacagtacggagctgcctgtggactgggcaccccatcttccacactgtctgaggntgagaagcagcagcaggcagggcagctcagcctggtaccancccatgtgtaggcagaccaagccctngaggctctggaaccaggagcagangggcagcaatgtttggggacagtgactgcactggcacctnnagnatgacttggagagggtgggacagagggtcctgtgacccatggagcagtggccgtggcctgcagggccaaccaa

SEQ ID NO: 697270 - DNA, 133 bp, Homo sapiens
acttagcaggtggggcagcagcagcaatctcttctcccaaccatccaaccatctgggtcagcattgaactcttcaatctctgcactcaaagctgttaagatagttaagcgtgcataagtgcccgccaatcgaa

SEQ ID NO: 697271 - DNA, 963 bp, Homo sapiens
  misc_feature (298)..(298): n is a, c, g, or t
gatccctcaacccacacattgaatgtattgttccctgagagcaattgtagatagaggagtgggtgggaagtctgaagtcagggcattgtttctgcgtatctgaggaggctggtttttgatatgtgggagctagtggtcgttaacgcatttaccccctatttggtggactctggttcccccatcttaagtgctgagtcaggggcctaaccgggcagctttaactatttgtttgttgtaggtgctagaatagaagaccagaaaatgaaatggtggagtttgaggctggatagacagtttngaaaggtaagtattgaaaaacacttgaatttgggtcagtacaaagggacatgcagagactttgaatcatcaaaactccagcatgcattgtcttacggatgtttagataggtgtgtttggacaacactctgggttcttgtaatgatgttgatcaaatgtctgagctgaaaataacttgtagacaatttttaacactgaagaaccttgtggaggcaactaagaatagtcgaatgatgtttagcatatttgtaagaggtattttcttttaattctagttaactggttgcatgcttgttcatttggctggcttgcttgggtaagaagccattgggggccttgaattccctccagtcatttgcagtatttactgcatacatttagcttttgaacatgcatgtgctaccatcagtactaaatggtgccttaaatttttttcaggtacaaataatggtttgaataaagaaaggtattaatgggtcacctcaagtgaaggcactgcaaacacaatgattggtcattctgaatttccggtccttcattctgaatttcaaaggctcctgtgacaagtggacatgcagtgactgcacctttgtttctgaggtgcctggatggaggctcaaatagaagatggtgtcagatatattgtgttaaaattttaccattaaa

SEQ ID NO: 697272 - DNA, 874 bp, Homo sapiens
  misc_feature (768)..(768): n is a, c, g, or t
  misc_feature (770)..(770): n is a, c, g, or t
  misc_feature (773)..(773): n is a, c, g, or t
  misc_feature (775)..(775): n is a, c, g, or t
  misc_feature (778)..(778): n is a, c, g, or t
  misc_feature (783)..(783): n is a, c, g, or t
  misc_feature (785)..(785): n is a, c, g, or t
aatacactatccccatgataagcataacttgcattccatttcctctaataagggtgtctccacagtggattaaatgcctcagccagatgcacaatagactagtcatcattttcacaagctccagttaaaccacacgagtaagggcataggaggtcaaagggggctgctgatgatgaagaaaccgggctgccaggaggaaggcaaataagagcaagagtgttttccactagtaggtcaccttacagatactgacatatctgtctcctggctaggcactccttcctctccaccactccaggaaagatggtccacccggtgtgggatccaaccacagcttacagacacaacaaaaacttcccgtgagagcttgagactgccgaaaacacatctagttttgctttattcttgctacttggaactacagcctgggaacagatacactgaattactgcgacagccagagagaaaatcatgaaataggaggagggaggaagaagagtcaactgggaaaagggaaaggaaattaaatgaacagagaatcaattatatgtgagcctgtctctgcttcatatgttatacaatttaagcaccaagtgtcattgtcctcatttcacatatgagttgacggaagcttagaaaagcctagcaacaggaccaaatgctttgactctactttgcaaactctttccacataatcatggcaggatccgcatgatcctgaactggagaaacaatatagtcaactaatgctctgtatgtgtctcagananacngntcngggtncnactggtacatgcaatgtacccacagacaggccatgaggcctaaatctgttcgatgtcgggctgcgagatggtgatgccggaaggtccag

SEQ ID NO: 697273 - DNA, 1048 bp, Homo sapiens
  misc_feature (383)..(383): n is a, c, g, or t
tgagcaggaatggcagtgtggacctctgtgatgggacatcttggtgggatctcacagccagttctgtggcaaaggaggatgaaggcttacgaggtgagtactgaatagtaatgagaagttaggttgaaaggacagtgccacaatgatgacatcatatttgctactcttgacagctggggtgacgatagctttaaaccaccatgattataactgaggcacacaaaataatgatttgggggctacttacagagtaagcagtttttacataaagattccccccccccaggactcgtcaggaagctggataacagagcgagcgcaatgtgctagaatagaagaccagaaaatgaaatggtggagtttgaggctggatagacagtttngaaaggtaagtattgaaaaacacttgaatttgggtcagtacaaagggacatgcagagactttgaatcatcaaaactccagcatgcattgtcttacggatgtttagataggtgtgtttggacaacactctgggttcttgtaatgatgttgatcaaatgtctgagctgaaaataacttgtagacaatttttaacactgaagaaccttgtggaggcaactaagaatagtcgaatgatgtttagcatatttgtaagaggtattttcttttaattctagttaactggttgcatgcttgttcatttggctggcttgcttgggtaagaagccattgggggccttgaattccctccagtcatttgcagtatttactgcatacatttagcttttgaacatgcatgtgctaccatcagtactaaatggtgccttaaatttttttcaggtacaaataatggtttgaataaagaaaggtattaatgggtcacctcaagtgaaggcactgcaaacacaatgattggtcattctgaatttccggtccttcattctgaatttcaaaggctcctgtgacaagtggacatgcagtgactgcacctttgtttctgaggtgcctggatggaggctcaaatagaagatggtgtcagatatattgtgttaaaattttaccattaaa

SEQ ID NO: 697274 - DNA, 615 bp, Homo sapiens
  misc_feature (509)..(509): n is a, c, g, or t
  misc_feature (511)..(511): n is a, c, g, or t
  misc_feature (514)..(514): n is a, c, g, or t
  misc_feature (516)..(516): n is a, c, g, or t
  misc_feature (519)..(519): n is a, c, g, or t
  misc_feature (524)..(524): n is a, c, g, or t
  misc_feature (526)..(526): n is a, c, g, or t
tgagcctgtctctgcttcatatgttatacaatttaagcaccaagtgtcattgtcctcatttcacatatgagttgacggaagtttagaaaagcccagcaacaggaccaaatgctttgactgtacttggcaaactctttccacataatcatggcaggatccgcatgatctgggaacagatacactgaattactgcgacagccagagagaaaatcatgaaataggaggagggaggaagaagagtcaactgggaaaagggaaaggaaattaaatgaacagagaatcaattatatgtgagcctgtctctgcttcatatgttatacaatttaagcaccaagtgtcattgtcctcatttcacatatgagttgacggaagcttagaaaagcctagcaacaggaccaaatgctttgactctactttgcaaactctttccacataatcatggcaggatccgcatgatcctgaactggagaaacaatatagtcaactaatgctctgtatgtgtctcagananacngntcngggtncnactggtacatgcaatgtacccacagacaggccatgaggcctaaatctgttcgatgtcgggctgcgagatggtgatgccggaaggtccag

SEQ ID NO: 697275 - DNA, 518 bp, Homo sapiens
  misc_feature (153)..(153): n is a, c, g, or t
  misc_feature (336)..(336): n is a, c, g, or t
  misc_feature (363)..(363): n is a, c, g, or t
  misc_feature (390)..(390): n is a, c, g, or t
gtcagcatctattccatctaatgtgatacactgtgtgtgttacctagagaaaatgctgtagatccacacatttgacagaaatgtttatcgatgccataacgtgatgcatttctttccggtgttgttttttgtttatatttttaggaaattttncctaccatcacagatttgttctttaataagcaaactattatttaatctagattttgttttaaaattatcaagtgttagcttttacaaataagaggcttataatgtggccagatattcttagaattcttttaggtctaagtgttttcaaaactttaagaaatacattctattgcaccatttaanatgtttcctttaagttttattaagtcncgagaagttattttttcattgaatccnagtgaattatggatatgtattatcttttatatgaatgtaatagcttgctttcagttcctcacaggtcattgaattatttaaccaatgaaaacattctctgttacttccaagaaatatgtttatcaaaa

SEQ ID NO: 697276 - DNA, 386 bp, Homo sapiens
ttcgtgacagttagactctagaggagtcgtcactacgaaaccccctctataatgtcatgctccaggattaacctggcccatgtgctcatgtgttcatacggttccggtgtggaaaacacgctcgtgaaaaagcagtgagtcctgcaatagggaagcccagagaaggcaccctctgacccttaggcttgaccctgtagcactaccagccttgccctcttcagtctcatcacaactgtgacttaacagttacttgaggaaggagttggtgcattcgccacccgggcctggggatccaggaggacaggccctggatgtagcttttctttcagctgtgttctgcgcctcgaatattatggcttggcattgccaggcagcctgttcagccc

SEQ ID NO: 697277 - DNA, 657 bp, Homo sapiens
  misc_feature (7)..(7): n is a, c, g, or t
  misc_feature (66)..(66): n is a, c, g, or t
  misc_feature (68)..(68): n is a, c, g, or t
  misc_feature (70)..(70): n is a, c, g, or t
  misc_feature (92)..(92): n is a, c, g, or t
  misc_feature (155)..(157): n is a, c, g, or t
  misc_feature (166)..(167): n is a, c, g, or t
  misc_feature (172)..(172): n is a, c, g, or t
  misc_feature (175)..(175): n is a, c, g, or t
  misc_feature (180)..(180): n is a, c, g, or t
  misc_feature (300)..(300): n is a, c, g, or t
  misc_feature (308)..(308): n is a, c, g, or t
  misc_feature (310)..(311): n is a, c, g, or t
  misc_feature (315)..(316): n is a, c, g, or t
  misc_feature (340)..(340): n is a, c, g, or t
  misc_feature (352)..(352): n is a, c, g, or t
  misc_feature (383)..(383): n is a, c, g, or t
  misc_feature (386)..(387): n is a, c, g, or t
  misc_feature (395)..(395): n is a, c, g, or t
  misc_feature (398)..(398): n is a, c, g, or t
  misc_feature (431)..(431): n is a, c, g, or t
  misc_feature (440)..(440): n is a, c, g, or t
  misc_feature (647)..(647): n is a, c, g, or t
aacagtnaagtttaagtaaaacccattgcacagactgttcctttcatcacagacacaaagaaggtnananttagatgctatcaaggaactanccaatcttggaccaagcgtacatgctcccttccttcttactccatggtagagactgctccatnnncctctcctnnacctnttnccacngggagatttaggaggccatccaaggagtgactgagccttggccctcttccatggctacaggaatattgttcctgcaggtactatccagatttcagctctagatgtaactgaaaaaacctnaaactctncnnccanncatctaaggcttatagtgcttganttctgatggggnacaactgcagcgaacagcaccagggaagctngannatgctcantangtgactcgcatcttttctcactcgcccactttntccaacttnggatggcaggccagctgcaccattgggggtggcccacaaagcagtaccagcacatcatcccctggagcgggcaggtgttcccggatcatgtcggcagtcacaaagcccttgctgtaggcccaatcttttgggggatgatccagagtgaaccagagcttaaagcgattggggatagcgggcctgcagttcctctaagtcctcccgcangatgatatcc

SEQ ID NO: 697278 - DNA, 113 bp, Homo sapiens
ctgcggctagacgattagatgtgcgacagggatcgatgttattaaacaagctcggagcccggggtgtgacgcgatgtgttctgcagtgtctgatgtcaagtgagaatcatgag

SEQ ID NO: 697279 - DNA, 181 bp, Homo sapiens
  misc_feature (147)..(147): n is a, c, g, or t
cctggaaggttgaggctgcagtcagctgtgatagcactactaaactccagccttggacaacagatggagaccagtcctagctactcaggaggctcaggtaggaggatccttaagccaggagttcaaggctgcagtgagctgtgatangcctactgtagtcaagcctgggtgacagggtgag

SEQ ID NO: 697280 - DNA, 1118 bp, Homo sapiens
tgtgaccccctggcttcgtgcatgtattgccgtcgcatgacctgtggtgcccgtggtttctccattgcttccacatagggctctggatggggtcctgttgccaattgccccgggaaagaccgttggccaccaaaggtgcgcgcctactgcgcatgtgaggtttccccgaccgtgggatggtactatcggcctgtattatcaccaatgtgtgtctcaaccccctcctgtgtcggcgtccagggatatatacgacatcccgacgtaattggtggactcccttcggtcgcctgtgtatatccaatgcgccaacgggtgtgacccaccatatcccgggtgtcggagtttccgggtccccgctaccagtgtggtccaactcactttggcggttgtcgactggagtttgcctacctgcggagaccctagatataaggggaccattgggctctttcgccggaataggccccgagcccctaacgtacttgtgctccgaggtcccgctattgattgtggatatcccactctggttcctactgggccttgagccagcgttttgggctgggttctaactcgttatcgtacagccgctatcaatctcgatctcttagatccctagtccttcgcaagctctgagccgcgggctctttgctgctagaacagtatgcctcgctgatgcgaggccctagcactacgatgcgcgaggccaaccatacctagcccctggcaccctggcgcgcttgagcgctattgtcatgctttcacgtccaactgttttgcatgtgaccatactacggagaggaacagggcctcgcggactgttctcgctcagatccgctcagctcacccattgtcctccatgtccttcacgcccacctaaataggcccagagaggtccctggagcaacgctgcttgcggaccctaggcttcatccctatgctaaggatagtccacgcaggagcccggtgctaggggaagcatccaccaggcactgactgagcggacaggggagcacggcccgtgggtttgattgtacctactctgttccactggttctaagacgcagagcgttctcacatctcaatcaggatgcttctctccatataccaccgggggtccatga

SEQ ID NO: 697281 - DNA, 447 bp, Homo sapiens
  misc_feature (35)..(35): n is a, c, g, or t
  misc_feature (297)..(297): n is a, c, g, or t
tatgatatttcagtctgtgtccccacccaaatctncatgtgatgtcatcctcaatgctggaggttgggcctggtgggaggtgattgggtgatgggggtgctttctaatggtttagcaccatctccctagtgctgttcttgtgatgagttctcgtgacatctagttgtttaaaagtgtatggtacctctcccatctctcttttccacctgctccagccatgtgaagttctggctccccatttgccttctggcatgactgtaagtttcctgaggcctccccagaagacaagcagattgncagcatcatgcttcctgtacagcttgtggaagtgtgaaccaattaaactctttttctttgtaaattacccagtatcaggtatttttttacagcagtgcaagaatggactaatacagaaaatcggtaccgaggagtgggggaccaggaact

SEQ ID NO: 697282 - DNA, 891 bp, Homo sapiens
gtaaatttcagaatgtgtctctggtacagaatagttgatattaacagaaaaaaaaaaaatctgtagcttcatgaatatgccactctgttaatttcttgttccagacattttaatagagatgggcttgagccatgtggtttgaattgctgccaatagcagaccatatccctatcatgttggtgggctcaactgttttttttttttcccttaattagagatggagttatcgctgtgttgtgctcaggcggggctcttgaactccgtgggctcaagctatcctccgtgcctcggcctcccaaagtacggggattataggtgtgagctactgtgtacccagccttaaccgtgtttccacagttgatatatactctcagtgcgtgtttccagcagggtattataaggggattaaaagttggggttgcatgcctgtaatcccagcatttggggaggccgaggatgggcggatcacgaggtcaggagatcgagaccatcgctgactaaacacagtgaaaccccgtctctaataaaaatacgaaaaattagccaggcgtggttggcgggcgctgtaatcccagctactcgggaagctgaggccggagaatggtgtgaacccatgtgagcccgagatcgtgccattgcacttccaagctgggcaacagagtggagaacttcggttctccaaaaaacacacacaaccgtgggggtgcgcagacaacaatggcggaaaatccacaaaatgtcaattttaaaacacagaaaggcaagggctgcggcaaatcaaacttccactttatttcaggaaaaacagagagaaaaagaaaaagcagaacaaaacaaacaaaagcagcacaaaacaaagcaaaccaaaaaaaagggcggggtcaaaacaag

SEQ ID NO: 697283 - DNA, 128 bp, Homo sapiens
cctgtccccttgaaaccttgagtaccattttccagttggtgatcaaaggcaaccccccacattggtttgatcgtgggtttgttcagtgcgtatgtaacgccgcatgttgggaaccctggttccttcaa

SEQ ID NO: 697284 - DNA, 941 bp, Homo sapiens
  misc_feature (267)..(267): n is a, c, g, or t
taatagcatatcgagatatatcgctggccgtgtacgtcgatgtcgaggcgagaatggtgttttctgcgacgccaccatggtttggttcgcgcatcgatggtcttgggcccccgggtgcccagcaatggggacgggccacaggcgggttagagtaccgggcaaggtgcgaacacgcgttgtggagaaggccctttacattgaaagtcttcctttatagggagttctcctcgaaggccttaggacgggttgggtccggtgacgttaagncagtggtatgaagtggtaaaaaggttcgtactttcaaggcacacagctttggaaacgttgttttacctggaccattgtttcttttcttttttaaggagaaaaagaaatgagttaaaggagctccacacttgacttgatttcatacccaagcctctgatgaccggccctgacctgtagagtggtccgaactgtgtggttggtttgagggagcgaattcggggagaggcacttggtgatataactcttgttttgtttaccgagtacctgctcgggcccggtaaatgctattggaatgtaatcccgtagtgtgtaatataaattccaccactatccaaccacagccaccactaattgtatgaaacttttatatcctaatttaaaagctgtgaaaatagttttcacgcactccaacccgattgtttataaagtttaaaccatttatgctcttatttaaagaagagctttgagctatttttttctgtaccctgtaaaatattgaaactaacataatatgttgaggttgcttgggaatgtacattaaacttaaattttctgaggatcgtgtgtttatgtttgagaatctgtgttttaactttgtaagtaaattctctgcccttgtatttatattttaccaaaatttttcttaaaaggccataaaactgttgaggaaagga

SEQ ID NO: 697285 - DNA, 555 bp, Homo sapiens
ccatggttctcatatacccatgtctgtaaaaagtgacatgagaattttgttgggttacattttattgtatttattagattcgcttatatagatgacttaggcagaaataaagtcatgtctttagaaggtgaacaagccaacttgtgatggcctgccttttgcttttggcagttgggatgagaacaattgactctcccattggttgttagatagttgaaatggtgcgttggtggtcatacttagtgttctaggctgtgaaatcatggagttcttccacttccaacaatgactcatttgttgttgtattctagtacacaatttagcagcttgatgtgtccccattctgatttgatttctactaaagtgcccttgtgtacatttgttttgtgatttaccgaagtgccccttgagtgtataatgactcccccagttagttcatgtaatccttgctttgaccattgttttttatctgtgtttagtagtaactgtgagcagaatcaaatcccattatgccagtgttcggcatatccctttaattaagtacatgccttggac

SEQ ID NO: 697286 - DNA, 332 bp, Homo sapiens
gctccttcagttccaaaatatgtgaacatccaagcttccttagccactatgtaaagaagcaaatacagtttctgagtatggggcacttagcagaacctctaaattattcacacaagtagtaatggggagggatgtttctataaaccaaaaaataaaaaatggtgactcatggaccaaatctggcttgccaatgtgctttgaaagctgagcatttaaaaatatattttgaaatcccttttgcaggacatgttctcctgatttctataatcctgatacttccagtcctcatgacttttaacctaatcactttacacaagtatttgagttgcctg

SEQ ID NO: 697287 - DNA, 161 bp, Homo sapiens
ctgtaggttgagacttacatcatgacagtgctgctgtggccgtgtgatggaagagcttttaggtctgtggtgtagtgtgtgtaacgggtaaagcttcatttctgcagtgctgtgtttcatgttgggactgaggggtctgtcggaagatctcccccaatgtg

SEQ ID NO: 697288 - DNA, 838 bp, Homo sapiens
  misc_feature (529)..(529): n is a, c, g, or t
  misc_feature (616)..(616): n is a, c, g, or t
agcggtcaaggctgcagtgagccaagattgtgccattgcactccagcctgggtgacagagtgagactctgtctcaaaaaaaaaaaaaaaaaaaaaaaaaaaaaaaaaaagggaaaacttacttacgcccgggttaccctgtgaacacaagcgttcgtgatgtggcattcactttaaattaccttcttgagaccaccccagtgtggactgagctcaagatttcccaaacagcttagttagaaaaacagagtgggttccgtgagacgtgctaaccacagattccaggcaagaacaaggaatttatttaccattagggactgaattaacctgattagaagggatgacttatggggttcccgtttaaaattattggctgattcgcctttagcggctccatattttcctgggattattaagggaaccccttttctcttttctctctgaaggcttattcttattaccttcacaacaattttaagggaagacttattgttttggtaacccggaaattaaacccctttattcttttnttcctcccccggttttacttccctccagaatttcaaaacactctatatttattttaaatttccatgggcaaatatagttactcggancaaaggttccaagtgagttcgtgccttcatagcttggaaacctttcccttattgcaacccaagggctttggactgggaaatgcccacttttgaaacattttcccttttaactccggcgtttgaccaaaatactttctaagatcaccagttgactttttatgacccaacgcttacagccctcttagggaaacgggcctggggacctggctacagagttcccag

SEQ ID NO: 697289 - DNA, 130 bp, Homo sapiens
gagatcgcgccactgcactccagcctgggtgacagagcaagactccatctcaaaaacaaacaaacaaaaaactagcgggtgaaatgattcagtgacctaaggacagccattgcactccgggggtaccgag

SEQ ID NO: 697290 - DNA, 291 bp, Homo sapiens
caggagggcatggggcctaggcctgaccactttggccccctgctggagcgaccaggacagtgtgctctctcctagggccagggtcagggcagagggcctcctccctcagtgtcaaggtctagggagcagtggggagaatctgccccaggatgtggccaccgaaggaacaggagtgtgggccagaggtcatcggggcccatggccacatccttcaggctctaagtctcaatgggcattgcatctggtctttgcagttctgtgagccaataaattctttttatagtttaaaaa

SEQ ID NO: 697291 - DNA, 190 bp, Homo sapiens
tttataccaagcatactatagcaaggactaacccctatacctactgctagtatgaagttatctagataatactttgcaaggagatccaaagctatgatccccgataccagactagctaccttagaatcagctagaacagcacacccgtctatatcgcatattagtgagaagattatagtgtagaggccac

SEQ ID NO: 697292 - DNA, 277 bp, Homo sapiens
aaagtttacaatttttttaatttactaaaattttatttaggattttagcatccttgtataaaagggccaaaactcccctactgctagtaagtaaaaagggggcctttctaatccacagacataaagtttcagtcaagtgaaatgggcaagcccaaaaaatttgctgtacagcattgtccctataggccccaataatgttttaaacccttaaaaatttaaaagggtaaaatttcctttaagtgtttttcccccaataaaataaaatataaaaaatcca

SEQ ID NO: 697293 - DNA, 444 bp, Homo sapiens
gttacagcctttctcaccctgatctgaccacacagcccttgcttctcagaacagcaatttctagttcatgggtgtagtcttccacaaaactctgtgaagggcaggggttcttggcctgaggtcagtggaagaccctgcaaggagcccaagaactgagatagccaagaaaaaaacgacagcttttcttgttctcaagctgacgtttgacatttccttccagttatgcatgttgtcaacagaccacattagtattagcaaaacctgtgactgttaccaatttaatcacagatactttcctcctatcacattaccactgttgcagatctctcaaaatagcataatttatgctcaccactgcttcaacattatgatagtgcttagacccactgcgagaactccctaattaatgccttaataaagaagcatgtgtgttgccaaattaaa

SEQ ID NO: 697294 - DNA, 229 bp, Homo sapiens
ccccccttccccaaagccatccctgcattgatatgtcttggctctcccgggtacttttgcccccccccttaatttttaattgggtttcttgtaaaaacagttttggacaatgttatctctgtgggaggaaggaggcaggctgtggtggggctgggtaggggatagtatccctcctgagttcccctgctctagaatctaacccgaaatagaaacctagtttttaaggtga

SEQ ID NO: 697295 - DNA, 229 bp, Homo sapiens
agtggcgtgatcttgcgcttactgccaagctgctgcctccgtgtagttcgtgcgatcctcctgcctcagtctccctagtagctcggattaccagcgtgtggtaccataatcagctgatttttgtatttttagctagatgaccgggttttaccattgttggccagggcgtgatgagcttcacaccgtgtcatcccggccacttttgggaggctgcaggcggttgccctca

SEQ ID NO: 697296 - DNA, 1175 bp, Homo sapiens
  misc_feature (1175)..(1175): n is a, c, g, or t
gagcgtgcctctcgcccgagtggtggtaaacaaggaccgtggagtactggaccgtgcagtgtatggatgagccagtgaagagccctggatcctgtcgtagtaccatgcctggaccgtcgtgtgagcggatagctaacttgtcgtggtctcaatgagagtcacgagtgaaaggcgactggagaagtctctatgacacattagtgtcgcctgtccactaaaagcgaggagggaatgccagaagtaccgtacatgtaattcccctgtacatcgccacgagagagtaggagatgccttaattgatcacaaaaagacgaggggattcgccgaagaaccgcatcttacgctcttggtaccacggagcgatctgagtaaggggatacgcgcgctgttgagttgatcatatcgttgagccttgggtcggaatccgtctaagggccagttgtggtcctcactctggacttcacgagtggcgttgacgtaatgaaaatcgtcattaggtgtacacgcgtatatgtcgcccgtacggggggactcaacaatggtgtacctaggagtgtgcacatgggacgaaaacagatatcgtgcttgtgttgtattgcgttggagacggtctgggttgggcgcatcgtcagcttttcggtatgccacaccaatgatgacgcctgggtttctatctgggaaacattacgctcatgggctgttattataacccaagagctctttttttcctggtgtatagcaccttggtgcttggcttgatagcgccctatttttcgcggacccgcaagtattcgaggcagtagatggacaccggggtctggccgatgaagggtcacacggggcagtcacccttccttttgagagtgtccctcagataaaacctgcctggtgcttgcaacaccctgttccctcgagtggacagccggacatcacttggggagacacgcgtggcataatcaaatcatgggccccaccattcacactacgagcaaacgaggacccaatcatcttgattgagcagacacactcactatgacggccgaccgcgcacccccatgtaaatcactctcatcagacacgacaacgtctcaacacacggcggaccctcgtcttctctactttactgcgagttattatctatctactgttcatctaccacccacacaccaaccgcn

SEQ ID NO: 697297 - DNA, 816 bp, Homo sapiens
agaaaaatgaagccaaacagtagagttgcaagacatggctgtatgagaagaaaaagagctcgaagaaagcagagaaaggaaccgcaagaacagaatgaagaaagtcagggggactgaaaggcaatgtggtgctggcaaaaagtgagcgtggagattggatcacagccgaaggagtacaggtgctgcaatgatgttagctgtggccactggtggactttcgtcgcaagaagcattaagtaaactaaaaactttcataaaaaaaagaaaaaagagactaaagaatgagggggggcgattcataagaaattctaccctcccagagaggagcccaaacggtcacacgcggtgtcaccccacgccattcttggacccagccaccaggtgggcccccaaaatagaagcgagaccgcgatatgtgatacacgcgagaggcacgactgcgacccgcccctgcgttcgaaacaaacagaccaggacgactggggctaacacacgttgtctgaaaagcttggggagagaaatccctctgggcagaaaaaggagcaccatcattatacatccttgagagggggtggcagaccatataaacttgggcggaacaaaaaagaactccgttacaaactaaagacctttgtaaagggcgcactagaacgggggatagaaactctttagacacatctttttgcaacccgtgtgccttataaccggagaggtttagacaaccttagaacgtgacgtaatctcccatctgggcacgtcgtggcacaaagaatgtgtggcatatacgcagaggagatattagcattatatatcaca

SEQ ID NO: 697298 - DNA, 317 bp, Homo sapiens
gtcgacgaaaatatcatcctgagtgaggtaacccagtcacaaaagaacacacatggtatatactcactgctaagtggatatctgccaaaaagatgctaggaatacccacaatacaactcacagaccatatgaaatccaagaggaaagaagatcacaccaaagtgtggatgctacagttctacttagtagggagaagagaataatctctaggaagtagatgagatagggatctgcgagggagagaagagggggtggctaaaattggggttagatataggaggagataggggagaaatacagagcagagaaggtcgacg

SEQ ID NO: 697299 - DNA, 728 bp, Homo sapiens
gggctgcgacagcctgggttgccggcgcccgcccgcccgctggcctcgcggtgtgagagggaagcacccgtgcctgtggctggtggctggcgcctggaaggtccgcacacccgcccggcctgcgccgcttgcccgcggcagccgcgtccctgaaccgcggagtcgtgttttgttgttttgaccctgctgtggctgcctgtgtgtgcgctgctggcctgagtgccttgtgtcggctggtggctgtggtgctgtgtctgctggctgtgagtgcagagtgaagcagggatgcgtggagctcttgcttcgagtgcctgggctgcctgcctatgtgaacttgggccctgtgagccccctgcacctggccgcctgccctgcgtctttcgccgtgcatgcgccctcgctccgcgcagtcagcgagccccgtcgctgaatgtgcgagctagttttggcggccttcaggaccgcctgggtggagctgtcgccttgtcaccgaaccatagagccagtcagctatggacccagctgcaggggtcttgggccagtgattactgagcgaaccacttggagggtgaatgaacgaacagtaatctgcaggagacatggggctcctccggagtcaacaggattcaggtttcttgtcgtagattcttccttgggccattgggacaggtaaaagaaaacgcttgagaaatccttatgagaacgaatacatttccctacgctcagaa

SEQ ID NO: 697300 - DNA, 583 bp, Homo sapiens
  misc_feature (135)..(135): n is a, c, g, or t
  misc_feature (156)..(156): n is a, c, g, or t
  misc_feature (480)..(480): n is a, c, g, or t
  misc_feature (541)..(541): n is a, c, g, or t
  misc_feature (559)..(559): n is a, c, g, or t
  misc_feature (573)..(573): n is a, c, g, or t
cctgatctatcctggtgatggccccactggtcactgttgtctccagtccacgtgcccggctctttgcctgttttcttaggctgggcactcagcaggccggacccctccaattgcatacaggagcctgctgcacancaagaaccactatgaggtgcntggtacttggtgggggagctggagggatcaccatggccactcgaatgaagaggagagttggagcagagaatgtggccattgttgaacccagtgagaggcacttctaccagccaatctggacactagtgggcgcgggtgccaaagagttgtccttgtcagtccgttccacactgagtgtgattccatccggagtgcagtggattcaagatagagtggcggaacttaacccagacgagaactgtatcccgcacagacagtggcaaggagatctcctacagataccttatcatcgctccttggaatccagctggactatgaagaagnttaaaggactacctgaaggctttgcttatcccaaatagggccaattactcagtgaagacanttgagaagacattggagncctgcagggtttcnaaggaggcat

SEQ ID NO: 697301 - DNA, 203 bp, Homo sapiens
aagaacatgggctttcagcagcagacaaatcccacttccaccactgactagctgtgtgaccttggacaagtgacctaatttttctgagcctgtttctcatttgtaaatggtgataatacctacctcatagggttgttgtgaggattaaaatgaggaaatgaatgtaaagcacttagtacagtatatgaaataatgggtattca

SEQ ID NO: 697302 - DNA, 108 bp, Homo sapiens
tccatgtgcagaagatcctcatcgtgggcattgttgctggcctggctgtctggctgtctagctgtctaggagctgtgatggctgttgtgatgtgtaggaggaggtgat

SEQ ID NO: 697303 - DNA, 154 bp, Homo sapiens
actgtccccacggactgacacgacgctcgtcctgctgatgggcactgaatggtgtccacgggttgtttgatcaccacgagatgttcttctatggcctcccaccttcggcgtgctcctgtactgacctcttctgtcccttccccttcaccgctcc

SEQ ID NO: 697304 - DNA, 223 bp, Homo sapiens
ccccccccctttttttttcctccttaaagggcccggggggcgttcccccccccggttttttttttggggccgggggggggtacctttttttccccggggccccttttttccttttggcccttttttggtgcccttttggccgggtttttgcgaaaaaccgggggggggcgggggggggttttccggggttttttttccccccgggccggccccgggggcccca

SEQ ID NO: 697305 - DNA, 621 bp, Homo sapiens
  misc_feature (117)..(117): n is a, c, g, or t
  misc_feature (191)..(191): n is a, c, g, or t
  misc_feature (369)..(369): n is a, c, g, or t
  misc_feature (435)..(435): n is a, c, g, or t
  misc_feature (538)..(538): n is a, c, g, or t
  misc_feature (592)..(592): n is a, c, g, or t
gtcccccgctgttctctgcggccgtctagggatggcgctcctgcctactccggaccatccctgcttggactgaaagcctgggcttcggcggggcgggcgggcagagggcggacggangcgcaggaggggcctggcagcagagaaacggtgcccgcggccagccccgcccctacctgtggaagcccagcacngcctcccgcggataaaaggtgcggagtgtccccgaggtcagcgagtgcgcgctcctcctcgcccgccgctaggtccatcccggcccagccaccatgtccatccacttcagctccccggtattcacctcgcgctcagccgccttctcgggccgcgggcccaggtgcgcatgagctccgncgccccggcggccttggcagcagcagcctctacggcctcggcgcctcacggcgcgcgtggcgtgcngctctgcctatgggggcccggtgggccggcatccgcgaggtcaccattaaccagagctgctggcccgctgcggctggacgcgaccctccctccagcgggtgcnccaggaggagagcgagcagatcaagaccctcaacaacaagtttgctccttcatngacaaggtgcggtttcttggagcagcaga

SEQ ID NO: 697306 - DNA, 131 bp, Homo sapiens
gcgccaggggtcgagcggaacagctgatcgcacggatacagcaggaagaccaggaggggccgcctacgtagcccctagctccagccatcctacccctctagctggggatcctactagtagtcgaccgtgca

SEQ ID NO: 697307 - DNA, 121 bp, Homo sapiens
agaagaaagtggatcagggaagaagaaagcttcatcaaagaaacaaaagacagaaaatgtcttcgtagatgaaccccgttattcatgcaactactatatatatcctttgataggataatgc

SEQ ID NO: 697308 - DNA, 187 bp, Homo sapiens
tctgtccttccagataggccacagcttaggaaggacacatggatcagagagagcctgcagaacagcagcaggccttctgcagctgctaacgggtgctctaggcgatccaggctcatttcaggactcagtttcctcatttttttttttttttttttttttgggtaaaagggttttttgtttttccttt

SEQ ID NO: 697309 - DNA, 488 bp, Homo sapiens
acatcgttgagtccaatattaaaaggtacgtctttaaactttttaagcttagggaaaatttctagagcaatggattttatggatgtggcattggtgaatgtacacttttggtatggtttaaatatgacacgaaatgtgtatctgtatggaaaattggttttatttccacatttagtaaccattctttattggtacctttctaaggtggtgtcatggaagtattacccaaagtcaaggctgtaaaatcatttcaaggacggcggttgaggctaaatagatggacatctaatttaaatacagaacataccttttaaacaaatgcaggaatgttattaatgccctggtctataaatccatctatattagaaaattaagactgggatttactattctacctcagcccttcttgtatatggaacctacaactaccaactcttcagttaccggaggataaagcattgttcccaacaaggtccaaatgtctcggt

SEQ ID NO: 697310 - DNA, 419 bp, Homo sapiens
ccaggcaagccaggggcaaggaaaagcagggcacagggaagggcaagggaaggcaaaggcaacaggaaaagaaaggaaaggaacaggcacacaggaaaggcaaaggaacaggcaacaggaaaggaaaggaagggaagggaagggaagggaacaggcacaagcaacaggacaggcacaccaggaaaggaaaatctgtgacctaattggaattttgaaaaggaatagaggatcatattttaaagactacacactaaataaacagaatatatcaaattatatatcttaaattagcagtaatgagtagcaaacttctattcaccacctgtaacttttctagatgcacctcccaaagttttaaccagatgtctcaattcatttttattaaaaattaacatgcatagtaaaaaaaagacaatttt

SEQ ID NO: 697311 - DNA, 198 bp, Homo sapiens
cgcttcgtctccggtctgtgtgtgtggactgtgtgcggtctgtgggtggtgtgcggtctgtgtgtgtggggtgtgtgcggtcttgtgtgtggtgtgtgcggtctgtgtgtgtgcactctgtctgtgtgcggtctgtgtgtgtggtgtgtggtgtgtgtttgtggtgtgcactctgtgtgtgtgtgacggtaggtgtct

SEQ ID NO: 697312 - DNA, 339 bp, Homo sapiens
gtccgggccgcctttgccatggctgccccgtgggtgtcatcgttccagttgggggagagttttgcgcttacggttgagtactttgcagcccttcggcccaaaacgggccaagacggccgacgtcggaccagcaggggacttgttaagaagttttgattagctgttaggacttggttgttgcagctcttgccattttgccaagtgcgcttacgcatattcggtatctgaaacctctagaacaaagttatcacagaaaccttccaaaggaggatttcaacctcctagctttttcatcctactataagggaaggatttgacagaaatgagtagccagaagct

SEQ ID NO: 697313 - DNA, 485 bp, Homo sapiens
  misc_feature (20)..(20): n is a, c, g, or t
  misc_feature (35)..(35): n is a, c, g, or t
  misc_feature (38)..(38): n is a, c, g, or t
  misc_feature (52)..(52): n is a, c, g, or t
  misc_feature (69)..(69): n is a, c, g, or t
aaaaaatttggaaaactggnctctgactgtgcaanaangggcaaccccaaantcaaggcacatggcaanaaggtgctgaatccccttcggaaaagctgttatgcctcacggatgacctcaaaggcacctttgcctacactgagtgacctgcactgtaacaagctgcacgtggaccctgagaacttcctgctcttaggcaacgtgatattgattgttttggcaacccacttcagcgaggattttaccctacagatacaggcttcttggcagtaactaacaaatgctgtggttaatgctgtagcccacaagacccactgagttccctgtccactatgtttgtacctatggtccactatgtttgtacctatgtcccaaaatctcatctcctttagatgggggaggttggggagaagagcagtatcctgcctgctgattcagttcctgcatgataaaaatagaataaagaaatatgctctctaagaaaa

SEQ ID NO: 697314 - DNA, 674 bp, Homo sapiens
  misc_feature (144)..(144): n is a, c, g, or t
  misc_feature (425)..(425): n is a, c, g, or t
ctttttttgtgaagtgtgcttcctgcaacgagcacgaacatgaacattaaaggatcgccatggaaaggggccctcctgctgctgatggtgtcaaacctgctcctgtgccagagcgtggtccccttgcccatctgtcccggcggngctgtccgatgccaggagacccttcgagacctgtttgaccgcgccgtcgtcctgtaccacatacatacataacctctcctcagaaatgttcagcgaattcgatgaacgggatacccatggtcgtgggctcattaccaaggccatcaacagctgccacactttttcccttgtcaccctcgaagacacggagcaagcccaacagatgaagtaaacagactttctgagcctgatagtcagcatattgcgatcctgggatgagcctctgtatcatcttgtcacangagtacgtggtatgctaagaagccccggaggctatcctatacacagctgtagagagtgggagcatacccaacggcttctagagggcatggagctgatagtcagccatgttcatccctgaaaccaaagaaaatgagatctaccctgtctggtcggactttcattcctgcagaatgctgatgaagagactcgcctttttggtgatatctgttcactgcctacgcaggattacattcgcaattctcgctccg

SEQ ID NO: 697315 - DNA, 465 bp, Homo sapiens
  misc_feature (174)..(174): n is a, c, g, or t
  misc_feature (217)..(217): n is a, c, g, or t
  misc_feature (224)..(224): n is a, c, g, or t
ggcctcgcaaaacgggcgttgcaacgggtcccaagacgacggcgcccgccggccatccggacgcaggcgcgaggcggcaagcgctcgcagcccgtcgccccggccgaccccgacggcagccccggtggagcgcccggcccatcaagatggagcaaaccgctttgagcccagcangtcggtggaccacgcggcagcacctctgagccggagggcaccnaggttanctcccagggccgtcaaggaaagggcagtggacgcctgcgcatgttcgggagcgaactcccccgaagaaggaccagtgaagacgtcaggggcaaggtctcgggggtccggaagggtgatcatcgatccccaagggacccgcagacccttaaaaaaatcacccacaaccctctggaaggtgccttgcaccgatcccttcccaggggcgaggtcggcaaagcaacatggcagagcagtcatagg

SEQ ID NO: 697316 - DNA, 860 bp, Homo sapiens
tggtagtcagctatttaattgggtccttaaaaattttaaaaccccaattggtgaggataaatcccatccgtcaaaccaaacacaaatcgcaggtagcccgtggagctgaggaataccttggattttgggtaaaatttggtgagctccacagcttctctgatcaatctggcgcgtgcccccgttaatctcatattctctcttttcctgggttgtcgaaaatctccacctctccggggtgtcggggctcccgacagcttcttctctctgaagtaagcttcagtaagatgttctggggattttacatggctgatatcgatttggtttcggaaggtggcaactgacaaatctttcgggtggtgtcctccgtagaggacctcgatggggggcaccaggaggtcccagtcacaggtattaggccatctagccgagctgcttcgaggaaaaccacccttcttgcccctgtggcgtccagtgccggatgtacccagagggtcccgggggtaatgctgggctcgcgagttttcctcccgtgctgactgaagggttgttgcgccggctccaaccagctcctcgaggcccattccttcgcgcggggatcacttctctaggcagtttgcgggggaggtttaaccccccggcgtacccgccgtcttggttcacccccacctggtgttccgtagcctgtttcgagagccttctccttcttttcctttcccactggatttaggggggaggaaactcctctcgaaatgcgcttctggaatccttggagctgggttcccgcgcttccttcgcaagagcgggcgcgccaaggggcccccttgggcttagttgggtccctttccctgcccgccactctg

SEQ ID NO: 697317 - DNA, 1296 bp, Homo sapiens
  misc_feature (977)..(978): n is a, c, g, or t
  misc_feature (993)..(993): n is a, c, g, or t
catgctgttaatatcaggtgatttcccccacccttttgtgccacagatttttgagccgggaacgacccctgggccaaaaaccggggaataagttgttgtcttaatggggggcaacccacccgcgtgtgtccaagactcctggggtaaataagaccctcgattggtaatacatacctgctttttccggaatggccaaacaccaacctggcgccacttcaccaagattaaatatatggaaaaatataatggttcctcgggggtaaaagaatttgaggtttcacgggattataaattttatgggaacccacgctggaaattccccccaggggatctatatgttaaaacaccacaaataagcccttttttggtttgtgtgtgcgcctcgtacaccaccagaggggaaatatataatgtttaaaaaggggaatttatatattttcctttggcccctggagagagaagattttcacaacgtttttaataagaaagtttttttcccccttgggggagagaaaaaccttatatgtaatatagaaacaccccccaatgggcccacccacaagcttgggccaccgtaatatttagatgttttgtcgcccccatgtcccagaggtcccatatgtaatcccaaatagtgtccttcccacatatagagttctcttgaaagaattttagatgggagagatatgttagaaaatacctttaaaagatatgttggccccataatatccacatagcccttatctcaggaacacccagatgatattgtcttttctccccacagatctcacaatatatataaagagaaaatatatagtgattccagagagcgcttgtgacacacacacaggcgctttatatttttaaagatataaaaaaataatatttgtgaacacatagggtgttcccctttatatggaaaatataccagtgggtgtatattagtgccatataaacacccaccgcatgccatttannagagaatataatatnggcacccaataaaaagatgtgtggcgtttccagaatacgcccagtgtgttccacaaatatataaatacgtccatattcccacattgtataacgctgtgtctcacgtgcctcttggtgtgataaatatttgcctcttgttcacagtgaagtgttaattatatctgcactttatacttttgttcctcagtgtttttctaataactaatagtgtattttcttaaaatatcacgtggaggataataggataaaataatgctttgagaagaatgtttaatagaaaatttaaataactttttttggcca

SEQ ID NO: 697318 - DNA, 432 bp, Homo sapiens
  misc_feature (275)..(275): n is a, c, g, or t
tgcaatgctggtgtactggccgatcagtatcacaatcgtcgctgagtgggccaggctggttttgaccttctgacctcaggtgatccgcctgccttggcttcccaaagcgctgggattacgaagtcaggagatcaagggattaccggcgtgagccaccatgcctggccacggttttttcaccattatagacgactaaaatggttcatttgcagctctacgttgaacgtcgtgaactaaccgactgacgacttgaaacctaagactatggactttgncacagtatacgacattaaactaaacctcttgactcttgactaaggggttactttgttgggtaacgctacttttttttgtggaaagcgtatttttgatacatagaaaataatcctcccccctttggttattttgggtctaaggtttattaccatcaac

SEQ ID NO: 697319 - DNA, 136 bp, Homo sapiens
gcggccgcctactactactactactgctcgaattcaagcttctaacgatgtacggggacatgggatttggcctttttgattaaattcctgctcccctgcaaataaagcctttttacacatctctcaagtaaaaaaa

SEQ ID NO: 697320 - DNA, 591 bp, Homo sapiens
acatgccgaacggtcgtttgccttaaagctttcgtccgcacgatacctttcggcttcgcctgccccgggttcgctgcgatctcctgaaaccatgccggtgcttttgcgaggttcttgttgcttttgtcgtgcatgaaccacggcgtaccctcgccggtctgatccttcatgtcgacgtgcagcatgtcggggctgctggtgtaagtgatgaaccggcgcgcaccacgcgaatacagttcgcggacgagctggccacgctctgcctcgctcatacccttcatagagatatccgacgctgtgccatcggcatgctcacccgggccgcctggcttcgcagcctctacgcgatgcgacggggagcgatagcccgaattgattgtgaaatcgcgacccatcgccttcgacgtctcggaaaggatcgaggcgaactgcggattgatcttatcctgaccggcatgcacgaagttcagcttgccgccggtgccgattggcgcgtcttccggctcgcggacgaggcgggccagccccttaccgttcgggtacgggacctttgtacccttcccttcatcgccctggagaagatcgaggtga

SEQ ID NO: 697321 - DNA, 486 bp, Homo sapiens
gggtcgtgtgccatggggcacgatctgagtgggccagtgtgggccaacgatgcaggtgctggggttcggccgtgatcctacatcatccgggggtgtcgtggccacgggtgggcgcttcatctcagtggtactttggtgcctactccattgtgagacgggcgtgtttgtgtgcttgtcgtgcgtaggtacctcccggcggcgaagaggaagaagggctccaccatgtgagcgctgagtggacagaagcactatgacctgacggtggtgagagactgcttcgcgtgtcccttgtaccagggaattactatgttctgggccggtcctgtctatctgcctgcctctcgtgatgcccgctcgagtcgttccttgctgggctcgccatccttgggaccggctgtcactggccgttgcgatgcgtgcgatctacctatctggcggctgtgcgtggcgagcagtggacgcccatcgagcccaagaccccgcgga

SEQ ID NO: 697322 - DNA, 554 bp, Homo sapiens
ctttaatacttgcccccccatcattgccggagcaaaaatgcttttgggtgaacccgtggtggaaccgacccttatcgcccccaattattgggtagatctgtcaacgctagtagtaattctcctctgagacgtaaaaatgttcttcaaagaagatgctacttaatgagtgacaccgacggtgcgcgcaacaacctgtaggggtaaaagagaggccttctcacccgccccagagagatgggggctttttccgcgaggcgccaaaacacccaaaaaaggtctttgccgcaagattcagctccagggggggatcgttctgccgcctgtccgaagaaagctcctggcggtggaaaacaacaaccggtcgactagtagtatctcactcctcgtgacaccaagagggtcgttacaaaaacaatatcttgccgcacccgtactaggacgtttctctttatatttttttaacaacttattgggggcggaaaactatattttgagaagctatttttttcccaaataatttaaaaaaacaaaaaaaatttttcccccaaaaaaaa

SEQ ID NO: 697323 - DNA, 154 bp, Homo sapiens
agtttccattttttaaatgggaattttcaatcccctgggcttgtttaacgtttgctttaaaaagtttgagcccctgtttctgtttgaaaatgcatgcatgtttcgatgaatttcccccctgaggaaaaaaataaaactcaaaaagctttgtgta

SEQ ID NO: 697324 - DNA, 124 bp, Homo sapiens
  misc_feature (87)..(87): n is a, c, g, or t
ggcctccatccgtcacgcaatgcttctaacggactcagcagatgcgtagcatttgctgcatgggttaattgagaatagaaatttgcncccttggcaagtgcacacacctcatgctagcctcagt

SEQ ID NO: 697325 - DNA, 194 bp, Homo sapiens
cgagactttttataactacttcagtctcattacgcaagtattggtctggttaggtttttccattttcttcctggtttactcctggtaggtcgtatgtgcgacatttattttaggttgtccaatttattgacatctagctttctattatagtctctaatgatcctttgtatttctattgtacctgttgtaactgg

SEQ ID NO: 697326 - DNA, 352 bp, Homo sapiens
  misc_feature (53)..(53): n is a, c, g, or t
acatctgtgtgggttttctccaactattctggtttcttcccacatccaaagantgtgcatgttaggtgaactggtgtgtctacatggtcccagtatgagtgtggatatgtgtgagtgtgccctgagatgggatggcggccctgtgcagggttggctcctccctgtgccttagctcccggataacttctggtcaccagtaaccttaactgaataaattaatcaaaaaatatcctggttttattaaaccaaggaaggacagctcccctttaattcaaaggttaaaaataaaaggggtttggttttaaaaattggggaaaattttggggcccaaaattaaccgtagggacttgaa

SEQ ID NO: 697327 - DNA, 734 bp, Homo sapiens
  misc_feature (33)..(33): n is a, c, g, or t
  misc_feature (120)..(120): n is a, c, g, or t
  misc_feature (142)..(142): n is a, c, g, or t
  misc_feature (152)..(152): n is a, c, g, or t
  misc_feature (171)..(172): n is a, c, g, or t
  misc_feature (190)..(190): n is a, c, g, or t
  misc_feature (192)..(192): n is a, c, g, or t
  misc_feature (202)..(203): n is a, c, g, or t
  misc_feature (208)..(208): n is a, c, g, or t
  misc_feature (212)..(212): n is a, c, g, or t
  misc_feature (220)..(220): n is a, c, g, or t
  misc_feature (230)..(230): n is a, c, g, or t
  misc_feature (237)..(238): n is a, c, g, or t
  misc_feature (256)..(258): n is a, c, g, or t
  misc_feature (261)..(262): n is a, c, g, or t
  misc_feature (268)..(269): n is a, c, g, or t
  misc_feature (276)..(276): n is a, c, g, or t
  misc_feature (289)..(289): n is a, c, g, or t
  misc_feature (291)..(291): n is a, c, g, or t
  misc_feature (300)..(301): n is a, c, g, or t
  misc_feature (311)..(311): n is a, c, g, or t
  misc_feature (313)..(313): n is a, c, g, or t
  misc_feature (315)..(316): n is a, c, g, or t
  misc_feature (318)..(318): n is a, c, g, or t
  misc_feature (320)..(321): n is a, c, g, or t
  misc_feature (325)..(325): n is a, c, g, or t
  misc_feature (327)..(327): n is a, c, g, or t
  misc_feature (339)..(340): n is a, c, g, or t
  misc_feature (357)..(357): n is a, c, g, or t
  misc_feature (375)..(375): n is a, c, g, or t
  misc_feature (383)..(383): n is a, c, g, or t
  misc_feature (393)..(394): n is a, c, g, or t
  misc_feature (409)..(409): n is a, c, g, or t
  misc_feature (419)..(419): n is a, c, g, or t
  misc_feature (423)..(423): n is a, c, g, or t
  misc_feature (437)..(437): n is a, c, g, or t
  misc_feature (455)..(455): n is a, c, g, or t
  misc_feature (462)..(462): n is a, c, g, or t
  misc_feature (465)..(465): n is a, c, g, or t
  misc_feature (472)..(472): n is a, c, g, or t
  misc_feature (483)..(483): n is a, c, g, or t
  misc_feature (486)..(486): n is a, c, g, or t
  misc_feature (508)..(508): n is a, c, g, or t
  misc_feature (538)..(538): n is a, c, g, or t
  misc_feature (540)..(540): n is a, c, g, or t
  misc_feature (551)..(551): n is a, c, g, or t
  misc_feature (581)..(581): n is a, c, g, or t
  misc_feature (585)..(585): n is a, c, g, or t
  misc_feature (597)..(597): n is a, c, g, or t
  misc_feature (602)..(602): n is a, c, g, or t
  misc_feature (605)..(605): n is a, c, g, or t
  misc_feature (672)..(672): n is a, c, g, or t
  misc_feature (692)..(692): n is a, c, g, or t
atccacaaattaagcaactgtttcttatgaagngcatcattttcctggttggcctgttcatccagtgactttcttatacaattctttaattcttcgattccttctccagtaactgcaganatggggatgatatgttggaacnctacagtccnctctggaatcatgtttttnncaaaaaaatgcagaaaancnttaggattcnngagcnggcncatcaatncaaggaactnatcttgnncatctggcaagcccattnnnccnnctgccnngcccgcnggcctcccctgangnccctctttnnccaattcccncncnntngnnagcngnattaggggttcnngagccgtcctgtgttgngtgtggggggggagctgnattccagntatttcctcnncgaggggtggttgtntggttctttntttntggttggggggttngggggccattcctttgtncctatgngcnccttctntttgtcccggnagntcagctactgatatctgtttgngatcactgtacattatctttccaagttcangntttaatgttgnaaatgcgtaatctgcaattgcaggttttgnatgngaaacacaactnagganagnggattttccagcatttgggagtcctactaggcctacatcagctataagttttagatcaaggtgaatnattcgtttctggcctttcantggtaagaaatttgtaagtgatttaccaccaagacctccttg

SEQ ID NO: 697328 - DNA, 151 bp, Homo sapiens
  misc_feature (43)..(43): n is a, c, g, or t
caacaccctacgtaaaggcgatgagtgtggagaggtacggagngtgatttgtatgttcaaactgtcatcttatttacacgttggtagatatggacagtagtcagattgaggaggagtagattaggcgtatgtagaagtcgaggttatggag

SEQ ID NO: 697329 - DNA, 234 bp, Homo sapiens
acaagatagccagcaggtacgtctacttcattatctgaaggctgacttcatttctttcagaatcctttccagtgtgggagattctgtggttaaagggaatttttcttgataatcttatcaagctaacttatgcctatgattgaaagtatgggctctttccttctgggtggatctccctgacttaagtaggattaagttctatagaaagggatctatcgaagtctaaagaaaggg

SEQ ID NO: 697330 - DNA, 328 bp, Homo sapiens
  misc_feature (2)..(2): n is a, c, g, or t
ancgggtgggggcacaacttgctgctactcacaggcctgcctgcttccgcagagcccaccgtgcccccattgccgtgttactgtccaactgcctgcatcccatggttctctttcaaagaggtccagatcccagggagggcgcagggctaaactccagtcctggttctgtgatcctttacctgggaccttccatgacatctggactaattccttcactgcttgcatctcagtgtctttttttcctcattctgtcacccaggctggagtgcaatggtgtgatcttggctcactgcaatccccacctcctgggttcaagcgatactcttgc

SEQ ID NO: 697331 - DNA, 126 bp, Homo sapiens
ccagtgtatatttgccccttcctgcccaaaatggttcacatacctgactcaggcagagcaatgacaccctggcaaatcattccctccaggttctcacatgtgcctcataccagccccctgttgaag

SEQ ID NO: 697332 - DNA, 912 bp, Homo sapiens
  misc_feature (2)..(2): n is a, c, g, or t
  misc_feature (4)..(4): n is a, c, g, or t
  misc_feature (447)..(447): n is a, c, g, or t
cngnacaaagagcagataaaggggcaagcggagaggcaggagacgacagacgctactgcctcagcgtgcagcttttatccggcttttactcttcacgctctctcatccactatggttcccctctctaggccgcttcgaactggtcccacatgcgcttcaagttagagaaagctgtgttccccgactactgagtctctggccccaaactgcacagcccctcaaaccaagtgggtgcccacgagtctccaccacactttctctctgcatctctggacagccgatggtacacgagtccggataggcccattgtcctgccgtggtgttaaaccacaagtgccaaggcgttgttccacagaaaactctcgcccccataaacccctactaattctgggagcacatttacccacaaaacccccattctatgcaagtgtcccgcacatagacccncttgcatcctcgaagaccacagtccacccgtagaattctttcataatctctgcacaactgagctcgttgcacccctggtttccattcgaattactcggaccacccagcatgttcccgctcaatatagctcgctcatgtgtccggatatacatcaattcatgccactagaaaggtttttttcattgcaaacgtacactcccgttgttgcctgagtgagaacatcttgtgatcagtggcgccctggtgacttccatgagactactcccacttgaaaggtgtactcccctattcctcctccctctggaaaagtgttgaggaacccagtatgccaccctgaggtagagacacccccgagcggtctgaccccggggactcacaaaacattggcgtcacattttgtttcccgccatttccacctcacgccaacaacaaacccaacaacataacggatccccttcagacata

SEQ ID NO: 697333 - DNA, 517 bp, Homo sapiens
ctgagatccaccacgtcccaaacggtaacctgctttactccaactctactgatctaagtgttaatctcacctagaaagtactttcacagaaacagctagaacaatctttggccaaatgtctgggtactgtggccttggcgaattgacacataaagtgagccatcccaggggccgtaagcaatggcgcccccaaaggaaggctccgtgaatgtgcaggagagcaaaatccttgatgtgagacctgagcggaaagttgagcaggtgcagcttcaagaaaggaggctgagaccggcaggcttgtctgtgtggaggagaagcatttgcagatggtgcgtgtacacagagcaacacctgcagaaatgcagggaggtcacaggtgaacgaggtagtgtcatgaaaacctcagtccttcccctatggatgtgtgaacgggatgccacctaaatagaatttctaaagagatgttttccattttcttttttgaaataaaaagaagtatttaaattcacatcgaaaa

SEQ ID NO: 697334 - DNA, 1111 bp, Homo sapiens
agcgtgggtgggtgctgcgcggaggagcgaggcgcttgctggggtcggggctgcgcgacggcggcaggggctgcggggagcgccgcgcaggcctgtgcagttcctagctgatggagtgcgcctgcctgccatttgcctgctctctctggtgagctgcagccccgctctcctggtgccggtgccttctgctgggccacctggcggccgatgggccatggtgctggcatcacctccgtccaaggacctgtgcttggtcctttcgtcaagcctcgatctatcatggtggtgggcaggcttggccatttttagttgcgtattgtgaggaaggccatattgtacttcaagtcagactttactgaatgaactaatgacccactttccttttgagcagatagtgtagcacggcgtcagatcccgttgctgttaggtgactcagtacgctttgtacggaatgcaccatggcacttttgccagtcaactttgggggcctaagtttgggcatggcttgttgcccacagagttcctggagaaacagctccggcgtgctagggaccgtttggcccgacaggagtcgagggtcagatccgagtcacagtggcatccttatgcggtataaaagggtacaccaagggacaccggtcagggtcgaggtacaggtaggggtagacgggagcactagtgggttgtacaccacggaggtccaaacaaggcgctagaggcaaaacaagttcggaaccgcggattcgacagtacacgccaacagggcagcagagccaaggagacaagacagggtagggttaggttaaaagggacaacgccgttagcgcaaaaggtgggggtgaacgaaccgccaacatagcccccctagtggaaaagattgtcccctttagtgcgagtaaggaggccccgggtggggggcgcattaagtttcgggggacactgctctagtttcgagttacacgcacggggacaggggaagctagagtgcgcgatttggacgggaagttgtcggggtcatcgtgccttggagggagacaaggatatccagcacgcgacactagctgttaagccgtgtccctataggaacactgttgggtgtctagtacaacaa

SEQ ID NO: 697335 - DNA, 675 bp, Homo sapiens
ctgcgcgtggttgtctcctgttttgcatgcgggcgtgcatgctttcccccgaggctcgttggtgtggtgtaagcgcgggtgtaacctctggattactatgcgcagtatgggtgcgtgaatgcgcggatttctctccctagtgctctcaagcattgtccggttatggactccaggttgtcatgcagtcctagccagctcatgcggctctctctttctgacattcactctttgtctgacattagctgtgtgcaagtagtggtcctttcatgtgctctttgtgcactgcattcttgcgtgtgtagcctgttgcccttcggggttctctttgagataccgttgtggcatatggtggccctttgagctggtctggggctatgttctacccgtatgtggcacggtcatcacccacgttctcggggattattgtattccgctctagaggttcgtgtctagtgtctctcatattttcaatcgcgccctctcgctcctcgtgcgtctcactgtagcgctcttggctgtgtttataccccttttgtatcaagtgctgtttggtcctcttttgatgtgtgttgatatcttgtatatatatatatctatatatagatatagagagagagagagagagagagagagagagagagagagagagagagagagagagagagagagagagag

SEQ ID NO: 697336 - DNA, 1385 bp, Homo sapiens
ccccttttttttttttgttcaattatcacaatgtttattgatagatacaagttatataaaatcagggcatgaacatgatctttgattaaatttaagttaaacttaattttcaatactattaattaggagggaccaatttcaaatttctcaccatttgtgttttctcacccccaaaaaaaaaaaaaaaaaaaaaaaaaaaaaaaaaaaaaaaaaaaaaaaaaaaaaaaaagagagagggggggcgcgacaccagagagatttcctcccgcggggggcgccccaaaatcacgagcgcccccccctttttgtgatcacaaggggggccccctatatacgggaggcctcttatatatatctatacgccaacagagcgcgaggcggcgcgcggcaaatctatataacacacacgcgcggagagcggcgggaaacacaacgcggagcaatcggcgaagagacacattagggaaagaagagaaccactcattatctctgagcggggggggaggccacaacataggggaggaccaacaactcgcccagccgacccgtatatataaaggacccccaccgacggcgcggaaaatatactacagaagcctgtaagagcagggcgataactcccgagggcgtgacaccccaccacaaccgccacccacttatatacacccggccagacgcgaagcaaagacacgaaaccagtaggcgcggccacagccaggcgggcccatacacaccacacacgcacagcacgaatatcacttatcaatccaccgagggggaccaagacgcagcatcaacagcaaaacaacaccagagcagaaccacccaaaacacacagaacacccaagcgacccccgcccgagaacggacgccaagacgagaggaaacaggaagacgaagggagcgacgaagagcggagaggggacggagagaacggaacgcgaggagcgcggcaggcgcgcaggaccagccaggagagagcagaggagccggagcagagcgagcggaaggcgagggcggaaggcgcggcagagaaagcacaccgcacacggaggcgcgaaggaaggccgagcgaagccccaaagacggaaagcggcggccggacacgcccgagaccgcgggcgaaagcagagcgacgggcaagagcggaacggaccgagacggaagaggcgacgacacaaggcagcagaagacagacagcaagacaaagggggagagccgacaaccgatgcgagaccagcacacgacagcgagcaagacgaaggccgacgcgaaccgacgcggacaagagcaggagggaaaggcgagcgaggagagcgggcgacagagacacagcgcgcgaaagagccagacacggacagcaaaccagccggagcagcaggccg

SEQ ID NO: 697337 - DNA, 134 bp, Homo sapiens
  misc_feature (49)..(49): n is a, c, g, or t
  misc_feature (106)..(106): n is a, c, g, or t
  misc_feature (113)..(113): n is a, c, g, or t
aaaaaaaggtaattttccagggaaccctgcccagattaatactgtgggnggaataagagaatcaagccatcctcaagagataacttcataaccagaattgtctgtnggttagnagctgtcacagataggcaggg

SEQ ID NO: 697338 - DNA, 549 bp, Homo sapiens
  misc_feature (59)..(59): n is a, c, g, or t
  misc_feature (70)..(70): n is a, c, g, or t
  misc_feature (144)..(144): n is a, c, g, or t
  misc_feature (409)..(409): n is a, c, g, or t
  misc_feature (411)..(411): n is a, c, g, or t
  misc_feature (431)..(431): n is a, c, g, or t
gcactgaatgtggctactgctgtatgctacggatatacacggcaaccattgcctcaggncgctgccgtgntggggccagaaaatgcattgctgaccacggtggttggggatgggatgatttttctcagcaacgtcgacgcgccncaggcccttaaagtctcttccagcacagtgtcctgcgcgctgcaactcgaccttccggagcaaacctataatggcaaattctacgaaaccgcttcggcggtctgtcggtgagatggcccgcatgaacgagtggcgtatcgggtgcctcaaaggcttggggctgttgtagagctgccttttactggcagcgccggcaagtgctgcgaactgccgcctgtccctgagccagcccatcatcgattacggcctgcttcgcccaggcgancngctcgaaaatcggggtgctncgctgggaaagcgtatggacgtctgaacgtgatctgcgtggaggctgcggtgattgcgctacgtattccaggcgtgccggccaatgagactgggctacaggttagggccggccaggac

SEQ ID NO: 697339 - DNA, 490 bp, Homo sapiens
ttgccggggcccgatgggtagtatgggatagcaccagccagcttccaccttttttggactcttgtacgttacatggtcggggtgctaaccagaatgaagactgtgggggagggttccctgctcttgaaaaaatgcttgtcaaaagaagtggctcacgcctgtaatccccaccctttgggaggctgacgcagttgcatcacttgaggtcagggggttgagaccatttctgacaacatggtgaaacccccctctttactaatacatttgccgggccgtgtggcccattactttaatcccacctacctgggaggcttaagcacccacaatctcttgaacccactggtgacacagttagactttttcgtccaacaacccctccttagccacatcattccttttccgccccctttgcccagtccactcttaatctgcaccacatttttgtcttgccgccccaattttagcctcctttggcctccccccttttggc

SEQ ID NO: 697340 - DNA, 208 bp, Homo sapiens
  misc_feature (70)..(70): n is a, c, g, or t
ccgagatgcggtcacggcgcccgaaccgtcctcctgctgctcttgggggcagtggcctgaccgagacctnggccgggctcccactccatgaggtatttcttacaccgccatgtcccggcccggccgcgggggaggccccgctttcattgcagtgggctacgtggacgacacccagcttcgtgaggttcgacagacacgccgcgagttc

SEQ ID NO: 697341 - DNA, 111 bp, Homo sapiens
cttgtgtaggctgtaagggcataaaatttaggtttacacactgagggtaagacttagtcagttgcatgtaatgttcatagagtacaaagggatatcaacaaaatgatcttg

SEQ ID NO: 697342 - DNA, 86 bp, Homo sapiens
gaaccaacttcttcattcagctggtgcggccggtgtggcccagcccgaggacaccgtgcagttccggatccccatggaaatgacaa

SEQ ID NO: 697343 - DNA, 376 bp, Homo sapiens
  misc_feature (109)..(109): n is a, c, g, or t
  misc_feature (113)..(113): n is a, c, g, or t
  misc_feature (198)..(198): n is a, c, g, or t
tttttcttctccccccccctgttcagaggggtttttttccccccaaacggggggtttttttattgtgtgtacccccccccccttcccaaaaggggggggggggggccgngggnggtttttttaccaaggcgttttttttttccccccggtttttggggggggccccccccccctgttttttttcctccaaaaagaacngggggcggtttcccccccccgcttttttctttggccgggggggggggttcttttttttcccggggcccccctttcccccttggcccttttttggggccctttttaccccgtttttttccaaaaccggggggggggcggggcgggttttcccgggttttttttcccccccgggccccca

SEQ ID NO: 697344 - DNA, 507 bp, Homo sapiens
  misc_feature (53)..(53): n is a, c, g, or t
  misc_feature (128)..(128): n is a, c, g, or t
  misc_feature (130)..(130): n is a, c, g, or t
  misc_feature (191)..(192): n is a, c, g, or t
  misc_feature (365)..(365): n is a, c, g, or t
  misc_feature (506)..(507): n is a, c, g, or t
agagggggggcgggcgccaccacagagggggcggcccctctcccccccacccnaccccgcggcgtgtgtggtggggcggcgtggggaggggagagaaactctcctctctctcgcgcgcgacatatttntnttatttatatataaatataacaccggccccgccccccaccaaaagagaagagaaatataannaagggagagaaacccccccccccgccgcgggggggggggggtgggttggtgtggccgccccccaccattggggggagaaaaaaacaaaaaagggggggggggggggtgtgtgttgaaaaaacaaccacaccccgcctttataaaaaaaaaaatgttgggggggccccccaaanaaaaagaagggggggtttttttttttttctctcacccccacaaacacaaaaagggagaggggggggggggggggggcggagaaaaaagaaggtggtttgtttttttttttccccccccccacccctcccccttttcttctnn

SEQ ID NO: 697345 - DNA, 902 bp, Homo sapiens
cgcgcgtcggccttcctgaacaccttaggctggtgcgggctgcggcaagaaagcgggtctgtttctttacttcctccacggagctcggcacactatgcgctgccctctggtctcccagaatccacaagcatgcaacgaaatggtgcatacccgagctcaagcctgggccttcgaatccggacacaaaaccctctagcttggcaaagtgaagtatgctgcactttacaaccactgcactacctgactcaggaatcggctctggcaaggctgaacgctacgaggaaccagacctcatcagcccaacatcaaagacaccatcggcaacagcagcgcccgcagccacccaccccagcaccgtgcgacttccatcttcatgtgccagccccctgcggccggaacggatgaccatccagtcacgcacatcatcctcagtagctgagctccttccagcgggcgatgaccgccgttccccgagcaccttcccgtcgtatcttcctgttgtccatcctttctgctctacttatgcttacctgagcctatgcctgtccttgtcgcttgtgttgcctgagagacttcgagagcgcgtccacgatttcctgttgttccccccggtcctctttctgagattctaagttttgcacctaaagctcagtttgccacctggcttgcgaagttctggcgggacgaacgggcctttgacgcttcctcaggttaccggagattgttgccgttgcacgtggtggaagccaaaccttgggcgctaagcttgcccttggtgccggggaccccggccccgggcctttccgatccttggggcccgcggttgccctgtggtcccgcccggctttgctgttgcccgaagggtccttcgccctttgcccctcggctatagtctgtgagac

SEQ ID NO: 697346 - DNA, 1539 bp, Homo sapiens
gcgcttgctcgcgcaaggctctgcctggcgcttcgctctgtctacttcacgacggcagatggctgcgtttcccgaactcctcagcaagtgcctctattgcctcccgtatgcccaaggcttggcagatgcaacttggacacgaatttccgattcacttgcaacactctggcttcccgcgcttcaagacgattctccttgcctcagcccttgcggaggtagtatgggacttaccacgtgttacaaacgactcactgcaagcttggactgcgctccttgtctagcacagcacaaaattacacttatgcctccttcaacagacatcacacaggcacacgaaaacagctgtttaatacacctttagttcatccaagcaagctggaaccttgttcaaaatgagctctaattgagcgtttcgtcccaccaaaggattcctgaaaccgagcaacaagccaaccagacacactggcacatatcacaactgacaacacgagaacaaacaaactttgacacctcacgcccgaggttttaaccgtgacacagccaacaggaaagtctaccaaccacacaccagcacccaccagtgaatggcaacttctcacgtggaactggtttgcccttattcacaccaagggtttgagccacacatttggttccaggaaacgcacacctcccattgggcaaggaattaacatggccacaaaacactttttcaaagcctaagctctactacccacagggcgtttctggccagggggccagcgctaagcacggaggccttggcacaagaagtcctccacttggggacacttccttcccatggttgcccacttcacccaacttatatcctttgcaacagcaacgcaagcaaatctcggcaaggacacaaacccaacaaggaaaccttaacgttggacacaaacaagctggcacatatacacccaaaaacacctggttgtcgcaccaacgacagcttaccatgcggaccgttcccccttccaccaaacaagcacactcccaccgctcccatcccttcgacacgactcattgtgcactagcccttcgaacacaggaccccactccaaaaaccctgccagcccattacacagaaaggacacatcggcccctcaaccaaggaaggccaccaaccacatccgggccaatctgggaccggcaaacccaaatatacggggcaccgaccacaaacatcaggtacaacatcatacttggcaccagataaatccagcatcgaacaacagtggccaggccaccgccacaccaaccccactctccgccacacctacacgctcaacccaaagcacactataccaagcacaaaacagacgactctaggaccgcacacatcaacccaacaaccgaccacgacgccatcccacgaaccccaactaacggagcacagaggaactaacacgcacgcacatgaaacaacaacaaccagctccgagacaaagagcgaggcaaaacaacaaacacgaccatagcaacagccccaaaacatctagcagcacccatcactagaca

SEQ ID NO: 697347 - DNA, 103 bp, Homo sapiens
aaatgagctcgaccgctattatcggcactcgctttttcatcggcacttcgttatcatcggcacccagtgctatgtttgtctctttggccggaggtgccgatga

SEQ ID NO: 697348 - DNA, 456 bp, Homo sapiens
gtgactctgaggatcccgggatgaggaacgtcactttaattttgcacaggaagtaaaacaaaattggggtcaaataaatataattacagtaaaacacatattcttatacatagtaagaaataatgcaacttactattttatagttaaaataatttatatgttatttactcaaatcatacgtactgtataatcaacgttaggagagaaagcatcaggggtggatagtcaatgatctgggattcacagtaatttcagacagactggcgactggtcaatccctaaattccagatttcaataaaagtgatctgctatatgggattaaaaataataaatatgtatgatatgcagtattacttaggagattacccggagatgatccaagaggaagcccctgacagtgggtcaagcactgagttctcgtctcatctcatctcattagatggttactaataacc

SEQ ID NO: 697349 - DNA, 158 bp, Homo sapiens
aggtgggcctaataggaggtattaatcatgagggttctgccatcaggaatggattaatatgattatcaaaggaatgggttaattatctcaaaaatgagttgttataaaaaggagttggtcccctcctgctctcttgctctcaccatctcttgcccttc

SEQ ID NO: 697350 - DNA, 258 bp, Homo sapiens
agtggaggccagcagcagctacaacatggtcatacgagaggacacccagaccacagcgcccgcaggagggggcgtgacacctcttcaagagcatcgggaacaacagatggctgcgcaccatctctgggatccagtaccccaacaagcaagatctgctcgctgagaacgtccttgcgtgggaaatcgaagatcgcaggactcactttcccagcaattagcatcgctcacactcactccatgtaggatgctcactcccgc

SEQ ID NO: 697351 - DNA, 177 bp, Homo sapiens
cggttatcgagtgaagggagtatcactcacctgagctcacatagtctaatagaaaacaaccgaaaccaaataattacaagcactagcttattacaattttactagggtctctattttaccctcctacaagcctacagacgtacttcgagtctcccattcaccattatccgcacggca

SEQ ID NO: 697352 - DNA, 246 bp, Homo sapiens
ctgtaggtgctgtcactgtgatggtagtttctttgctgtgcagaagctctttatttaattagatcccatttgtcaattttagcttttgttgccattgcttttggtgttttagacatgaagtccttgcccatgcctatgtgctgaatggtattgcctaggttttcttctagggtttttttcaatatatggaaattcacatttcgcttgggaacatgaaggggaagatatacaaaaggaaaactagat

SEQ ID NO: 697353 - DNA, 701 bp, Homo sapiens
  misc_feature (129)..(129): n is a, c, g, or t
caagagactgcttatatattcttaactagcttctgggtcctaatgtagacctcactaggtgcataaagatcattaataaacgcatgtacgcagcttgcgtaattggtgccttaatgctctgaatctaantcagaattgcagacctcatgagtccatctgggaagaaagacactgtccgtctgtggcacgtgtgagttactaggcccaggtgggaggagtctgatacaatggaagttctttatgtgtgtcctgtgctctcagaaggagatacctgatgtgttcagaagcaggcgtatgtaaggctatcaacattcacgtatttcgtgtcgcaatctagaacacattattagatttatgcctgtttaatgcataagtggtgcagagataatacacacaccacatcgtgattcgatggctttttcttccataaagttgcataatggcttcttgatggcgtagtgttattggcaacaagagtcctttccagggctccctgaataatctaccatacctgtatccatagcaggtgatgcttgttttgtgatccccactttgaagacgtgtgtatctgtatttaccttaaagtcatactatggttattaaagacagcagtgtttgaacccgagtgtgaacactgtaggaagtatgttggaaaaaaggaggagtgaactgtgcgcattaaggggggaaggctatgggag

SEQ ID NO: 697354 - DNA, 193 bp, Homo sapiens
gtgtgctcggattactgtgtcagccaccgtgtctagtcatggctttgcaatttgctggataaaaaaatgactcttaagggaaactacatgtctttactcaaatatattcttctttcctctggcacattattgaattaaaatagagtatttttcaggggccagcaagagtgtaatcggcgtatgatgaagcttg

SEQ ID NO: 697355 - DNA, 1198 bp, Homo sapiens
  misc_feature (516)..(516): n is a, c, g, or t
ccagtgcgtgttgacgcgtcgttagtctcgtcgttctctcccctctcgcagggtcggtgttgtttaggttgtctttccttttggtgcgccatcgtcggagcgtttgtggcttgtggtgtcttccaagccttggcacccttcactgttcccgtcgccagggtttgtatcgcgccggtgatctgtgggtctccctggggtcccctttttccacagggtctgcccacagtagtggttctccctttttgggggccccaccaccgtgcccaccgccgtgtcggctctttcgcgtcacagtgccctaggcccccgccttccgggccggcacctagggtttgccgcatggcccggtaaccccgggacgcttgctcgcccaggagctcttgcccccccagcagatcttcccagcgaacctgccaatgagggaccctgcgagggcgccgcccgctccctttgctgcgccctgccccctactggacgctgcccctgcaatgctgcccagcccactcccggaggaantccggaggccttgagggtgaccccacccttggccttttgggaactcttcccttgtgtggctgccccccccatgcccgcatagctccctgccttgtcctgaccccctggttctgcttaaagacttccctcttcacgactgctgggacgattcgccccaggctggagactggccccgccttggtggcctcgggattctggcccacataccctcctccctctggggtgatagggaccacagaggccccccgcctcgttgagcactcacagcctcgctttcttcccctctctgcggctttcacctcgctgaggtgttctgtgttctcccctcgggagaagcctcgtgccacgcaccctcttgaggcctctgggcccccacctgagggcttatggcctcctctgcctcagggatgggctcccacccctccccctcgaggatgtgcctcggagttcaccgcccctccttgtttgcctctttggggctcacaagcccttctcctaacctcctcggtgaatggttttccaccacggagaccaccacgcactctttcaccccaagatgggtggcacccacacacctctgctgggaacttggattccccggggcttatcttcttccagtgtggagagggcccgggtccccccctctgctgtagcttatgaaattaactaattggaaattcca

SEQ ID NO: 697356 - DNA, 895 bp, Homo sapiens
ggttagtaccggtgagtccgtggttggcggtccccatctggttgcgaaggctgtgtggtccggagaacccgagcccaaggagtgtggagcgtccccggagcgaggtccacatttccctgtcccctgccacaatgaacttgtccacatccgtgataccctggtgatgaccctggacatgggtgtgttgatctagcagtaacacgaagaagtgggccccgaaagagatgcaatgcacgtggttccccaaatggatggaggagctttagacgcttgatagtacgggatgcgtctttacttctattcgcgggtcgtaatggcagcaggattgtccccgtgagactttagaatgtatggcattctctgacctactcattcttatagccgttataatatctcccagtggactatcaggaagactgctccagcttggtgactcgacaagtatgtctctgaatccttgcacttgtgtcagtgggagaccgcatccgaggtatgtggcttgactccatatctacagtgcgcagtgtgtggagctgggggttgaaagaagtccccctgtgccctggtggagtccggaactgtgctccgtgatgctcgattcagtatcccagaggtggaacgtcctagtgttcgttctcctggacctttcttgctcacgcccggatcttggaatgaaggcattcgaaacctcccaggtctcgacgggaagttcattgtttggctgatgtgccttttccgaagctgtggcactaagggccccaggagttccactagggccaacccctgggttttaaaaccaagtcgcacccaatgactttgttcaacctattaatccagggccccgggccggggatggtcccaaaatcgcttggagcaataagtccgcccccaacaa

SEQ ID NO: 697357 - DNA, 774 bp, Homo sapiens
ggatgaaagagttgtgattggaggacagccttgatgatgccaagtactgtgggcggctctatggcttacgccacaggagtgtgcccagaatgcaagaatgcaggatgtggactctgcccaggagaagatgagctatcctggatgattatcaacgaacgatgctagctagtagataggttgaccagtgctctgccagtggtggagccctgaattccaacagtggtgcttcattgtgctgacggtgctacgtatctgctcccatagtagacacactgcgttcttttggagcaccactgtgacctagcatctgcctggacgtccggaagactttggtcatactgaagacataagatgttggattcttagaacccagaagagaggagctctgcgtcgtcgaatttgtaattaagttctgccctcatagcctctattaactcgcagcactctatctctcgtggattgccgtcacttgtccaatcagcccatccatgggctccatattgacaacattttataaactaatcaaggacccaagatcgtgaaaatcaacacgctaaagtaccccaccttcgttcttctttcaccgtcgtgtagccctggatttgctaccctctccctacttgctgctttctgtaaaagtagggatgaagtctacctcgtacgtggattacactgtaacgcacttccttgaacatctctggaaatcgcttcagacctgaagtctgctggacagtggccttcccaaggggacacaattggcaccatacaaattgg

SEQ ID NO: 697358 - DNA, 282 bp, Homo sapiens
atggagcatccacagattctgcacgtaactacttcttctgtggccactactggagtttctgaagaattggacaatggagcagatgcttcagataaggcagctcatgtagctcatactgatgtagaagagtttccacactgaacagcagatacacccgtatcatctgttaggttcaccacccctccaggtccaatgataacacagtggtgctgcagcatgtatagtcacagtgtcaggactctctgggttagtgtagattaggtactgcatagcaatctgtaa

SEQ ID NO: 697359 - DNA, 109 bp, Homo sapiens
gtatgataagcagtgtgtagcaatagttagagaagtaaatagcttgatctagtgcaagtttatttttaagaatgccttatcgtgttactgttagtaaagttttgttttg

SEQ ID NO: 697360 - DNA, 1354 bp, Homo sapiens
ggagagttcgggggctcaacagtgcctaatccatatggtcgccacacgtcgggcaccgtgggctcgccgtcgtcatggagagcggagggcggccctcgactgtgccatttcagtcctcctgtggcacgcaccgtcgtgtggtcacctgcctggcctcgtgttatctccgctgttaccgggcaagaaaggtcggccgaggtcttcaccgaaagaggcgtcagagtgtgagctaagacatagaacgttcacttatgagagtgaaggactttcaaacggaggtacttctattcaagaacagcatccatgtgagagacattgccgcttgccgttaatcgcttgcttatcatgcacatggcgagctcgtgccgggtctagtttatacagagaaccggctttaggagcgagtctcaggatttgtagttgggatacaactttgcttagaaggcgcgaggtaacaaattctcaggcctgggacttggacgaactttacaggtggatgccaccaataaggaactgagctgtaggcgcaaatcagagactctagccacaacacctttattgggcgcacagtcgcacttggctccgcaaagggattccatttttacagtcccaggaagcgaacacaaggcaaacgaggttagacccgtttgggagcccgtgggttgagccccaagcttggaaagcggacttcgcgcgcccgtttcgcggaatttgcttgggggcttatgaatggccagaaggtttgcattagataagggccccacccctgtgggatacttcaaaggtttggtggacttcgatggaggcggcacattaagggacggaaacctttggtgcgggtagtttgaacgcacacaagtttgtcccaagccccaccgtttcgggaagtaatcgcaagaagttaacccctttttctaggccccggggactttggtgtacacacggtccggtgggccccacaacgttagactcccttttgcaaagcgcaggggggatgagcatggccaggcggcctgcccccaaccgacgtgggggcacgactttcccccaatagaaggcatgaaacgcttcgacagggtggtattgcaaatttgcctgttggcacaagactgggatagagagcgggcgagctccaaacaccacccggtatccacaacccccgtggtggcggcttttgtggagtccctgaaagacaccttgtgaagcttcgcgcaatatggggtaccctgagaaccataggaaacattttacctggacctaccccatggcgatcatatgggccttgtgtacccagagcctctcgaaaaaccaaaatgtgtgtgccaataattggcccacgcggctaaacccaata

SEQ ID NO: 697361 - DNA, 213 bp, Homo sapiens
agtacagccacgatagtctggccaaagacatcagctaagaaaggacaactgggtcctacgtgcttgtgactttccaacgcctgacagaccctgcaagacaaatacaatctggttcttgcctgcctctagtagaaatctccagaacatctcagccctgacacgttaataccctgcatcagtatcagaggctgctggccacacagactcaccaag

SEQ ID NO: 697362 - DNA, 389 bp, Homo sapiens
ggaggagattgcttacagagagggatacccagggagaaggctgtgtgacaacaaagcagactggagtgatgtgtctacaagccaaggaacaccaagaattgctggcaacaccaggagccgagagaaaagcatgaaacagatcctccgctagaggcttcaaagagagcatggccctgctgacaccttgactttggacttcaaactgtgagacagtaaatttctgttgtttcaagccatgcagtttgtggtgctttgtttttcagacttaagagatgaatacaacctgtatttatgcttttatattgatacgtatattataaagcatacaccgaaattgatattgaaaaatgcataaagatcaataaaccaatatttgaaaatttaaaaaa

SEQ ID NO: 697363 - DNA, 1068 bp, Homo sapiens
tacttgcatgtatctcagggttatatggtagcgaggctgggtggcgcccaggccgcgtgtgggggtgcgttcgcgcaggcccgctccctgcccccacctcagctcgtcacctccccgccctctcggcgtggcccctgaggtgcgcggcgcagtgcgcggagcgtggctggccagtgcagtgctggcgcggagcctaggccagtggggcctgggctgactcagtgcgcgtgtgtgtgctgcgctgtgtgtgatgtggagaggggtcggcccagcacagcgtccgggagcggctatgggccggagcagctgctgcccgccgccgttgcgtccgcggggaacggacctgcgcggcccctccgcccttgcgctctcggggcgcccgacgaccttcttgccgtggggcccggccgcggggagggtgcctcgggggaggaactgaactttgacgataaggtttttcacactcgctgtttaaccccacgggcttggcagacgaacaactggacttgttggactacatccggaggtcagccaacaaagccttccggaccttccacggcgatttccaaaggcggaatttcatcaatgccgttcaggaccttccccagaggttagcgcttcaaggactttaacagcgccaattgttgccgaacccagcggccccgcgcgtaaattatagtaatttcaccaggtcggacagacggggggttatcccgcaatgtacgggtcaagggctagggtccttgaaatttcccagagcgtcagggtgattcgtgtacgacacatccgatacttcccccaaaaaaggttgcgctggcgggaatttcaacaagcgggcggttagacgaccaagctttgcaacccccggggcgggaagcgcagtttttttataagcgttggtcctaccgaggaaaacaccttcaagttgcaacttttccaaattttatcccctccaactacccaaggtaggtcacacggacaatttattacccaacattttgaccacacgcaactcttgaagttgaagtaattccctcaagagacaacatgacagcaatgtggacgcaa

SEQ ID NO: 697364 - DNA, 979 bp, Homo sapiens
ggcagtgcaggccattgtacattgatacggacagtgatgtgctggacaaggccagtagcctcatgaggaggcgaacaaggcagctggccatccaggggaccctgagagccagcagcggcttgcccacggtggctccaagcagtgacccaggctctgaaccgctgtgtcagctgcctacctgtgccaggcgcgatgtggataatgtccctgagggcgagtcggacgatgccagcaagcgacctcctgagtgactcgcttcctcctagcactgggacatttcaagaagctcagatgccggttgaatgacaagctgctgctgggctgacatcaggcagcgcacagaactggtgcaggcctctcggggaacccctcaggacctggctcgagcctcaggaccgcatttggacaggagttcagcaccttcctgcgaagcctggtgtggagatggcaggccaggctccgagccaggaggaccgagcccaagttcgtgtccaacttgaagggcatctccatgtcttcaagcacacttcttctggctgcaggcctgccacggaccctgatgccctatctcgagagtcaggtggactgcacggtgcagggcagtcagcgacagcatcaatcagctcatcactatgtgacacccagaggacgccggcagaagagtgtcgataacgcctgcgggaatggagacggtccggaactcctggagaaaccagtccagcataaggacgtgcactacctggggctggacggacacggagactcaaagtgcgggagccatggatggctctccaaacgcagacggcaccgacgagtggcagcgccacagccaagcaggggccccagcccgacggcgccgcgggcccaccagcacaaaacaagaaggacaaatccgcaagagaacagccccgagccgtcccagccaccacggcaccccgacgggtgcacaacaacagacacaaagcacgtgagaatcggc

SEQ ID NO: 697365 - DNA, 628 bp, Homo sapiens
  misc_feature (33)..(33): n is a, c, g, or t
  misc_feature (52)..(52): n is a, c, g, or t
aaattttaactttcctttttaagttgttgtctnatgcaatcttataacccanacattccactgtgaacaagacatataatgcatgtgataactggtggtggttcttgaaatgaggatagtttagtatctttaaaatcagtgacaaccataactggtttattatttacaatgctatgtgtgaaaaaaacacttattctttcaattataggtgaccaaacataaaaatagggtcaacaggcctcctttgtccctaggcatggaagggttcaagggcttccataacaagtagaaaactagatctcacattggccgtcagagtgataaacagctactaacgttcacgtgagtagaaaagccaggatcggaagtcctgcacagcgtaaagcactcagtcatcatccgaaagaaattaacaaaaacctccccgtgcgtgtggaatggttcctaaaatgcaagaacggggacttggcagtaagagcagacatctgttttctcttgtacagaataggttcaacaaccagcagatagccagtcactggcatgtgactgcaaactgctcagagcatggtgaagctctggatggagaggggggattatattcctgctcgtgtgactgcctatttattga

SEQ ID NO: 697366 - DNA, 433 bp, Homo sapiens
gctaaatgtgtgccctttgcccatctcatcacacatcgagagctccggagcgcactatcccgagtctcatcaatacgtgatccatcgggcccagtcctcaatagtctatcggtgctgatacaaacaggtacagactcagtcggtcttccattgctgtcatatagaactgattgccgaaagtcctaagaggatctcaccaggctaaagtcaaggtgctggcggggctgtgtcccttctggaggctcaaggaaagaatcgggtccctgccttttctagcttctaggggctccagcttctaggtttgtggcctccttcctccatcctcaaagccagcaacagcaggtgaagtccttgcccatcgtgcatcactctcccttctgcctccttcaactttttttttatatttagggggaacgagtacaggattcttcca

SEQ ID NO: 697367 - DNA, 238 bp, Homo sapiens
gcagacgagcgtagttttggtttggtgtggttttttgaggacggagttcgactctatggcccaggctggagtgcagtggcagcgatctcgggccacggcagcctctgcctcgctggagtgcaaaggatcctcccatctctgcctcgtgaagtagctgggactacaggcacatgtcaccacacttggctgatgtttatttatctatctatctgtttattttgtggtggagcatgtgaag

SEQ ID NO: 697368 - DNA, 155 bp, Homo sapiens
  misc_feature (148)..(148): n is a, c, g, or t
agtggcatgtgatggtgcatatgaaatgtacttacaacactagaagaaagggctttataggacacagtgggagtcataaaggaagagtcagaagctcttttccatggggccccaaatggaaacaaaaacaaaatacacaaagcgcaancgcaggt

SEQ ID NO: 697369 - DNA, 408 bp, Homo sapiens
  misc_feature (21)..(21): n is a, c, g, or t
  misc_feature (37)..(37): n is a, c, g, or t
  misc_feature (64)..(64): n is a, c, g, or t
  misc_feature (104)..(104): n is a, c, g, or t
  misc_feature (128)..(128): n is a, c, g, or t
  misc_feature (161)..(161): n is a, c, g, or t
  misc_feature (198)..(198): n is a, c, g, or t
  misc_feature (281)..(281): n is a, c, g, or t
caagtatatgaactccatggntctcccaggctttcanaaggggaggggcagagttgggctcccnggctccccagtcccttccctcgcccatgcccaaatcatcncagtgggcctgtgatccccacaangagctctgtgcattttttcttaactgatacatnagtatacatatttatggggtacatgtgacagctggangcatatatacaatgtgtgtgatcaaatcagggtaactgggatatccctcacctcgaacctttatcatttcttatgttggaaanattccaaatcttctcttctaggtattttgaaatacacaataaattactgttaactagagtcaccctactgggctacagaacacgagaacgtattccctcctatctggcgatatgtttgtaataaact

SEQ ID NO: 697370 - DNA, 235 bp, Homo sapiens
  misc_feature (123)..(123): n is a, c, g, or t
tgctccagttcgcgctgcaatttatagcttagtttgctactgctgcgttttacagtttctgcttttgccgcggcggcttcttcggtttttttcaccgcagctgtttgagcgccacatactgcncttgctgaccacgggcatcatgataacgccgacataacgaccaattttaccgccgccttcgaagatccaacattctgtaacggtgtatcgacaaactgacgatcgtggctaa

SEQ ID NO: 697371 - DNA, 149 bp, Homo sapiens
  misc_feature (82)..(82): n is a, c, g, or t
  misc_feature (131)..(131): n is a, c, g, or t
  misc_feature (146)..(146): n is a, c, g, or t
gatctccattgcacatgaaaagaagatgaaaacaacactagtaccggaaaatactgtagtatgactctgtgctctgccttgnaactgccagtaccagtgccatgagacgccgtatggaggagcgtgttttngtcccccaggttatntaa

SEQ ID NO: 697372 - DNA, 309 bp, Homo sapiens
aacgtagtagacagtgtaacaataaaaacattggaggctgagaaatcgaggacgaagaagtgtactactagataggttaactgccctttaaatctagtggtgcatgtcttagtttccaattggaatttcagtgatctgcactgttctcacttcaaatgcagaggaaggataaaatagtgaagtagatatggccctgtaacagccaatatccgaatcataaagtgacatgctaataggatatactgtggcatttctgtgtattacagcttgtatggttagagttacttttccacaacttctaaggttaag

SEQ ID NO: 697373 - DNA, 214 bp, Homo sapiens
agaatacaaccccgcttctcccagccctccagcttcagcaaaggtgtcacaaggcgtggagctgacggacaagctacccaagacagaaagcaggtaatgtggagtgtctctagggagggaactcccatttgtccagagccagaacctctgacagaagactcttcttcatactccagagctatagacttctgaagattttacagagggtgaatca

SEQ ID NO: 697374 - DNA, 405 bp, Homo sapiens
cacaaagaatacaccaaaacattcacagtgattatctgcgcagtaggatatgtgtgcttgctttcctcttcatgtttctctgtattttctaaaatttctgctataaaggtatatttttttataagcagatatcaatgtaacatggaagtgagtaaaaaatgttctgccttaagagaaaataattaaaatgctcaaatcatttttattagtttttaaacatttgcccaatcctgaattacaaatacaaaaaaaaaaaaatcaaccttgatgatctattcttcctctctcttaaaaagaaaacaaaggaaacctaagtagaagttaagtttcactttttagtaaagttgtaatctaatctttgaaactatttggatgtaagtcagcatgggaaaacatatttctgct

SEQ ID NO: 697375 - DNA, 333 bp, Homo sapiens
  misc_feature (26)..(26): n is a, c, g, or t
  misc_feature (146)..(146): n is a, c, g, or t
  misc_feature (159)..(159): n is a, c, g, or t
  misc_feature (162)..(162): n is a, c, g, or t
  misc_feature (189)..(189): n is a, c, g, or t
  misc_feature (196)..(196): n is a, c, g, or t
  misc_feature (198)..(198): n is a, c, g, or t
  misc_feature (218)..(219): n is a, c, g, or t
  misc_feature (221)..(221): n is a, c, g, or t
  misc_feature (235)..(235): n is a, c, g, or t
  misc_feature (238)..(238): n is a, c, g, or t
  misc_feature (242)..(243): n is a, c, g, or t
  misc_feature (251)..(251): n is a, c, g, or t
  misc_feature (257)..(257): n is a, c, g, or t
ctgaatattgtagagcatgtcgcttnaagtctacttgtatctacggtggtgctcctaagggaccacaaatacgtgatttggagagaggtgtggaaatctgtattgcaacacctggaagactgattgactttttagagttggaaaanccaatctgagagnacnacctacctgtccttgatgagcagtagnatgcttnanatggctttgaaccccaatanngnaagatgtggatcanaanaccnntatagganactctnatgtggagtgcgacttggccaaaagaagtaagacagcttgctgaagatttcctgaaagactatattcatataaacc

SEQ ID NO: 697376 - DNA, 846 bp, Homo sapiens
cgtggaataggctgaggacatggaaatgacatcccccatgtgtggctctacctagcggaactggtaagcacccattctgcaggaaggtggggtgcccatgggggagctgtacagggagattgacaaagaccgtcgtgagatccgtaggtgcgaaacgcatgacttccctggtagctggagatcctgaggcctctcgtgtgacaataagcatgggtcctaaaaaggtggtggacgctgtggctgatgaagccgggtcttagctggaagtgaatttctacctgaatggccaggagattggtgcattcgtcgctgaacagaaggtggagtatagcctgggagaggagtcggaagcccctgtggcagagggcactccgccgtccgagtggagctgaacaggcagctgggagaagctgctgaaggagggcagcagtaaccagtcgggtgttcgactggatagaggccaaccggagtgagcacgcagatagtatccaacaagtaagttcagagccctcatgacggttgtctgctattctgcaatgatattagagactcccctccgagtggacgtcgcagtgctgaaagcgcgagcgaagctggtgcatgaaatacctgtgtgagcgagcagaaggagctacaggcgctctacggtctccaggtccgcttgtagtgaccttagaacagcctcccaagctgctgcggatgtgctttgcacgcaactgtcatgaacgaggacagtggtggaaaggaggatgtggttctagcaggttgggagagtagcaaggaccccgttgagcagcaaggggaagggtgttggccattaaatctgtaaaggcttcttcaagtggc

SEQ ID NO: 697377 - DNA, 991 bp, Homo sapiens
tcttaggacatctgaatatttattggaaaagccacagttttcccacacttctccattaacgtggtaggcttttattattaaggcaaaagcaagagtggatctccactacttttactgtggaaagaaattagcttctgcagcaaaccccagggtttttgcagttacagattcaaaagtgcaagtgtacattgacagattttaaaaaacaggtttaaaacaaaaaaaaaaaaaaaaaaaaaaaatataaaaaaaaaaaaaaaaaaaaaaaaaaaaaaaaaaaaaaaaaaaaaaaaaaaacgagggggggggcccacaagatacccccgcggggggcgccccccacgcgggccacccccattcttggtacaagggggcaccacaaagaggcggcgtcataattaacagggcgagaggggggcgcggcgcgccttaacaccagggggacagggcgcgagaaaaccagcgcgcccgcggggagaacaccaggggagaagacaccacctatcccggcgggaggaggacacaaacacagggccacgcaacctcacaacacaaccaactataaaacacccaccagggcacaaactaaaaaaaaatacaaaacgccaataaaaccggggcccaacacaccagcgaagaacaaaacgcgcgacggacgccaaaaaaccagccaccaccacaccgaaaaacacacacaaacaaaaaactctcacaacaccgccgccgaacacacacacaaaacacaccacaacccacaacaacagaacaagacaccacacccgccccacagcaaaggacgtggctaagtaagaccggcctcgccccgagggcacacacgcaacgacgacctcagggggtgtcggggggagaaagtagcgcgtcggtccccgcacaagtcgcagactccgcacgagggggaaagggttgggggtgcgtgtggcccaagccacccacacaacaacacagggggggggggtggcggtgcgaccac

SEQ ID NO: 697378 - DNA, 463 bp, Homo sapiens
ggaggtggaggttgcagtgagccacgattgcactattgcactccagcctgggtgacagagcgagactccatctcaaaaaaaaaaaaaaaaaaaagaaaaaaaaaaaaaaagggatttggtccttggggtagccaagttttcatttggctcagggaggggttcaagtcttaaaatccttttcatatcaacacaaaatttctatggaggatgtagctttccatatgcagtcatcccctttcatttctcacgttgggtgccccctgaggcgtaagagacacggtacaggatacaattggtgatgctggaacagtgaccctaggtctgtctgtccaattctacacacctcaccactgtgtgactcagctataggcttaaatactagtgagacggggaatgcttaccctgttatttggttccattgatttggtttccaacttaacagcgggactctttgttgttacgc

SEQ ID NO: 697379 - DNA, 977 bp, Homo sapiens
gagcggaagcagcgagagggcggtggcgccgggggcacggctgggcggctccgcccagaagagggccgagaggcggggcggtgcccgccaccgcaggacccgctggcgccctctgcaggccgacaggacagcgactcaaccagtggcactcatctattccttcatcctccctcttggggcatttcctcaggcgcacactatttctgtgtgtctgggcagatctctcacggcctccgacttcccgatcaccatttcttccacattccaggccgggcgtgttcagtgtcgttcggcgggaaaacgtgccaataaagattttatctatcattctcgactcccaaggatccccgcactcacccattaagcaccgccgagatctgacggacgcggcttaccatggcggcggccttctgaatgcctcgggagccttagacagaagatggcagacttgctatgccggcatgagcatgtggccgtgcacggtcccggacccagacgccaacacccgggcctgatgaggaatcctgacgagacccgctcacggactccacaggaggcccgacggacccgcacgggggatgtgcccgatgggccggacgcccaggcacgactctcgagatccactgactgcatttcgcaggcacgggcgcacgcttcaagggccacatccccgactgagccgacgctgccaggcgctcgaccccacaatcgtaccccacggcgtcacatctgcgacaccagcgcaacaagccatgatgctcgctccctgcgcagcaaagttagccctccgggccaccccctcacacgggaacctgtgcgaagacacctcacacggcccaccccaagaacaggaggcacgccactaggcgacctacactcacgaccacaacaacctgcggcagggacccaagacactcacacaccacggacacgacagagcaccaccgggcacctacaacacggcacgccgcacaccg

SEQ ID NO: 697380 - DNA, 111 bp, Homo sapiens
tggtaccgtggaggaatctatttgccataaaaaagggataagttcacatctttgcagagacatggatgaaactggaaaccatcattctcaccaagaccctggcacgatctt

SEQ ID NO: 697381 - DNA, 288 bp, Homo sapiens
gtttttattaccccctcccggcccccagacccatgtgatttttgctttcttctttagcaagatattttggtttctaaataaggaagagtctttaatgagcccccgagccccagtcttttcagactcatggattggtatgaggggtttgaacgtctcctagccaatcagaactggctgtgggcccccctagcccggccccctttcagggcccctggcaggccttcctgagttaaatttgtagttgcatatttagctttgcccatttgaaataaaccccggttgcagcca

SEQ ID NO: 697382 - DNA, 218 bp, Homo sapiens
actgattccagagacgtcagacattactgagcgactgaactgaactgtacgttacgtagcagtctgggaaggccaggcaggcaaggtgtgtctcggctttttacttaggtatttatttgtcaatgaccattgttacacgaagatctgttgaagacttttaattgctgatgatggaagcaaatatgcaagaaaaagtcattctttgggggccacgctct

SEQ ID NO: 697383 - DNA, 269 bp, Homo sapiens
catgctgggcttttacaataaatgggttaccaataattgcctcattttttcagtgctattttatccaattttgggctggctctttttctcagacttcttcattggcttttcactcttaagtaactggtctgcgttctcattcttcatcttttttttcttctccttctcgggtatctcaagcttttcatgctttttagactccttggcttttttagggggaacattccccaccggcagctcgtcctccagctgagaagctgaggcggccg

SEQ ID NO: 697384 - DNA, 128 bp, Homo sapiens
cttaggcttcccagctaccggataccagcttaaaattacaataccagggttagggggatcacctgggccttcctatgtgtaggtagaattccggtctcttcccagcgcggggtacggagctcgatttc

SEQ ID NO: 697385 - DNA, 334 bp, Homo sapiens
  misc_feature (7)..(7): n is a, c, g, or t
  misc_feature (9)..(9): n is a, c, g, or t
ggaaaancngtacacaaaggatgtataatcctgcattgacttaaaaaagttcattaatattaaataatatggatatatttggctatataaatgttaaattaatttcacttttttactatgttaatatgttattggaatatttaaaattacgtatgtgacttgcattgtatttctattgaacagtgccgctttagagaacaagtaatgaaagtattttccctccagccttctaaatggtgtgtcaaatctgtagccatttagggaggtcaagttaaatttgctccctggaagaatcacttaacttgcagagtgtattctgatatttcccattatg

SEQ ID NO: 697386 - DNA, 295 bp, Homo sapiens
cactgttgcctggcctattcatttctctctgtttatcctttcaccactctctcttccaggccattttcgtttccacttggactgggtaagacacccaactggcccctcagctttcattcattcttaccttcctcactacagacttttcatcttacagccacccccagagtcttctaaaatcttaaatctaatcccatgatacccctactcaaaatctaccaattttttgtcttcacattcgaatatccatctggggccagacacagtgtctttcgctggtactcccagtactttg

SEQ ID NO: 697387 - DNA, 180 bp, Homo sapiens
caggaaagagcagatctgtttcgtcagctctaaaaggctctcatcgccctggtgcagggtcccgggtgatggccacgttgagccagtctctcactgtctgagagttggccctggtaaaaagaggtccgtgacggagaagttcccataaggcgggttaccgcacctccgaaatcggaatca

SEQ ID NO: 697388 - DNA, 140 bp, Homo sapiens
  misc_feature (15)..(15): n is a, c, g, or t
cagggtcaagatgantccaccatctcagcctgctgaatagctgggactgcaggcacatacgagcacacccaagctaattgttgtatttatttgtagagactgggtcatataccatgttgcccagactgatctcgaactcc

SEQ ID NO: 697389 - DNA, 135 bp, Homo sapiens
cccacaggtcaaaaagaaccttattacttttatgatgccacttatgctttcttgccagatgccttggagcaggtgctttctggctgagcttttgaccctctgtgtctctccagccgtatagtagtagtagcgggc

SEQ ID NO: 697390 - DNA, 404 bp, Homo sapiens
  misc_feature (156)..(156): n is a, c, g, or t
  misc_feature (392)..(392): n is a, c, g, or t
aggggaatctggaacatgttggattttactttgaccctaaactccgtgacttctgaactccccatttcccccacttttggggactaacttaaaaaaaaaattcctttagagatttcttcttaaaagctaaattccgggccacgtgtggtggctcanacctataatcccagcactttgggaggctgaggcaagaagatcacttgagcccaggagtttgagaccagccagacccatttcaaaaaaataaaaaattagccgggcatgctgtcatgtgccttcagtctcagctacttgggaggctgaggcaggaggatcacttgagcccaggagctcaaggctgcagtgagctatgattgcgccactgcactgggtgacaagagcgtgactctgtnctggaaaaaaaa

SEQ ID NO: 697391 - DNA, 118 bp, Homo sapiens
gtagactgagttattttatttcgctatttccagtttgaagctactatcatgggcgtttagagttataccctccgtacttacggattgttaaagaccaagacacccagagtgagatgca

SEQ ID NO: 697392 - DNA, 391 bp, Homo sapiens
cagttccaaatattctcaagaaaatcagtagctatacaagcagtagaaatagtttgtcatatgtcagtcatcagttttcagaagtaaataacttctatgcactaaactacaatgcattgaaaactaaatattttaaatattcgttatagtgtatttgaactcttgaactgagttctagaatatctttatgtatttaatatacttttttttttccaaaattgaggataggtgaatagttatctaaggcttaaaaagtgttgccaatatagtttttttgttttttggggtttttttgacacagtcttgctctgttgaccaggctggggggcagtgagctgagatcgcaccactgcactccagcctaggtgaaagagccagactccgtctcaaa

SEQ ID NO: 697393 - DNA, 366 bp, Homo sapiens
gaatgaaattgaatggaaaaattgaattaattgaatgatggaattatgccattaataattaaatgcccggtgccgtggccccctcccgcctgggttataaagccagtctctttctccaatgggatgaaattaaattaagaaattaaattattaattattaaatgcccagtctccctcccaattaaattaaattagattgaattttgaattgaattaattgaacttaattgtaaaaattgaataattaaatgcccggtgcggtggccccctcccccctgggccataaagccagttttcctctgggaattaaaccaaattaaattaaattattaaattaataattaaatgctgggtggaattaaatta

SEQ ID NO: 697394 - DNA, 506 bp, Homo sapiens
  misc_feature (63)..(63): n is a, c, g, or t
tcaacttctctcacgctcttcagggatgagagaaggggagtggtgtttgagcgctacctccgnatagggtactgtgtgtgcaccttcgctgttcctgccttcagatatttaccaagtacccgctgtgggtcaggccctactctcaccctaaggatgcaacatgaagcacagcagaggtggagaagatcccactaacacacacgccgattggaatgtagggccatcagtcctttcgacatgaattttccctgtactgggggtagagctggtaactggaggatcatccgattatagaagacagaaggcctgctacttgcccctgctgttaggaggcgggcttcctgaatggctttctgtatacatgaagaatatcaagacctttcgttaaggtggacaaagctaagttccatcgattacaagaggtctctgggctgactggctataactgacaagaccctgatgcgcggacaccttttgcttgttattgtattagtacttactacgag

SEQ ID NO: 697395 - DNA, 692 bp, Homo sapiens
ggaaggagacggagagcatagcacctgcagccatgatggatgtgggcagcaaagatggtcctgactggagagccctgccggatctactccgcagctccccgtggaccagattaggcattccactgctgcccgagtagcacctgaaaccgccttctaatctgtggctggatggtggtcggtcctcatcgtcgtggtgattgtgggagccctgatcatgggtctccagcatgagccagaaacacactggagactggttctggagacttgatcatctggcggactgccaggaaaggcgcaatgcacacgcctggcccctgaagtgaagtcacctggttaacacaacttagacaacactatctcccaatccaggaggatcccaacatagggatcatcgcatgacgtgtctggatttagcgagcaaggcttgcaatgactcagcgcactacacgaagcctcaagcacaccattggcacacgtggtatgaccataggaggttcaattgggcaacgtaatctgcgcgcgggcgcgaggacagcaacgtgaaatgtcgaccagaaggttcctagtcgaaggagagctccgttcgacctttacggaagacgctatggtatcgcaagagcagatgcgtagtcccagtggggccactaagtacgccgtgatgtgtgggggcacatgtacggttatgtaaaaag

SEQ ID NO: 697396 - DNA, 836 bp, Homo sapiens
gctgagccggccgccgaggattcagcagcctcgtgctggagtccgcctcgcttgccgagcctaccgtacccaccgtgtatcgcctatcgcccgtcagttgagagcgccgcgcttccggataccgtttgcagcgaggaaaaggaatcgtatcgtatgtcatgttatccataatctccactctttcgagcccttttgcatgagtgcaagtaacgggtgatgacctgcttcctgctggcgactgaggattatatccagtatatagcgaattcaagcagagaaacggcaggaaggaccctttactatctgtccaagggatcgctgactgacttacgagtaaacaagaaactagtgaaggcgtcttaagaaaactctttgccttgcaatggtactgtaagttgagcactccggacataatgcgagaaagtagtttcacgcgtacaggtgtgaccaacgcaagaatcatactgccaagttcctcggtacagaacttgcgacgtggctaagagacgactcaggtgaaagcgtccatggcgcttattaaaggtgcttagtgggctcagctgaacgcgttacatgtgagggaattcccttcgccaagtgaagctagaatttcccttctctcactcttgtcacaggtttaaaaacctcgacagcttgtatcattgtaacccatttgaggtcccgctttaacttaggactaggtgtaagtcctgttcattgccattaaactgaaaggagctaacaaacaaccgccatgcatacaccaagatcagccgaacaaaatgagggcggcgacaaccccaaaggacttgtcctgttctctcgtttccacagca

SEQ ID NO: 697397 - DNA, 205 bp, Homo sapiens
ctagaccacgcgtccatgtgattcgtcgctagcgctgtattgcctctttgtgtctcgtgctcagctctgtttcttccgtcctggttatgctagctagccgagctgctcttctctctttatagaaaacaaacaaatgtgtgagtttgggtgcaacatctgcggtggatgagagatatggcgatttcccacggcataggttggtgta

SEQ ID NO: 697398 - DNA, 1018 bp, Homo sapiens
ggccatatttttaaatttcgaaatcatttttgtttgtaaagatacaggatcttactcttgcctaggctggattgcagtggtccatcatggctcgctgcagcctcaagcttccgggctcgggtgatcctcccgcctcagtttcctgagtagctgggactgcaggcatgtgccaccatacctggtaattttaagatggtaagaaacgaggtctcactatattagactaggctggtcttaaactcctggcctcaagtgatggtcctggcctcagacctgtcacagtgctgcagtgaggtgtgatcgtgccgattcagctgaggtgtgatcgtgccctctgaactccagactaggtgacagaaggagaccctgtctcaaaaaaaagaacacagaggccgggagcactggctcatgccgtgtagtcccgagtactctcgggaggctgagcgcggaggtatcacgaggtcgggagatcgagaacatgttgggcaacagggtgaaaagcgccactctctacgtaaggatagcgtacagaaatggaaggtatgcccgaggccactggtggaaactgacgtggtatgacccaggacagtggacgcagcatagagcgtagggggaacatccgttcaggctgggtaagagcaacgatgttagcacggtgagcagagagatggcgaaccaccggacactcacatggggcgggggacaacaactaaggtgatgccatgcacacgggactgggatcagtcccgcataatacacgagcagacaactggaagatagggacggacgcgaatcgcagcatgcagacgcacaaggaagaaggataccggaagaggagcggtcgccaggaaactcaaaaaacaggggagagcaaccagtgtccgggccgcaactctacccgaagggacggcgagtgggaatcgcacacacccaagaagaaatcggcgacagcggagaggaacaacaggaacactagggcgtacaaaagacagctgccacggagccaccagaggaacaa

SEQ ID NO: 697399 - DNA, 301 bp, Homo sapiens
ctccgttcatctccccgctattcattacttggcaattttaaacgccacgcaagtggtgtttttaatctgttcccgacccttctaaatttccaaaagagacaccttttcttttcttttcgatggaagtttttcttgtacacactcgtgcgcagcctgatctaattgtaatttgtatggagacactcataaacagagcatgtcatgctgcgttcatgtctattttggatcacaaagatttatcagcttttgtttagatgcagtttgggttgatatgaggtaaataaaatgtacttgtttatta

SEQ ID NO: 697400 - DNA, 116 bp, Homo sapiens
aggtgacgtagaaggaataatactatcgctgttcattagctaccctcataaccctccacacccactccccctctagccaatattgtgcctatatgccatactagtctttgccgcct

SEQ ID NO: 697401 - DNA, 614 bp, Homo sapiens
aagcagtggtatcaacgcagagtgcccaccagccttgtcctaataaaattaagttgtatcattaaaaaaaaaaaacaaaaaaaaaaaaaaaaaaaaacaaaaaaaaaaaaacaaaaaacacaacaaaaaaacacaaaaacaacactgtgtgtgcctgcgcgccgccccgccgccgccctcataaaaaatctttctatcacaaccacctcttgtgtgtgcgggcgcgccgcgcgcgcgcccccctatggagatagtatcagatagagagaagagagcggagcacactatagtagtgtctctctccatccaggaagaaagcaaccacctcgagcgaggaccatacaaaatacagagggggcgcggggtgtgtctccctcccacccacataaaatcagaagaacgcgcgccgcgcggggcagagaaacgacacgaccgacgtcggtattcttgtagcaacacaaacccaataccacaaggaagagagggtgtcagtggcgggggggagagctgattacgtacgagggggagtttattctcactactaagagggagtcgattccacaaagagagcgcacggagcacattaatatctacataaatactatctcgccccg

SEQ ID NO: 697402 - DNA, 214 bp, Homo sapiens
aacccgcgaccgcctttgtatttctggaataaactcaacttagtcataatgtattatatacacttttaaaatgttactagattcaattcactaatacttttattagaatttttacatctatgttcatttcaaaagttagatgacctagttccctttcttctaatgttcatgtagaactcataaaactaatactttttccattctttgtaagagc

SEQ ID NO: 697403 - DNA, 215 bp, Homo sapiens
tgacatctagaggctcccccgatttacatctccgccttactcctcttctcatggaatggtctgaaatattttaatagatacgtaagctatcactagtaaatagctcctgataggaagacgatgctccatatatttacataaatctctttattcttcaacagtggtttctttctcaaagcatgcttttagtcagggagccatggttcaacagcagc

SEQ ID NO: 697404 - DNA, 168 bp, Homo sapiens
  misc_feature (56)..(57): n is a, c, g, or t
  misc_feature (59)..(61): n is a, c, g, or t
  misc_feature (85)..(85): n is a, c, g, or t
ctgatgatcatcgagttgtccagctacctggacagcggtggcgcccacggcatgcnngnnngtggcttcatcaactactccgcangctggacaaggtactgaccctgcaggacatgttggtgccgggccaggaggacaccttctggaaaaccgtcgaggagtcatcag

SEQ ID NO: 697405 - DNA, 127 bp, Homo sapiens
ccgggccatgtgttccaggtatagtgtgtggatcggtgcacgtgtgggcgtgtgcacatgtgtgagtgtgtgtgcccaggtggatgagtgtgtggactaggtgcatgtgtgggcacacattatggag

SEQ ID NO: 697406 - DNA, 699 bp, Homo sapiens
agcgggcctgtcccgtcccctggtggccgtctgggggcgactagtcctgagagaaaccagacggaagctgcgctgggactgacacgtggacttggtgcggtgctgcccgggctgggtcatgctcgtggtgctggtgaggcagccccgggacacagtctgtgcccactccgtcttatcacctccaagcccggatgcaagactaccccacagacgaggtccctgcgagggacatggtcggggacacccagtggtccaggcccgaggtgccagtgctatggacggggacgcgtgctgctgggcatcgtgccgttcgtgtactgcgccctgctccatgcatgcccatctgcaccgtctccatgagccaggacttcggctggaacacagaaggaggccggcatcgtgctcagtcagcttcttctgggtgctactgcctgacacaggttgtgggcggccacctcggggatcggattgggggtgagaaggtcatcctgctgtcagtcctctgcctggggctccatcacggccgtcaccccactgctcgcccagctgagcagtgcccacctggccttcatgaccttctcacgcatcctcatgggcttgctccaaggggtttacttccctgccctgaccagcctgctgtcgcagaaggtgcgggagagtgagcgagcttcacctacagcatcgtgggcgccggtccca

SEQ ID NO: 697407 - DNA, 460 bp, Homo sapiens
  misc_feature (37)..(37): n is a, c, g, or t
  misc_feature (61)..(61): n is a, c, g, or t
  misc_feature (107)..(107): n is a, c, g, or t
  misc_feature (140)..(140): n is a, c, g, or t
  misc_feature (398)..(398): n is a, c, g, or t
  misc_feature (410)..(410): n is a, c, g, or t
aaatgggggaaaccaaaaaaaagccctgggaaagccntccccaaccccggccggggtgggnccggggccccggccttccttaaggaaacccttaaggttggggaatncccccccccggggggccttggccaaggggaaanttttccggccggggccccggcgggttcccggaaccaaccggggccttggccggaagaaaaggaaccggacccaaggaaaaaaggggattggccccaaaaattcttggttccaaaggatttccaaaggaaaaaattaaagggaccaaacgtggaaagtttaaaagtttcgatggcagcagataccttttacaccctggttcatcactggacaaagagaagggcagagaaactggaagcagttccctgccccccggtttnggcagtgaaggnattgaaatgagccagacacactggttgggctgtattatattatacttcct

SEQ ID NO: 697408 - DNA, 83 bp, Homo sapiens
gtggggtgtgataggtggcagggaaaatatggaattctcacggatgggtacgattctcatagtcccccttctgtcgtcttctc

SEQ ID NO: 697409 - DNA, 313 bp, Homo sapiens
gtacatgtatttctccataggcagagttgccgaatcaataggcatgcaagtttgtacttagatctttaccaggtcagtggattgtttccaaagcacatttttgcgcaagcactcactgtgctatctgaaagatcctgaggccgagcgtggtggctaacgcctgtaatcccagcactttgggaggcctaggtgggcacattatgaggacaggaaatcgagaccattctggacaacatctagaaacctaatgtctactaaagatacaaaaatcagccgggcttggtggcatgtagcctgtaatcccagctgcttg

SEQ ID NO: 697410 - DNA, 863 bp, Homo sapiens
cttctttggcgtcgccaggcgagccacatcgctcatacaccatggggaaggtgaaggtcggaggtcaacggatttggtcgtatagggcgcctggtcaccagggctgcgttttaagcatctggtaaagtggatattgttgccatcaatgaccccttcattgagcctcaatctacgatggtttacatgttccaatatgattccacccagtggcgaaattccatggctgccgatcaaggcatgagaacgggaagcttgtcatgcaatggaaatccccatcaccgatcttccaggagcgagatccctccaaaatcaagtggggcgatgctggcgctgagtacggtcggtggaggtccagctggcgtcgttcaggccagcgcatggaggaaggctggggctcatttgccaggggggacgccagaaacgggtcatcatctctgccccctctgcgtgatgcccccatgttcgtcatgggtgtgagccatgagacgtatgacaatcagactcaagatcatcgagtaatgggctccgtgcagcgatcaaactggcttagcaccccctggccgaggtcatcccatggacaaacgttggagtatcgtggaagagacctcattgaagccacgagttccatggccatctacttgccaccccacgaaagattgtgggattggcccctccgggggcaaagtgttggagtgattgggcccgcggggctctcccagaaacttatgccctggctcctacttggcgctgccaggtggtggcaaggtctcctgaaagaagggaggcactggatgacaacaggcccactggcaagtgccagggggctcgacgccctgtaaaacgcgcataagactcacagggga

SEQ ID NO: 697411 - DNA, 413 bp, Homo sapiens
  misc_feature (7)..(7): n is a, c, g, or t
  misc_feature (28)..(28): n is a, c, g, or t
  misc_feature (65)..(65): n is a, c, g, or t
  misc_feature (72)..(72): n is a, c, g, or t
  misc_feature (74)..(74): n is a, c, g, or t
  misc_feature (81)..(81): n is a, c, g, or t
  misc_feature (87)..(87): n is a, c, g, or t
  misc_feature (112)..(112): n is a, c, g, or t
  misc_feature (120)..(120): n is a, c, g, or t
  misc_feature (125)..(125): n is a, c, g, or t
  misc_feature (141)..(141): n is a, c, g, or t
  misc_feature (178)..(178): n is a, c, g, or t
  misc_feature (186)..(186): n is a, c, g, or t
  misc_feature (192)..(192): n is a, c, g, or t
  misc_feature (208)..(209): n is a, c, g, or t
  misc_feature (214)..(214): n is a, c, g, or t
  misc_feature (217)..(217): n is a, c, g, or t
  misc_feature (226)..(226): n is a, c, g, or t
  misc_feature (233)..(233): n is a, c, g, or t
  misc_feature (237)..(237): n is a, c, g, or t
  misc_feature (255)..(255): n is a, c, g, or t
  misc_feature (266)..(266): n is a, c, g, or t
  misc_feature (289)..(290): n is a, c, g, or t
  misc_feature (311)..(311): n is a, c, g, or t
  misc_feature (321)..(321): n is a, c, g, or t
  misc_feature (340)..(340): n is a, c, g, or t
  misc_feature (350)..(350): n is a, c, g, or t
  misc_feature (358)..(358): n is a, c, g, or t
  misc_feature (401)..(401): n is a, c, g, or t
  misc_feature (404)..(404): n is a, c, g, or t
gtttttngtcatattgcctctagatttncttctgtgcttctctctatctgctctggaatggatgngtgaatntnttctgcngctgtnttagggaacatattgatagacatgnccaccttncagancaaaatctctctctcnctttttgctttttatagaaaagcaagtgcatagttanttaattgncattcnatttttccagatattnncactnccntataatggnttgttcnttgnatacctgtaaaattgtgncaatttccaantattaattgtaggtcatatctgnngcaaatcattcttggtctgtnctttctaggntattccatagaatcaacanattttaaggnctgaaagnatactgtcgaaatcacccagtcccaaccccccaatttaaaatngantctagtaaa

SEQ ID NO: 697412 - DNA, 981 bp, Homo sapiens
ggtatatggtcaaatgaatgaaccacctggtgctcgtgcccggatagcatctgatgtgtggctgtactgtgagtctgacatagcttccagagtatccccaaagcaaggaggggctttcccaaaaatgggccaaacgttggggagtttaaatcccctgtttcgggccgcccttttcctccaaacttgcttcggttattaaaagcgttttttgtggggggggcaaaaaacgttttccacccgcaaaaagccctcttttaaaagtggttgtgttccccccccggttaataaaacggtgttctgagtgtgtcccccccgcgggggggtgaaccaccaacactgtgtgttttgtgtgtttttttctgcccccgataaaaaaagaccgcgagttgcccagcagtggccccccacaaataaaaaaaaaggggggggggtcctgggcgggggtggtccccaagaaaattggtgggggggagtggggggaaataacacccgaaaagggggaagggaaggtattgtttccttgaccgattcaaattgtgagtgactcggtaacatccggctttcctgtcctgaagagggctaatcagacgtaccctgagacacttgacagtgggtacctatgcatgggaacaagaattaccacgtaccgaacgaaggagatcttaatcggacttccctttttgcgttttggattaaccacgagctaatcttaataggtagcgcctgcgatgactagacgtgtgaatctagatccgcattggctctccacccccgcgcgatattttggggggaacacaacacggtagtgttgtattcaaataaaaaaaaaaagagcaccaaccccacaacaaagctagtttagtttggaaggaacaaaacaaagagacgatctggcgccaaaatataaaggagagggagagacaacacaataaatctgtcttgactatccacagacccactcagcgacacaaaaccaaggag

SEQ ID NO: 697413 - DNA, 929 bp, Homo sapiens
  misc_feature (90)..(90): n is a, c, g, or t
  misc_feature (102)..(102): n is a, c, g, or t
  misc_feature (105)..(105): n is a, c, g, or t
  misc_feature (108)..(110): n is a, c, g, or t
  misc_feature (123)..(123): n is a, c, g, or t
  misc_feature (129)..(129): n is a, c, g, or t
  misc_feature (132)..(133): n is a, c, g, or t
  misc_feature (136)..(136): n is a, c, g, or t
  misc_feature (147)..(147): n is a, c, g, or t
  misc_feature (149)..(151): n is a, c, g, or t
  misc_feature (918)..(918): n is a, c, g, or t
cgcgtgcgcgtttggcaagacagtaagcggggccgcgatcgggatgccccgcgcaaggcggtaagtgacccgtattaggagaccgaccanaggtgaacgggncanggnnnaaggtaccccaanctaaanccnnagngggaacccctncnnncgcaccgtccttgtcagaggaattggcaggtattcccgatctgccatgtattccagaaaggccatgtacaagaggaagtactcagccgctaaatccaaggttgaaaagaacaaagaaggagaaggttctcgcaactgttacaaaaccagttggtggtgacaagaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccgggaccattctgatcatcctcactggacgccacaggggcaagagggtggttttcctgaagcagctggctagtggcttattacttgtgactggacctctggtcctcaatcgagttcctctacgaagaacacaccagaaatttgtcattgccacttcaaccaaaatcgatatcagcaatgtaaaaatcccaaaacatcttactgatgcttacttcaagaagaagaagctgcggaagcccagacaccaggaaggtgagatcttcgacacagaaaaagagaaatatgagattacggagcagcgcaagattgatcagaaagctgtggactcacaaattttaccaaaaatcaaagctattcctcagctccagggctacctgcgatctgtgtttgctctgacgaatggaatttatcctcacaaattggtgttctaaatgtcttaagaacctaattaaatagctgactacaaanaaaaaaaaaaa

SEQ ID NO: 697414 - DNA, 1135 bp, Homo sapiens
ggccaccagaggtttcccagagaggaaggcgtggctccctccctgggccagtgagccctggctgccgccgcggccgcggtcccagcagctggagtagggctggcggctgcagccccgacaccatggggggcagacccagccccagaccgcggtaaactgccgacactccgaccgaccgcaccgccgccgcgatcatgcaccccatcccgacgtgcggactcatcatgagacagccaatccccatcactcacctcgaaggccaacaatgaaggagacccggggactacggaggggatgcccaccttctgcaccccgacctccaaccactcctacacaggcatgtggggcagccccgaggcgataccgcccggaggacgacgagaggcaacctcacggcgcccctccagggatctggcgaggattgccggaatcgagtgatccgtggaccttcccgatcaccatgcttgctcactgggtaaacgatgggcaaacgcacttggcccatgcatgcatcggtgatcggcgcatgctaccggcgccgggagaagcaagcgcaagcaagtccttcctgactgtgcatccggcatggctggcgctcaccgacctggtccggggcagcttcctcaccaacccggtcgacaacagacgtgaacctgtccaagcagacgtacgagagcacaatcgaccccgacaggggcggctacaggaaccctataacagggactgaccaaggacagtgacaccggggtccaccacggcgaacaatcgcgagcgcgcatggcccgcagagcaggaactggccacacaggcgccgaaagggaaccgagcccaatgaaaacacaggagacacacagaaagggcgtcacggaatgaggaagacagagacacatatacaccacgagagacaggggtaaggggagcgccagacacccgtcacggcctcgggagaggagtgactcaacgcacacaactaaggaggacggagactgctcaggacatgggaacaaagtgaacggatgcagtcccagaggggatagcagcaacacgatgagcccaaaagagttggcgcgcagagacaaagacgcggcgacgaacaagaagggtggtacaccagcaacgaactcccacgagaggc

SEQ ID NO: 697415 - DNA, 676 bp, Homo sapiens
  misc_feature (13)..(13): n is a, c, g, or t
ctatagaaccagnggatcccccgggctgtaggaatacggctttagcacacccttacccctgggaaaggaatgctgatatcatgaagcttccataaaatcccaaggagacggggttcagagagcttcacggaagctttgagtccttcccctaataccttgccctatgcatctcttcatctgtatcctttgtaatattctttgttataaactggtaaacataaggaagtgtttccctgagttcggggagccgtgccagcaaattgaacccaaagaaggggtcacgggaaccccaacttgaagctggtcagtcagaagttttgaaggttctaacttgtgactggtgtgtggtgcagccggtcttggggactgagccttcaacctgtgggatctctctctccaggtagatggtgtcagaactggattagaggaagaccagctggggtttgctgcgcggtttctgctttagtcacagaaagcttctgggttggtgattgggtgagaatagggaccatggatagaggagaaggtttttctccggaccaccaagacctgggtggaccttaaggtttcctcaacctgaggttaagaaggaccctgttttgtgggcctaccaaacctattggctgaaattcaaggtgcctgtacagacatcccaccggcaggggcccttgattgt

SEQ ID NO: 697416 - DNA, 1335 bp, Homo sapiens
  misc_feature (1324)..(1324): n is a, c, g, or t
catggagtaaaatgttcgccccccacgcggaaaaaaaggggcgccgcaccaccaaatggggtggacgacccccaagatggaggagtgggggataaaggtgtagatccgccgtgccccagatgtccgccccggccctgtgtgaaagaatgtggccgcccccaccaaagaggggggttttgtgtagagcaaaagaaaagggcgaaagaaataaagatgggcaatcaacgcgctgaagggacaataaaaggggggttgttttctcttttctgcggcccacagcgccctctggggtgttagcgacccccagcagaaaagccccaccagctttgttgggggtgtttggggtttgagagcacccacgaggaataccgggcggcccggggttataaccccccccgcggcgtttggagttttttaaaaagaagcttgtgtccggcgcaccaagaagattggcgccccttatagaaaataatgttgtagtattgtcgccttagtctctggagaaaagaagattggtgggccccccttgtcgacacaaaaggcctctgcttgagaggggccccccccgggcccctcttgagagcccccctcttccaacggttccacagagcaacacgcctggatgagagaaaataatctcgcggcggagagccactcgccacctttataccccccgccccgcggggggacccaacatctgtctggagatgacactttccctctcaccttggggagacgccccacacacgggggggccacaagagagggggttgggtttttttcccctcgagaaggccacagtctcggggctaaagtggggcctctatatatacactctcgtggagactcgggagacctctctcgggtgcgctccacacattcgagaggtttcccttctatacgagaggagacacaccaccccacgcgaaattttggtcacgtgtgcccacaccttcacacgcccacaatttcgagatatatcacgccacaatgtgttaaaaattctcccccaaacactctttatctgaatgcttatacttctacaaaaagaaagaaagctgccggaaaggcccacgagcacccacggaaaggtgaagaatctttctgaacaccacagagaaaaagaggagaaataatgaggagattacggagcagcgcaagattgatcagaaagctgtggactcacaaattttaccaaaaatcaaagctattcctcagctccagggctacctgcgatctgtgtttgctctgacgaatggaatttatcctcacaaattggtgttctaaatgtcttaagaacctaattaaatagctgactacaaanaaaaaaaaaaa

SEQ ID NO: 697417 - DNA, 980 bp, Homo sapiens
aggaggcctgggcagtggtgtgctgatgtggacctgacggactgcactggtgctgggctggtgccgggagccatggagcgcggccctggggccctggtggtgcgcgttgccggtggtgggcttcccacggcactgacatggagacctgttgttgcgaggctccctgtgggctcgtgcttggacctgctgatggggtgcttggtgcccttgtgcctcctaacggtggcttgctgtcttgggtgctggtagcttgggggggcgctctcccccctgcccgcgactctggtatcacctcttcacccctcccctgactcgtgggccattgcctggggcggggcgttgttgtgcggggtgccccctgtgttggaaggccgcagggagcttgggcggctgctccgctcaaatcgaaattgggtgctttggttctgcttcgagttgagtgcgtctagcttagccctctttccttgctctagccccagtcacttgcctccctgggtctggcactactcgctttgcgccagaatgcttcgcccttattcttaggcaccgtgccagggtagggacacgagagctattacgttctcagcattgggttgtccccttagtaagggtgcctcggtagtgtgcacatggggggagcgcgttgggatgagtgtggcccggcggggcccaagtaaacccaacacattattgatagtagtaactcccttttgaatataatgtcccttctccacttcagacgcgtactggccagacctcccgcggtgtccctggcatttgagagacaattagccattgtccacaatcacttttggagcggcgaaagacttagatgagcctgaacagattatcacaaaggattaaccatacagtacccgaaatacagactgcaagtcaactgtagaatcatacacaatatcgtaataggcggattacattatacaccacacaacctccataagagaatatcattcacccga

SEQ ID NO: 697418 - DNA, 103 bp, Homo sapiens
cgaggattcctacctaactggctgtctgggaactgagctacagcaacacaccacactttctaggtctcaccacacatccagtgaacagccttttttcttatat

SEQ ID NO: 697419 - DNA, 183 bp, Homo sapiens
attcgtggaagatcatcagcagtgctcctgcaccaccactgcttgccgccctcgcaggtcatccatacaactttggtatcgtgaaggactctgaccacgtccatgccatcactgccacccagaagactgtggatagaccatccgggaaactgtggcgtgatggccgcgggactctccagaacc

SEQ ID NO: 697420 - DNA, 352 bp, Homo sapiens
  misc_feature (341)..(341): n is a, c, g, or t
gaacaccaaaaatatgacaatgaaacttcattggaaatacgaaatcagcaatagtaaagtccaaaaacatcttactgatgcttacttcaagaagaagaagctgcggaagcccagacaccaggaaggtgagatcttcgacacagaaaaagagaaatatgagattacggagcagcgcaagattgatcagaaagctgtggactcacaaattttaccaaaaatcaaagctattcctcagctccagggctacctgcgatctgtgtttgctctgacgaatggaatttatcctcacaaattggtgttctaaatgtcttaagaacctaattaaatagctgactacaaanaaaaaaaaaaa

SEQ ID NO: 697421 - DNA, 127 bp, Homo sapiens
gggccaagaatttttctgtttgcccgggaaaggtaaaaggggaaaattaaaccctttccgtttagttctggaaggcccggaatttttccaaaaaattaaaaaaggggcgggggctttttctttggga

SEQ ID NO: 697422 - DNA, 939 bp, Homo sapiens
  misc_feature (928)..(928): n is a, c, g, or t
gcttctctttcccatcttgcaagatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaacaaagaaggagaaggttctcgcaactgttacaaaaccagttggtggtgacaagaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccgggaccattctgatcatcctcactggacgccacaggggcaagagggtggttttcctgaagcagctggctagtggcttattacttgtgactggacctctggtcctcaatcgagttcctctacgaagaacacaccagaaatttgtcattgccacttcaaccaaaatcgatatcagcaatgtaaaaatcccaaaacatcttactgatgcttacttcaagaagaagaagctgcggaagcccagacaccaggaaggtgagatcttcgacacagaaaaagagaaatatgagattacggagcagcgcaagattgatcagaaagctgtggactcacaaattttaccaaaaatcaaagctattcctcagctccagggctacctgcgatctgtgtttgctctgacgaatggaatttatcctcacaaattggtgttctaaatgtcttaagaacctaattaaatagctgactacaaanaaaaaaaaaaa

SEQ ID NO: 697423 - DNA, 1272 bp, Homo sapiens
  misc_feature (928)..(928): n is a, c, g, or t
gcttctctttcccatcttgcaagatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaacaaagaaggagaaggttctcgcaactgttacaaaaccagttggtggtgacaagaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccgggaccattctgatcatcctcactggacgccacaggggcaagagggtggttttcctgaagcagctggctagtggcttattacttgtgactggacctctggtcctcaatcgagttcctctacgaagaacacaccagaaatttgtcattgccacttcaaccaaaatcgatatcagcaatgtaaaaatcccaaaacatcttactgatgcttacttcaagaagaagaagctgcggaagcccagacaccaggaaggtgagatcttcgacacagaaaaagagaaatatgagattacggagcagcgcaagattgatcagaaagctgtggactcacaaattttaccaaaaatcaaagctattcctcagctccagggctacctgcgatctgtgtttgctctgacgaatggaatttatcctcacaaattggtgttctaaatgtcttaagaacctaattaaatagctgactacaaanaaaaaaaaaaaaaaaaaaaaaaaaactttggtggggccggcttcgggcctgagaaaaggtttatcatagaaccattcgggttggggcggcgggggccccaggatgttatgtgtcgacacttgtggggcctaaaggctggtcacaaaggagagatccgtggcacatgagatatggtgttgggtttcttccaccaaattaaaaaaagcggcccgggggaaacccggggctgttcctggaaaaaaattcccagatggggacttcccgggagggacattagcggggttcctatcaaacagggtgccaagggagagcgaggatattaaatttagcccggcgagagggaa

SEQ ID NO: 697424 - DNA, 1104 bp, Homo sapiens
  misc_feature (1093)..(1093): n is a, c, g, or t
gatcttgcaaggtaagaatcgcgggcctgtctgcaagacttgagttcaggactcccaatccttcgccatccgaacctggagggcatccagtcgacacctacaggggtcggacatgtccaaggctaactgagaggccttccagacgcttcatttttgttgtttgggtttgcggcagggcacaaagaggatggcgggtgaaacaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaacaaagaaggagaaggttctcgcaactgttacaaaaccagttggtggtgacaagaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccgggaccattctgatcatcctcactggacgccacaggggcaagagggtggttttcctgaagcagctggctagtggcttattacttgtgactggacctctggtcctcaatcgagttcctctacgaagaacacaccagaaatttgtcattgccacttcaaccaaaatcgatatcagcaatgtaaaaatcccaaaacatcttactgatgcttacttcaagaagaagaagctgcggaagcccagacaccaggaaggtgagatcttcgacacagaaaaagagaaatatgagattacggagcagcgcaagattgatcagaaagctgtggactcacaaattttaccaaaaatcaaagctattcctcagctccagggctacctgcgatctgtgtttgctctgacgaatggaatttatcctcacaaattggtgttctaaatgtcttaagaacctaattaaatagctgactacaaanaaaaaaaaaaa

SEQ ID NO: 697425 - DNA, 199 bp, Homo sapiens
cctttaagcaggaggcccaagaagggaaccccggaagcctagaagttcccagctgccgacatcccattgaaccgtgatcccctgcatggagggggaagtttgagccgtggcccaacaatgatacagtcgtcctcctggcttggggctggggttaccagggtctccatgtgtctgtgctggaaccagagtttctcatcgg

SEQ ID NO: 697426 - DNA, 1139 bp, Homo sapiens
  misc_feature (829)..(829): n is a, c, g, or t
  misc_feature (841)..(841): n is a, c, g, or t
  misc_feature (846)..(847): n is a, c, g, or t
  misc_feature (850)..(850): n is a, c, g, or t
  misc_feature (1128)..(1128): n is a, c, g, or t
gatcttgcaaggtaagaatcgcgggcctgtctgcaagacttgagttcaggactcccaatccttcgccatccgaacctggagggcatccagtcgacacctacaggggtcggacatgtccaaggctaactgagaggccttccagacgcttcatttttgttgtttgggtttgcggcagggcacaaagaggatggcgggtgaaacaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaacaaagaaggagaaggttctcgcaactgttacaaaaccagttggtggtgacaagaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccgggaccattctgatcatcctcactggacgccacaggggcaagagggtggttttcctgaagcagctggctagtggcttattacttgtgactggacctctggtcctcaatcgagttcctctacgaagaacacaccagaaatttgtcattgccacttcaaccaaaatcgatatcagcaatgtaaaaatcccccaagaaaaaaaanaaaaccccattncttannctnaaaacatcttactgatgcttacttcaagaagaagaagctgcggaagcccagacaccaggaaggtgagatcttcgacacagaaaaagagaaatatgagattacggagcagcgcaagattgatcagaaagctgtggactcacaaattttaccaaaaatcaaagctattcctcagctccagggctacctgcgatctgtgtttgctctgacgaatggaatttatcctcacaaattggtgttctaaatgtcttaagaacctaattaaatagctgactacaaanaaaaaaaaaaa

SEQ ID NO: 697427 - DNA, 466 bp, Homo sapiens
  misc_feature (64)..(64): n is a, c, g, or t
  misc_feature (118)..(119): n is a, c, g, or t
  misc_feature (349)..(349): n is a, c, g, or t
  misc_feature (466)..(466): n is a, c, g, or t
gttgtggatattcagtagtattagggaggctggttgtgaaccatagtcacctgtggaacttctnaaaatagcctcttccccaggattctaattaagtagcctggggagtgaggcctannaggctttcattctatttttctactcccattttgaattaaaaccacagtaaatttgcacgattttttaaaaatcagaaccaaagactattgttaaaaactaagtatcattctctatgcagacttccaggccccttcccagtggcagccactgttgaaagtttttgtatatgtttctaacaagcactgcccaatagaaacataatgcaaaccacatatttaatttcaaatgnatttaaattaaaaaaaattcctaattttaaattttcatgtagccacattaaaagaaaaagtttttaagaggtgggataatctgaggcccagagtttaagaccagcctgcgcattatn

SEQ ID NO: 697428 - DNA, 236 bp, Homo sapiens
  misc_feature (55)..(55): n is a, c, g, or t
tacacattctgtattatctatgtacttactgttttagtgagttttgtacctttanaggatttcttactgctcattcatgtccttttctttctgattaattacttcctttagcctttcttgtaggacaggtttggtgtggataaaatccctcagcttttgtttgtctggaaagtttttatttttcttttatgtttagaggttattttttccatttatataattctagggtggtatag

SEQ ID NO: 697429 - DNA, 586 bp, Homo sapiens
  misc_feature (574)..(574): n is a, c, g, or t
gcttctctttcccatcttgcaagatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaacaaagaaggagaaggttctcgcaactgttacaaaaccagttggtggtgacaagaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccgggaccattctgatcatcctcactggacgccacaggggcaagagggtgttgaacagggatcccactgcagacagctgcggtagggccagatgggaccgtacacaaggatatntatttcttacag

SEQ ID NO: 697430 - DNA, 176 bp, Homo sapiens
cgggaggcaggcaagtaggatcgggaggcaggcaagtgaggatgtgggaggcagggctgggaagcttgagtgcagcacaagtggcagaaaacaaacccagaaagttcaggccacccctgacagtatgctttcccatgggaaggaggctcaatgtacccatgcagacggaactacgg

SEQ ID NO: 697431 - DNA, 635 bp, Homo sapiens
gcttctctttcccatcttgcaagatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaacaaagaaggagaaggttctcgcaactgttacaaaaccagttggtggtgacaagaacggcggtacccggcaaaaaacccttcagtcagcacgtgagaaaactgcgagccagcattacccccgggaccattctgatcatcctcactggacgccacaggggcaagagggtggttttcctgaagcagctggctagtggcttattacttgtgactggatctgtggtcctcatcccagttcctatactatatatcacactataaatcagcattgccaatttcaactcaaattctgttcctctcatgcattactccctaaattatttctgatccttacttcattcttatatagtcttgcgccttctatacc

SEQ ID NO: 697432 - DNA, 953 bp, Homo sapiens
gcagggcattgctccaattgctcccttctcggaccagccttcttcctcccaccatggcaggtggggagcaggtctcccagaaacaccccgtcccgaggatggtgctctgtgcatgccccagcctcctgggcctgcccttccctcttcttcgggaggatgtgtctcttctgacctgcactcttgcctgaccctagaatggggacagggaaagtgaaggttagggaaagcagaggggggcactttttagcattccctttctatcccacccctctgatctcccataagtggaaatgggggtacccaggatgggcaggctttggcctagggacatgaagtatgggagtgggtggcgtgtgtgcgcagagcagggtgtggaacgcgggatacgtgtggacagttccttcttgtggcggatgttggtggcgctggggttgcttcttttctttcctcagggtcacgggagaagggagcgaacagggtacgggtcgctcttgttacagaacagccctggcactgcattcaaatccagtcttcattcagctgggatcaaaatgccagtcaccttggttaccactgtggacagctgtctgtcagcatgcagagggatccaggaatccccccggagcacggccgtttccttctcctccatgtgggcagcagatagtcaggctcctggtggagacagaaggtaggaccagtctcatgaccagatatggtggggtgtgcacggaagggaacaacactagagggccacaagctctctccccaggtgtccattccgggttaaccctgaactgtggggaggggagggcagggggggcacagacgctcccacacagagaacgcgccactcggggaaaggggtgcccacaacaacggggagggggactccgggcgcacccacccgcgaggcaaacagcgagcacgagcggggcggcccacaagggaggcag

SEQ ID NO: 697433 - DNA, 1064 bp, Homo sapiens
  misc_feature (253)..(254): n is a, c, g, or t
  misc_feature (1053)..(1053): n is a, c, g, or t
gcttctctttcccatcttgcaagatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtcactaagcaggacacgctcacatcnnagccgctcaaatcccacaggtcgcataagagcaagaaagcacaggcatgaaggtgtctcgacaacacctagttaactaatagaccagatatcgcgctaggtggatcataggaaaccgagagcgctcaactccgtgcgtggctctcagagacctttcgtcagatacaattgccctgaagatatatatgcctactggcaaggatgttgccctcggacaatgctgtatgatgccaacgtgcgaatagagaacgcactttcagctcgagcatcgggtgaagaataactttgcagaatgctcgagcaattgaatccctccgtggaacccgagttcgtgaatccatccctgcactgtgaacgctcgacagggtggcaatgaggcgtggttttcctgaagcagctggctagtggcttattacttgtgactggacctctggtcctcaatcgagttcctctacgaagaacacaccagaaatttgtcattgccacttcaaccaaaatcgatatcagcaatgtaaaaatcccaaaacatcttactgatgcttacttcaagaagaagaagctgcggaagcccagacaccaggaaggtgagatcttcgacacagaaaaagagaaatatgagattacggagcagcgcaagattgatcagaaagctgtggactcacaaattttaccaaaaatcaaagctattcctcagctccagggctacctgcgatctgtgtttgctctgacgaatggaatttatcctcacaaattggtgttctaaatgtcttaagaacctaattaaatagctgactacaaanaaaaaaaaaaa

SEQ ID NO: 697434 - DNA, 209 bp, Homo sapiens
tcgcggacgtgtatcatgtgccctatgggaagtcaagtcagtcattgtagcgtctgtggatgatatccagtgtgttgaagaatttgagtgccaatgccactgtggaaaccccagctgctgagagagacaatgaacaccagtccgggtactcctgccccatctgctgaagagacaattaacaccatcccaggtaatcccccccgcactgt

SEQ ID NO: 697435 - DNA, 344 bp, Homo sapiens
ggcacgaggcagcatatatttaatttcaaacagaaattagcaatatttgcaataggaatttagtggagaatctctcttagcaagaacaatcaagagaaacttgcagagttccattgtataacaggataaacactgatttggaatgagacccaagttccagcccatttttctggtcctgattggccaagttaaataaaaacctcaaatatgagtatcctaagtgtttcacatgtgaatgatctcatgtactgcccccatgtgtgtgggtgtgggtgtgggtgtgtaaaaacaaggaaggaaaggcagcaggatgggattttgtagtgattaggaacaggggtaac

SEQ ID NO: 697436 - DNA, 428 bp, Homo sapiens
accggctccgatgtcggcattcctgaaaatctgtccaccaatcttctggtcaatcatggctggcacggtacgattttcgaactcgatgcgaccgagtgcgacaagatgcgctacttcttcgcgcgcaccgccgccacacgtcattatcattggacgcgagagggcttgaccgaatattactccccagtgatcgtccagaaagccattagcccggagaacatcaacgagctgctgatggctgccaaccaggagccggagcccgatctttttattattgatattgacggcggtgatttcgctgtcatggaaaatctcagcgcgatcaaaccacgcgtcattgtcgtcgagtttgaaaaacgttttcgcgaacggacagcgtggttcagcggggtcgacgcgccgcgaatttagtagtagtaggcggccgc

SEQ ID NO: 697437 - DNA, 283 bp, Homo sapiens
gcgacctagaggaccccggaggtaatggtgatcggagtatagtggagcgcttgtcagatttccaggtggcttggtccacagcgtatgtggccaatgcacgctgagccgcaaagctggcaagatcgtccaagattcgtcaagccgccagaccgtctccttcttggccatatccacatggaaaatctcatcaccatcaaagtcaaacataaactcgcctgataggtcaggattcagatagaactcgggctggatgatcacaggtcgttctttgaaagcccatgga

SEQ ID NO: 697438 - DNA, 931 bp, Homo sapiens
  misc_feature (670)..(670): n is a, c, g, or t
ctcaagagtctcaggagatagatgtcatctgatccccatacaagtggctgcgcgtcaaacagtagctccaactcaaccatttgacgaaggcaccaagagagcaaaataaccttcaaagtagatgtgcatgaatgcccccaagagagtgcgcattaactgcgagaatctctaactcgtcgcgctccaggaccaagggacgtgaatcctcatcccgacctgctacaggggaatcaagatcaagtgcaatcgatagtgcggaaaacatggatcaaggacatccaagaatcatagctaatcgtgaatctccaacagaagaaccgtcgcgtgacaagatctcagctctcctacatgttctaggttcttgagtgtagcgtataatcatcgcttcgcatcatcgtcctgttgatggcgcttgcaacgatggaatccatagaggagaaggaaacgcatttagtcgcccgtacattgagggaactccttcctaaccaaattcgcgtggctgccctattctacctgcacgtgaggtatttcttgcctgcgccgaccctagggcaaacgagtattcggtaggcatggcaagatagttcgagacacatcccttcctcattctcgagaaacacacggagcaagaaaatagaatacacttcgaggcaattcttccatgaatagnaaccttattcctaaagccctttttggaatttaaacacacatgcaaagatagatagttgacaaatttattatctgctacttgacgtggacttgacgaaggccctatctacaaaggattatgtgggataggttcatatcgttggtaacgcaaatttgcttcagattacaaaggcacacgaagaggacacacgtgagtacataccaggcttctgagacggaaaaagatagtggtggcgttatgtcgacccacccggcgaggttg

SEQ ID NO: 697439 - DNA, 172 bp, Homo sapiens
tgtggggggggaaatagaatctcattgttggcccaggcgggtctcaaatttctaggctcgggcggttctccggcctcagcctggcaagggggtgggggatacagggcatgacgctacggcagcgggcctaaaccaggtgtttggaaatccattttccttcatatacctttgg

SEQ ID NO: 697440 - DNA, 892 bp, Homo sapiens
catatatcccttgtgcgataaacaaaagaaacgaaaaaaaagaaaagaatggcacgtgaacttccgatttttcaaggcctttgcctaggaaaagtgggtccatggggaataaacagcggagtatttggtttcgtaaacctccagaattgggtccccaataaattgccgagggggtttcccaaagttaggactttcggatacacatttggaccgggaatttccgggtggttgtcgaactttttacaagcacctgacgctgtgtgactcacggggctcggaaactgaggcagaactctctacgtggttagaacaaaattacacccgtgaacttatgtgtcgctttttcgggaagggttctagctccggatgttaacaaagaaactcccgtggagactcaacaatgcccatggggggaactgtcggtctcaaaagcgtcttagacgataatattggcggagggtgggactctgggagtggaggacccccctttcttggggcatcttgggaggttggaacgggggaactccagccagtaatggttgccgttggtcacgggactaaaagaccccttcgaccccggtaggggctgtggcccatttgaaaggttcctggaccccaaattggttccagcagggttcttgccactgaggaaccctcgaatcctggaatcggaactcctggtgggagcataacgggtgatgaccctttgaaacagtccaatgtcgcctcacacacacaccaatgggaccccttcctaacggaaatgtggtcttatgttcccccatggcacagtgtgccccaacaggggactcacctcccattgtgacctggtcaaaaacacagcggttttagatgaccttagggcgggcaaaccttaacacatgtcgactag

SEQ ID NO: 697441 - DNA, 1356 bp, Homo sapiens
cgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcccgtagtcccgagtagctgggattacagtgggctcattgagcaactctgaggacatcagttctgaaagcaagtgaacagtctgaggaaacttttcctttgggtgaacaaggagactttcaactttcaagtttcatgtctccattatcaccatcatcttggtcatcatcacctgaattattatgactttgcaactcaacaggaacatttcatccaacagggcccatgctgtgctcatcctttcacataacacaacacagaccctactgcacacaaccacaccacaccccacccacaacacaaaacttcttcgcgcccctcggcccacgagacaattttaaaccccaccgctaggcgcacgcgcgcccacgaaggctacggacaagtggccacacggtgtccccacgggacaccgggcacgacagcggctgggatctcaccccaataaagcgccggggacaccgcaggttcgcaacccccgcagggtccgacgcacacagggggcacaagagccaagagcgaaatgccccgcggaaaaaacaacccaccaccaaacaaaaaaacaacaaacaaccacacacaaccaaccgacaccaagccaaccccccccacacgaccaacgcccaagacaaaaagcacaacaacaaacaagaacaaagaaaaccgaccaaaaaacacccagaaagaccagaacaccaaaagaaaaaacaaaaacacgcagagaacgggcggagcgggagggagactacagccgcgaggcgagggaaacaagaaggcgaggacaccgcagagagaaagagggaaggagggggcaacagaaagagcaggaggaaagcgcgaagaaaagaggaaagccgcagaggcaacgcggacagggggcgcgccgagagaacacagagagagcggagcgaggcgccaagcgccagacacgcgaacacgagaaagaaagacagacaccacacagcagacacaacaagacaagcagacacaaaaggcagcgagaagcgggacacgcaccagacacacacgagacagcgcgaaagacgacaagacggagcacaccagccagcaaacaccggacgcaagacaacccaggagcacgagagccgaaacaaccgacgcaagcaagcacgaagcaaccccaagcgaagaacaaccgaaagaacgagaggacacaagacagacacgacagacagcagaacacaaaaa

SEQ ID NO: 697442 - DNA, 226 bp, Homo sapiens
tgggtatatcctgagtattgtgaaatctaaaaatctgagaggttatctcaagcaaaacattctgttttatagatgagaaataaaacctctggtaggttaactgaacatatctaattgtgtaggactgaaactagagcctctcgaggttcaactctctccaatatgaatcttcatttaagagacaactgaaggctgggcgtggtggctcacaccagtaatcccagca

SEQ ID NO: 697443 - DNA, 569 bp, Homo sapiens
  misc_feature (559)..(559): n is a, c, g, or t
tttttttttggataaacagactttattatattttaaaattatatacagtaattattattatacattcattcataaattctatataagtaaacatacattctaatcacagtgtttgaattccatttttctcaaaacacacacacacacacacacacacacacacacacacacacacgaaaagcctgtaacgtttgaaagcctaaaatgtaggagttcctccacgtactcacttcatagttcagatggatcttaccagattattagcaacaagaattcagtgcctatatcacagttaaaattatagttaaaatatttaatagagggacacccaccctcaatgcgggtgggcaccatccaattgggtcaggggtatggataaaacaaaaatgcgtaggaaagctcactctctcctggacctaagacaccctccttctggtgcttttggacatccaaactccaggctctctgggccttgggattccaggagttgcaaagtggctggtctgagttctcagggccgttgcctgctggactggagagttataccatcagtttcccnagttctgaat

SEQ ID NO: 697444 - DNA, 320 bp, Homo sapiens
gcctccaactgttgtccatcttgatgtgctagataccggcggcatggagcctctctatgggctgatatgatctgtggctgggataagaagggtcctggactctactacgtggattaacattggactcggctctcaggaaatttgttctccacgggtagtggtaacacttatgcctacggggtcttggacagtggctatcggtctaatcttagccctgatgaggcctatgaccttggccgcagtgctattgcttatgccaatcgacagatacagctattctgcaggcgttgtcaatatgtaccacatagttcagcgtctga

SEQ ID NO: 697445 - DNA, 698 bp, Homo sapiens
gattcttgtgtctcagcctccctagtagctgggattacaggcacccactaccacactcggctaatgatgagattatagatggggtttcaccacgttggccaggctagtctcgaattcctgacctcagatgatccacctgcctcggccttccaaagtgctgggattaaaggcgtgagcccccgcgcccagccacctccatgtaagctttggatcataagcatcgcctcttaaatcttgcccatcaaatacccccttcccttctgtagctgtagtttctttctcactattggttctttttccacaactttataacacgcccagtggtcccactttctaataaaatctccctttccctgctccccactctgccagtttctcttccatcttcacattgcctgaattcattgtactcatctcctaatttcccacccccgacttacagtccagcttctgccctcaccaatggcttcctaatttccaaatccaggaacctcttcttaaagaggtcttcctacctatttctgtccagggctctagctggatttaataatgctgtctttttcccagctgcccaagctagaaatcttggctcactgcaaactacgcctcctaggttcaagtgattcttgtgtctcagcctccctagtagctgggattacaggcacccactaccacactcggctaatgatgagattata

SEQ ID NO: 697446 - DNA, 451 bp, Homo sapiens
  misc_feature (261)..(261): n is a, c, g, or t
  misc_feature (266)..(266): n is a, c, g, or t
acaaaaaatcggatttatacggctgttagtgctatcggcgtctggtatgtgttatatattgcctatcgttttttggccaatgggcgttggctacgcggggcaatgattgccattgtttttgttatcttggcttattttgtcgttttaaatattatttactattttacaaatactgtggtcaaatgggatatttcgccaaaaattgagaaagtgttaggcggcccgcagctggaggaagagaaagcggctgtgcatgaagtnattgnacccgctaatgggctgtatcaacgacaacatgtgatgctgggtgaagtgacggtcaatgccacgcagcaagacaatatcacgcaattagccacggcgtttgatgcaactcgggctgatgaaacaagattatggccatcttggtgaacaggcacaacggcaattattttacagcacgtagtgattt

SEQ ID NO: 697447 - DNA, 323 bp, Homo sapiens
aagagacagggtctcactatgctgcccagtttggtcttgaattcctgggctcaagagttcacctgcctcagcctctcaaagtgttggggttacaggcgtgagccactgcactcagctttaaatttttttttatagagacagggtcttgctatgttgcccaggctagtctcaaactcctggcctcaagcgatcctccaggctccacctcccaaagtgctgagattacagggggtgatccaccacgcctggcctgtgcgtgttttttttttaacctttctgtgacttattatccccatttcacagatgcggaaattaagacacag

SEQ ID NO: 697448 - DNA, 239 bp, Homo sapiens
cggggttggggggggggccccccccctttttttttccccctttaaaaacccggggggggcgctccccccccggttttttttgggcggcggggggggttaccttttcccccgcggaccccttgttccctttggccctttggggggggcccctttaacccggtttggcacaaaaagcgcggtggggccgggccgggatttcccgggtttttttttccccccggggcccccccgggggccca

SEQ ID NO: 697449 - DNA, 263 bp, Homo sapiens
ccttatatgctgtctcaggacattgtcttcaaatttctaagccttggagccctctgttccaataaatcctacgggcaaattcataggtaaaagagattttaaagaagagtgggtgtggggttcatgcctgtaatctcagcacttgggggggccaaggtgggaggactgcgtgaagccagaagttggtgaccagccggggcaacacagcaagaccccgactctaataaaatctctcgtactctcaacaccatccaccaccacca

SEQ ID NO: 697450 - DNA, 332 bp, Homo sapiens
agcccattttttttctgtattttctgtatgaaactgccccatatcatgaatagaaagggagaaccataaaggagaaaggacgtgatgttctgttatgttcatgtaaacctaaaaaaacagtgtggaggcaggggcgatcaaccgaactttaggggcttggtgttgcttggaaggcatccaaacctgccttttgcattttttgtatgtaatcatattgccaaagacaaactatttcatcctttattgtaaataacccttttccccagacctaccataaagtttttgtgatgtattgttttccagttgcaataaaaattactgggttgcctcca

SEQ ID NO: 697451 - DNA, 294 bp, Homo sapiens
atactgggtgccgaccgcggcgcacgccctctgtgggcacagtgactttatctctgtttccgtctctttacgctgagggtcttttagaatgaaacgtgctgggaactgttctagagcctttatgtggaataacttagtaatcctccccacaggggatgtcgatgctgcattttacgggtgaggaaatcaaggcatgagagatcatgtgagtggcctcagctcacaccgcagagctaggactttgatcataaatctttaaaagaacaaaacagtggctgggcacacattatggag

SEQ ID NO: 697452 - DNA, 273 bp, Homo sapiens
cgtagctggagttccatggacatgatcttgactcactagtaacctctgtacccctgggttcaagtgattctcctgacctcagcctccagagtaactgggatcacaggtgttcgccgacatgcccggccttgactaccatatataaaaattttactggaggacttatttgttgctcttcttttaacatttattataaatagcatcccagctcttatttcagcaatatacaaaacatttttataggtatgtagcagtaagaagtctataggagca

SEQ ID NO: 697453 - DNA, 207 bp, Homo sapiens
atttcccggggcttcaaagcaggcagtctttgtgtgagtaaagattgagccaatgctaagagtagaacgagctattaagttctatttgctacttccatccccaggctcataacagagcgtaagctaaacaaagaagaacagctctccgctggacagaatgatattcaacaggtagactcatttctgtaggcacttctcacatcagcg

SEQ ID NO: 697454 - DNA, 326 bp, Homo sapiens
gattgatgtgcggccaggcgatcattgcgactctgcatattctgagatccttcgtatgtgcgctcttcctatcatcgtgtagcagaattcaccaaacgttggattgttcactcactactagggaacgtgagctgtggttaggccgctctgtgattggagaaacctctcgcgctactgatgacgtgttgttgccatggtaatcctgctcagtacgagaggaaccgcaggttcagacatttggtgtatgtgcttggctgaggagccaatggggcgaagctaccatctgtgggattatgactgaacgcctctaagtcagaatcccgccc

SEQ ID NO: 697455 - DNA, 498 bp, Homo sapiens
  misc_feature (2)..(2): n is a, c, g, or t
  misc_feature (42)..(42): n is a, c, g, or t
  misc_feature (117)..(117): n is a, c, g, or t
  misc_feature (142)..(142): n is a, c, g, or t
  misc_feature (147)..(147): n is a, c, g, or t
  misc_feature (169)..(170): n is a, c, g, or t
  misc_feature (206)..(206): n is a, c, g, or t
  misc_feature (210)..(211): n is a, c, g, or t
  misc_feature (334)..(334): n is a, c, g, or t
  misc_feature (343)..(343): n is a, c, g, or t
  misc_feature (393)..(393): n is a, c, g, or t
tngttgttcatatgagtcctctaggaaatgagagaggatgantgaagccaattctataaagttgcgttaagttgtataaaaatagatatataagaataaattctttcacttgatgtntgttagaccagaaagtgtgtgtgtnctgtngctcagttcccagacagctttnnaggtagtggaggaggtggcatcatgtggcacttggncatnnatattccacttgggagggtcaggctgtggccttctggagcaggtggcttgttaaggaacgctagcagggcatggcacgtgagctccggaatagatgtcttcatcacttcttccactgtgtgtngacacaganatccttacctatatcctcagatccccagcttactcctctgctaatgatanacttcacagtgcagcttgcagtccgtagctgaaaatgattataagccctgcataatgggtaagcttatggtgattacgtgtatgtaacttctaactattagcaga

SEQ ID NO: 697456 - DNA, 545 bp, Homo sapiens
cattctcctcctatccctcaaccccgacatcattaccgggttttcctcgtaaaaaaaaaaaaaaaaaaaaaaaaaaaaaccagttggtgcggttgggccgcggccctgggccctttgagaaaaaagagattttaatagaccaattccggtggggcgggggggccccgaaagtgaggtcctactgtctgacagtggggccaaaacgcggtgcctccctagaggaagaactccgggcgacagcgacacaagggcgtgtgggggctttcaccacaccaaattaaaaaaaccgggccgggggggacacacccgggagcgggtgttctcgtgagacacacaacatcccacagagaggggagcgttcctcaggagagcggcaccacccacggggggggctcatacctccaacagggggagggggcccacaaagggacagagggctccgagaatatccaaaaatatacaccgccccgggtcgtcggtggaggaatatgcaaacagaaacagagcagcaatcccaatcagcaacagcacaccagcacgagcag

SEQ ID NO: 697457 - DNA, 249 bp, Homo sapiens
  misc_feature (2)..(2): n is a, c, g, or t
  misc_feature (7)..(7): n is a, c, g, or t
  misc_feature (20)..(20): n is a, c, g, or t
  misc_feature (29)..(29): n is a, c, g, or t
  misc_feature (42)..(42): n is a, c, g, or t
  misc_feature (46)..(46): n is a, c, g, or t
  misc_feature (58)..(58): n is a, c, g, or t
  misc_feature (65)..(65): n is a, c, g, or t
  misc_feature (72)..(72): n is a, c, g, or t
  misc_feature (84)..(84): n is a, c, g, or t
  misc_feature (145)..(145): n is a, c, g, or t
  misc_feature (215)..(215): n is a, c, g, or t
tntagtnaataatagagggntagtatctnggttcagaacacntgtnagtctggttttnctacctntgtagtngaaccgcttgancataggattgctgagacccagaagaaaagtcagcattggctctcacactacagaacaaatnagaggtggctccagaaacttcaagatgacaacttcctggaaatgctgcattttcgcctcctttgactgtngactctggcagtctttcaggggacatctccaggg

SEQ ID NO: 697458 - DNA, 299 bp, Homo sapiens
cgaataaatgtgtaactgtgaattgtgttgcatttgccccggtgcaacggttgtgctttggaaatgcctggcagctttgtgcaatgaattaatgtttaaaggaattatctaattttgtcatagtatttaagtcataatgtcatttctgtattcagttctgttggattttcttttctttgagaaatgtatattctgggtagttttattggtaaaaaaaatgtattgtgatttaatactgcatagtgttttgggttttgttttatatgcaaggtcttcgagccaataaactatttctaagt

SEQ ID NO: 697459 - DNA, 944 bp, Homo sapiens
tgttgcttctgtcccgaggaaagagagagtaaaacaaaaaaaaaaaagggaaaagcacggaggcagcagggactacgctttgtgccgtgttccctcgtgttctcaaaactacatttggtaggtcctaccgcatgcagttaccaacttactggaaaagttctgccacggttcttttggacctcggacactttgctgtaccggccctttttatggcgatgacacgagtcggtctaatggcgtccgcctatagcacctatgtaccctcttaatccacattgggacacgctgtatattggtatggcaagacaccaggtacctggtaatacagataattgtcccaccaaaaatattttggtaattgatgcccccaccaagtgaatttttgtatttacttggccaaatgagagaatgatttataagccccacgcgtataaagctttcttcactccaaagcattgtgttggataaggccccagttctggaagccttgcgacaatgccagtcaatcttaccacagacctccccctcccaattctctcaataacgaagacaaccaccccggaatgtgccacacaccctggtaagttctcccacggaacgtcgacccattgttgaagttcacccccaacattctgctccgccataatactcccgggaaaccaatgtttcgggaccactttataagatccagcttacctgtagtaatcccttggcttttagagttctccccagggctgagatccccgcttatcaatgtctgccacccacccccccacaaaagctgtaatattaatcgttttgtcccccttgttttaaataagacaagtctccatgtatgcaatgctgcaaactctgtgcgacttttcaacattattattttctcaaaaggtttgacccctttgcgaaacaaaaaaatttccaaaaaaacggccagacatgacaaa

SEQ ID NO: 697460 - DNA, 220 bp, Homo sapiens
tgtaataacaggctgaacatgaaaatataatggtgaaattttatttattatcttgagacaggatctcgctgcccagctgaagtgcagtggcatgaacatgactcactgcaacctccacctccattgctcaaggtgggtggacatctcagccttctgagtagctatgaccaccgtgcaagggtgcacacccggctcaattttttattatcctggtagagac

SEQ ID NO: 697461 - DNA, 390 bp, Homo sapiens
gggaacccgagggacagggaattggaagaggtggagtgtgtaagggtagtcgtgcaggtgtagtcgatcgttggaggggtcccaggatggtagtcatgggcggcagatgtgcaagttgcgggacaagggatgagtgggggtcatgttcgttgaccatgggggccgggccagtgggacgtcggccgtcattatcgcggtgaattcagtccgttcatgtacaaaagcgcgcttcagggtcggtgcgtgaaattaggggagggcgccggcacgcagtaatcggatgggttcgatagaagtaaaggcgttcggggggacaccagtacttaaaaccagcgacgcaatcggcatgaagttgtacaccccgagtcccaccaatcgctatttttccct

SEQ ID NO: 697462 - DNA, 1239 bp, Homo sapiens
ccacgcgtccggagatatgggagtatttacctgcacagaacgcaccttcaggaactgccaagccagaagcaaaatccaaagctgctctctgcgatcccttcacttattaacgtctcagtctgcactattattttttttaacctgagcatctattatgtgctaggccctggttccagatgcgtcggggacgcagcgtgatgcactgaacagaacatgggggactggaggacaggggagaaacccccgttcacggggccttaggaatggcagagggggctcagggcacagcgagcagccaccagcacacaagtaaacaggaacataatactgtcccccgagcatgccgaacaggcaggcaggcaactggggcatgggtgcatggtgcaccattacaagtgcttatgcaacacgctggcgttctgttcggcctactgaaactctgagcctattggtgggactctagtaacttattgggaacaagagtgggaagacccccgtgtggtatcctagaattccacaagcctgcgccggcgtgcgacgatagggcgctagggggcgaaggggtgagatggtacccaacagcgtggctggtagggcacaccagaaaatacatcaaaacatcaaccgttaaaaggaggcccgcggtacacatcaaataagaacacccacccaagcgattgacacggggaggccccaataacacccgagatacgaccacaagggcaagggggtaatagcgaaccgaagggcgcaagatgcaccgaagaagacgaccgggaaaaattagcgccaaaggaggcacacactataaaccgccacgaaagtaagaggaagaaggtaggcaaaaacgaagcgaggatagtcgcgatcgaaagggcggaaccaaagcaccagaagggccgcacagtaagaataaaccgatacaccccgacgtataacgatacgcggatccacgacgcgtttgtgagaccgccagaagtggcagcgaaccgaataccaaataaacgaagggggacaaagtggagccaccaaacaccaaaggggtgaaaggatgggagaccgaccacaggcgcgggcacacaattgatcgagggagggagaacactagggcaaacacaccagcggggagcggaccaaaaagaggagagtaacacagaggaaaggagaaatgggggaagcgtggaacaagaggaagaaatcccccagtgaggaaaaagacgtaaggaaagggagagggca

SEQ ID NO: 697463 - DNA, 101 bp, Homo sapiens
taaagatcaggaaggcgttgtcgtaggcactaatcgacgacgacacctccgggtgcaccaggcgtacgtgggacagcatcttcttcatgatgatgccggcg

SEQ ID NO: 697464 - DNA, 271 bp, Homo sapiens
ctgctcccgaatgatcatacgagctttggaagtgcagcaatgtatagtatacgctgttggagctggaattaccgcggtggctggcagccagacttgccctccgatggctcctcgtgcgcggatttacagtggagtcattgccaattacagggcctcgaaagagtcctgtatagtcatttgacgtcagtacctcgcggagcgatctataggtgtagggtaccgaggtgaatggtgggtatggtgagtagcgtggtgtgtgtgaagtgttatg

SEQ ID NO: 697465 - DNA, 103 bp, Homo sapiens
ctgggaggccagcgccagcgggcaggagaggtcagcaaagaaacgtggggtgtcgcgccatctactctggaggggctggaggtgaggggcacgcccgctcaac

SEQ ID NO: 697466 - DNA, 145 bp, Homo sapiens
tcggttactatagatagtggtctacagttgatatagacaaaatactttactaagaaatgttcagcaaagagctcattttaggtgtatgactcaccttctgtacccagttctccctcttttttttttaaggctagtggttattccc

SEQ ID NO: 697467 - DNA, 518 bp, Homo sapiens
tggggtcctttaatgggccgatttggtcttttttcttcttttttccccattttttccacagggatgtggacagggctcagaagaaaaacatataaaatataaacacatctcttctctcaaatagtctctttctccgtggtgtacaaacgcaggcgtctctctctctctgtggcgcgcgtggggcagatataagagggtgtggctggggacagagcgtggaagtgtgggagaggaggcgtgaacaccttctcccccaaaccccgagttttagactcctgtgggttctccttcctcccagaaagaagtggcagaagagggcagtgggtgggaaacagcgaggggaaaaacatagtgggtgagtgcacaaaaccccgagaaggaactcacgaggggcgtgagtgcctccgtggggcccccaagaggttccccaccaaagcccttcatatgaaaacagggtgctgggccaaggggggggcccgcgagggccctccgtgggggggcgtgccatactgggccta

SEQ ID NO: 697468 - DNA, 157 bp, Homo sapiens
  misc_feature (24)..(24): n is a, c, g, or t
  misc_feature (28)..(28): n is a, c, g, or t
  misc_feature (34)..(34): n is a, c, g, or t
  misc_feature (40)..(40): n is a, c, g, or t
  misc_feature (84)..(84): n is a, c, g, or t
  misc_feature (90)..(90): n is a, c, g, or t
  misc_feature (96)..(96): n is a, c, g, or t
  misc_feature (99)..(99): n is a, c, g, or t
  misc_feature (117)..(117): n is a, c, g, or t
  misc_feature (138)..(138): n is a, c, g, or t
  misc_feature (151)..(151): n is a, c, g, or t
  misc_feature (153)..(153): n is a, c, g, or t
gctggctgtatggaaatgcacccncccncctgcngctccnctctagaaccgtctagaacctggctgtgctgcttttgagccgcngacccnggggcngcntctcggttctgcgcggcntccgttgtgtttatatggcgntttgtctgtgttncngttt

SEQ ID NO: 697469 - DNA, 410 bp, Homo sapiens
tatggtaggggcaattcatctgagttgcttctcttaccagagagtgatgcataaagaagcgcaggtatttctgcgttaccatgaccctattcccagtggttcctagccagttgactctcctgcactggataccatcctggacagcattcctgtagggaaactgagccccctgctctgcttcccaccatggcacagttggtcctttgcatggacgcaccattattgcccctgtctcttcttggtggaccttaaggttttctccatcctttggctgtaacacacactgctccaagtgtgtgagcatatcagtaggaaacgcttccaggagtagaactgctaggtcagagggcgtgtggatctgtaacctgacagacctagaccggcttcagtatggtctctcggcttgtgca

SEQ ID NO: 697470 - DNA, 149 bp, Homo sapiens
actgttgttcatacctccgtactcctcctcccctcgttccgccccccgatacagcgaccaggtatgaacaacagtgcacccccgatacagcgaccaggtatgaacaacatgtgcagtgtatgaacaacagtgcagtgtggtacctgagc

SEQ ID NO: 697471 - DNA, 321 bp, Homo sapiens
cccggactggagtatagtggcgcgatattggctcactgcaacctccgccattccgggctcaagcaattctcctggctcagcctcccgagtagctgggattacaggcatgcatcgccacgcccggctaattttttttttttttttagtagagacagggtttcaccagtgtgggccaggctggtcccgaactcctgacctcaggtgatccgcccaccttgtactcccaaaatgttgggattacaggcgtgagccaccgcacctggccccatctttctacaactgggaaaatcctgagttctggaaccacctgcgggtaccgag

SEQ ID NO: 697472 - DNA, 327 bp, Homo sapiens
tagtgaataaaatgtttaaaataatatatttacatatgtttaaaactttggggaggccaaggcaggaggattgtttgagctcaggagtttgagaccagcctgagcaaaaaggtgaaacctagtctatacaaaaaatatgaaaattagaaaggcgtggtggtgcacacgtgtagtatcagccactcagggggctgaagtgggaggattgcttcagcctgggaaataaaggctgcagtgaactgtgatcatgctactgcactccagcttgggcaacagagaccctgtctcaataaatatataaataaataaataaaaataaacaaaata

SEQ ID NO: 697473 - DNA, 338 bp, Homo sapiens
acgatagacacatcaaaagtaggccacctacccaggtacaaagatagagcacgctatctttctagctaccaacctattaaagtactaatctcgtaagtcaataagctagtcagcagtatggctacatataactaatatctagagtaacatatagacgaccagtcaataagttacccagcatactaatggtaagacctagatcgctagaggagtacatataaaagtaaaagctaggtcactagtagactaacagtcattaggtaaacagtactatacccaaggtaaggctatactagcaatattcctatacatactatatgtatcagaatccataagga

SEQ ID NO: 697474 - DNA, 349 bp, Homo sapiens
cggcagcccggaggccgcaccagatgccgccgccgccgccattttttttcccctcaggccgccagccccggggccggggcccgcccccgaataacggcccccgcgggcggccaatccgagaaaccgcgcctgcgccccaaaggcgggcgggagcgggcggagggcggggaattaatttaagcctccaaagacagcgcctcctgctgcctgaacgagaactgcccctttttttgcaaggatttttggatttgtgtgaaaactgagcccccgacaggttaaggggctttcctaaagttgcccagtaagttagcaatttcctttggaataaagttcatgatatatggcttta

SEQ ID NO: 697475 - DNA, 1272 bp, Homo sapiens
gggaggggcggttggctttgttggagtgatgcttgatttgtgtccctgtggggtggacgtggttggtgattgaggcaggatcctggtattccgctaacaggtcaaaatgcagatcttcgatgaaaactccttacctggactaagacctatcacccttgtagtgtggagcccagtgtacaccactctgaaagatgtgaatggccaagacttccagagaataacggaaaggacaattgcctctcccggagccagacatgaggactcatactattgccacgtgccaagacatgtgctggtacacgactgagccgttctctcttttctgcagctatcaactatttgccagataggtagttcgaatcccttcaaccgcttgggttccttgtcgatctagaagaagggtaggctcattgtcatgtactctttcgtagaaaagaacccactagtatcccaggagccgaatggatcacagtactaggcacttgtgaatcaaggttgtgcaggccccacaaggggtaacatctcattctgaaaatactttgttgaaatgggctcataagatgcccaggaggcattacgacagggcactagcggctttcgctcgttgctccagaacacaagacgtatgcatggacattcaaatccttgtttaggcgatgtgggcaaaagccaacgacttcgggacatggatgtggggcgctggccacgttcctctatgcgtggaatcgtaaaccgaaactttttcaccatagtaggcggtaggttcccggaaagccttgggggtccgttggagggtcgcctttgccaggttcggttgaaacggagggcggctcggttctatagtcgcccaagtacctccggttttccgggttggataggacgggaccccgccttgaacagttcacagtggcccggtgggatcgccagttcgggcgtctctgtgtgacacggggccgttgtacaggggctaaatgttgcacctccccaggtctgcaaaagtggttggccggaaaccgtgcgctaaaggcaacttcccaggggcatttttcacagggcaaagagcgcttttcacgcttgcgcccggggactccagtcaagtaattgcgttacccatcaggtctaagaccgatcgacttacagcacaaaggtttgtgcaaggcacttggggcccgtgcaatcactcctggtaccttcgcacctcttagccgaactcgttgctcaaagaaaagcacagcatgttcacaacaccttggcgaaccctcgggtatacgt

SEQ ID NO: 697476 - DNA, 279 bp, Homo sapiens
gttacagattaccacgaaccaccacctatatactattgaaaatgccccaacctaacatactaccgtctggaccaccattaattatcccatatctccttacactcttcctcatcacccaactaaaaatctgaaccacacactaccagctacctccctcatcaaagccacataacaataaaaagttacaactatcgcctggataaccaatcatgcacgaatctctgtgcgcttcattcattgcccccacgatccgtaggcctacccgcgcggagtactgat

SEQ ID NO: 697477 - DNA, 329 bp, Homo sapiens
  misc_feature (305)..(305): n is a, c, g, or t
gacagggccctgatctgtcgctcagactggagtgcagtagtgcgaacacagcccactgaattctcgacttcctgagctcacacaatcctccagccccagcctcccaagtagccgggaccacaggcgtgtgccaccaagcccagctaatttttttttccattcttcgtacagacggggtctccccatgttgcccaggctggtctcgaactcctggggctcaagcaatccttccacctcagcctcccaaattgccggggttacaagtatgaggccacccacaattcagcaggggacaattattatgnccatttacagatgaggaaaagttg

SEQ ID NO: 697478 - DNA, 307 bp, Homo sapiens
aacgtcgtatttttttttcccccaatctcggctgctaacttcagaagggacagagtttttgtgttaaggaaatggctatggattaagatggtgcaagaaacacggtagatggaaccaaaattatataaaaccgtgaagggtatggcttcccattggtcttccggtcctggtcctacttccacttgccgggccctggcggccccagacctggcaggggggggatatggtaatgtgagagaagagcagagctccaggagagggccccccatacggatagataagagagggcccgagctcgattccgaaa

SEQ ID NO: 697479 - DNA, 169 bp, Homo sapiens
tgatctcaccttcaccatcctaggccccgttactttcctcactatgttctccagcttagtcataatatcctcatttatcaagaacttcagcttcaaacctcacatgaccctattacccagtgcatggtgcatgggcacctcgttatcccacgctactcagtgacgctga

SEQ ID NO: 697480 - DNA, 372 bp, Homo sapiens
aagacatgagtgatgcaatagactttggggactggaagaggaagggttggggtgagggataaaagactatacacattgggtacagtgtacactgctcgggtgatgggtgcctcagaatctcagaaatcaccactaaaaaacttattcatgtaaccaaacacgacctgttccccaaaaacctattgaaataaaaaagacagaaagacaagacatgaaaaggttaagccttaggcagagaaattaaataatggtgaggaatggagtaacatagtggttgagtgcatgagtcgatgacctctgtgtattactgatttaacatctatgataataataatattttcctagagctattatgtacgttacatgtttttt

SEQ ID NO: 697481 - DNA, 754 bp, Homo sapiens
tgggcttgactcaggatttaaaaccgggaacggtgaaggtgacagcagtcggtgtggagcgagcttcccccaaagttcacaatggtggccgaggacttggattggcactattggtggttttttaaatagtctattcccaattattatgagatgctgttcgttacgaggaagtcccgttgccatcctaaaaagccaccccatttctctctagaggagaatgggcccagttccttcttcccaagttccacacaggggaaggtgatagcattgtgcttccggtgtacaattatgtaagtgcaaaattttttaaatctctcgccttaatactttttaattgtggtttaatttggaatgatgagcctttcgggcccccctttccccctttttttggtcccccaatttgagatgtttgagggctttgggtctcccgtgggagttgggtggaggcagccagggctttacctgtacactgatttgagacccagtttgcaattaacgttgcccccctttaaaaaaaacaaacacacacaccaacaaacaacaaacaaaccaaaaacacactccagcggggcactcttctttccgggggggcacacaacaagagtctaatcagaatgcgggaccaggtggacatcatcgtgttctactccacacacgatattttatgcacaatggtggatacttgcgggggtcccccacaaatgtaggggcccataaaattctgtaatccaccggagatacccggttataaggg

SEQ ID NO: 697482 - DNA, 422 bp, Homo sapiens
acaaagtgatgccctctagcctcacctttcatccatgcttagcgggtattcgtgccggcaggttggcgctaacgcagtgtgatgtgtagaaggtgccgtgccctccaccaagtcctcctgttccagcccggctattcgctccagggtatctatgttctagagggagagatggagggaagaggggtgaggagtgagccaccccttgtaggccagaaggcacagtaagggagttgagggccacgagtagcagtgaggtggtggggacaggtggagaaagggagggaggagaagcaaagtggcagggtttaatctggaagaactcttctgttcatcccaatggtgccacttaaagggtgacagtcaaggctgcttaaaggcaggggccaggctgtgcatagcggctcacgcctataatcccagca

SEQ ID NO: 697483 - DNA, 431 bp, Homo sapiens
gagggagagggaagaggagagtagagaggaagagaggaagaggagagaagaggagagagagaggaaaagagcggagggagggaggagaataggaaagagacagagggagaggtaagaaggaagtagagagtaggagagaggcggtgggagagggagagaagttgaagaaagaaggagaaaggaggaagaaagaggggtgaggagggataagcggggaggagatgtggaagagatagagaaggaaggaagaaaggagtgagagcataaaagggagggaaatggcagggacaggagaggaggcaaggagagagagatagaggttaaagtggaacagtgagaggaagaatgagagatataatactctatatatatatatatatatatatatatatatatatatatatatatatatactactatatatatatagt

SEQ ID NO: 697484 - DNA, 212 bp, Homo sapiens
atagggagtgtgcctgatatggtgattttggctacgccagttctgttctcctttctccttccttgctctgccatatcttttctctgttttaaaaagctgatggtggacggatggttctgtcctgtcatttaaaacattcttctgccaggctcggtggctcacacctgtaatctcagcactttgggaggctaagggcaggtggattgcttgag

SEQ ID NO: 697485 - DNA, 386 bp, Homo sapiens
  misc_feature (231)..(231): n is a, c, g, or t
  misc_feature (247)..(247): n is a, c, g, or t
  misc_feature (343)..(344): n is a, c, g, or t
aatttatgcaatacccctttgaacttattaatcatactgaggtgaaagaagacttagggaatatacttaatttagacagatgtagttttcaaactgataccctttttattcaaagtcaaaacaattctcctcaaaacaataaatcattttgtcaatgtggatgcaaatattaaaggaagatgattttcagtacctgatttagttattggaaaacttttaagtatgtttganagcccttgagtatgtnaaccaactttttcaactgaaaattttatgaaatctagattcagatcaagtattctcagtgaaaatttagcgcacaaaaagagatatgctgtaagtnnttttaaaagaaaaaacagttttcaaagactcaatactaaaaa

SEQ ID NO: 697486 - DNA, 167 bp, Homo sapiens
acagaagagggggtttctggagctgaatctccggcccccaccaaaacggagatgccgtggccggatcagcccggacaaaggtcagctagccccttgaggacatcagcttgggcctcagggtcctaagggcagcagaaccacggacagagctagaggggtaccgagct

SEQ ID NO: 697487 - DNA, 117 bp, Homo sapiens
cacctctgtttcagtttgtggggtgctcatgctttcctttcattcttctccgtaggtacagctctcatgtcctcccctccctaacagaactttctgacaaagctaagcccactgata

SEQ ID NO: 697488 - DNA, 623 bp, Homo sapiens
cgaaaaatttaaaaaaaaaaaaaaaaaaaaaaaaaaaaaaaaaaaaaaaaaaaaaaaaaaaaaaaaaaaaaaattaaaaaaaaaaaaaaaaaaaaaaaaaaaaaccttgtggcccgcttgggcccagtcgattttaaactcggccaggtttttgcttgcggccgaatttggggctcattgggccatttccccttatggggggccgttttccatttcattggccgccgtttaacaccgtcgggacgggaaaacccttggggttccccactttaatcgcttggcagcaaatccccttttccccagttggcgtattaccgaaagggcccgcaccgatggcctttccaaacggtggcccaccctgatgggcaatgggaatttgaaggcgtaaatatttggtaaaaatccgcgtaaaattttggtaaaaccagttaatttttaacccaatgggccgaaatgggctcctttataattcaaaggattgccccgagatggggtggagggttgtcccagttggaaccaggagcccttttttaaagaccggggcctccaccgtcaagggcgattttttgggtccaggggcgccaaaggcctatatttggaaccctgggcccccgttttaggtt

SEQ ID NO: 697489 - DNA, 165 bp, Homo sapiens
agatgtatggttggtgatcttatggtagatgaatgaagcggaagaagccgctggatgtgaggacagatgtgtggaaattagagatgggatgatgcctgtgtatctgggcatgttctcatggtttccacagttaatgtctactgctactgtgatgagagtgcctgc

SEQ ID NO: 697490 - DNA, 109 bp, Homo sapiens
  misc_feature (11)..(11): n is a, c, g, or t
  misc_feature (84)..(84): n is a, c, g, or t
agggtgagcancaaactcaaactacgcctgtcggcgcctgggagcagggagcccaaacaatctcatatgaagcaccctagcatnattctactatcaacattactaataa

SEQ ID NO: 697491 - DNA, 913 bp, Homo sapiens
agcggagtcggatcgcggaaaccgagactggctggatgggaaactctgtatccagtgaaggctccggggccctcaagagtggtctccgcaccttcccctgtgaacactgtgtacaccatggctagtcttgcgccgaatcattagagcgcactggcgaactgcgcgaccgcggttcacgatgtgcgtccagggctgacacaacgttccggaagagtttcaccttcctggacgctgtggcagattgtatccttctagcatcacagagtagccgaacttgagtcatcaactctccgtgacttgtcccactcggactaatgtgcgtagggcattcgagctacaccgcgaagttctctccgactctctgacggaaatggtctacttcagcgggtaccgggatggaggccctaccctgctcgcgacttcgtagaggtgtttacggcagtcgaggcccagtcggtcgcctccggcttgaatcataggaatactactcggcgcaggggggcggtctaaggcagtatcgttcctcgtcgcccacggcgttgccccgcgcgattttactgattgtatcacatcatggctcgcttccccatggcgagcgggcaatggggcaggtaggtgcgggtgatagacagtgagcctggagaaggttgttaggcacgctcgcattccgttcgcacggacaccctaggcgtggcaataggcgggccgactatggttcgcgttggccattcgttgtaagccatgtaggttgccaacgaatgtgaaccctcctttcccaagcagttcgtagaagaggccatccggagggagttcctaaattcgcacagactttttgcaaggaacactcgccgtaccggacgttcccccaccccggccacacaaggtcccgggagcccttctagcgggactttgg

SEQ ID NO: 697492 - DNA, 116 bp, Homo sapiens
gaggtgatcctcctaagtagctgggactacaggtgtacaccaccatgcctgactaatttgtttttgtttttgtagagacaggactccagcctgggtaacagaggaagaccttctct

SEQ ID NO: 697493 - DNA, 545 bp, Homo sapiens
tggttgttgttggggaggatcggggccgagtggggcacaaagggtctttttgcaggtttccttcctgggattaaaaggggggccccctcctgggccataatgatcagcacttatgggtttggcaaaaggtttttccaaaggttgaaccaggcccggcttttggggggtttaaaggggcaaggaggcaaggaccccgtttttcccccggatggggaaagggcaggaggaaacccacccaagggccttttcctcagccttaagggaggggggttgtttcccttccctcccggggacaaggttcaggggaggggtgtccctttggggggcccagcatttcctcaaacaaaattttttcctgggggtccagtgggggggattatcatttaccccccccccaagtttaagaccaaattttccaggggccccctttgggtttccctgggtttgggggagggggggatgtttccaggaaccaaaaagcccccagccggggggagtttccctgccccttgttaattccttaagtttaaaaatgatgaatttca

SEQ ID NO: 697494 - DNA, 137 bp, Homo sapiens
gggcccccaaatttttcggttggcccgggaaagggaggggggggattttaacccctcccctttttttttgggaaggccggggtttttcccaaaaaattaaaagggggggggggcctttttttttggggttgggggga

SEQ ID NO: 697495 - DNA, 489 bp, Homo sapiens
ggatccagataattaaggcttctcaaatggcaactaataatttgcatttgcagtgcggccagccttaggcgctcggggaacccacacaggtgagaaatgaaagaaaaagctcttcctggtggtcatctgatctttcctaatggagtcttagaaaaatcatttcgccctcccgccctatcttgctgaagttattaagtgacctaggggagctattttcatttattggaaagcacttgggaccagctcacagcattaaggagtgtggggtggttctcaagtctatctcctgcttctcatccctctgtcactcacaaggaccaccccagagggtctattctaagaggtctttgtgcttccagcccctccctcctcgaatccctctttcacattgtcaccagtaagatcttcctaagcccaagtttggaccattgtccttctgctttcacacctccattgtatccagaattaaagtccaaattcctgtgtaaa

SEQ ID NO: 697496 - DNA, 204 bp, Homo sapiens
gttcctttaccaggccccctggagcagaaggacttccggggtccccaggcttgcccaaggtgccccaaggaggaccgagggcttttcccggaaccccaaggaagggccaaggcctggccaaggagagaaaggggcgctgttgggccaagccaaggcatttggttttccacggggccccccggccccaaaaggtgtttgacggaa

SEQ ID NO: 697497 - DNA, 214 bp, Homo sapiens
  misc_feature (81)..(81): n is a, c, g, or t
  misc_feature (130)..(130): n is a, c, g, or t
ccagcttgcccagaaatacaactgcgacacgatgatctgccgcaagtgctatgctcgccttcaccctcgtgctgtcaactnccgcaagaagaagtgtggtcacaccaccaacctctcccaaagaagaagngtcaaataagtgtttgttctcttccgttgaacgggcagcgctccgtgcccagtgccccgttggcccttggatgcctcaaataaa

SEQ ID NO: 697498 - DNA, 371 bp, Homo sapiens
atccttccttctctcacgttgggggacaaaaaagggggaagggggggcaccaaggctcatcactcacaataaaacacaataaaaaattttatggcgaagataaaaaaattttgcattacataatttacacgaaagcagtgctgttacctcccctgtgtggacttgggagaggactgggccattttccttatagagaaatggggtggcttttaggatggcaagggactttctgtaacaacgcatctcatatttggaatgactattaaaaaaacaccaatgtgcaatcaaagtcctcggccacattgtgaactttgggggatgctcgctccaaccgactgctgtcacctttaccgttccagtttttaaatcct

SEQ ID NO: 697499 - DNA, 212 bp, Homo sapiens
cagcaacacagtacaagcttccagaaagagacaagcaactacattactcagaatataatttagaagatctatagtgccatcattacggagcctttataagtcagtatatgatcagtcacttagtcaacaaggtttgatgaacatcccttctgaatcttcccagcagacccacagcttcatgtgcctatcaggactactcccagcattacagt

SEQ ID NO: 697500 - DNA, 122 bp, Homo sapiens
ttaagggacttaactaagcaagcagctctccagtaaacggcttgtgccaagtaaacaccaagcgaagtcctaagcccagcccaggccaacgcctccagggaggcttgccaggaggaaggtgg

SEQ ID NO: 697501 - DNA, 163 bp, Homo sapiens
aggggtaagtgggacaaatggaatggaagggagaagaaagagatggaggaggccagagggaaaaggagagggcatgtaaggaaaggcctggccgacgagtaggctaagtgagtgagagaacatgggtcctggcagtggagcacccacctgagtccgacgtagt

SEQ ID NO: 697502 - DNA, 506 bp, Homo sapiens
  misc_feature (395)..(395): n is a, c, g, or t
  misc_feature (477)..(477): n is a, c, g, or t
aggatccccatggtacctgaatcagacggctcggagctataacttccaaatatgaaatagagacggaagagatttatttccaaacattatcaaatacaaggggcttatgaaacacaggttctggctagattttatggagattaaaaaatatatttcatagctgggcgcaggggcttagggttgtaatcccagcacttggggaggttgagaggggcggatcacgaggtcaggagatcgagaccatccgggctaacacggtgaaaccccgtctctactaaaaacacgaaattagcggggcatggtagcgggcacctgtagtcccagctactcgggaggctgaggtggagaatggcttgaaccccaggggcggaggttgcagtgagccgagatccggncatggcactctagccgggccaacagagcaaaactccatctcaaaaaaaaaaggaaaagaaaaatggtcctgctcgggatgtnatcctcagatagggcctggtgcctgggga

SEQ ID NO: 697503 - DNA, 166 bp, Homo sapiens
ttatgggtagaggtaataatagaggtggagactacaggtgctgtgaactagtaataggtaactacgcttatctagtcaggttcggtctaggaggagtaggggcaggtttggctcgtaagaaggcctagatacggggatagtgcggtgtgtgatgctagggtagaat

SEQ ID NO: 697504 - DNA, 422 bp, Homo sapiens
  misc_feature (412)..(412): n is a, c, g, or t
tgactggggactgctgctctgaagaagactctttcatgcttcctccttagcttctgatggctcctggcagtccttggcttgtggctgcatcacttcagtttctccctccgtcttcacatggccttctgtgtctgtgtctcgcatggccttcttccctgtgtctgtgtctttccatggcctacttataaggaccccagtaattggatttagggcctgcctaatccagtctgatttcatcttaactaactagatctgcaaagactctatttccaactaaagtcacattctgaggtttcaggtagacatgaagttttgggggacaccacttcaacccattgcagaacccattaggcagtcacttcccgttcctcaacgcccccttaccccaggggcaatcagtaattctactttnctgtctgttt

SEQ ID NO: 697505 - DNA, 120 bp, Homo sapiens
tacgagcttggtacgtgctatggtacgtgctgtgggtacgtgctgtggtgacgtgctggggtgacggctgtggtactccagcacgtcacacagtccacgtcacggatctctagatcactg

SEQ ID NO: 697506 - DNA, 1136 bp, Homo sapiens
  misc_feature (529)..(529): n is a, c, g, or t
aaatgcactgtccaggatgagagccacgtcagagtgcggtgttcgtagttgatccgcattcatcgcccaatctagacagaaaataccctattcattcggtcgtccttgtggcctgggacgaatgcgtggtcaagggtattgtggaccctggcgtaacgtgcgagctgaaggaccaaggcaacagttggtgcacacagggcgtattatgaacaccggtgatctgtcatactcacagataggatcgcctctggtggcttcgtgggagggcaaggcatggataggcacatgtaatgggatgcgttcataggaacggcgaataagctttgaaacgcgtgagaatgggtggagtgacgatcgatgaagacagccgcatgtatgattaatggcctgaacacgcgtaacatgaggatgtagatgattgcccatcatgtgccccaagcaatcacaggatgcgtgtggatgttgacgacggggcaaacgagtcgattggtcacagattgaggacctgaagcaacgaaaggttatgcangtagccaagtcatggccagggtcagaatccaatcgcacagatgcgagcactcacacatgggacactggtgtctgcgtggatggcacaggactggaggttatgggtggtctgcaacggaatcaagctggttgcagaagtgtggacagggtgaaccatttggaacaaaggctagtgaaggttaactgggtagaaggcttttaacaataataccataaaatggggcagagaccctggagattacatctctgacaaccacacaccctggtccaattttcgaccacacccggaacggtcagcgcagtggtgcccaacgtggagccacctgttgacagaacgccagaaggcccatgtgggcgacgtgcgctcccaccaatgtaacggcaagcgtaagtgaccatgtggcagcacagggccggacgcgcgaaggggatactcgggggatacaaacgaaaggagtgcgggagagtgatccccacattatgacatatagcccgcgggggggtcaacagcagaggtccgagggacagacacaccaaagaggcgcgcgaggagagcaacaggggcgcgtcacaaagcgggaccaccggagaggggggaaataaaagcg

SEQ ID NO: 697507 - DNA, 712 bp, Homo sapiens
  misc_feature (2)..(2): n is a, c, g, or t
  misc_feature (77)..(77): n is a, c, g, or t
  misc_feature (79)..(79): n is a, c, g, or t
  misc_feature (99)..(99): n is a, c, g, or t
  misc_feature (109)..(109): n is a, c, g, or t
  misc_feature (123)..(123): n is a, c, g, or t
  misc_feature (137)..(137): n is a, c, g, or t
  misc_feature (173)..(173): n is a, c, g, or t
  misc_feature (191)..(191): n is a, c, g, or t
  misc_feature (198)..(198): n is a, c, g, or t
  misc_feature (208)..(208): n is a, c, g, or t
  misc_feature (212)..(212): n is a, c, g, or t
  misc_feature (226)..(226): n is a, c, g, or t
  misc_feature (230)..(231): n is a, c, g, or t
  misc_feature (234)..(234): n is a, c, g, or t
  misc_feature (256)..(257): n is a, c, g, or t
  misc_feature (259)..(260): n is a, c, g, or t
  misc_feature (268)..(270): n is a, c, g, or t
  misc_feature (276)..(276): n is a, c, g, or t
  misc_feature (287)..(288): n is a, c, g, or t
  misc_feature (357)..(357): n is a, c, g, or t
  misc_feature (360)..(360): n is a, c, g, or t
  misc_feature (397)..(397): n is a, c, g, or t
  misc_feature (405)..(405): n is a, c, g, or t
  misc_feature (412)..(412): n is a, c, g, or t
  misc_feature (419)..(419): n is a, c, g, or t
  misc_feature (423)..(424): n is a, c, g, or t
  misc_feature (445)..(445): n is a, c, g, or t
  misc_feature (451)..(451): n is a, c, g, or t
  misc_feature (463)..(463): n is a, c, g, or t
  misc_feature (476)..(476): n is a, c, g, or t
  misc_feature (478)..(478): n is a, c, g, or t
  misc_feature (481)..(481): n is a, c, g, or t
  misc_feature (483)..(483): n is a, c, g, or t
  misc_feature (486)..(486): n is a, c, g, or t
  misc_feature (490)..(490): n is a, c, g, or t
  misc_feature (498)..(498): n is a, c, g, or t
  misc_feature (501)..(501): n is a, c, g, or t
  misc_feature (505)..(505): n is a, c, g, or t
  misc_feature (518)..(518): n is a, c, g, or t
  misc_feature (522)..(522): n is a, c, g, or t
  misc_feature (537)..(537): n is a, c, g, or t
  misc_feature (551)..(551): n is a, c, g, or t
  misc_feature (563)..(563): n is a, c, g, or t
  misc_feature (577)..(577): n is a, c, g, or t
  misc_feature (583)..(583): n is a, c, g, or t
  misc_feature (586)..(586): n is a, c, g, or t
  misc_feature (590)..(590): n is a, c, g, or t
  misc_feature (599)..(599): n is a, c, g, or t
  misc_feature (615)..(615): n is a, c, g, or t
  misc_feature (624)..(624): n is a, c, g, or t
  misc_feature (626)..(627): n is a, c, g, or t
  misc_feature (705)..(705): n is a, c, g, or t
anatgcctcaaacaaattaactttattttcagacaacaggtccaagaagacttcacagctcaatcatgacgaacatnangctgtatcctcacagccagnaaccctcggnattagaagaaaaanacaaccccccacancatcatcaaacctcttttctcactgtgaagaactgntgagacagaattcctganaaggggncatttaggtnatcngggataggggggcntggnnggnctgggcaaactaagcctccccnngnngggggggnnnagcctnttcccaacccnnctaccagcccacccgccccctccgtctcttccggctccccccgccgccactctagatgctctgcttggnggntgtccgtgcctgcgggggcggggggtgggtctggggngcgggggngggttgncggcccnttgnntccgtactctgcgttgggtcngtgtgnacttggctttgntcccaatggtcantnctnanatnggtncttctganganggtnggtcaggtatatnccanccaccctcaccaganaatacatctatganaaacccaaattnctaatcctgaagtnctttgngcnactntacattgtngccactcaataatagnataaatttntnnaaaagctgcatgttttattttaggaaatgagtagaagttcacaagcaacccagaatatgtgccagcagtttgctccantgggcca

SEQ ID NO: 697508 - DNA, 182 bp, Homo sapiens
gcatcccccccgcgaatcgcacggagttgaggcacacgatgtggccattgtgctgctgcagattacgcttgagcatggccttgggggcacagatctgatccaggatgtttatgtgttgcaacttgaggagcgcctgagcaggaggtcggaatcaagaaccagagatcgcaggaggtcacgct

SEQ ID NO: 697509 - DNA, 380 bp, Homo sapiens
cttatggctgccttgagataccacgtgcacgagaggcctctttgcgactcccgtcctctgggcttttctctccagtgccccacagcattaccatttccggtttcatcgaccactttccccttgctttgtgttttctccttgaccctagccatcactgactttggtcgtgactgaaaagaccccttgcgaaattctgcctttgggatttttccttggccgggagccagagagaggtccaatttgtcttctgctaccaaaaatatattccatttcctttcagtcctgtgtttaattaaaaagaggaactagaattgctggataaacacgtgctatttttattcccacctcccacttgcaaaccctcctcctcttcctaatgc

SEQ ID NO: 697510 - DNA, 451 bp, Homo sapiens
  misc_feature (194)..(194): n is a, c, g, or t
  misc_feature (207)..(208): n is a, c, g, or t
  misc_feature (214)..(214): n is a, c, g, or t
  misc_feature (216)..(216): n is a, c, g, or t
  misc_feature (220)..(220): n is a, c, g, or t
  misc_feature (239)..(239): n is a, c, g, or t
  misc_feature (259)..(259): n is a, c, g, or t
  misc_feature (262)..(262): n is a, c, g, or t
  misc_feature (363)..(363): n is a, c, g, or t
  misc_feature (410)..(410): n is a, c, g, or t
  misc_feature (427)..(427): n is a, c, g, or t
ctgtagagacgtggtctccctatgttgcttaggctggtctgaaactcctggcctcatgcaaccctcccacctcggtctcccaaagtgctgggattataggcatgagcactgcacctggccaaaaggcaaactcttccaccaagctaacattcctgagcttttggcgccaaaagaacttcttttttagtgagggnattttttcacgtnnggtacncncccnagattttagatcaggaganttggatttttaaaatgaaantanccaaatatacaggcaataactgacagaaaaatattttgcgaagaaaaagatgaggaggaaaagcctctcgtttgggaaaacctatgaagtgttatggggtnggcgtggtggctccacgccattaatccccagcactttggggaagccnaggcagggtgggatcancctgaaggccaggaagtgattgca

SEQ ID NO: 697511 - DNA, 464 bp, Homo sapiens
atttatattcagatgaaattagggttggcgagtgtctattaaatatctcgattaattttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacctgggggcccccctggccccggggggtttaagcccggggcagctttagcctggggcccgaatttgggcccacttggcccattcccccttaagggggggggattaccattccacggcccgggttttaccaccggggggcggggaaaaccctgggggtccccaacttaaaccccttggaggaaatcccccttttcccaggggggggaaaaaggaaagggccccaaccggtccccctttccaaaagttggcccaccctaatgggcaagggaaatttgagggggtaattttttggtaaaaccccggg

SEQ ID NO: 697512 - DNA, 178 bp, Homo sapiens
  misc_feature (63)..(63): n is a, c, g, or t
  misc_feature (130)..(130): n is a, c, g, or t
gtgggagaggacaggttgggggaggaaatgaagagttcttttctcttctggtttcctgccctnccattcaaaagccaggaaatttctacagtaggcaggatgattggctccggcattccttaatttcagnctcaaaatcaagagcttacaccctcagggtcttcttgcagtagaggag

SEQ ID NO: 697513 - DNA, 342 bp, Homo sapiens
gtccaaagtccatgttcttttttttttgagacggagtctcactctgtcgcccagtctgaagtgcagtggcgcaatctcggctcactgctacttccgccttctgggttcaagcgattctcctgcctcagcctcctgtgtaactgggaccacaggtgcgtgccaccacgcctggctaattttttgtagttttagtagagacggggtttcaccgtgttagccaggatggtctctatctcctgacctcgtgatccgcccaccttggcctctcaaagtggtgggattacaggcgtgagccaccgggcccggccatgctcttaactgcctcactctgatgcctctcta

SEQ ID NO: 697514 - DNA, 900 bp, Homo sapiens
  misc_feature (8)..(8): n is a, c, g, or t
  misc_feature (92)..(92): n is a, c, g, or t
  misc_feature (166)..(166): n is a, c, g, or t
  misc_feature (227)..(227): n is a, c, g, or t
  misc_feature (238)..(238): n is a, c, g, or t
  misc_feature (248)..(248): n is a, c, g, or t
  misc_feature (305)..(305): n is a, c, g, or t
  misc_feature (342)..(342): n is a, c, g, or t
  misc_feature (351)..(351): n is a, c, g, or t
  misc_feature (366)..(366): n is a, c, g, or t
  misc_feature (394)..(394): n is a, c, g, or t
  misc_feature (396)..(396): n is a, c, g, or t
  misc_feature (415)..(415): n is a, c, g, or t
  misc_feature (427)..(427): n is a, c, g, or t
  misc_feature (440)..(440): n is a, c, g, or t
  misc_feature (467)..(467): n is a, c, g, or t
  misc_feature (492)..(492): n is a, c, g, or t
  misc_feature (495)..(495): n is a, c, g, or t
  misc_feature (498)..(498): n is a, c, g, or t
  misc_feature (510)..(510): n is a, c, g, or t
  misc_feature (547)..(547): n is a, c, g, or t
  misc_feature (637)..(637): n is a, c, g, or t
  misc_feature (704)..(704): n is a, c, g, or t
  misc_feature (770)..(770): n is a, c, g, or t
  misc_feature (825)..(825): n is a, c, g, or t
  misc_feature (889)..(889): n is a, c, g, or t
tcaccgtntgagtaaaaataggccacctgcaggcctcaggcaaaaagtagaaactggatagaagaataaagcctcaaaaacgcaagtaattntttggggtgcacgcaggagagggcggatctggggtgtggtcagcagaagaccagccgtggccttgaaggcagtntccagtctctgcagcggcgggatgagggtgaagccccccatttgctctgctcagcctaaangtagagtatanaagaaaaccngattctccgtgtcctgccagggaggatactgcagaagagtggactggtgtggccatnatttcagcatcttcaccatgtacgggcctggtaaacngtagccganctttctataaaaatncctggtgccgacccctgatatcacagcnantatcccagaaccaagtacnactctagccatnctttctgcttccnccatcagcagcatgccaaaaccctgangcggaaatttagtaggatcccggcngcncanagggaccacacncccaaacacatgcagccctcgtactatggagacaccnccacccaattcgaaacggaaagtatctactgaacacttgcgtaaacgtaggaggccaataaaaaagtctagatcagggtcttcgtatganaagaatgtttcccagccaccatttgcaacaaaatctctccttaccaattcaacctggtatggccgtnctttgtgatgaatttcttggattccaacttctctggttctcacatctcgacactgtattccgaggnctttcattcttgcaagtgccagccctctcaggttaccatgctctactcctgagcnaactaaaggcattggaatatccctctgtactcggtacactcgagttcatggaggcacgagggcnaggatccgagc

SEQ ID NO: 697515 - DNA, 229 bp, Homo sapiens
tggataggcaaaaggttttaattggtatagattaaaattaacttgggacaaaaattaaaactcaggcagaaaatgtgttttcttctttttggcaacagcagacactatgtaaaaacaaaggccacagtaaaatattggaaacccaaaatttggcagctgtaaagtattatgatattataatatatagacacaggcaggggaggatattaaagaaaaaaaaaagaggggg

SEQ ID NO: 697516 - DNA, 162 bp, Homo sapiens
ctagctgactctagagtatcccactatcgctacataaactcaggtatctcccgcctcagatctccacagtgctggtattacacgtgtaagccactgcactcagcttgtattaaatgagtttatgattttacgtgtgatatggatccactgttagggtcatga

SEQ ID NO: 697517 - DNA, 219 bp, Homo sapiens
  misc_feature (34)..(34): n is a, c, g, or t
  misc_feature (73)..(73): n is a, c, g, or t
  misc_feature (81)..(81): n is a, c, g, or t
  misc_feature (97)..(97): n is a, c, g, or t
  misc_feature (129)..(129): n is a, c, g, or t
  misc_feature (135)..(135): n is a, c, g, or t
  misc_feature (141)..(141): n is a, c, g, or t
  misc_feature (143)..(143): n is a, c, g, or t
  misc_feature (172)..(172): n is a, c, g, or t
  misc_feature (217)..(217): n is a, c, g, or t
aaaaaggctaagtaatatgtgaatatcatatttntgaaaggtaaaaagtacatttgtatattacatatatggncataactngtgaaggatgaaaganagtacagcctctcggtggtgggattatgaatnattttnctcctntngcttgtttgtattttctatattcctaaanttaacacacattattattgctaggataataaacgttttataaaangg

SEQ ID NO: 697518 - DNA, 1047 bp, Homo sapiens
cggtcgatggcgaggagcccgccccggaggctgaggctctggcctgcaggccgggagcggagcagccggcttcattgagcaggccatggatgcgtggctgagagccagggatgccggcaggcgctgctgtgttccggtggcctgcttccagggcctgtgcggcggtgatcaagcaccggttccccaagggctaccggacccggcgctggaggcgcgggttggcagacggcggacggtgcaggaggcccgggaagctcctccgctgtcgccgcgctggaatatctgccccagttgtcttaatagtggactatgcttccaactgcttatatatggcacgccattgaaggctcagtgactgtccgagattatattcagtccactatggagactgaccaaactccccagggtctctccaacttagccaagacaattgggcaggtataggctcgaatgcacgatgaagacctcattcatggtgatctcaccacctccaacatgctcctgaaaccccccgtggaacagctgaacattgtgctcatagactttgggctgagttacatttccagaacttccagacggatcaagggagtagacctcatatgtcctggagaaggcttcctcagtaccatcccaacgaatgaaacactgtgttggaagcttttctggaagagctaatcccactcctcccaaaaggccaggcagtgctaaaacacttcagctgcagtgcgcctgagaggcacacagaggtcctggtggctcgcacgcacagggatgacagcccccaccaggggacctcccagcacaggacatcgacagcaaggacaagcacgacatggacctccggcacggggcaccacacaatgcaacggaccatgacacggacaagcaaacacgcccggccaccagaccccagggcacaacaccggccccggcgaaggaggccacagacgggcagctcccaacgaacgacacacaacggcgcgccaccaaacacccaaaaacagcagccaacgcgcgcccgacgcccaaccccaccagcaaccccac

SEQ ID NO: 697519 - DNA, 718 bp, Homo sapiens
  misc_feature (583)..(583): n is a, c, g, or t
  misc_feature (621)..(621): n is a, c, g, or t
  misc_feature (684)..(684): n is a, c, g, or t
  misc_feature (715)..(715): n is a, c, g, or t
gggggcgctttattttattactcgtcgggggcgagatgaccaccaatctgttgactctgaccccacaataaaaattctaccttggatatgcctgtagatctaatgcgaaccttcgacagagttgggctaacaatgacttggcgtacaacgttcaactgacactgattcgatttaacaacaaggtcagggggttcaagatcacctaccgggcactccgcaatcacatgggtttgaaggctatcatcatttgggaaaacaaatctattatggaagcgtatggacatgagactgccggggtctttaccaaaagaacccttgtccatcgcttttccaaatgcgtcttcgagagtaaaagcacattcgaaccttgtggatacttttagcttgtcaactgtctgcagcaatgaccgagtacctagttcgtatattaggaaccagctatattttgatacatttcattataaaccttcgaggggccttaacacaaacttaaataaaggccaaattaatgacccatttcacctttatataagccgcggtatacatataaaagggtgatatacccatcttgtaaccaccgccntttaatataaggaaaaccggtataattccctgtggccncggaaaaaagaccccattatcgtgcctgtaaaaagatgccaatctaaaagccactcctaaacnagcccttttaagggggaacccctgatattgnccg

SEQ ID NO: 697520 - DNA, 280 bp, Homo sapiens
ttttttttttttggggggggggggcccccccctggggaaaattttggggggggggggcccccccgggaaacccccccctggagaaaaaaatggggggcctttaaaaggggttcccggcttccaggggggggggggttcaaaacccccaaaggccccccccccggggggggggtaaggggccaagaaaaatttccaaattggggggggggggggggcctttttttttttttggaaaaccccccaaaattggggaaaaaaaaacccgcccttttttttttta

SEQ ID NO: 697521 - DNA, 174 bp, Homo sapiens
atcagccgaagagtgtggtgcacttgtctctacaaaaaataccaaaaattagtcaggcatagtggcatgcagcttgtggtcccagctacttggtgaagctgaggtgggaggattacctgagcctggtgaggttgccacagtcttcgcgctgatgggtacctgagctcgacattc

SEQ ID NO: 697522 - DNA, 279 bp, Homo sapiens
  misc_feature (99)..(99): n is a, c, g, or t
acttaggcgcgttctgcgtcctgggagctgctgagaggactggctcaatgcagaggctctgactgagaaaccagagggagccaggcacgcatgtgcctntagtcttggggggctgaggcgggagggtctcctgatcccaggagttccaggctgcagtgtgccatgatcacacctagagaacagccactgcactccagcctgggccacagaagcaagaccctgtctctattaaacaaaagacagcagagggcacctccgcacgcagaacgcgcctaatac

SEQ ID NO: 697523 - DNA, 230 bp, Homo sapiens
ccctcctaaggtgggaatatcctaattaagctcccttaggaatgggccaggtgaataatctattcatcccaggttgggcttggaggtcggatggccatccctttcttccagggccggggtgtttggtagtaaaatcacgggttaatccaaggcttaattaggggggtaaaggtaggcggtaaacccccagggtgggcgggcggctattggaacctcctaaacgggggggg

SEQ ID NO: 697524 - DNA, 384 bp, Homo sapiens
tgatgcaagtgtcctgtgcttaaagtctcgaatcggcgagcaagtctatttgggattggagacccccttcgatgagtgttttgggagggcctggtcggctctgttggcacaggatgatagctcatgcagggagactgttgggaggtattctcctagctgagagttagaagggggcctgttttgtaagaggaaagggcgtccgtatattaactcaaatggactgaggaaggagggtgcttttggactggctctaatgctctccagtgctatgggcaaaaggggaggtccatggttgttggacttcaagagtgagtttggttaactgaaccttatagatcccatttgccctttcgacttttccggatgtctggggccagcatggga

SEQ ID NO: 697525 - DNA, 261 bp, Homo sapiens
tgcagtagtctcatcaggcacgagtctcatcagctgttcatttcaaattccttcttctatttttaatgaggagacggtttttcagctcttgtcgaccagtctgaagtgcagtgtcacaatctcagctcactgaacctccgcctcccaggttcaagtgattctcctgcctcagcctcccgagtagttcgaattacaggcacccgccaccatgcctggttaattttttgtatttttagtacagactggaaagacagcctggtt

SEQ ID NO: 697526 - DNA, 375 bp, Homo sapiens
atatatggatcagaaagacatcgcgatcaggccggctcgaacaggcacggagcgagcgctcgaggcgaatctgcacgatctcgcgaaaaaccgttcgaactgtctggcggtgaccttggaatgcggcgtgcgatagcataaagtttggtgaaatcttgcgtcaccgcctctggccagtcgcgcacgaatttcggcaaattgacgcgacttcgatatgcggtcgtaaagctgcggggataatgataaccattgtggacacgcgcttgattgttgtatgacgcacgttgcaggagtgcagcttcctgctccacaagcgcgatacgcttgaatccccgttgcttggcgaggtagatagctattgccgcgccatagaat

SEQ ID NO: 697527 - DNA, 182 bp, Homo sapiens
gtagtcattgtcattactcgtataatcgtctgatcactctgagagaagtccctgaggagtacagctcctggttaaaatccagtgtgtgaattatcaggcctgaccataggcaattacagatggctttacctggcacgcctcgtggggaaatctgcctttccctcaccagactttatagccaa

SEQ ID NO: 697528 - DNA, 397 bp, Homo sapiens
ggtctggctaggtaagaatattctgccagtcgaggtaagggcctacaatttgcctagcaccccggcccaggactaccactgtcatgttatgtcagtctcaggtgcgttctagatgcaactaacagaatccccagcagcaattggtccacctatttggtggttcttgttgtttcacatgacacgtctggagttgagttcttgggaaggtcaatagctgattgcacgttagtaagtttatctggggccttctagttctttgccttcaaagctccaacgtggctgccttgctcccagaattttgggtaccctcaacaacacccaccagtgagaagggagagaggaaacaagatcctgtttcctgggatcatgggggctttcccaggagcctctgcatctc

SEQ ID NO: 697529 - DNA, 265 bp, Homo sapiens
  misc_feature (46)..(46): n is a, c, g, or t
  misc_feature (99)..(99): n is a, c, g, or t
agccggggtaggaggatcaccagaggccagcaggtccacaccagcntgggcaacacagcaagacaccgcatctacagaaaaaattttaaaattagctgngcgtggtggtgtgtacctgtaggcctagctgctcaggaggctgaagcaggaggatcacttgagcctgagttcaacactgcagtgagctatggtggcaccactgcactccagcctgggtgacagagcaagacccctgtctctaaaataaattttaaaaagacatatt

SEQ ID NO: 697530 - DNA, 182 bp, Homo sapiens
ctgggctggggacgagggatggcggtgtggtactgaccaggctgaccctctgctgcttctccggctcacccccaactctctgcgctctctctgatgtcaccctccagccgcagacccttggactgccattccctctttctccagatcctcagacagcccatccccctgcccctcttccccag

SEQ ID NO: 697531 - DNA, 124 bp, Homo sapiens
tgacatactgattattagagaacatgtaacaaatcaccatcagcatcccactccacatcagtccagcacatggccgtcattcatcaagtccacaaataacaaatgctggcagggggtgtggaga

SEQ ID NO: 697532 - DNA, 191 bp, Homo sapiens
agtggtgtgggaggaaacttgagttgcagagttggaggctgtggggatggcgcgagggagagaaggaaggtaatgtgacctgggtgaatgacctgttgcactgaagggtccacagctccgctgctgctgcccctgccattgctgctgctgctgctgctgccactgctgccgctgctgctaccactaccacc

SEQ ID NO: 697533 - DNA, 924 bp, Homo sapiens
agcggagctccaaggtaacctaggtttgcaatatgggattcccaattctgctcgcagagatttacccgagcgtgttgcggagcgagctgggcttgcaaggtgctgatccaagagggatttaagcgagaccagagctcctagaagaaaatagagagcagatgatgatgaaactagacactgagacggcgttaaggcgtttagccgaagttagatactatatttgtgaaagaagaactgttgagtgatatcatttagcgcattaatgtgacccgtgcgcacgacggctagtaagcgtgcatggactgcgggaatgacaagaactacggcaaactctgggcgcacctggaacgtgactggacggaccctggtgaacgacgacacagacgctcttacagtgacgcagtgaaaccattcaaaggcaggtgagataacagaaaatggaagtgtgtgttcaaatgggaaactgggtccacaaagactgggggaatgcggcgataaaaagtctatcggaagggaaacactattacatgccaaggagggtacataaatgttgtacagctctcgctgtataccgtttaattgtgacgaaacaggcgcttccacacagacgatatgtggcgcccaacagacgtagttgtccccatatcccctgaacaagccccttattcatggtaacccacgatcgacacaattggcggggcagaaccgagagacactgacactaactttggcaacccttttacccctgcaagtcaaaagtttctaccaattcccttggtccaccattcccttgtgattcgacccattatctgaaaccccatccaccaatgtggggggtacgagaggcgttatcctgtgaacgacaccgggaaaacggcgttggtacaaacttggctcgacctttacttcaaaataacttggtta

SEQ ID NO: 697534 - DNA, 80 bp, Homo sapiens
acacggctgtgtattactgtgcgagagggaggcacctcaataccgagtttgacaacttggggccaaggaaccctggtcac

SEQ ID NO: 697535 - DNA, 158 bp, Homo sapiens
gtcaggctcttaagacgacggcttggcgcgactgtatccgggactgtgacttgcagggtccgcatggagccagagcagatgctggagggacaaacgcaggtgcagaaaatcctcactcttagtacggtctcacagcaacgttagagatagtagaaatg

SEQ ID NO: 697536 - DNA, 170 bp, Homo sapiens
aggccgtgagggtgcaggcattgttgacaccggcacctctctgctgaccggccaaccagccccattgccaacatccagagcggcatcggagccagcgagaactcagatggcgacatggtggtcagctgctcagccatcagcagcctgcccgacatcgtcgtcaccatcaa

SEQ ID NO: 697537 - DNA, 287 bp, Homo sapiens
gatcgagctcgcaccgattcctaattacgccagtgtcacactgaagcagaagaaatacccaacccattcccgaatccttgctacaaaaaataatggtaataatgataaagctatcttacagcacttttctttctaaaagttcacagcacgtataaaggtcaagaagagagaattacactcctactcattttacctagtataagactgggatggtataatgtggaaaatatatttacatgaaaagccattttttggagttcctgtcatggcgcagtggttaacgaatc

SEQ ID NO: 697538 - DNA, 253 bp, Homo sapiens
tcagagagtgacaaaacaacaagatggcaaaagcagagggacatgagacccgaggacatctgcgatccagaacttcatactccagaatggcctcaaagtgggggcaggagataacgtcatcgtccagtactaactcagagggctcagacagggtctccatggcaccaatgaggtccacaatgggcttagaatcatagcgctgcagcaggtctcgcggccggcagtagcgctgcctgcaaaccagcacacgcga

SEQ ID NO: 697539 - DNA, 141 bp, Homo sapiens
atgagtgatctacgactatggtgctgctgtgagacaattactacattgattatctactaattattctcttaatgctggtctgcttatagggtataatctcatgggtatccaagacaaaggagaatgagctcttgtacgaaa

SEQ ID NO: 697540 - DNA, 382 bp, Homo sapiens
tccagttatggggatgtcttctaaaattttctttgctctaagtttataaggaatctgagattaaatcttcacaaaccccttgagaataggaagccaaaccaaggctgacttcagactttgcctgcagttcatattggttcattctatctatgtttttaatataacatccgaatcaaagcgttggtaatataaccaatgatttcaaatgtgtcatgttacaaagaaagcagattgttactgtacttgtgcaaatatgtgtattaccataaacatatcaattctcatgaatagttgcccaattctggggcagtcaggtagaaagcaaaagtaaatgtttcaattacggttcccagaagtatagtttattgaactgctataagca

SEQ ID NO: 697541 - DNA, 728 bp, Homo sapiens
  misc_feature (1)..(1): n is a, c, g, or t
ncggtttattttctaggctttttttgttgaccttctgtctccgtggggatgcctattactctttggtttggcctctcctctttttgatgctcctgggggctggttctactcttctcggcgttttccctttggcctccccggggcttggatgtccccattttgcataccaagcgaaccactttattgggctccactttgcctttatttttaggggcacacattttttagctaccaacgtttgctttcctaaaaataccatggacttggttctctgtctctcggattttctccgggagtttttttttctcacactcacatcttgccggcaggcactggcgaaatgttcacccgggcgttctacgcccgcgaattctccgctgcgccccccggtgtgggagacgccaccgcagttgtttcgttcgccctggttctcccattaggggcacaccattgccgtggtgggctccccatgtgcccatgctaggcaacacgttccacgagagtctaccctttcccaggtcaccattttgagtcaggggccaacaaattgggggcccaaaacggccaaattccaagggctccccccagtatccttgcccggaaggccacccccgcgcgcccaagggggtgactcccccacccacctgggtggttttttgagtacaatgaactctatggtttttccaaataaagtttcaagcatactcccccaaagagcagaaatagaa

SEQ ID NO: 697542 - DNA, 270 bp, Homo sapiens
aggatcccggcatcatttcagttccaagcacaagaaaacagacaatactggcatctcacaacaataccttagttgacccttgtgaggagcataagatagaagaacccagtatgcttcagatcaatgttctcagcagtttctaaagaagtgctcagagacatggaagaccagttaggctaaagagaaaggaaaattggaagatatggcaaaggcggacaaggcccatgtatgaagagagaaatgagaaccatatatcccatcctaacaggg

SEQ ID NO: 697543 - DNA, 933 bp, Homo sapiens
ggcgaggagcgcgggacctgctgacacgctgatgccttcgagcgcggcccggggcccggagcggccggagcagcccgtggttcctgatccccggatccggctcccgctcgcgggctctgacggtcgggcgggcgagcgcgtgcgcggtccgggccggggggatgtctcgggggagggcggctgtgaggatctggatgaggcgtgcacgtaccgaggactacatgattcgagagtgtgccggagcgagagggataggcaagtgcagaggtcaaatggaccacagtgaggactggagcgagcatgctggagggcccgtgggtgatggcaagttgggagcaggcatggactggacagttcctggaccagtacagcattaccctaagccgaactgaccagacaaatgccagtgacaggtggctcgagacgtttcgaatccagaccttgtcaaggcggccatggaccaaagaggaagaccgagaaaagtcatcgagctggttaagaagtctggcacaaagcagctggacactgatttgccaaggcacctgacgggccggcttggggacagcagtgccgtgaacggctggcacaagcaggctcaaccctgaggtgaacgaagtcttgctggaccgaggaggaggaccgcatcatctgcgaggcccacaaggtgctgggcaagcggtgggccgagatcgccaagatgttgccgcggaggacagacaatgctgcgaagaatcagtggaacttctaccattaaaaagggacggtggacaccggagggctactggacgcgaagtcaaagaactggcaagcccccaagggacttgtggtgggaccaccgaggcaacgagcggcctccaaagtggccaggccacggaaaggccaggaacgaccggacaaactggcctccagccactaccaaaagggggagaaacc

SEQ ID NO: 697544 - DNA, 357 bp, Homo sapiens
tcccgggctgacggtaatagaggcacctacaggctccggtaaaacggaaacagcgctggcctatgcttggaaacttattgatcaacaaattgcggatagtgttatttttgccctcccaacacaagctaccgcgaatgctatgcttacgagaatggaagcgagcgcgagccacttattttcatccccaaatcttattcttgctcatggcaattcacggtttaaccacctctttcaatcaataaaatcacgcgcgattactgaacaggggcaagaagaagcgtgggttcagtgttgtcagtcgttgtcacaaagcaataaggaagtgtttcttgggcaaatcggcgtttgcacgattga

SEQ ID NO: 697545 - DNA, 485 bp, Homo sapiens
  misc_feature (4)..(4): n is a, c, g, or t
gtanccgttcgtacgagaatcgctgtcctctccttgctcgagcgcggtttgtacgggcgagcgatgaaacgcctgttggccttcggcctggtcgcctcggtcccgttcattgcgttgggtggagtggtgggcggatggtggccgctgaacgtcatgttcacgctgttggccgcaaccgcgatgctctacctggtcgagcgcggccgctcggtcgctcctatagcgctgttcgtcgtggccggcggcctggtcgagttctgttggccggcgctgctgctggccgcgtctgtctggttgtacctcaagcgcccgacgtgggcggccgcgttgatggcgctgctgtcttgcgcgtccctgtggtacatcaatggcaacctttgggcgcttgctgttgtgcccctggtgatcgtcgccgccggcgtcgatcttcgtgtcccgcgcctgcgctgggccttttacacgtactacccgctgcatctttgcaa

SEQ ID NO: 697546 - DNA, 239 bp, Homo sapiens
atcgcctgctagctgcttgatataaatggtcatttctgcaataaagctcctgttgtgatcaggacccacttgggtgaggagaggggctctcaaatttgagagcccctctcctctcactcagaacaacacacaaggtcttatccaaaggcagaaaccaggttatacatcacagtcaatgactttgaatttcatgtctataatcgctcggatctttatggacgccttcaagagttgtttgg

SEQ ID NO: 697547 - DNA, 362 bp, Homo sapiens
ccgaggtcaagcagtcgcctgggggctcgtttgaggcaagaagcgccagtcgtgttccaggcggggtcttgagggtgctgcggtagttttcgcgccgggtgcccacgacattgaggatcaccctctcgttgttctcgatcttgcccatctctgtgactcagacatgacttaacgagaccgagagaaaagtggttctgctttggtttccgagtggacgagtttctctgggcagcgggactgagtctttgcgcccagttgagccgcccttctccgacgagaaactacttgttggcgttttccggattcaggtgtttgagccgcttccccgggctgcagtttgagagggggtaccgtgctctaat

SEQ ID NO: 697548 - DNA, 198 bp, Homo sapiens
  misc_feature (71)..(71): n is a, c, g, or t
  misc_feature (95)..(95): n is a, c, g, or t
  misc_feature (120)..(120): n is a, c, g, or t
aataaattcaaatggtacaaaaagggataaaacaagaagtgaatgccttaaagtccattttgtctgaaatnatgattgcaacccctgcttttttnctgttttctgtttgctttgtagatnttcctccatccttttattttgagcctatagatgtcattacatgtgagatgggtctcttgaagacagcatactattggg

SEQ ID NO: 697549 - DNA, 834 bp, Homo sapiens
  misc_feature (28)..(28): n is a, c, g, or t
  misc_feature (84)..(85): n is a, c, g, or t
  misc_feature (197)..(197): n is a, c, g, or t
  misc_feature (218)..(218): n is a, c, g, or t
  misc_feature (224)..(224): n is a, c, g, or t
  misc_feature (228)..(229): n is a, c, g, or t
  misc_feature (254)..(255): n is a, c, g, or t
  misc_feature (288)..(288): n is a, c, g, or t
  misc_feature (297)..(297): n is a, c, g, or t
  misc_feature (299)..(300): n is a, c, g, or t
tggtatccagagagaagactcatcctgntcttcgcgctgtgctggcttctacaccacgatttgctgagtttctgctgcccctgnntgattgagaaagtggattctgaggttctgagtgccaagttggattctctacagactctgaatgcttgctgtgctgtgtatggacagaaggaactgaaggacttcctccccancctttgggcttctatccgcanagaggntgtnnccagacggcaagtgagcgggtgganngcagagggcctggcggccctccactccctgacntgcgtgtangnnctcgctctgtgctagccgcgctgcatgctgcagcgagcgctcccttgaactccttcctctcacgcaacattcgtacaggacctgcacggccaccaccttgtgctcaacccggcccactgaccacatggctgctgcgccctacactgccaacagctgcacagcacgcgccccctaccacgctgccactcgtcgcccaggcgccctgcctgacctcaatgcacacccaagccaaacagacacctgaccctcacaacatgccacggacaaacaacgaccaaccaaagaaccacacgcaccaagaaggacaaaaccaagccgagagagaaacaaaataccatagtacacaaaatgcacacccaagaagacaaacaatagaaagacacagaagccacacacaaacgaagcaaccacctgaacaccacaacacacaacacacacgaccctcatacaacaagcgccatacaaacaaaccacaacagacacaccacatgacacacacaaggcacacacaacaacaccacagacaaacaacaa

SEQ ID NO: 697550 - DNA, 736 bp, Homo sapiens
  misc_feature (28)..(28): n is a, c, g, or t
  misc_feature (84)..(85): n is a, c, g, or t
  misc_feature (197)..(197): n is a, c, g, or t
  misc_feature (218)..(218): n is a, c, g, or t
  misc_feature (224)..(224): n is a, c, g, or t
  misc_feature (228)..(229): n is a, c, g, or t
  misc_feature (254)..(255): n is a, c, g, or t
  misc_feature (288)..(288): n is a, c, g, or t
  misc_feature (297)..(297): n is a, c, g, or t
  misc_feature (299)..(300): n is a, c, g, or t
tggtatccagagagaagactcatcctgntcttcgcgctgtgctggcttctacaccacgatttgctgagtttctgctgcccctgnntgattgagaaagtggattctgaggttctgagtgccaagttggattctctacagactctgaatgcttgctgtgctgtgtatggacagaaggaactgaaggacttcctccccancctttgggcttctatccgcanagaggntgtnnccagacggcaagtgagcgggtgganngcagagggcctggcggccctccactccctgacntgcgtgtangnnctcgctctgtgctgagggctgatgcatgaggaccatccatatgactccattccttagcaacattcatacagtgactgcaggcaacacaacatgtgtgaacacggacatgaaactggtgtggcactagatgccaaagcttgtatgcaggcaaggtgacaggtgcatcttgcaccgggccatgtgactctgtcaacagcaatgtactgacatttacttgctggaaacagttaccacaagcacagtcaagagcagcccagcgtgttgaccaatccttgcaaatgctcctgggttatcttgaacgctgcagcagaaatggagctatgaaaaccaagatcaaggctctgaatggtacaaggaccagatgtctcaatggtatcatggctctacagacacaggcacagctcagatgtaggatcgacactgaagcatggtgcag

SEQ ID NO: 697551 - DNA, 861 bp, Homo sapiens
ccatgaggaaacgagcgtatgaaaaatcagatgaaatgagtataagaataataaaaggagtaaagaacgaaaaaattacgacgagaatttagaaaaaaaaaaaaaaacgggcaacaaaaaacgaagctgccaaaaagaccagaacaaccagagataaacagagaaagaagacaaagagaaaaaaaataacaaacagaggcatagaaaaagacacacaaacaaggaacgacacaaacacagaatcaggaaagagaaacagaacgaatgaacaaggacagacgtccagacacaaaaaacaagaaaaaaaacaacaacgcacagaacaagcaaaagaaaagcaacaaaaaacacaaggtagaagacagaaaacaaaccacaatggaaaaaaaacaaaacatgaccagcaagaaaacaaggagaatcaaaaaaaaaaaaagaaacagagcacgacagaaaaaggaacagaaagaagaacaagaaaaaagaaagaacaaacgcaaaagaaccagaaacagaacaaaacaacaaacagaaagagcgagaaagaacagaaataaaaaaaaacaaaaacagaacaaaaaggacgaaaaggaaaaagaacaagaaaacccagaagagaagaacacgacagaggaccagacgagaaatagacacaaaaagcacccacaaaaacagaccaaagaacacaaaacaccaaacaacgcaacagaacgaaaaagaacaagaagcagaaaaagacaacggaacagaacaaagagacgaaacaaaaaaaacaaaaagacaaaaagaagacaacaaaaagacgaacaaaagcgcagcaaaaacaaaacaaacgaacaacgagaaaacaacacaacacac

SEQ ID NO: 697552 - DNA, 84 bp, Homo sapiens
cttgcgcaagcactgtacaggtttgccaaccaagttttaagcgtgcttcaaagtctggagggtgctcactacggtcacttaaga

SEQ ID NO: 697553 - DNA, 1250 bp, Homo sapiens
  misc_feature (618)..(618): n is a, c, g, or t
  misc_feature (922)..(922): n is a, c, g, or t
  misc_feature (1116)..(1116): n is a, c, g, or t
  misc_feature (1250)..(1250): n is a, c, g, or t
tccagtggaaaatacttttttttggaaaccccaccaatctgcaaaatctgtccctggcatttaagcctcctttcttctcctttgtgcaattctcggctcttctcttctcaggtggtctcccatgtgaatgtgcttttcttctcctcctctccagtggtctcgtggaacgcggccatgtgcgccaaactttgagagggtggtgctcaagtgaacctttaaggctcaactctctcctccagagaaacccccgccgctatctcgtctctgtgccaccgagcaagaggacacttttgcggagagggtgtgagagccacccgcgcttctctgtgtggttctcccccacaccccacaacagagctctttctcgagcatatgacaccaaagagtctcatatgtggtctccacttctccacaccaatgagtgtgcgacacaaaagacgccacacccagagagaggcgtgtcgtgagagtcgctctctgtgtgtctcagagatataaggctcatataagtctcagaggttggagagcgcatatgtgtgtctctgtgtgacacctccgaagctgtgtgacccggctctctgtgtgaactaagagcgtgtaaaccccctcgtgtggccnacaatatcctcctatataataaaatatcatctcatcatctgtgtattgtagaataatctctccacgaagtgtggcgcgcggtagaatagtcgggatagagcccctcctatttctcgtgcgctcaacaagaagcgcgtcgtgttgcccccacacgagaagaagaaagaggcgctcctaaacccccgccgagcgccagaggagaatatttgcgccaagttgtcgccccccccccaatattataccacaaggggcggcgccaaacccctttgtttagtacagaagaatggtcgcgccgaagagaagnagggggaggacacagaagaagaagggcggccccacaggtgggtaggaaaacaacacgcaaaagcggcgtgtggtggctcatccccggggggccgcaccccagggcgtgttgtcgtcggtcgtagaaaacataccaccgcaggagagaagggccgctactaaaagacgaacaccatcgctgtggcggcgtagganaatcttcccccccccgtgttgtcgtcttctatgaagacaaaacacaagaggggcggccctcatatagcaacaacactctctttgtggcggggccaatctttgtggtgcacccaagcggagaaccacatttcccn

SEQ ID NO: 697554 - DNA, 1240 bp, Homo sapiens
ctccgccacatcctaccacctctcttggtccatgcgatgctgttgcctggtgccatgtggtcaatgctggatgtgtgctcctgactgtgctgctgtgactgtgacgctgaatgctgcctgatgccactggctgcaccttaactggtgcatccactgccactgtgaatgatgcttgaagtgaatttcttttgccaatgtgcactgtggcttggctcttgtgctgtgctcgatcaatggtttgttgatttgagtgactgagcagctctgtgcttggtgttgcctctgcagtgagccagtaagtgcctgctgtgtgatcacgtgacctcatgacatgtggcctgtgcttgaccacttgctggactgcccagcagaccctgactaccttgctactacctgcctcgactcacagaattgctcagggcttacgaatgtgctcttcctcgacctggtctgcctgataactcccccgtgctggctgaagatcgctgtactgctgtgccactgcgggccacatgtgaaaaatggagttttggaaggttggccacatcaatggatgagctcttcgtggactgtgaagtgatgacctctctatttgctgggtaccagaaacagctgtcgatcctgttgcggcacctgccccgatgacctcaggctgagagagagctccagaagatccggattaaactgatgtgtgaatgacagagatcagtgtggaaagcaagcaccaaagcctgcagggcctcgaccttcccgctgaaggcttgaggccaggggtacttcagcagctacaagcagaagcatggtcagatacctccagatgacgtggaccaagagcgggaaacacattgaaggtggtatgcaacacagaggcccacggattgttggcccaggtggtcctccctggtttgcctgaattgggtggcgggaatccaggacttcctctagagagtcagccccagaaggggacccccttaagacttcgtaaagtccacattaccctccctggggctaagtggccgaacaggatcgcaactacaaaccagcgtcagaagagcactaatacacaagtaggaagcgtacccatcggggagtctacaagtatattagttctgacaaactagagcaatagaggaggcacaacagcacacatctgtcaatcgacgctgcggctgacgaacccagtagcgtcacgcgacgagagtgctcacacagactttagtcctttttctagtgtagttca

SEQ ID NO: 697555 - DNA, 364 bp, Homo sapiens
agtagcggaccaatagttaataaagaagggaaagtgagttcaaagagatattgtacccgtgtcatagcagcattattcattaacagcccaggattggggcagccagatgccaatggataaatgaataaacaaaatgtggtatatacagtgaaatgttattcagccttaaagaggaaagaaattgacatatgtgacaacgtgaatgaatcttgagggtattatgctgagtaaattaagtcagttacagaaagacaaatgctatgattccacttttttgaggtacctagaatagtcaaattcttaggcgtggggaagggggagctatcgtctatggggtacagagtactgattgtgtaaactgatt

SEQ ID NO: 697556 - DNA, 364 bp, Homo sapiens
ctaattttgcaagctcattatcacctcgagattaaacaacactatatacagttccactcaccaatctatcgtgcataacataaggagtagatctaactgtgtagcaatttatgatcatgtcacttccaaccataaggtcgcacagtgatcctcctcccagggactaccgagcaagtataatactcctatgagtataagtagaaaagtgggttaggaggctattataacctgctgcatacctcccctagtttaagtcttctaaaataccttttttccatcaattactctataatgccaccaaatacaataactttgtaattcatcagccttgccatatgtataaaaatgtgtgctctcaaagcat

SEQ ID NO: 697557 - DNA, 176 bp, Homo sapiens
gtctctacaaaatataaaaaattagccaggcatagtggcccacgcctgtagtcgcagctaatcgggaggctgaggtgggagaatcacttgaccctgggaggttgaggctgcggtgagatgtgattgtgccactgtaccctaaagcctgggtgacagaatgagaaccctgtcccacc

SEQ ID NO: 697558 - DNA, 238 bp, Homo sapiens
tttggggaaaaggggttctctctatgacccaccttgaggaaaagggattcagtgtctgtggctaggcttggggaagaatgaagggccgagacaggaaggccgaaggtcagagagaaacttttgcttctgaggctgcttcagagccttaatttggggtatcattctctgagccccaacaacatgttaaagtctctgtccattagttcaaacattttggtttgagtagcttggacgacag

SEQ ID NO: 697559 - DNA, 839 bp, Homo sapiens
  misc_feature (197)..(197): n is a, c, g, or t
  misc_feature (204)..(204): n is a, c, g, or t
aaaccatcgatgacctagaagatgaagtctatgcccttaagatgaagtacaagtccaggagcgagtaactggcaacgcactcaaatgccacaacttccttctaaccccaagccaaccgtgccacctcagctctcttctctcctctcctttccattctctctatggtgaggccagcaggcagaagaacaagaaattgncaacatngcacagccagggctgggagcagcctagggagagccccatcatgcccaccacccactcgggcactggcttcatcctttacctatccccttccaccctccttggctgcttaataaattctgaacttgggagaaaacacaaacaaaacaaaacaaaatcataaaagcaaacacaaacagaaaaaaacaaaaacatctgtgggtgtggcgcgcgcgcccgcgcgacccctagcagaaaaagagcttttataagacacaccttgcttgtggggggcgcgcgggggccccccagtaggtgtcaaggtggacccagtgtggcgccaaccaaagagggtgtgttacgccagggagaggacccaccgggggcaacaaagagaaacaagggggcggtcggggggaattttctcaccacacaattataaaaagaaaagcgcgcgcccggtgggaaaaaccaccgagaaggtgctcttctggtgaaaaaaaaacatctccgacgagagagggagagaatcctcagcagggaggggagaccaaacaatagagggagaacttactaattcacgaaagagcgggacgtccacagagagcgagacaccgcaggaatttgataaaatgaagccccccgtgttgggggtaggt

SEQ ID NO: 697560 - DNA, 148 bp, Homo sapiens
caaccgccatgcactgcggcgtcagacacaccgcgatcttctcccgacgcgaggcgcggaccccaatgccgcaaacagtccgatggtaggcagaccgtgcctatgacggcagcctgctccatcgctggggttgaatcatctgggatca

SEQ ID NO: 697561 - DNA, 658 bp, Homo sapiens
agcggggtagggccgggaagccgggcgttggtggagggaggcgttgggcttctgtcgccgcgaagctggcggaaaaggcagtggccatgcgaagccggctcgccagttcccacgactcccagggcaggtggcgacgaccacgacttcccgggaccagcctttgcccacattcctgacacggggtccagtgcttgccattccacaggtgggggaaggtggaacactgtccatccccgtggagcaaaaacgctgcgcctcggggccttgaacccggatttcggtttgaacaggaagcaagagaaaataagtgtttttccatttaggtgtgaagaacaaacgagtgacacatccaatgggctgccacgtggcaaccgtgttccttctatgccgaaactaggacgtcatgtttaagtcttcatgcgctaccgtttcgatgtccgtcctcagagaatgggccagacagatcatgagtcagttacaagtggtctggcggttaaacattaggcaagctataagcgggcacaccaacgggcatttgtccctttaaccacgtcatcaattccctactacgacattggtccctactggtactaaaactgcctgttgagacgacagtaaggaccactattccctagaagccatacccatagaggcagaa

SEQ ID NO: 697562 - DNA, 353 bp, Homo sapiens
ttgcgctgggtatgaagaaactggaactctgcaagttactggtgggctccaaaacggtgcagctgctgtggaaagcagcaaattaccatgagatccagcaattccacttctggatacctacccaagagaaccagaagcaaggtctggaatagatatttgcatatccatgttcacagcagcattattcacaacagccaaaaagtggaactaacccaagtttccatcaacaggtaaattactcaacaacatgttacacatacatacagtggaatatccatcggccttaaaagaaaggacatgttgacacattacaacacgggtgaaccttgaagacactgaagatattatgctgc

SEQ ID NO: 697563 - DNA, 298 bp, Homo sapiens
caataaccctcaatacaggtagttaatagaatatgtataattagagagacgagtcccttctgttgcccaaggtgccaagcagggagtaccgtggtacgaccttggctccatgcaagctccaactcacaggtatatgccattctgccggctaagccacccaaagtgctgggattacaggtgtgagccaccgtgcccggccttagatgtagaatattcccaaaagagaattctttgagttcctgtttcagtctatttattgagttgagaacaagtatacccatgtaccctacataaggta

SEQ ID NO: 697564 - DNA, 494 bp, Homo sapiens
tatactgaatactgtaggcagttgtaacgcaatggtaagtatttatgtatctaaacatagagtaaaaattcggtatagaaaatagaaatggtacatctgtataggacacttacccatgaacggagcttgcggggctggaagttgctctgggtgagtcagtgagtcaagtaatagtgaatgtgaaggcccaagacatcactgtacattgttgtaaactttataaacactgtacacttgcactacactaaatttataaaaaacatttttcttcaataataaattaaccttatcttactgtaactttttaactttctaaaactttaaaaaatttttgaactttttgactcttgtaataaacctttagtttaaaacactatacagctgtacaaaaatattttctttctgtatatctaaactttgcctacttttaaatttttttttctttttttttttaacttttaaacttttttcttaaatgtaagatgcaaaagaga

SEQ ID NO: 697565 - DNA, 176 bp, Homo sapiens
gcaggtaggcctaatgggggaagatggtaatataaaagcaaaaagtattttttttttgtaaagactgaaagctgttctgtggaagacccaccctttcctttaaacacgattctttcacttccaactccaaacttggtcaactaatccttaaaaataaacttgagctgggttttgga

SEQ ID NO: 697566 - DNA, 744 bp, Homo sapiens
  misc_feature (26)..(26): n is a, c, g, or t
  misc_feature (74)..(74): n is a, c, g, or t
  misc_feature (81)..(81): n is a, c, g, or t
  misc_feature (90)..(90): n is a, c, g, or t
  misc_feature (106)..(106): n is a, c, g, or t
  misc_feature (114)..(114): n is a, c, g, or t
  misc_feature (173)..(173): n is a, c, g, or t
  misc_feature (211)..(211): n is a, c, g, or t
  misc_feature (258)..(258): n is a, c, g, or t
  misc_feature (310)..(310): n is a, c, g, or t
  misc_feature (338)..(338): n is a, c, g, or t
  misc_feature (358)..(358): n is a, c, g, or t
  misc_feature (360)..(360): n is a, c, g, or t
  misc_feature (375)..(375): n is a, c, g, or t
  misc_feature (400)..(400): n is a, c, g, or t
  misc_feature (402)..(402): n is a, c, g, or t
  misc_feature (419)..(419): n is a, c, g, or t
  misc_feature (424)..(424): n is a, c, g, or t
  misc_feature (459)..(459): n is a, c, g, or t
  misc_feature (504)..(504): n is a, c, g, or t
  misc_feature (548)..(548): n is a, c, g, or t
  misc_feature (551)..(551): n is a, c, g, or t
  misc_feature (561)..(561): n is a, c, g, or t
  misc_feature (630)..(630): n is a, c, g, or t
  misc_feature (683)..(683): n is a, c, g, or t
  misc_feature (720)..(720): n is a, c, g, or t
tcaagcaaatgaatacttttattaanagggtaagtttttgtttgttttaacatggtagggttttgacctcaaanatttgtnaggtctgcnactcaaatgaacttanagctgganaacgtatgaaccttgaagatgcctcttctagtccagtttagggtccaatgcagaaagtnccatactctcatccccaagcccctaaagggcctttgcnaatttttcattttatgccaagtcctctaaaacgcatcagggtattanatcaacttgtaaagaatatcaagatcttatcttctattttaggttccatgtnaaataaagctgagtaaggttgtccaaanaaactcaccagaaaggttananaagaaagtgtaccanaacaaatttaaattttgaacaaaananatctctcctcctttggnctcanaaagaaattaaagtctccaaatacagacaatactntccattctccagctcttctccagattcacgagttccagccagggnggcccatccacactccccgttgaagtgtgggcctttcttcagtngtngctgcatggngtggtcttccagaattaatgcagccccttcagcaccctccagagctggagaactccaactgtgagtttnatgtgtaaaaaacagacccaaagttccaggcgagctatcaggtcacacaaganatagcaaagcacctcaaaaatttagaaataaccaccnaagcccgggaacaaatgtgacttc

SEQ ID NO: 697567 - DNA, 151 bp, Homo sapiens
tccaatgtatataacccactcctgaaaaaaaagtctgataattattagacgtaaacgacctctctaaattgatcatgacctggttactgggaattaaaggtcaggaatgtcactagaagctgatatctagctggacttggctactttgcaa

SEQ ID NO: 697568 - DNA, 115 bp, Homo sapiens
gggagatcgaggctgcagtaagctgtgattgcaccactgcgctccagcctgaacaacagagccagaccctctctcttaaaagggaaataaataagctctcctcacatccgtactg

SEQ ID NO: 697569 - DNA, 288 bp, Homo sapiens
gggtccaggaggtggctaaccacttgcatcacatgcagcagtccattgtggccgtgctcatcatgcctctggggcatggtgacattgtcatctgtgtgaagggtactctgtgccacagcaggataagcttgccagatgagcagctgggaaagggtaggctatgtatttcgtacagctgttgtcaggatatcaatggctgtcgcacaaagccctgcaggaatcatgtccgatgaggcatgcattatgcttaccagagtgggaatcagcgtcatttgcattgggccctga

SEQ ID NO: 697570 - DNA, 834 bp, Homo sapiens
  misc_feature (834)..(834): n is a, c, g, or t
tcccatctttctactttttcatttttttggaaacagggtctcactcggtggcccaggcgtggattgtgcaagggatcaccatatattagcctcacgtgcagaccctctatacctctccggggcctcaagtgtgactcactcgtggcattcagccctcccgagaatagcgtgggaacatacgggcatgtgtgtgccaccagtgacgtgacctaaacacaaacaactatttgaggtgtagaagaagtggaggctcctccacactcagtgttccgcccgagggcgtggctcttgtgacacctctcgcgtgagagacctcaagcgcaacactccccaccgtgcactctgcgcactatcaccacagagtgtgcgtgaggggatatataaccacagcactatgagaagcccaatcgtaggacactcgtgggcgccccaattatcgagagcggtataaacaaatcccgcgcgacgtgtgaacaccctatctcttttatttatttattatatctatatactatctagagagaaataagagagagtatatcctgcagatcatgtgtagccatactccacaacagagggaggagagaagacagaggcgaacaagagtgcgacaaccaaaaacaactcgtggggagacaacacataaatagtagaacaacaccaccaactgatgtagaggccactccacccagaaacgatcataacaaaaacacccaaaaaatcaacctctactgtggagagacaaaaccaaagacgctcaccacacacaaagagagaaacaaaacaagagaagacaaccaaccgagcggcagaaatagaagagtgtaccacccn

SEQ ID NO: 697571 - DNA, 292 bp, Homo sapiens
taacgcaccattactgcgtgtgctgcaccgaaccacgcagagctcatcgtgtgtcccagagcgggagtatccacatctgggagttgaaaacagagcacaacgagcagatgatccctgagcccgaggtctccatcacgtacgcccatatcgatcccgaggccagctacatggcagctgtcaatagcaccgtaaactgctatgtctggaatctgacgggggcattggtgacgaggtgaaccagctcatccccaagactaagatccctgcccacacgcgctggcctacgcacatg

SEQ ID NO: 697572 - DNA, 123 bp, Homo sapiens
  misc_feature (95)..(95): n is a, c, g, or t
tggacttctactgattctaatgacggtgtgggtggccagagtggagggatggttagggtggggactatgatgcccagctgcagtctgggcgtgantaaactcgccagtccagtggaaggtttt

SEQ ID NO: 697573 - DNA, 373 bp, Homo sapiens
ggtgcgactccatctgcagtttttgcgtaccggcagtcacgcgcacgtggcgctggccggccatctgcaacaactgttgctgcttgtcgctgagccatgcgatggccttgagggtcatgtcgctttgccgcgctggccatagttgtccagggcccgcagcaacagtgccgccgacagcgagttgtagcgttgctcgttgaggcgcttgcgaagtttatccagcaggcttgccgacacatcgtcgagcatttccgggaagtgacgggcgagcaaatgcaggtgctctgcgtcgtgcaccagcgggtcgtaatacaggccgtcgctgttccatttatccgacaggaaagccacggcaccttgcggaacagcgtgt

SEQ ID NO: 697574 - DNA, 328 bp, Homo sapiens
gctcccacattgactgtgcccatttaagacttagatgccttgtggggtttcttcgccacccagtgcttccaccaacgccggcagaagtcaccaaacgtcagcatcatcagggtaaagctggcgtcctgctggcccagcgcttcgtcgcgccgtcctgttccgcctgatcctgcagcaggtcttcgaacttcaggcgcttgacggtcatcttgtcgtccagcatgaaggacagcttgtcctgccaggccagggacaactgggtcacgactttgccggtggtcaggtgcagctggatctcttcgccggtcaggtcctggcgcttgcagcg

SEQ ID NO: 697575 - DNA, 252 bp, Homo sapiens
aagtccctctccacgccctgcaggcacaggcacttttcatggcaagccatggagcaggatggagagcccctgggtgctctgggccttgggcaggagtaagcaaggtatggctggctgaccaggagaagacccagcgcaccaggagcactttgttttcaggccgtgggaagttccggggcctttatttttattctttttaaggaaaaaatgataaaatctcaaagtgtttttcttgtttaaaaaactatataa

SEQ ID NO: 697576 - DNA, 1297 bp, Homo sapiens
  misc_feature (95)..(95): n is a, c, g, or t
cgcagcagattgactatacaccgtcatctactcaaatacgtgtgatacatgctgtgctagtgatctagcccggctatatatatgctagtctgganatcttatacatgtttcccactgagtccacgtagatgctgctcgtatagccactgtaggacttccactagacaacataggtgaagagtcaactcagtacacaacataatctagcaacggcacctggcagcagttagcaagacgggtgttgacccggattagtaggccgggccgcgagacgagtaccctacatcgcctgccattacgaaacgctacgcctagaagacctgatggcccagttgctgtttaaagattagagcagcagggaggcgctgacaccggaatcctcgtccccggaaacgccagacacaagttcacactgtgggtgcagccgcatgcggtgacctggagactcgtatggaataacgactcgtaattgatcgtcggggattaaggtcgtcccaacgtccgctgagtattagcttgcgcagcctattgatgaaccttacgaacacagggccgtacgctgctgaacttggctgtgcaggctggcatcacacccgcacggtaggctaaccctccacaggactgggaatcatcgggcgactatggcgatcacttatacaagagtcttagcactggagggacactaatctgttctgtggggcaatatcggtgcgaacgcttaggtggcagttaaagagatccatgggaacttgtacggagttaaccccgagagcaccatgtccttctagcgaatggttctacaagaccgccaaagcaatcaggggtatggcactctgtgtcaacactggaaggctgtgggagttctgaactcaacgggatcccaatggccgtgctagcgatagtacctagaagcgaacgcaaatagccgagacagctgtcgcattgacctctatgcggtgctcgtgaagaactcctaaatgtgccccattttacaccccaatctcttttggcattgggactgggtgcctccgtacactatgactcgcgtaataagacatgcaccggtcttgaacgcccggcgtggaaatcctaaacgaagggggtgctacaccactagagggggtcagcagaccgcgggcgacacgctccgagggggaacctcgggagtcgaggcaagacgggccggacccgggataaaaagccggggccagaggggagacgtgggataaccaaggcaaggcgcggagcaactggtacaactgctaacacgcggacagcgggcctgggacaacggggc

SEQ ID NO: 697577 - DNA, 1276 bp, Homo sapiens
  misc_feature (956)..(956): n is a, c, g, or t
gagtcccacacaacaggtggcagactaaatgtcgcccaagcgaaaataagctggggcctccacctccccccccccgcgctagaggacacctcgtattctggggaagatgtgtgcgggccccccccctctccccccccccgggggagaaaaaacacacatcttcggtgtggggccccgctacatgaagttgtagggtccccccccccccgcggcgggggaccttctttctttttcccaccgacggtagtacctatcctttttaatgtttaattccgccctatggggccgtctttgttcttaatcaacattcgtggggccgatgtcgatttttgcccgcaaacaacaggagactcttattttgcgggcccacacacaggggttttccaactactcccccccctcctggagactctggttgagacacccgccgggagaaacacgtcctccacaccttctggggacaacaatagcggccccttcatgttccccggctggggggcacccccaccccgctctggcacgacacacactgtgtggccacagctgtggtgtgagaaaacccctcggagacctcgtgccctgctgtctcacagagacaaaaaccctcttctccccccccaatagtatgtagagagggacgactcttccacacagagagagagtgtgtgtgtgagacacccacagggagcctccgcagagagaggcgcccccctctctcacacaggggacacactccctctggggcgtcacacacacgcgaggcccccccaccgcagtggtgtgtctctcctctctctgagactctctcacacacaccgcgcgcgcaccacccacactctctctctcccacctctctgtagacccctctgcgggcgtctgcgcgctcttgcagctcccacaccgcgcccctctttgtgccacagctccctatgtctcctccggtttatgcgccaccncaaattttgggtaccaccccacacacgggtgtggtgggaccctccactcggcccaccaccggcccccccaaggaggtataaacacccctcggacgcccccacacccccccccaagagagcccccgagagaggaaaagaagaagaaccccccccgccgggggagtccccgcccaccaccccagtccccccccccccctggatatctccccccccccccgcagtgcccacagtaggacacccctgtaagaaggggaggggcccaggggacccccccctgtccaaggagcccccccattaagtacccccggccccacacccca

SEQ ID NO: 697578 - DNA, 101 bp, Homo sapiens
cagtagtagctgggactacaggatatgcacaggcatgcccagctaatataaagtatttttactagagatggggtttcaccatgttggtcaggctggtctcg

SEQ ID NO: 697579 - DNA, 143 bp, Homo sapiens
caggcgaacgattggtgtgtctgcattgagaggtatcacgtggtgtacagctcactctcgcccgggatgcggcggcaccgagggatcttcggatggtattcctgcttccggccacagtcttcgcctgatgggtaccgagctcg

SEQ ID NO: 697580 - DNA, 110 bp, Homo sapiens
tacgactcgagctcggtaccatgctcatcccgtcctttcatattatatctggacttgagttttgtgtcaaccaacttagccttcaccttcagtggcattcccaggaagat

SEQ ID NO: 697581 - DNA, 1703 bp, Homo sapiens
tggcttcggcagctgggagttgttacgttgttgccagctgcactcaacaaagcagcacattcaacatcattggtgttgcattgtttgcagcacaatgtgcacagcacagcattatttcattcatgcaagttgtatcccgagttgccatcacctgattgacaaatgtgtgagtgcacagcagcaaagacttgggcacaaatctaccatggatctcttttgtggctgtgcatgcacaggtcagtgccccatggcatcactcttacacatgcctgccaaataatgaaaccacaagtgccattccatcttgggtgcagcagtgatcacacttgcattggcagtcattctggcaggcacatcctccaatgcacaggtcacatcaccattgtgcaaaccaagaacatgcatcgtcttgtcggtgctatttccacgcacagcaagtgcacagcaaagtgggccagcactctcacaatcaggacttccatcttcgcaccagcaaaaggcttcacttcaaaattgcaggtcacatcaattttgtgcccacaccttgcacctttacaatctccattcaccacgaaacccgcagcacacattgttctcccattgcaactataatcaatacaattgtcgtacacccatcccgttttatcacatcaagcaattcgtccaatcaacaccccaaagaacaatatcccaggcaatcctaattgcaaattgcacgtttgcacggatagccacaatccaattcatcagataatagagggacccaggactcccgttgcattctttaaagaccactcagaggcaacctgggcactcctggatggggattcacaagagtggcaattcaattgcttcccaggattctccgactgcaaattttacgacaatcagctaacaccgtccgacacgttttccaagctaccacaatggcgttcactccacacacttggatgatacagcgccccattcatgtcacaacacaggcatctacttttgacacttccatcgcaccattcacgagattacgagcaacagatgggtcatcacacagacgtatcgatccacaacaacagaacattggagtgaactatgacgcagattctttcgaccaacctgttaccgatggcaacggacattgggggcctctcacatcaacttagtcacaggaattaatcagtcgttagacacacatggagatcaaatgtcgcgacagacattcatgtccacacactcgagcggcgtacaacaatggggtacaccttagcaactaacaacacgacaatgaacacaccaccaccgacgtcggatgctacgtagattcctacacgtatacattaatccagctatttacaaagcacatcagattacacatctcaaataagtagcaacagcaccataagtaattagtacagcaacaacaagaactcacacatatacatctacgcaactactcacacaccagcagaccaccacaccagtcacacgagacatccacatacgagttaatccaaacacaagcacacactcaacaccacacctagcagcaatcatcctcgcttactcaaccagaccagactatagcactatacactcaccacatcactatctcatacacaataaaatacaaatatacactaagctacagacatcatatactacactcacactagactaactactactcatcacagcacgtcataata

SEQ ID NO: 697582 - DNA, 828 bp, Homo sapiens
aaagcattagtgtcatttaattacatgtctgaggaatttatgctaactagatttgggctttgcagcgaattttagtcggggcctcattcctgagcccaagtgaccctttcacctcagcttcccaagtagctgggattacaggtgcacaccaactgtgcttgcagtttgtttgtgtgtgtgtgtgtgtgtgtgtgtgtgtgtgtgtgtgtgtgtattgtgttttttattacaacgcccacaacatcatagctgtgcagtttattaacccaggaggctggtggagatctgtagaaactcattgtaggccaaattctttgtagattacatattatgatgaaactagggatctaccttaaaggttgggggaagctctttcaaaactatcagacaccatagaaatatatatagtgcaggatcagtttgtagtcttctgcagcgtggtgggaaacaaaagatacataggatttacaactcgatgtgtgttcttcttacaggtagaagtaaatgctcgtgtggcttgaatcgcttatctcccaagagagatacgtgcacgttcaaacccccagtagtgtacatgtgaccttatggggaaaatagggtctactagagatgcagtcaaagatagaaatgagatcagtagtggattacaggggggccccaataactaggtgtgcggttcaaacaaaacaaaagcggaaagtgcgcagcgagaaaagaatgccgcgcgaaggtggccggaaacactggaagacgccgagcccacggatacggggatggtgccacccacgaagcggaaagcacaggaacaacccgcgacacaaggaacgc

SEQ ID NO: 697583 - DNA, 430 bp, Homo sapiens
  misc_feature (15)..(15): n is a, c, g, or t
  misc_feature (246)..(246): n is a, c, g, or t
caacggttttaaaanactagggtccccccaacccccgggctaacagaccggtacccagaaccgggcccacacagcaggaggtgaagcagccaggcgagcaagggaagcttcatctgtatttacagcccacccccccattgatcccacagcagccctgaagtccgccctcctgtcagatccagtggcggctggagattgtcataggagctggaaccctatggtgaactgcgtcatgtgaggaggttngccgctgcttttgaaaacctaatgcctgatctgtcgttgttgcccatcacctccagataggactgtctagttgcaggaaaacaagctcagggctcccacggatcctacattactgtgagttgtatatttcactatatgttacaatgtaataataatagaaataaaatgtacataaaaaaaaaaa

SEQ ID NO: 697584 - DNA, 419 bp, Homo sapiens
ttcggaaggaggtaggacattgcgtgctttggtggctgcccgcattgcgtcacttcccctttggccccaggtcagactggcgcgatctgcccaacatcgaggtgcggctctcagacggcaccagggccaggaagctgcggtatacccaccatgacaggaagaagggccgcagcagctctggggccctcgggggggtctgctcttgcgtggaagccggcaaagcttgcgaccccgcagccaggcagttcaacaccctcatcgctgtgtgcctgccccagacggggaaccgacacaagcagggggctggcctctagggaaggctcgagtgggacggtttctacagcacaaccgtcaccaaccccgagcccatgggcaagcagggccgtgtgctccacccagagcagcaccgtgtggtgagc

SEQ ID NO: 697585 - DNA, 430 bp, Homo sapiens
gattcggtgagttcagggatcaaattctggtccttctacttatctgtgttgccctagaagagtcactttaactgtctggggtataatttctcatctacaaagagaggattaataattgtacacagttaatagggttgtgagaataaatgaagcaatgcattgaaagcacaaggcatagtgcctggaacccttgagcgatcagcaaatggtagctcttactattgttgttgtttgtggccattgtggcaaagcctagtgcttggaaacttgaaggagtctaccatatgtttgttgaaccaaaatcagttgaaatcccatccaaaatcccttccaaagacccatgcactgatgcaatagcgatgaagatttcccctagatgtctagactttagaggttccaatttttttttctttgagccagagtctcactc

SEQ ID NO: 697586 - DNA, 247 bp, Homo sapiens
gccatactcctaagttttttgttttttgttttcttgagacaggatcttactctgttgcccaggtttcccaggctggagtacagtggtacaatcacagctcactgcagcctctttcttgtgggctcaagccatactcccacctgtcagtcttctgagtagttgggtctataggtgcacatcaccacacccggctaatttttgtatgttttgcatagatggggtttcatcatgttacccaggctggtct

SEQ ID NO: 697587 - DNA, 292 bp, Homo sapiens
atctcagtactccagatttttatccttcaggttcggtacgtacgttaaacatgtgtcactgggcaggcagtgcctctaatactggtgatgctagaggtgatgtattaggtaaacaggcggggataagatttgccgagttccttatactttttttaacctttccttatgcagcatcctgtgttgggttgacagtgcagggtcaatcaatgactggcttgcttgcattggtagatatcgggctgtacatttgtccgcatccagtgctcccaatctgcacgcaggcttcatgcgg

SEQ ID NO: 697588 - DNA, 139 bp, Homo sapiens
ggaagacaagagagtagcctctccagtttcagcaaccgctagtttctattttttttcctggattttactgttttggtaatatatatattgaaacaagatatattaataccacatggcgagaaccccaaccaaagaaatc

SEQ ID NO: 697589 - DNA, 364 bp, Homo sapiens
tgtatgtgtgcatatgtgctcatcatttagctctcacttataagtgagttataccattttatactttttgaggtgtatcatataatagtacacactcatttttatatttaacatctttgtactgtgactgagtttttccacttattcattcaagatattaatcatctgagacccacctacactgtggctctacgcttatgcaggctctaagatcagagacctaaggagaatagggtatgctcttctgcgttaaagaggggatcaatggctcaggtatttcaaggtggcataacctagaagctggcaagtgcaatatcaaggcgcttgcagattcagagtgtgcgtaatatgcactctgtgtctg

SEQ ID NO: 697590 - DNA, 112 bp, Homo sapiens
ggccaaaaaaagggaaaaaaaacggggggccaagatagatcgggcgagtcatcgcccctccccccccaaggcacggggggccaaccctcctgggcccggatcaaatgaaagg

SEQ ID NO: 697591 - DNA, 202 bp, Homo sapiens
tgcactgcagcagcagcagcagcagcagcagcagcagcagcagcagcagcagcagcagcagcagcagcagcagcagcacacagcagcagcagcaacagcagcagcagcagcagacagcagcaaaacaaaacaagcagaaaaaacacacacaaaagaaacaaccaaacacgaaacacaaaaaaaccaaaaccgaaaacacccc

SEQ ID NO: 697592 - DNA, 237 bp, Homo sapiens
gtctgttgcggtgctagctcccgttttcctcttgccccatcaccagctttacctttcttactagtggtgggaagcagacatcttggaatgctaacctggtgcttattttctgggaaagaaagagatccacccctgaatatatccatttgtaagaatgggcagtatttcccagataggttttcagggaaaagaacaatctcacaactacataagtttgagaaaatttacttgatatat

SEQ ID NO: 697593 - DNA, 126 bp, Homo sapiens
ccctcaagatcattaacctatataacttgtcagttgcacttaagtcagctagtggacctcctgcggtcttggggtcgcatccatctagtgtcctataaggacgcgtagtacttgcagcagacctgt

SEQ ID NO: 697594 - DNA, 113 bp, Homo sapiens
  misc_feature (83)..(83): n is a, c, g, or t
tgtgctataaactttccagctgttacatagacgtcaacatctttcttctgagtttaaactttctttagcttattggtttctcngtggatataccagtccaagcctcttgggga

SEQ ID NO: 697595 - DNA, 757 bp, Homo sapiens
cggaagcagaaagagcgtctgcaaaaatgtccgaatcagaaatgcagcggggtgtggaccatggttcaaagtctctgtcctcttgaagaagaggtggtcgggggacattgacccaccagccccgctaggctactgcctgcaaacaagaacccctcatctgccacgcacgttcttaatgtatctatagtctgactgatgccacaaaggagtccaggttgtgacttaccaagaagtgactaccgatacggaggaaaatgactccccagatcgctgactgcagacgacacgtgtaccatgctgagtctgctcttcctggaccaaggtgcaccacggcaggggccacagggaagacatatcgcttctgcagccagcggaaccagacacacaggagcagcctccactacaaaaccacacagacctgcgcatctccatcgagaactccgaagaggccctcacagatccatgcccctttaccactgaaggcgcacccgtgctaacccgatacttacactagaaaccagagagacatctacacagttactggctctactggaaccagacatgactaggagaaaatgaccatcataatacataataggcaaagcggtggaactaacatagcatgacagtggacaaaagacatacataggcacaacacctgataaacagaacaaacaccgagcgcccagcctagagaacacgggcacaccagagagaaaaagcagatcagagaaaaccctggggacagaccacaaaa

SEQ ID NO: 697596 - DNA, 130 bp, Homo sapiens
ttaactgagctcaggagtcaagaccaacctaatgcaacatggcaaaaccctgttgtgcgtatagtgccagaaaatactaaaaattagccaggcaatggttgcattgcgcctgcacgtgagcacagcatat

SEQ ID NO: 697597 - DNA, 411 bp, Homo sapiens
gtaagggtccaggatggatttgtaaattacagaattttatttaatagaccagattgttattttaatgaaattctaaggaaaattgtaaaggccatatgcaacatgtttaaatattgagtattcttaacagtataaagcctagggaatgatatgaaggtgagaacttcagttaacgttaagaaaatgtgactgagcatttactttagaattaagtttgttaagctgcaaaatactactcttacacttctcttaaataaaaccttctgactattaaagccttgattaatatcctgtcaacaaaggcggaggaaagcagatatttccaaatagtactttaactaattcatgctttaatgatagcagtaaaaatgtttaaatgtagtcccacatattattttaccaaccctgcag

SEQ ID NO: 697598 - DNA, 646 bp, Homo sapiens
ggaatatagccgcataacggggcatgtagtaggattagtacaccatcgaggaccacaggcttcagaacgcgagaagagccaccgtcctggtgccagtctacacttccacaggcggagtcgacataatagatgactccagaatacaagacagtatttagtagatactagatttactgtatttcacggcaataccgaatgcttgggagcatactagagtgttttgagatgatggaattgggctctaaatgttacatgtttgaaatacttaaattggttggctatgcatcttgtgtaaagagtgcatgtgattgtgagtaaatgtctattacaatagttttagtttagactgtataaatactaatacaacgtgattgaacatgacatgggaaacgcaggaaagtaatttttggagtgatacaacgattaaagtgggtacgttcgtattaggtaaattcaggcaatagagttacgcaattagtcagtactgaaatgagagaaaaagaattatgctatatggaattcgtagtgtgttaaggatgtgaggaagcttggaacactaacgaaattaaatggtagtttagaacacttattagggaagagaagggtgagtagataaaaaatgccctggtctgtattaggaagagac

SEQ ID NO: 697599 - DNA, 757 bp, Homo sapiens
catccaaggtcctttgcgcaattccttacccggggtttcctcgtggggtcccagctttggggaactgggggaacccttttttcgggaaattccgcagctgcacttttccacacttgagtggcgccacggccgttggccccccctcgagaagggagatggccccactgttgcctggttggtggctgtggagagttttcacggcacagcccgcccacacaacgcgtctcttagaactttttgctggcacatggcaagaatgcgctatagggtggagaattatgccagattatcacatggcccacggcctggggccacagggccacagaaaggagggaaaggccccctggagtttcttcaacgtcacatggtgaggagtctcttgaaattcttccctttcttttggttcctggtttgtgtttatgttatgtatgtccatcttggtaaatagtgttaaaaaccaccaaaaactctgtatctgtgttttaagcacttgtgctgcatttgaactctattaatcacatttcacaattcacccgtacatttcctctcctctgtcaactagcctcttctgaaaggtggtcctggccaagccctggaggaaaagcaactggtggtttgcaagcacccctcaagttcctgggcctcagcccacaggccactgtgataatggtctggttagcaccttttgtatttattgtaagaatgattataatgaagatacaccccggtatacaaggaaattattaatgtttttcca

SEQ ID NO: 697600 - DNA, 174 bp, Homo sapiens
  misc_feature (89)..(89): n is a, c, g, or t
tttgccgttggggccctggcctgggcctggggaactgacgccggtcgtccggaagccaggaggaggcgtgaggccgctcgtggaccttncgcctaggccctctcccctcaaccttctcccggggcctggtcaccccaatccacggagagagagtaccgccgggaggtcggtcgc

SEQ ID NO: 697601 - DNA, 167 bp, Homo sapiens
aggaccaactaagcagctatccaagatataggcgatgtcagaactgagatcgaatggagatggaaaagctgcattctatgtctgcagaaccaatggtgtcacgatcagagtatcatggagtgagcccaaaggtcgaaagtgtgcagcttcttcgcttcgtcaaatct

SEQ ID NO: 697602 - DNA, 120 bp, Homo sapiens
cttaccacacacccggccggcttatggcgcgttccagggccgtcctgttgcgttttttttcttccccattgggggtttttccacccatgatcgatacttcgttggaactttttcggggta

SEQ ID NO: 697603 - DNA, 401 bp, Homo sapiens
ctgttctgcacaacattatcagaaatagattagatggagggaaagaaaaaggaaacaagcaaatataaaaacatcagacataagcaattatgtaacaataagcaccttaaatgtaatggtctaaataaaccaaaagacagattgatggagagcctataataaacacatggtccaactaaatactgttcataagaaacttcaaactcacttaaggacctaagtaggttgaaagtaaaagaatggagaaagttatcctgtgaaatcattaattttttaaggaagcaggagtgaatatattaatatctcatgaagtagacttcaagaaaaataatttaccagagctggagagggtcttcgctgaattttaagatctaaaatttcctatgctgccttgacatctt

SEQ ID NO: 697604 - DNA, 398 bp, Homo sapiens
  misc_feature (244)..(244): n is a, c, g, or t
aagggtttcctgggtggttgtgtttgtatagggttctgaaagtttatctttaaggctttagcttcattgtgcaccatggagcaaaataaattttaagtttaaccctaaccacctgaccagtacccattttattgttaaaggtttattacaaaaaaactggggagggggtgggaaattaagtaaatttttaaaatgtttacgccttcttataccagcctgcaaaatatgaaagtaaggcactcancttttcctgtagtagtctgtcttttgaattcacagccagttgtatccttgagttactttgttaatgtatttttctcagtacatttaaccactgggaaatgaacccttgtacgaatgtgtttcttcttctctgtaggaataaaaaataaatataa

SEQ ID NO: 697605 - DNA, 138 bp, Homo sapiens
acgagatgctcatggctaacacagagtctgagtgtcgctccgtgttaccatactccctgtgcctcatcttcctcaccactctctctcccttctctcttcaccaaaactctttttcaccccactccttcatacttgtct

SEQ ID NO: 697606 - DNA, 381 bp, Homo sapiens
  misc_feature (15)..(15): n is a, c, g, or t
  misc_feature (100)..(100): n is a, c, g, or t
  misc_feature (115)..(115): n is a, c, g, or t
  misc_feature (119)..(120): n is a, c, g, or t
  misc_feature (123)..(123): n is a, c, g, or t
  misc_feature (152)..(152): n is a, c, g, or t
  misc_feature (326)..(326): n is a, c, g, or t
  misc_feature (349)..(349): n is a, c, g, or t
  misc_feature (364)..(364): n is a, c, g, or t
cggtggtgaaccgangtgtttgacaagctgtccccgctgcacgagcgcaatcatacatgtgcactctctggttcagctgctgatgcccaagcccgtggcngacatggcgccctancaanntgnagctccatgggatagaactggaggaaccntccactttgttttggctgctgaaatgtggtgagaaatatcagctataaatatcgagaggacttgtctgcacatctcatggtagctggctgggaccaacggtgaaggaggtcaggtatatggaaccctgggaggaatgctgactcgacagccttttgccattggtggctccgggnagcacctttatctatggttatgnggatgcaccatatanccaagcatgtctcccga

SEQ ID NO: 697607 - DNA, 461 bp, Homo sapiens
  misc_feature (59)..(59): n is a, c, g, or t
ttgatggagcccaaccccaaaaggcaggggtccttcctttggtgggacaaaaaaggggncttttatgttcccctggggtacaaaaaaccccaaaaacaattcccgccttgggggttgccaaaaggggaaccccccccccgggggtttggtggagagggggggttccgcgctttttttggttttggcaataaattgggtggaaaaaaaaaagggggggggcccccccccccccccccccaggcgggggatttttaaaaggggattcccccttttggattttaactgggggagaaaacttttttccaaaatttccgcccccctgttcaaaagggttaaagggaaaaaggtgggggcccatttttccctttttttggggaggggccggccttggggtaaaaggggagaaacccccaaggggggggtgttggggggttggggaaaaaaaaaaaaatcttttgcca

SEQ ID NO: 697608 - DNA, 383 bp, Homo sapiens
ctacccgtgcacacacgatcctaccctctctttggatagtattctacattcctctattttcttactacacctttctactgctctcctactaccttactatctcctctccgccacttgactacctatttatattcctacctgcaccttctcctctcctcctcacctttttcttattttcccctccttcttctctcctcctccttttccatttctcctctcctgtcctcctcttcctcctctcttgtccctctcttttggctcttcctccttctcctctcctcctccgcctcgtttttctcttctcctactcatttttcctccacctccttttcttctcctcctcctctcctcttgctccttctcattcttccttttcttttccc

SEQ ID NO: 697609 - DNA, 261 bp, Homo sapiens
catatgtactaacctatgtgttctatcttcatcattaacatcctactttgtctattgcttggctgttttctgtaagtataatatatagttgatgtatgtgtgttcgtggtatatgtcagaaggcatagcatcttcacttttgctagctttgcagaatcttacaatgtgtactcgttatttctaatgatgtacataaaaaatccctagtcctgtttagcatttgacttttttatatgttttaaatgttgcagtgtgcttccg

SEQ ID NO: 697610 - DNA, 413 bp, Homo sapiens
ccaacatgtcctctgtagaccaccctgaggcctaggaagcacataggggggtcgatgagaactctggtgtgaagtgactgtatggacagcagacaccaacatgagatccgtgacataggacgggttcactaggagagtgatatgaagcgagtacagcctctgccagctgagagctggtcagtgggagaagatgcccttaggcacgatcctgggagtatagagaggagacagtcccagtaatcaggctagccaatagaccactcacattctgtatcaccatgtgaggcatgtagtgctgagcatttaagcggccagcccaaccactgacaatgacagctggcgactcagtctgacgtatgagctcgagctcgctggctaccaattacagtatgactgtcagcctcaggctgtgg

SEQ ID NO: 697611 - DNA, 528 bp, Homo sapiens
gcaataacctccatagctcttataaacagctcttatttgaagctttccatttctaaagtagacatgtatagaaggcagacagtaggtttgcctttttatattaaactatgtgagccaactttttatttttattttttattttagattcgggcgcacatgtgcaggtttgttacgtggatgtattacatatactgaggtttgggcttcaactgaacccgtcacccaaatagtgaacatagtacccaataggtagtttttcaactcttccctccatccctccattctgttttgagtccccagtgtttattgttcccatctttgtgtccatatgtaccctatgtttacctcctacttgtgagttagaacatgtagtatttggctgtttttgcattaattcacttaggataatggcctccagctgcatctgtgttgctgtaaaggacatgattttatttgttttaatgtctgtgtaataatccatggtatgcatatacaccacatattcttccagtccaccattgatgggct

SEQ ID NO: 697612 - DNA, 382 bp, Homo sapiens
cacgagggcgactgcaccggcctgctgccgctggcctcggtggccgccatgcagggccgcatcgcgatgtatcacgcgctcggcgagggcgtcagcccgatccggctgcgcacagtcgcggcgacggtgttcacccggcccgagatcgccgccgtcggcgtgccgcagaccatgatcgacgacggttcggtgtcggcgcgcaccatcatgctgccgctgcgcaccaatgcgcgggccaagatgtcggggctgcggcagggtttcgtgaaggtgttctgccgcaagtccaccggggtggtgatcggcggcgtggtggtggcgccgatcgcctccgagctgatcctgccgatcgcggtggcggtgcagaaccgcatcaccgtca

SEQ ID NO: 697613 - DNA, 766 bp, Homo sapiens
gagcgttgtgtgtgccgggcgggtcttgtcctgtcgttgtttcccgctcccttggttgtgaggctgttccccctagtggccccgccgctatgcgcggatctggtgggtgttgtcctgcctccgggcgtcgtctcccccgggatgttaggctgcccgcttcgcggccacgtccgtgcggtgggaggtgtgatattttttgaagccgactgcctcttattcgcgcctcgtgtggtggtgatttgtctgcgggttgttttctacggtgcagagactgggggcgtagtatgtctgtcttgctgccgagagacatgactgacctcgcctctctgccgccatagtttttgtgacctcctgcggtggatatattgttcgttagttcgctctctttgattgtgcgtcgcgccattcaatcaatgtctctctttgtgtgagatcgttgtgaggcgcgcgtccgtatgttgtaaatgtcgctcgcctcgcgcctgcctcctctcttccgatgatatacctatacagacaggggcctctggtgcgcgctctgcactcgttgtgtgtgctcgcccgccttgatttgtttcgaccacagagtggtccaagaaaaagaggagcatttgcaccacatcactctttgttaaacataattcctcctcccatttctataaaaagagggtctctcttttatattagtgccccccgattctctctctcctctgtcgattcgccaacctcgctgcgaaaagagacccacccaacaattaacaaaaca

SEQ ID NO: 697614 - DNA, 339 bp, Homo sapiens
cccggccagccggtccaggtagtcccgcagccggccgcgggagcggtgctgcagcgcgttgatgccgggctgtcccgccgacatccggcaataccagagggagaacagctgcatgacccagccgttgtaccagtcgacggtgccgtgcggaccgtccttgtaccagccgccgcggccgccggcctcgccgaggtaccagtcctccatcacggcgatgttgtcgtccacccgctgttggtcatggggcgcaccgaccgaccgcaggaacgcctgggtgacgttgcagaaccagcgccagttgttgtccggatagctcaccgtgccgctgggtgcgagcca

SEQ ID NO: 697615 - DNA, 123 bp, Homo sapiens
ccggggggggtttttttgggggccccccccccccccggttttttttttgggggcccccccttttttttttttgggggggccccctttttttttttgggcccaaaaaacccccctttttgggga

SEQ ID NO: 697616 - DNA, 238 bp, Homo sapiens
gtcctagaagtatccccgattacggctccttagacgggcagggactgtcagtcagcagcttggcgcttctggatgctgatattatggagtgctccagagagcagtacggctactttagctaattattcaacggttggtgccatactccagagggaaacattagattaaaattagtttagactgcttccactgacggctgaaaggggaaagcgggcggtctaagggccattggctgggg

SEQ ID NO: 697617 - DNA, 304 bp, Homo sapiens
tttttttttggggggtttgggttttttttttgggggcccccaaaattttcctcccgggggcccctttttacccctgggggatggggggtgccctttttttgggaaaattcccccaaaggggggggagaccaagggggtttttttcccggtttttgcccccgtttgggggggggagccccccctttttttttttttttttgccccggccttttttcttagggggggtttcctttttggtgtgggttttttttcctaaagaacatagaaaaagaaataaaatgtatagaaccacaaaagagaaaca

SEQ ID NO: 697618 - DNA, 261 bp, Homo sapiens
attgactctagagcgatccccctgtatcccgagagaaagatatgaaaagtcgacttccatcgattgtatgcattacgggtcaggccctggtgactgtgggaggtgacactgatgcctgctcctcagcccctcctcccatccccaacgcgcacaacacatgcatttcacatggtaaaaggcttaaaaacagcttgtatagaatattcttttttaaatagatcatggttgaaattgtctgaaatcaggactgagtcatataca

SEQ ID NO: 697619 - DNA, 82 bp, Homo sapiens
  misc_feature (31)..(31): n is a, c, g, or t
  misc_feature (34)..(34): n is a, c, g, or t
cttatagtacatattttcccctctgtaatgncgnaattttgattctaatattttttctattatttataagtgcaaatttttt

SEQ ID NO: 697620 - DNA, 409 bp, Homo sapiens
taggattcatggcatgcacatgagccctgctaatttagtatttttagtagagacggggtttctccacattggtcaggctggtcttgaactcccaacctcaggtgatccaagcacctccacctcccaaagtgctgtgattacaggtgtgagccaatgcgcccggcctcaacctgataagtttttacaaagtgaaccacgtggaaacagcatccagagcagacattggacatcccggcaccccagagctccctatggatgcctcactgacatccatccccaccccaaaggtcctccggcattctggaatgatcttgccttgtcttcaagttgcggtaaatagattcttacagtgtacattagaatacacgtccacgtgtgtcagccacttcttcagcatcttggctacagg

SEQ ID NO: 697621 - DNA, 121 bp, Homo sapiens
ctagaggatcccaggatgcagcaagtcagttctgttggttgggagcagaatggacatgagtagtaacaatggatgcatgagagatccaaccctttatcgctggaagattcaaccacatcca

SEQ ID NO: 697622 - DNA, 190 bp, Homo sapiens
ccctgtgttcccgaccaaaagccccccggtccccctcttggcccccgttttttttacgcccccgccccgggggtgttcctggggccctgggcctttttgtccttgtttttttgtaaggggggggcccggctcagtgccctgtgttgttttgtatggtcccgtgtgtaaaaataaccccgttggaatccta

SEQ ID NO: 697623 - DNA, 120 bp, Homo sapiens
cgatacatacaggatcccaatgcagcggactcggcatgtgtcttgatattatcatccgctgaaggtgaagctgaaggtggaagggagagctgagcagacactcgaggcacgagtgtcttg

SEQ ID NO: 697624 - DNA, 812 bp, Homo sapiens
  misc_feature (160)..(160): n is a, c, g, or t
  misc_feature (679)..(679): n is a, c, g, or t
gggctcaagcatttggggacgctctcaagctctcgagcgcacggcccatgcttccttcaacaatgtctacgtgttcacgacaatcctggtgcaagctcgagcttggcaggtgtgatcacgtctacaccctccaagtgcatatgggtcctgtcaaagcctnatactacactttgaatgcttgagcggcgatgctgttgacacattgaaacatgccagtcaagtaccaacaggtgtggcatgacggtcacgcatgtgtccaaccacttttggagccaatcctgcagcgaagtgccacatgatgaccaggcatattggccgttccgccatacgcagcagaacaggaccgaaacacacggacactttgcagtccagccactggacagtccagcccgttactcgtgggccaaccctgtgagcaccggctgcacttcatgagagccataatttcgacagcacagccgtggctacaggatcattgcacgcctctcgtggacgcctacaacacgctttcccattgacagtgtggcctgcggaacacctgagctgagggcactcgtcgtcgattggcaggatccattctggcatcacagtaagccaagaccaaggcagcctgccagtgacaacttaaaccacgacgtcgtaccaagtgcacaatggtagcaaggcactgtgcatctgngcagcacagtgaccatgcatcgtcgagaacacaattctgggtggcacttccggcaaagctggatgcgttggccctgggcaaaggggctagaaggagcagcaggatggctctggcaattgacttcatgaccttg

SEQ ID NO: 697625 - DNA, 389 bp, Homo sapiens
gtacaaaccagctatatagtgctgcatataaccttctgcttgccgcatcccattgaatcacaggagctgtgacatctgctatactgctgtgttgtcagtaccaagtaattactacaacgagaatatcttggcactgatggttaaatgaagctaaaagtcagagtgcatacatatcatcatacaaggttaagtaatcccagttcaacaacctaaaaatatcaaactggatcacacttaattatcttccatatcctctacttcatcctcgtgtatcttcaaggctctcaccatttcttagactgcatggtacaaaatatttttaacctgtagtttatcatcataattgctttcttccttcaaaagtctcagttcctgtgttaactgcaatg

SEQ ID NO: 697626 - DNA, 343 bp, Homo sapiens
ttaagggatcttcaggatttggagtataagacacacctcggccttccaaagtgctaggattataggggtgagccactgtgcccagtgctgctccttttttcttgcaacatgcggattaccatacctttcctcttttcacctttagcccactttttccctttaaatactgaagccctcagcatcatctctggagaaaaggcacagaccagactgtttctgggattccctatttagttcttccaggcatgtccttaaccttggcaaaattaacttctaaattgttttagacctgtgtcagataatttttggtgtacagtatgtggtcactttcccccaagattta

SEQ ID NO: 697627 - DNA, 581 bp, Homo sapiens
atccttcgtcttatgggggaaatttgcatgtgtatttttttttttagggagatagaatctggccccggtcgccgaggctggagtgcaagggtgctatctgggctcagtgcaacctaggcctccggggttcaagcaattctcccgcctcagcctccggagtagcggggataacaggcaccggctgggattaccacgcccagctgattttggtattttaagtagagatggggttcaccatgtgggccagggtggtcctgaactcgggacctcaggtgatccacctgcctgggcctcccaaagtgcggggattacaggcgtatgccacggtgcccagcctgagttccggtttagaaacaacagtctatgatagtataatcctctctttttggtacacagagtaacgaggacaaataggtgaaagaataattgaagggctggaatcccatttccccggctgtcccagggcatgggatatggagggataggaggcagcaaaccactcacagagccaggaagaattgattgcgtgggtatggccaggaggggaggcgggcccggctgaaatacactatgaccatagc

SEQ ID NO: 697628 - DNA, 231 bp, Homo sapiens
ccagaaagggtatagaagcagtacatgttgacacatcagatgcgagatctgccatcccaggtctttgagcccagttccaagcttggccccaatcagaactcagccgtgattcccgccaagtcgttgtcatctctcatcaagacagaggtcaacggcttcgtgcctgtttctcctcaggtcagtgaggacacccccaccagtcacgtcccggctggggctctgtcttcctct

SEQ ID NO: 697629 - DNA, 433 bp, Homo sapiens
acctgtgcctcccacttgtgacccctccctgctgactacatgccactacatacactgacacatcacagagacctgacgggacaatgattctatggtgaccaccattggagaactcacaggatttgtccatgcaagatctgacaactgccctgtctggctgcgagatgacttcctgaaccaagtcatgagacggaacaggctctgacgcatgagcgtggacggccgacatcaaacgtgccatgacgcaagtggtgactaggatgagcttgacccttggccatggaacctgacctggagattgcagatcgaaatgtgcctagaattgaaagagcttggaactaacctgaaagaagaaaacagtgatggatggaaaatcagataacgctgaagggtgccaaagtgaggaaggacaggatcaatgtgtgggaaggtg

SEQ ID NO: 697630 - DNA, 382 bp, Homo sapiens
tggacttacagctccacatagctggggaggcctcacaacatggcagaagtcaaaggaggagcaaagccatatcttacatggcagcaggcaagagagcctgtgcaggggaactgcccttttataaatccatcagatttcatgagacttattcactatcacgagaacagcacaggaaaaacctgcccccatgatccaattacctcccacccagtccctcccacaactcatggggagacacagccaaaccgtatcaagtgcagactcgaagcaacagaacactggattagtgcatttgaagacaagtcaacataaaaatatcttaataaaagtgctgaaaggaaaagaaattacacaaagagcaattctgtgtcagaatggggcc

SEQ ID NO: 697631 - DNA, 750 bp, Homo sapiens
  misc_feature (21)..(21): n is a, c, g, or t
  misc_feature (44)..(44): n is a, c, g, or t
  misc_feature (46)..(46): n is a, c, g, or t
  misc_feature (54)..(54): n is a, c, g, or t
  misc_feature (64)..(64): n is a, c, g, or t
  misc_feature (69)..(69): n is a, c, g, or t
  misc_feature (75)..(77): n is a, c, g, or t
  misc_feature (80)..(83): n is a, c, g, or t
  misc_feature (89)..(89): n is a, c, g, or t
  misc_feature (91)..(91): n is a, c, g, or t
  misc_feature (93)..(94): n is a, c, g, or t
  misc_feature (98)..(98): n is a, c, g, or t
  misc_feature (101)..(101): n is a, c, g, or t
  misc_feature (274)..(274): n is a, c, g, or t
  misc_feature (279)..(279): n is a, c, g, or t
  misc_feature (296)..(296): n is a, c, g, or t
  misc_feature (319)..(319): n is a, c, g, or t
  misc_feature (324)..(324): n is a, c, g, or t
  misc_feature (330)..(330): n is a, c, g, or t
  misc_feature (358)..(358): n is a, c, g, or t
  misc_feature (360)..(360): n is a, c, g, or t
  misc_feature (362)..(363): n is a, c, g, or t
  misc_feature (413)..(414): n is a, c, g, or t
  misc_feature (416)..(416): n is a, c, g, or t
  misc_feature (445)..(445): n is a, c, g, or t
  misc_feature (450)..(451): n is a, c, g, or t
  misc_feature (453)..(453): n is a, c, g, or t
  misc_feature (455)..(455): n is a, c, g, or t
  misc_feature (525)..(525): n is a, c, g, or t
  misc_feature (529)..(529): n is a, c, g, or t
  misc_feature (536)..(536): n is a, c, g, or t
  misc_feature (552)..(552): n is a, c, g, or t
  misc_feature (556)..(556): n is a, c, g, or t
  misc_feature (562)..(562): n is a, c, g, or t
  misc_feature (588)..(588): n is a, c, g, or t
  misc_feature (594)..(594): n is a, c, g, or t
  misc_feature (638)..(638): n is a, c, g, or t
  misc_feature (652)..(652): n is a, c, g, or t
  misc_feature (657)..(657): n is a, c, g, or t
  misc_feature (659)..(659): n is a, c, g, or t
  misc_feature (679)..(679): n is a, c, g, or t
  misc_feature (714)..(714): n is a, c, g, or t
tctcaggctgtcacccatggntcctgcagacccttccctcctcnanaacccttnaaggcgaacntgaanaaaacnnnaannnnaaaatnanannaaanaantaagaactaaattttatgccttcatctgatttctttccaaaaagtccatttcattaagtattcagacttcttagctccatcccattcatactttttgctctcctactacccacccaagattgttaataataacaataataataacaacaataatactgcgataatattaatanttcanatttgtacgaagcttanagaatgttttcacatatagcatntcatntgagcntcccaacagttccgtgaggtaggtattntnanntccctttttacagacagggtaaccgaggctcagagaggtaacgggatttnntnaaggccacacagctagttagtggtaaagntaggnntngntcccagcaccccatatccaagttcagtgtttcaacaccacagctacctctgttaagtggagcgacatttnttancccagtnaggcctaaatggtggnctgnggagcnaagaggctgacttctcagatgggganggaacntcaacgcttctttgaagcccttatgaaccaagaaaccttcgttnaggacctcaaaatnaaacncngccacatgcagctcgcaggnctggctgattcggttgtagccgtctgccgtaagcnctcgtcgaaggtgggcaccttgcctcctgccacgta

SEQ ID NO: 697632 - DNA, 83 bp, Homo sapiens
tgggcttttttcggtgttagattcaaccctgcgctaaaacggggatgttcccttgaataaaaaagcagtgtggttttttggga

SEQ ID NO: 697633 - DNA, 861 bp, Homo sapiens
  misc_feature (21)..(21): n is a, c, g, or t
  misc_feature (44)..(44): n is a, c, g, or t
  misc_feature (46)..(46): n is a, c, g, or t
  misc_feature (54)..(54): n is a, c, g, or t
  misc_feature (64)..(64): n is a, c, g, or t
  misc_feature (69)..(69): n is a, c, g, or t
  misc_feature (75)..(77): n is a, c, g, or t
  misc_feature (80)..(83): n is a, c, g, or t
  misc_feature (89)..(89): n is a, c, g, or t
  misc_feature (91)..(91): n is a, c, g, or t
  misc_feature (93)..(94): n is a, c, g, or t
  misc_feature (98)..(98): n is a, c, g, or t
  misc_feature (101)..(101): n is a, c, g, or t
  misc_feature (274)..(274): n is a, c, g, or t
  misc_feature (279)..(279): n is a, c, g, or t
  misc_feature (296)..(296): n is a, c, g, or t
  misc_feature (319)..(319): n is a, c, g, or t
  misc_feature (324)..(324): n is a, c, g, or t
  misc_feature (330)..(330): n is a, c, g, or t
  misc_feature (358)..(358): n is a, c, g, or t
  misc_feature (360)..(360): n is a, c, g, or t
  misc_feature (362)..(363): n is a, c, g, or t
  misc_feature (413)..(414): n is a, c, g, or t
  misc_feature (416)..(416): n is a, c, g, or t
  misc_feature (445)..(445): n is a, c, g, or t
  misc_feature (450)..(451): n is a, c, g, or t
  misc_feature (453)..(453): n is a, c, g, or t
  misc_feature (455)..(455): n is a, c, g, or t
  misc_feature (525)..(525): n is a, c, g, or t
  misc_feature (529)..(529): n is a, c, g, or t
  misc_feature (536)..(536): n is a, c, g, or t
  misc_feature (552)..(552): n is a, c, g, or t
  misc_feature (556)..(556): n is a, c, g, or t
  misc_feature (562)..(562): n is a, c, g, or t
  misc_feature (583)..(587): n is a, c, g, or t
  misc_feature (590)..(590): n is a, c, g, or t
  misc_feature (592)..(592): n is a, c, g, or t
  misc_feature (598)..(598): n is a, c, g, or t
  misc_feature (624)..(624): n is a, c, g, or t
  misc_feature (699)..(699): n is a, c, g, or t
  misc_feature (705)..(705): n is a, c, g, or t
  misc_feature (749)..(749): n is a, c, g, or t
  misc_feature (763)..(763): n is a, c, g, or t
  misc_feature (768)..(768): n is a, c, g, or t
  misc_feature (770)..(770): n is a, c, g, or t
  misc_feature (790)..(790): n is a, c, g, or t
  misc_feature (825)..(825): n is a, c, g, or t
tctcaggctgtcacccatggntcctgcagacccttccctcctcnanaacccttnaaggcgaacntgaanaaaacnnnaannnnaaaatnanannaaanaantaagaactaaattttatgccttcatctgatttctttccaaaaagtccatttcattaagtattcagacttcttagctccatcccattcatactttttgctctcctactacccacccaagattgttaataataacaataataataacaacaataatactgcgataatattaatanttcanatttgtacgaagcttanagaatgttttcacatatagcatntcatntgagcntcccaacagttccgtgaggtaggtattntnanntccctttttacagacagggtaaccgaggctcagagaggtaacgggatttnntnaaggccacacagctagttagtggtaaagntaggnntngntcccagcaccccatatccaagttcagtgtttcaacaccacagctacctctgttaagtggagcgacatttnttancccagtnaggcctaaatggtggnctgnggagcnaagaggctgacttctcagatnnnnngtngnaagggntcagcagcgtcggggagagttggggnacttggccttcaactcctgtttgaactggcgatataggatcttattgtgctgattttcagcctccttttgggganggaacntcaacgcttctttgaagcccttatgaaccaagaaaccttcgttnaggacctcaaaatnaaacncngccacatgcagctcgcaggnctggctgattcggttgtagccgtctgccgtaagcnctcgtcgaaggtgggcaccttgcctcctgccacgta

SEQ ID NO: 697634 - DNA, 108 bp, Homo sapiens
aaccttacgtgaactgcggaaagcaatacccaaataaccgcgttcacttggctgtagtggtctattgtatgggagggtttgatgagggttgctgacagggtggtgtac

SEQ ID NO: 697635 - DNA, 851 bp, Homo sapiens
gcatcgcacccatggattcagttttcacagcgtacgctctttttcgtgtgacggaaagaggagatgggagagaacatcatggaccctactttatggttgccatggatgcaagcctcatttccattcctttctactttgaacatagcaagtcctggaggctgctgggtcgtcctccagccacaaggtggctcccccaatcccttctctcaagccaatcgatgcacgcctttgctgaattctccacacggactacaattcacagctaccatgatcgataaacgccattattttcattgggaagcaaaaggcttatgaccaataccctggggcactaaaattcaacgccaattttctcctttaaacatgcccacaaagcaacacagctttgtccttagcgaatcagtctatttcaaccatacttgtcataaagacaactgagtcttatcactaagagcaataaacgattagtcctctcaccgcctcatccagaccccaccctgcgtgtcgcaaccgaacaagcgcgtgcgcggacacacccctacccgcgtcatagacactttcctccatttaatccaactatatctttgagctaccctctccgcctactactggcgacctcttacactgtgcgttaataacacatggtcaaattgcggcccaaccccctcgtgtccctttactctttctgcttgtttctgagaactttactgccacgtaaatgaaagcgagcattcgaccggctcgggtcgtcgccatcgccctgcccgacgctgcatacgcgccaatcggcgcggacgccctcccgccgtgcccctgtcctcttgtcgggatatgctccacttacacgtccc

SEQ ID NO: 697636 - DNA, 394 bp, Homo sapiens
  misc_feature (29)..(29): n is a, c, g, or t
  misc_feature (78)..(78): n is a, c, g, or t
  misc_feature (261)..(261): n is a, c, g, or t
  misc_feature (269)..(269): n is a, c, g, or t
  misc_feature (283)..(283): n is a, c, g, or t
  misc_feature (285)..(285): n is a, c, g, or t
  misc_feature (288)..(288): n is a, c, g, or t
  misc_feature (290)..(290): n is a, c, g, or t
  misc_feature (335)..(335): n is a, c, g, or t
atacaggcacagaggaaaggccatatgangacacgggagaaggtagcagtcgtcaagccaaagagagaggtctcaggngaaaccatgcttgctggtactggcaccttgatcttgaacttctagcctctggaactgtgacaaaataaatttctgttgtttaagctagtcagtctatggtatttaagttatggcagtcctagaaacctaatacagtggagggtttcttttccatgcagatgaaagcagtccttgtgatacaanaaacaaantattacagaccaantncanantactaattttgggcatttgaacacatgttcctaatttcaggtganttttttctttgaggtgggtttaagtttagagaggtttgcttttcacttgagcttttcat

SEQ ID NO: 697637 - DNA, 179 bp, Homo sapiens
agatggaacagtcatcccgtatggatggcaatgccaattggaaccacgactgcttgaggctctggactgctattctaccaccaatctcgtccaactgacaagcccttgcgccatgcctctccaggatgtctacaaaaattggtggtattgggtactgtttcctgtttggccggacgtgg

SEQ ID NO: 697638 - DNA, 156 bp, Homo sapiens
gatcgtgattatgggtgagcatactagctcaagttctcttctcttcttaaaaagcactagagccattcccttgataacccataaatctatgagtggattaactccatttatgagggcagagacctcatgcaccaatcaccttttacaaggccctcc

SEQ ID NO: 697639 - DNA, 408 bp, Homo sapiens
  misc_feature (50)..(50): n is a, c, g, or t
  misc_feature (55)..(55): n is a, c, g, or t
  misc_feature (119)..(119): n is a, c, g, or t
  misc_feature (134)..(134): n is a, c, g, or t
  misc_feature (140)..(140): n is a, c, g, or t
  misc_feature (151)..(151): n is a, c, g, or t
  misc_feature (153)..(153): n is a, c, g, or t
  misc_feature (157)..(157): n is a, c, g, or t
  misc_feature (174)..(174): n is a, c, g, or t
  misc_feature (344)..(344): n is a, c, g, or t
ccccctggggtcgcttgccgttcgtgatatgagccagacattgcggtggntgtcntcaagcagtggacagaaggctgctggagctggcaggtcaccagtctgcccgaagctcagagggntaatgatattatccntatacntgccaccccantnttanccagtggtggagaacgntctcagaactggtttcaattggccatttaagtttagtagtaaaagactggttaatgataacaatgccatcgtaaaaccttcagaaggaaaggagaatggtggaccactttggttttcttttttgcgtgtggcagttttaagttattagtttttaaaatcagtactttttnatggaaacaacttgaccaaaaatttgtcacagaattttgagacccattaaaaaagttaaatgat

SEQ ID NO: 697640 - DNA, 668 bp, Homo sapiens
gcacgcgtgccggcattaactgcaggccgagcctgtcagtgctgaaggtgggaagtgcgacgtaagggataatctgtccagacccgggagcagaagattcgtgcattagcctatgcgactgctgcttgttgccggataacccccggagtgatatgtcgatcctgtccactctactgtctcgacacgaagggatggcgacaagacctgtcacacttgatggagccttgagtggataatcgaagaggaagggagtgacattactacgtttacaagcgtctagatagttctagttcggacctaagtgaatagggctacgtgaagaatttcgagctttcagatagtgacaagagttgatcacacgagcaatcatcatagtagtatctcataacgatattcaactagcgtggtgccaaagcggatgcaagaggattgttttccaattgtgaaacttaccatcgtccacggcttttcgtcctatttgcagcggctcaagcaagaggttgggcttgaatcaacttcaatgacttccaaaaatggaaccatggggaactgggaaaagaaaagtaaggaattggtgaattggaagtttattcagggaagcagagacgggggggggtcattccaacaagttttagattattcttttttaatttttggttcttttccct

SEQ ID NO: 697641 - DNA, 1133 bp, Homo sapiens
ggcccacaagcaacacgtccaccagaaggaaccttgtcagttgatttccctgagccgatccccagcagagactggagataccagaggcccctgcagccccctgtgtctgaggagacctcaacaaggcccgctggcccatggacctaccgctgtcctcctgtgcagacgtgcaatttgcgagaggccttggatggctgtattcccgtgacaccaacgttttgtgcatcgtgactggtaccggcgcctgtacatgcagcatttagtggcaagatgttcatcgaagaagtctcacgtgctgtaccatccgtgcgcacacttcacaggggagcggctccttaccctcgtgccctgactgctctcaagccgctttcaactcatcctgagcaaacctggtcccgcgaccatcgtctctatcacatcgacaggtagagcggccctaccggtgtggggactgtgtgctaaggcttaccacagcaaagctccacactgaggccagcaccgtttgtgtgcatgcaccagcaagttgccctagctggtgtccaggaatgtggggctgcgttggcagcggtcacgttaacgcgctgcttctatgcaccggttaccaattcactacatggtgagatctccctaataagtgttcgcagagttgccacgcgcttcccttcttgcttggcgtcagggctgcgtgtgacggtgcaccaggggtcgtggatcccgtgcccgggcgcccagcacgcgacctgctagcccattccttgttgggctgctgcctatccccctcctcaatggtgcatcgagtacgctccaggattgtagaggccggctgcgtggcccattggccacaacgatcgccctcttgcacgttgctggggccccttggtgggcccacgaaagaagggcggcttaacgaatgactcgaaacatggaccagggcaccaccgaaagggcgggcccctatgtcatggatatgatggcgaccctagcatgaacggttcccctgcagataacgggtagggccacctgtggccgcatttggaagagccccaccggggtcccacttcggtgtacaaccggttgtgcccttccagcaagcccctttgtgaaaggcccttgataacaagaatcccgctctg

SEQ ID NO: 697642 - DNA, 233 bp, Homo sapiens
tgaatagagcaagataaaggtcagcgggttttttacatctgactggatgggagagatggactcactaatccattcattgatttgatatttacctatctctcctcaccatgaagtgtcatgatcataccattttggcctctagccaatctcacaaattttcaacgaaaagcacagatgcaataaatccatgatcaaacatgatttgcatcattgcaaacaagtgtattgggcga

SEQ ID NO: 697643 - DNA, 317 bp, Homo sapiens
gctgcctagaggacccataggttacacaaactatattttgtacccactaacaaaaccgcttcaatcccccctccagccactaccacactaccattcccagcctctggtaaccatcattctactctctatctctgtaagctcaatttttttttaaaaaatttagtttccacaaataagtaagaacatgtgaagtttgtctttctgcaccacacttattccacttaacataatgacctcctgttccatccatgttgttgcaaatgacaggatctcatacttttatatggctggatagtattccattgtgtaaactgatt

SEQ ID NO: 697644 - DNA, 545 bp, Homo sapiens
cctatgtaggaagatatgtgaataaatccaccgtcgccgatcattctcctccttcacccttcgtaaaacgattgatctcctccattgtcagccccatcacagaaccacccaacttccctgggcctttctcccgggctgagcccacgaggttgttcatttccgcatcactggccgacattggacagcaacgctaaggtttcaggaaagggtttcgcctggaagactcaaaggtgggataaaattggacgagttgatgcccgctgggcaggatcttggcacaaaaaatcctacaacagtgaacatatctgaaatcatactggctttaatctttaagtccagaggcgcatcacaggccaaagaaggagagagattcacttccaacaaaccatggcttcagagtagaatctatgagcacgtcaaagccatagagttcaaaacaactgctgcgatgaggcacaaaggttttacaggccgtagcaatagctagttcagcagagattctagtcttaatgatcaggtcttctacatgggccatcgggacgagg

SEQ ID NO: 697645 - DNA, 714 bp, Homo sapiens
  misc_feature (362)..(362): n is a, c, g, or t
  misc_feature (424)..(424): n is a, c, g, or t
taacaaacccggtctggggtgggtgtgggtataatactaagttgaaatgatttcatttacgggggaaggcgctttgtgaagtaggccttatttctcttgtcctttcgttacagggaggaatttgtgaagttagaattagaaaccgcaccgtggatttacctccggctctgaacctcagaactcacgttaggacttttaactcgtgtgacacaaacgacacctttaaatagcggcgtgccaccattgtgggattgtctccgtgactccaacatctcggaggctcgtataacacccttattgtggtgtgattattggcacctctatagaaatatagagattgtgcgcgcagtgtgtatatctcncctatgaggagataactgtgtgtgtcccccgtgtggctcacaagttatattgtggaatctcnaagtgtgcaggatatctagactagttctcgccttgtgacacgtgggtgtgaaagtctctttgagcctgtgtgtcacgtggcctcgcgagagagtgtgtgcgagttctcgtggcccccgagagggtctcggccccacaacgcgcgaaattcttgttacatgtgcgcacggggttgtgagatagaattatgagaacccgtggtggcgcattgtgtgtcagcgctaccgtggtgtgtggcatattaaactacaattttaagaggcccccaataggggagctcttctcggtcct

SEQ ID NO: 697646 - DNA, 899 bp, Homo sapiens
ctcttaccacccttgacgagtaggcgtgtgcgtgactcaaatgtggaacttactcgttgatttcctagattctacgcctcttgactgtgcataacttaccttaccccacgtgttcagcctaacatttcagtcacttagaacgccatgtccgggcaggagtcttttgtgttttcctccgcaagcggttacacaactcttagtctgaaattacgggtactgaatccacaaaatgtcctctaggtcaccagcaagtgtatgtatcaatagtgaattcttctgtataagtgtgactgaaatctatgtggctctcgaacaagtacaccctctatcctcagtcaccgctcagtatacaccatcgagtagccattttgcgggaataagacaatagcaatattacgaaatgttcattttcagacctccgtcatggtcacgatcatatcataatgtaatcaggtcggtaccgtttacattgcctcattagtaatccatcattagtccaaatgctcactattaggcataaatgtacaacgagttattcagaatacccagaaagagtatttcgtcattgtaaacattcaggacaagctgactgaaataagtgcatcaccttgaatttgaactttcaaggcacatcacctgaagtcaactcagatatgtcagaacactcttctataataatctcaagttagtaaaattcctgcctctcccgtaacacaggagttggagggagttccaatatctgaatctttctgaattcactgtaactgcgaatataaatcttgatgacagtgtgtattctaaaatttcatgccgttaatacatacgcatgccactataaccacattagttactgctttatgcaatccttaatcatacgtcaaaatctgtaaaattactcc

SEQ ID NO: 697647 - DNA, 617 bp, Homo sapiens
  misc_feature (565)..(565): n is a, c, g, or t
ccgcgatccggaagtttttttcttttgaacaaaaccctcctctttggcccgggttggaaatgattggcagttatttggccagggtaaactttccccagagggttcaagcggttcccttcaatggtatgttcaagagtgggggtcggtgtccaaagcaaggggttctcggtctgggtaaaatccgactatcagtaggagaggagttttccccatggtgttcagacgggtaaaatgcccctaacgttgttatcaccggactcaaccgcctcagtgagttcgagggtgttttgtgaacaatacgtgcttactggtaaaagcaggattgtaaagcagtctgtatggccacatagcaaagttcctcaacactgcagtgtccactctcatttaataagctgtcttccagcacatcttcacgtggtcctctggaaaatgacatgtcctctacatggttttgacacaagtctatctgcctgcctgcccactcgctgatctataatctcagtgcatgtagcagtctcatttctcaatgtatgggatatagatggcgctcatgcatatggtaatnagggcagatgcagctacgtgtatttcctcctcgcctgccatctctacaatcg

SEQ ID NO: 697648 - DNA, 239 bp, Homo sapiens
caatagcgcgtggaaaattcactagctcttcccaatcttccaaatctgccagtggcagtcagctatcagacaccagagcctcttgtccaggcatgcggcagtcacgtgccagctgctctgcacgcttgttgtgacctgccaagaatgagggtggtcacttgtgtcatgtagagacaggtctaggaactggccccccagctcgtcttctaggcgccgctgaagccgttaggccgatctga

SEQ ID NO: 697649 - DNA, 367 bp, Homo sapiens
  misc_feature (203)..(203): n is a, c, g, or t
  misc_feature (206)..(206): n is a, c, g, or t
cccgggtttttttccccccccccccccccgcccggggggggggtggtatattaggacccccctttccccccccccccccccccgggggggtaaaccccacccccccccccccccccccccgggggggttttttttttttccccccgggggccccgggccttccaaaaggcccggggggcccggggggggttttaaattccctnccnggtttcaaaccccccccccggggccataccccggggtttttcctttccccggggccgtttttccctttttttttttttgttttttttttttttttttccgtttgaaaaaggggaattaaaatcccccccaaaaagattcccccttttaaattaaaggggga

SEQ ID NO: 697650 - DNA, 647 bp, Homo sapiens
  misc_feature (185)..(185): n is a, c, g, or t
  misc_feature (200)..(200): n is a, c, g, or t
acgccgagcgcgttcaaagttgagaacggggaagaagtgtcaagtacgaggcaccttaccaaagctactaatgcaggcacttggcatttcaggagtttgtcttatggtagcataagaattatccctttcacccagacctggaccctttatgttacaaagttaagaacgggaagaatgggtggcanggtggctcctggaanagctcacccagcacaggtgccctgagctcggagccttggtttctgtccctggggagatatatattaaataaattatgatataattacactgagcagtagaaaatataacatctgaggggtgggggaagaaacgtgaggtactcagcaggaagccgagagctgaagagtgtccattcaggccagtttgacttcctccttgacccgttggtattcgggtttctcgtccttggtttgctcgtcttcggtcagttctatcttctcctctgggcctgtcccttatccatcctctgttctgactctcttggctttgctgaagtcggcagagttctggcggtcccgctctccttcctcttcagattcggagaagtcttcctctcgtgcatgccgtgggcagaggagcagatcgggatgcgcttgccagggtcgacttcgtcccgttcgccactc

SEQ ID NO: 697651 - DNA, 186 bp, Homo sapiens
actatcacattactagtaggaaaaaatggcctgctataagtacaataaagctactactaggaacctagccacacccatatacattatatacatatgactatagtaatatttactaccctcataacgggacagagctagagtaattagcaaacagactagtctagcctatgcaaaatatataaaata

SEQ ID NO: 697652 - DNA, 953 bp, Homo sapiens
tcaggctgcccgcatatcctttgacgaggtgggtggtgcttcctcactctagctaatgatcgtcgtgtgctaccttctggtgcctcactgccagagtgggggcgcgttacggatgatggcttgatgccttacttactcacatgccccctctcacgggagagctgaccctgtctgctctgtttgtttaggaacggtaccgtgcgtgcatacgacaccccgcccttcacatctgatgttacgtctctccgctgcagcggtcttacgtctcactcaccacacgatttacgtctttccagagcaggcgttggttctcacttatacacacacgcacgtccccgtcgtcgcggcgtagtttgttctgccgcgccccggcggcggctgcctcacccagctagtctgtcgtcttgcgtcatttgcttactacgtccgtcgcggtgtgtggggctcacgccaccccccacccccttgtttgtggtgggtcctcgcccgcgcggtgcgctagctactttcttcttgggtgcgcgccgggcgcctcgacgtgtgtcctgccatctgacatcttgtgtgttggctgacgcctacgtattcttgttgtgacccctgcctacgttgtgttctaatactgtactcgcgacgagcggcgggccgctcactagatctgttgtcctccgcactagcatacgtaatgatggggggaccgctcagtgtgctgttcctccaccgctggggggggtgttaggaggaggtgctgtcctttctttgttcgctcactgctttgttcagcaaataatttgctgctcgtaagaacactcctggcgcccctctctcaccccgattctgaagcagaggttcttctgcagtacctccccgctttttttttttgtcttttccccccccccctttttttttttttctcccccctcgggggtgggcgttttaaggtgaggggagga

SEQ ID NO: 697653 - DNA, 489 bp, Homo sapiens
  misc_feature (17)..(17): n is a, c, g, or t
  misc_feature (158)..(158): n is a, c, g, or t
  misc_feature (274)..(274): n is a, c, g, or t
  misc_feature (308)..(308): n is a, c, g, or t
  misc_feature (332)..(332): n is a, c, g, or t
  misc_feature (348)..(348): n is a, c, g, or t
  misc_feature (372)..(372): n is a, c, g, or t
  misc_feature (410)..(410): n is a, c, g, or t
ttttggcgacccagcgnccgctaactccagggccccagcgcagctcgggagcccgcgcaccgaggcgctaggggcaccgcgcactagagggacacccgccgcgcctggacagcccccggcgggcgcccccctcgcacctcctgccccgcgcgggccgngctcccctcccccgcgcctgtgtccccagggcgcagggtcgcgcgtccagccccagacccgccggggtccctggggacgcgccagcccggcagtggctcgacgatggaggagccgnagcgcgcccgctcgcacacagtcaccaccaccgncagctccttcgcagagaacttctncaccagcagcagcagnttcgcctacgaccgggagttcctncgcaccctgcccggcttcctcatcggggccgagatcgntctggggctgctggtatggacgcttattgctggaactgagtacttccgggtccccgcatttggctgggtcatgtttgga

SEQ ID NO: 697654 - DNA, 458 bp, Homo sapiens
caggcgcacttcggaacccacgcgcgcttctgcacccaggcacaccttctagcacccttgtgcgcactatactagctcgttcctagccacctgctgctgctagctagctggacgtccccacggcggcagtagcaggcgtcccctactagcaagcagtaagactatctattagggaatagggccaccgagttaactacaacgacaggcaatctaatacctagcggtgggcccctagaagaagtccaaatgcaccggcttgtcaatagtagaccctactactatacaagcactgtgcggtaggctgccaagccttccgtgatccggagagctctatcccaacattggcttgttaggtcatggaagatcctacaatagtcacgctggttgccctaacggaaaacgcacaaggaacaaaatgtacagtggcacggtgggagttcaaagtgccagcctaggag

SEQ ID NO: 697655 - DNA, 521 bp, Homo sapiens
  misc_feature (114)..(114): n is a, c, g, or t
  misc_feature (143)..(143): n is a, c, g, or t
tgctggtgtattaggtgtactgtgtatatatagagagagatcgtgtgtgtgttagcagtgtgtagtaatccccattacagatgagaaactaggacgcaggatgagtcacttttnccaggcttgctcagccagcaagtggcagnccccagtctagaggtcacatcccctaagcctcagtcagtgttctgttagacaaaccaccctgcctctgatggttgcttctagacttgtagacaacaggctcttcctacttctctcatcccttgtccgtggcggaaaacagaaacacaacttgtcccctcatggtttccatgtcatgcagaccaggttctcggcttcacctgggcccttccgcaaacctatgagatccaggccctgaggagttcctcaggagacatcacagccgtggcacaggcatccacctcctcccttctgcagctgattaacttctggggtgaattggttattttcaaggtgtctgggaggaccaccacgggtcaacaggagtactggagcagccg

SEQ ID NO: 697656 - DNA, 353 bp, Homo sapiens
acctcctaccccacggttaaagcagagatgaaaattttgtgggaaagacatcggcggaataaatttgcttgcaatgaattgggatagacggcttggccctcaggtccagacctccctaacataataaatgaaccagttatagaccagacaaagagatttcccttaagtgctctcttaattttaaagcagaatagctttaactggctcttgatgaagaaatcatcttaccattcttagctgtcctctcttctgcatatgcagtgccaggagtgcttttgggcatttgctgtgttagggtagtgatatgttttggaaagataacggtatcgaaatcagggtactttcacgagaaa

SEQ ID NO: 697657 - DNA, 807 bp, Homo sapiens
  misc_feature (22)..(22): n is a, c, g, or t
  misc_feature (61)..(61): n is a, c, g, or t
  misc_feature (64)..(64): n is a, c, g, or t
  misc_feature (67)..(67): n is a, c, g, or t
  misc_feature (69)..(69): n is a, c, g, or t
  misc_feature (72)..(72): n is a, c, g, or t
  misc_feature (83)..(83): n is a, c, g, or t
  misc_feature (95)..(95): n is a, c, g, or t
  misc_feature (97)..(97): n is a, c, g, or t
  misc_feature (103)..(103): n is a, c, g, or t
  misc_feature (107)..(107): n is a, c, g, or t
  misc_feature (143)..(143): n is a, c, g, or t
  misc_feature (163)..(163): n is a, c, g, or t
  misc_feature (170)..(170): n is a, c, g, or t
  misc_feature (173)..(173): n is a, c, g, or t
  misc_feature (175)..(175): n is a, c, g, or t
  misc_feature (179)..(180): n is a, c, g, or t
  misc_feature (183)..(186): n is a, c, g, or t
  misc_feature (194)..(194): n is a, c, g, or t
  misc_feature (224)..(224): n is a, c, g, or t
  misc_feature (232)..(232): n is a, c, g, or t
  misc_feature (249)..(250): n is a, c, g, or t
  misc_feature (271)..(272): n is a, c, g, or t
  misc_feature (275)..(276): n is a, c, g, or t
  misc_feature (278)..(278): n is a, c, g, or t
  misc_feature (280)..(280): n is a, c, g, or t
  misc_feature (290)..(290): n is a, c, g, or t
  misc_feature (293)..(293): n is a, c, g, or t
  misc_feature (307)..(307): n is a, c, g, or t
  misc_feature (320)..(320): n is a, c, g, or t
  misc_feature (334)..(334): n is a, c, g, or t
  misc_feature (346)..(346): n is a, c, g, or t
  misc_feature (361)..(361): n is a, c, g, or t
  misc_feature (373)..(373): n is a, c, g, or t
  misc_feature (395)..(395): n is a, c, g, or t
  misc_feature (412)..(412): n is a, c, g, or t
  misc_feature (433)..(433): n is a, c, g, or t
  misc_feature (440)..(441): n is a, c, g, or t
  misc_feature (473)..(473): n is a, c, g, or t
  misc_feature (486)..(486): n is a, c, g, or t
  misc_feature (546)..(546): n is a, c, g, or t
  misc_feature (668)..(668): n is a, c, g, or t
  misc_feature (738)..(738): n is a, c, g, or t
  misc_feature (764)..(764): n is a, c, g, or t
gatgttttcgtggagcttgttntggatgctttaggcgcaatcggttatgggcatatggggnatntcncngtntagtgcatggncagtcacttggnantgctgnctcngtaaaaggttgcttttttgtaattaattgtactctnggtgtccacttaatcggaanagtggtnttntntgtnngtnnnngggggggngtgtggggtggggggggggggggggggggngggggggngtgggggggggggtggnntgggcgccctcagttccgccnnggnntncncatggggtcngcngtaagcggggggcngctgggaggtggnactgcgttggggcncacggaggtgcngctgttgctggtgtngaggggggtggnagggccgctgtggcgagggcgncgttgggaatgaggaangcaaactggccatcgggtgcnggtaccnnctgggagcctccgaacaccttagccgcctctncagcctggctgcncagcttgcgtgggggcgccgccgggagggggcgccgcgccccggtggatgggcacgagtngcggcggcggcgcgaacggcgcgtgctgggggccgccgggtcccggtgggggcggtggcggcgctgcaaggagagtgcggctgcccggggtaggtcatggcattaatctgggtcatgcagtnggccaggtggccgagcagccgagtgcgcacctcggtattaacgccctcgcacgtggacaggaagcgggtnacctcgttcatgcactcgctgaagcnggctcggtacttccccagcacacttgggtctgttctcagcgca

SEQ ID NO: 697658 - DNA, 261 bp, Homo sapiens
atgcttagtcgctctgggggggtcgtgcgcatggtcgttccttccgttctcaggtatctgcggagcctgtcaggcatgttccctccaggtaggctctctgtgctccgccaaatggccgctccaattgcgcttggtgatctgagccgccatgctcgccgcgatccaaagagcgcaggtcctcgtccaggggcgatttgaaggccaagagcgagtgacatgccaagatgcgattgacagggccaagagcgattgacaggggga

SEQ ID NO: 697659 - DNA, 435 bp, Homo sapiens
  misc_feature (259)..(259): n is a, c, g, or t
  misc_feature (262)..(262): n is a, c, g, or t
  misc_feature (298)..(298): n is a, c, g, or t
  misc_feature (315)..(315): n is a, c, g, or t
  misc_feature (338)..(338): n is a, c, g, or t
gggtcagaatgttagcccttcaacggtgatggcaatcggtgcgccctggtaagcacgcgccaggaagttgctttgcccgagcataatgcctttaccgccggtaatatccatcgcatcaataatcgactgctgcccgcggtgggtacagtgatacttaacgatagccgacagcacggcaggtttttcgccgagcataatgccgtagtaatcagcgatgccgcagcatccatcacgtaggcattaccggcaatacgcgcangcntcttcaatcccttccatcttaccaatagagattttnaactgacggcgaatgtnagcatacggccggttgccagcgntaccgatttcacgccgccggttgagttggaaggcagggtgatgccgcggcctaccgagaggcactccaccagcatccgccagccttgccggccattt

SEQ ID NO: 697660 - DNA, 116 bp, Homo sapiens
tcggcgtgagtgccacatctaagagatctactcagatacacgtgtgagaggcatgggttggcggtgaggcccaagctagatacactgtgtaggagtcatggcgggtacctgagctc

SEQ ID NO: 697661 - DNA, 182 bp, Homo sapiens
  misc_feature (16)..(16): n is a, c, g, or t
  misc_feature (101)..(101): n is a, c, g, or t
  misc_feature (124)..(124): n is a, c, g, or t
ctgcaggaaattcggncaccgaggcctaaataaagatgatttaagcttagagtggtgctgaagcataagcttcaggtccagaagatgggtttggatccagnctctccacttctctctggacctnagattattcttccagccaccccactcctgagctgaataaagatgatttaagcttaaaa

SEQ ID NO: 697662 - DNA, 412 bp, Homo sapiens
agagagctagcatagttcttaagggccctagggtttttgaaatggtaaacgatcattggcttcaacttaatgtcaccaattgcattagcccctaaccaaagagtcagcctgtcttttgatgctttgaagccagatattgacttctcctctctagctatgcaagtactaagtggtatcatcttccaatagaaagctgtttcatctacattgaagatctgttgtttagggtagccactttcatgagtgatcttagctagatcttctgaataacttgctgctgtttctatgtcagcacttgctgctttcgcgttgcactttttatgatatggagaaggcttctttccttaaaggtcggtgaaccaacttctgctaccttcccaacctctgcagcttcctcacctgtcaagccgtc

SEQ ID NO: 697663 - DNA, 302 bp, Homo sapiens
taatgatccagagagtcatagaagaaacttttctctccttctgtatacccagcttgtctacagtagacaagtttatttccgcccaaaggacaaagttgctaaatggctgcaagttggatctatattttatcattgaatatctttggtcaaatatatccatgccttttatattttactatgagcctttacagatactaatgacttccatattcagagtctttcaactcaaagtgatcatccatggggcattcccttcatatttttcctctaatttattctcagactttcttatagacagtggg

SEQ ID NO: 697664 - DNA, 201 bp, Homo sapiens
accgtaaatgtacagaaggcagctataattattagaactggaagtaaaccaagataatagatgagaaaagaaaatgatgacttcactgtatattaacagatgaaaattgagcaattatacaataaatttcatttggaaaataatttccataatttttttatactttaagttttagggtacttctgcacaatgtgcaggtta

SEQ ID NO: 697665 - DNA, 399 bp, Homo sapiens
  misc_feature (369)..(369): n is a, c, g, or t
gcacacgccctctctttaatggaagccatgaggtgctttcacacaagaaaccagcttagtcaagaaggtacagcctcaccaccaggtcagaatgtggtcctcctcctctgccttggccccggggaagcacaggcgtgctggccagaggtctcagaagatgtcgggcacgatatactcagtgtaggccccatcgatgagtccagccccattgttgtgattgacccaccggcacacctcggccccatgccacgggtccttgctgtagtctttttgcaaacctctggtgaccgtgagccggcggttcctcaccaccatcgtggcatctgcctgtgtgggctcgagagcctgggtgtatctcacacacttcanaaccgatggggtggaaatattgccacagct

SEQ ID NO: 697666 - DNA, 252 bp, Homo sapiens
taccaacaatgcacaggctcaattctctgcatcctgaccaacatttatttctctctctctctttttactttttatttttagagacaaggtctcgcattgtcatccaggctggagtgaaattgtgcgatcacggctcactgcagcctcaacctcctgggctcaagcaatcctcccacctcagcctcaaaagtagctgggaccacaggtgtgcaccgccatgcctggctaatttttgtattaatgttagagata

SEQ ID NO: 697667 - DNA, 1308 bp, Homo sapiens
ggcgcgggctgtggagcccagagccagagagcgcgctggtgcgcgtgctgtggcacccgacggagtggaactggggctggtgtgaatgcacatgggtctgcagctgcttgggccaccctcggtcagagtggcgccgtgtccagcagagcaaactgggctgcccctggagccttgcttgagaggccagttctggtgctttcccagctccgaagtcaatacttgagatcccagatgtgtccagcagacatcctgaacgaggctcggcgggctggacggacgccttcgctgtgtccacaacacgggactcctgaaactgactgatagccacgtggatttgccagcagctctgagccttctaccgcagctcttccccccaactcaactccctgctagctactggacgactacccaatgcgaaccggcacgacctgcctactgagcagcctgccgctgcccggtgctgacaggcctctccccctgcccacctctctcacccgcccactcagtgcctcatgcgcgggccaattgtccatggagcctgcaggcccatgagcaccccagcacctgcaacgactatcgccggcgaccagcgcctacacctgcgcccgtcgacctgcccaacctccgtcacactgtccccttcctcctcatcggacaactgtactcctcgctcaggcccgatacacttcgacacgccatgctcctcgcatacgcttggagaacaggaccatcaggataccctgccaccagcctgtcaccaacagccgttacattcgacccccctaatcactgtctgtatactacaaagaaaccggtggtgctctacagaccctcacgcccagaccagggcagcgcaagtctgagcaatacagccacgacacgacactcgcgggcacattgagacacctgacggcacgctcccgcgaaacccgccatgctagatctcacgtcacgcactcacaagccccgcactccgcgaagcactaccacccacgcaaccggcccctccacagctccccccaccgctgccgcccacactcgaccagccaaacagcgacccgcacacacactaccacacccacacaaaaactcccaccaccccactccaaacaacataccccccaaccccacaaactcaccccccaccccccacaacccacacccacacaacccaccccacccgcaccacaccccctcctaaccaacccaccccaaccctccccaccccacacaccctcccccccaatcaacaatacccccatcactcccccccgccacaatccacaacccacacaacacccacacaca

SEQ ID NO: 697668 - DNA, 285 bp, Homo sapiens
  misc_feature (3)..(3): n is a, c, g, or t
  misc_feature (7)..(7): n is a, c, g, or t
  misc_feature (38)..(38): n is a, c, g, or t
  misc_feature (83)..(83): n is a, c, g, or t
  misc_feature (114)..(114): n is a, c, g, or t
  misc_feature (122)..(122): n is a, c, g, or t
  misc_feature (129)..(130): n is a, c, g, or t
  misc_feature (135)..(135): n is a, c, g, or t
  misc_feature (182)..(182): n is a, c, g, or t
  misc_feature (243)..(243): n is a, c, g, or t
  misc_feature (251)..(251): n is a, c, g, or t
  misc_feature (284)..(284): n is a, c, g, or t
cgngcgnaaaaagatgaattgtaaattatactctcacngtttggatccggtgtggagagggaatgtaaatttacatcatttcnttttgggagagacttgttttggatgcccccnaatccccntctcccnngcgcngtaaaatgtgggattatgggtcggggaaaaagtgggttttttagttnaattttttttaacattccgcgtgaatgtaaatttgtactatttaactgactattcgtgatntaaaatcntgtcgtgtgtataaaaataaaaaagatccgggnt

SEQ ID NO: 697669 - DNA, 367 bp, Homo sapiens
cccacattgactcagtctggggcttgatgtggccctgggtggtacagagccacatcaagcgccacattgactcagtctgggccttcgagaaggtggctgatgccatgaggaacagatgcaggagaagaacgaatgtgggcaaggtcctcctggttccagggccagagaacggagaactatgggcaagtggctgtgatgaccctacgagaccagcgaagggagaagttgggaacgctacgttctgttggacaccagacttgcatttcagcctctgtcataatgctctgccctcgctccacccgaagtgctctgtggtgatgaccagatactacgctgccactccatgtagcgtactctagaagacgga

SEQ ID NO: 697670 - DNA, 875 bp, Homo sapiens
  misc_feature (9)..(9): n is a, c, g, or t
  misc_feature (72)..(72): n is a, c, g, or t
  misc_feature (75)..(75): n is a, c, g, or t
  misc_feature (96)..(96): n is a, c, g, or t
  misc_feature (125)..(126): n is a, c, g, or t
  misc_feature (132)..(132): n is a, c, g, or t
  misc_feature (136)..(137): n is a, c, g, or t
  misc_feature (145)..(145): n is a, c, g, or t
  misc_feature (163)..(163): n is a, c, g, or t
  misc_feature (165)..(165): n is a, c, g, or t
  misc_feature (168)..(168): n is a, c, g, or t
  misc_feature (176)..(176): n is a, c, g, or t
  misc_feature (179)..(179): n is a, c, g, or t
  misc_feature (195)..(195): n is a, c, g, or t
  misc_feature (201)..(201): n is a, c, g, or t
  misc_feature (214)..(214): n is a, c, g, or t
  misc_feature (217)..(217): n is a, c, g, or t
  misc_feature (274)..(275): n is a, c, g, or t
  misc_feature (280)..(280): n is a, c, g, or t
  misc_feature (286)..(286): n is a, c, g, or t
  misc_feature (299)..(300): n is a, c, g, or t
  misc_feature (322)..(322): n is a, c, g, or t
  misc_feature (338)..(338): n is a, c, g, or t
  misc_feature (343)..(343): n is a, c, g, or t
  misc_feature (379)..(379): n is a, c, g, or t
  misc_feature (390)..(390): n is a, c, g, or t
  misc_feature (414)..(414): n is a, c, g, or t
  misc_feature (420)..(420): n is a, c, g, or t
  misc_feature (422)..(422): n is a, c, g, or t
  misc_feature (430)..(430): n is a, c, g, or t
  misc_feature (447)..(447): n is a, c, g, or t
  misc_feature (450)..(450): n is a, c, g, or t
  misc_feature (490)..(490): n is a, c, g, or t
  misc_feature (492)..(492): n is a, c, g, or t
  misc_feature (522)..(522): n is a, c, g, or t
  misc_feature (606)..(606): n is a, c, g, or t
ctgcactcngggaccgtccctgcgcgctctgggcgcaccatggcccgcggggctgcgctggcgctgctgctnttnggcctgctgggtgttctggtngccgccccggatggtggtttcgatttatnngatgcncttnntgacaatnaaaacaagaaacccactncnatncccaaganacncagtgctggggatganttttanttaggagatgctnttnttgatggagaaaattacgacccacgaccaccgaacccacccaaaccgatgctaaatnnaaacnccaacnaccctagttcctnnggtagctttttagatgctgacnttgcggatggcgtttnaggtngagaaggaaaaggaggcagttatggtggaggcagcnacaggaaaganggggaagaggccgacgccccaggngtgatntncgggattnttggggctgttgtggtngcngtggctggagctatctctagcttcattgcttactagaaananaagctatgcttcatagaaaatgcagaacanggggaggtggacatggagagccaccggaatgccaacgcagagccagctgttcagcgtactcttttagagaaatagaagattgtnggcagaaacagcccaggcgttggcagcagggttagaacagctgcctgaggctcctccctgaaggacacctgcctgagagcagagatggaggccttctgttcacggcggattctttgttttaatcttgcgatgtgctttgcttgttgctgggcggatgatgtttactaacgatgaattttacatccaaaggggggataggcacttggacccccattctccaaggcccgggggggcggtttcccatgggatgtgaaaggctggccattatt

SEQ ID NO: 697671 - DNA, 1068 bp, Homo sapiens
  misc_feature (423)..(423): n is a, c, g, or t
  misc_feature (429)..(430): n is a, c, g, or t
  misc_feature (435)..(435): n is a, c, g, or t
  misc_feature (439)..(440): n is a, c, g, or t
  misc_feature (442)..(443): n is a, c, g, or t
  misc_feature (452)..(452): n is a, c, g, or t
  misc_feature (461)..(462): n is a, c, g, or t
  misc_feature (468)..(468): n is a, c, g, or t
  misc_feature (472)..(472): n is a, c, g, or t
  misc_feature (518)..(518): n is a, c, g, or t
  misc_feature (520)..(520): n is a, c, g, or t
  misc_feature (532)..(532): n is a, c, g, or t
  misc_feature (539)..(539): n is a, c, g, or t
aacaaggcttggatggtggcaaaagacctacctgcaccaagtgtgaaaaaaggggccctttcaaggctgagccaggttggaagagggcagagctgcttccaggacaccagagagtgcagcaagtatgcagagaaaacctgggcaccaagagacctgggagagaggaggcagatgggtgggccaaagttctggtagttgggaaaggtgatagaaagcactgcattaatgctgggtcctctgcccttgtactaagagcagcacatggctgcctctgaatcctgcccatggagtaacatttgcttccatatgccacaaagatgagatggggccctgatgtgcctgttataggagggcagagcatcctgtgtgctctgtgagaagagctgggccacgtatctccaggtcaaagcccgcacagcagtnatcccnnccctntctnntnncttcaaccnttcctttcnnattggnaagnatttccgtatttccaagagcctgctcaagtggggtcagcatgtgtntntggtcaccaacntctcccntgtggaaggctgacaactctcccatctatacaaaattgaaaccaccaattatatgattgacactattacactggaacaatttcctgtcagactcccccaccagactctttacaggccggtgcttcatctacatctctctgtccacagcacttggtgtagtattcgcaacctagcaggaatgaaagagtccgtgtggagtcaagcacctcagggaaccccttgaaagcagtgacacatacctccaacaagaattgcctcttccttccttctgtggctttgcacagcatttttctttaattataaacacagttggtctctctatgctgtttaggctaagcacagcacagcttcaaactggaaggttaaatatttgtggtaaaaataacttatttgtgcccatgcaaatgtggcaacacaaactcaggcatgtagtgttctatgcagagaagctaaaaccaaggaatgacattaatttccggtgaaaatatgtgatgacaatcttagaattctggcttttcagaaaaaaaaa

SEQ ID NO: 697672 - DNA, 238 bp, Homo sapiens
gcggccgcctactactactactaaattcgcggccgcgtcgacccaaaagcacaggcaacaaaagcaaaacaaacaagttggacaacgtcaaactaaaaagtgtctgcacagcaagggaaataatcagaatgaaaaagcaacctacagaggggaagagaatatttgcaaaccatatatctgataaaagggctagtatccaaaatgtataagaaactccaacaactcaatggcaaaaaaa

SEQ ID NO: 697673 - DNA, 348 bp, Homo sapiens
tctagagttccccgagatccccatacagagtaactcacacatataaagctcttagcatgatatctggtacacatgaagggcttcataaatgttaaaacaggaagcacagttcatattgtccctcctcccccaacgaatacagcagcacacttagaagtacaatagaggctggtttcagtggctcacacctgtaatccaagcattttgggaggccgagtagaaggatggtataaggtaaagagtttgagaccagctaggcaagacagtaagacctcgtctccacagaaaaatttaaaaatttttcaagcctggtggtgcatgcctgcagtcccagctactctgtatggg

SEQ ID NO: 697674 - DNA, 437 bp, Homo sapiens
tcagaatatactccattttcttgatccattcttctgtcagtagacacatgagttgtttccgtatcttggccattatgaataatgcttcagtgaacacgggggtacagatacctctttgagatcctgacttcgtccttttggccatctacccatggattaaagacttaaacacaggacctgaaactgtaaaactcctagaaaaaaaacatagggaaaaagcaatgatattttagatgtgacaccaaaagcacaggcaacaaaagcaaaacaaacaagttggacaacgtcaaactaaaaagtgtctgcacagcaagggaaataatcagaatgaaaaagcaacctacagaggggaagagaatatttgcaaaccatatatctgataaaagggctagtatccaaaatgtataagaaactccaacaactcaatggcaaaaaaa

SEQ ID NO: 697675 - DNA, 553 bp, Homo sapiens
  misc_feature (505)..(505): n is a, c, g, or t
tagtttatcggatgccatgacaaagtgatttagaaaaaaaaaaaaagaacctaggattagatctaacgaaaatatggtgcaagaccttagtataaaatgttcattggcgagcactatagacaacccaatgggagtgacttaggacttccacagataacatgactgaatatagtaaaggtgtcaattctctccaaaaggtaaatagagggaaggcaatggcaaccataaccccaaggggaattttgcagggacctggatagggcagttggaggggctatcggaaggagcaagggaaaagaagacccaaggtgctgtgaaaaagaagcggggtctccacctcatagcaccacaaaagtccatttcggagggatgaagacctggaacttgaaagacgacctcggaaaccctttagtaggaaatatgagagggtgcacgggtgtactacaacttggaagacggtaaccattccttagtggcttaagacacaaaagggacaacccataanggaaagactagtaaatccaggtcctttaaattgaaaggcttctgtcct

SEQ ID NO: 697676 - DNA, 113 bp, Homo sapiens
cttttccacagggataataaacaagtataaatgtcaaaatatttttttaaaagtataattggccaggtgctggctcacgcctataatcccagcactctaggagactgaggcag

SEQ ID NO: 697677 - DNA, 405 bp, Homo sapiens
  misc_feature (105)..(105): n is a, c, g, or t
gggacccaaaggccccaggtggggttttttaaaagggggttttaaacccccctccccaagggtgcgctggggaagtttcttgtgcccctttttaaaaaggccccncgggctttcgggtttaaaagtggggttaaaaaacaggggtttttgggagcccccccccagccctttccgggtttcacaagggggggggggtcaattgccctttcccaggggggcccgggggcccggccttttcccccccccgtttaaatgtgttttttcttgggtgggggggggttcccccccctaagggggggggcttttttttttttgggcctttttttccccgggggaggggggggcccccccccttttttgttcccttttttttcgcctgaataaagggcccttggtttgttttta

SEQ ID NO: 697678 - DNA, 189 bp, Homo sapiens
tcccccacgactgctgtctgctgtctcctgtgggttgttgctgtactgctcgagcacgggctccacattctgcctcacagtcttggtgccctgctcctgcagcagggtccacttggtgtccagaaccttgttctgctgctccaggaaccgcaccttgtcgctgacggaggcaaacttcttgttgagggt

SEQ ID NO: 697679 - DNA, 217 bp, Homo sapiens
attcatgcggtgagccatcctttcatagtgttttaatgttattaactatttcaaatcatcttggtaaataagctgtaaaaatttaggccaatagtggctcattcctgaaattccagcaccttgagaggccaagacaggaggactgcttgagcccaggagtttgagatcaacctgggcaacaccccaactctacaaaaaaaaaaaattggccaggctt

SEQ ID NO: 697680 - DNA, 191 bp, Homo sapiens
ggcggggcgtttgcgtgcttgcggttttttcattgcgcagcaattctaatcacctcaatatctatcactagatagtgaacaatcagcggcatttagtacatccagtaacgttgtgtaggcaccacctctgtcacgttccggaacattctgtcatcaccctgtgcagcaatcatttcccctttcgtcccccg

SEQ ID NO: 697681 - DNA, 129 bp, Homo sapiens
cggaccgtgccttaaaaatacaaagtggaagttaagtttacatatttgaaaatcacatatcactaaattaccattatctagaattttccaaagacaaattgcaccatgacatgctacaaaaggcatagg

SEQ ID NO: 697682 - DNA, 1226 bp, Homo sapiens
gcatcatcactgggccatcagatatatgcagacatcaataaccactatgaggatatctatctcgatcaccagattagtgaatggtcatcaattaaagaagttcaggagaaccaacatggctgcctggtcgtagtgactggtggatgaaaatatggaacatgttttaccactagtaggtctgcgggactggtaatgctatgattcaacccacttgtggcaagctcagttgttggcgaatatcctcagggcactcgtagaagcatagcaaatagccactccgatgcccagccataccgcagttagctggcggtatatagcccaacaggaccgtataatacgtcagtgctgtcgtagtaaaagcagcagcatggcacacatgatcttacttgcgggcgactagcttcatcgaaatatgcagatacgaccttgcgacacccaaacgcccagaagtgatcccagaacgaactagaatatgacctggcgaatctaagcgaagaaatcgtggcacaattattacgatccaatgagaagtactagtggcgaggcccagtaaaaggagaacatggattagacgatttcgaatgttccctattaagttagcggcgagcactgggacttgacataactggagaagatccatccatgtgcctcaggtaataactaatccgcaaagaagcaaaataaacccaagaacacgcggcattagtgtctcaacttcaattagagggtggggatctttggcaatgcaaatggaagaattcaaccacttgggacaacaggggcacaggggtggaaattaattcatcaacttccgttgagggtgacccttggtgggattggggagggatcgaagggaggaacgtaagcggcgggccacagagacataggccatttagtgtggaaagacaattggtacgccataaaatggcactcacagaggagacaaccaaccggttcacgacggagaggtgtgacaaggcggcaagacaggggccgtgtggggacaccaaatggctcagtaaccaggtagtggggtaagggtacacacccaggacagcatagggggaccaaacaggggtaacccaccaagaaaagccacagcagagaaaaaagggcacacaagaagcaagagagagaacacaccgaaaaagtcagaaaccacaggaccaaatacaggccaattcatggcacgacagaccaagaacaatataggacggcagaacgga

SEQ ID NO: 697683 - DNA, 233 bp, Homo sapiens
aatatttatattatgacgtcttcttattcacagcctagccaggcagtaagccatgattactgttccttttggcgtagttttggtgtcccgggggttaggaatgatcttgacttttctgcttgctttgttttctaagctttgggatttatttttattttgattttttttgaaacagagtctcactctgtcgccactgcactccagcctgggtgaaagagtgagactcagtctca

SEQ ID NO: 697684 - DNA, 352 bp, Homo sapiens
acctccataatgtgtgcccactctccgacataaaacaatgtgtaagatgtacattggtttggtccaggaaggcgagacaactcgaggtgaggtacggggcgttccagggcacaggtggataagagacaaacagttgcattctgttgagtttctgattagcccttccttgtggaattaggtatttccttgtgggcaaattatgagcaaggtgtgtagctttttttttttaatctttgtagctctcttatttaggaaataaaatggggcccaggtttgcctgaaagttctcagcttgactccttggcttagtgattttgggttccttggaaaatgatttattttccattcacat

SEQ ID NO: 697685 - DNA, 471 bp, Homo sapiens
  misc_feature (137)..(137): n is a, c, g, or t
  misc_feature (153)..(153): n is a, c, g, or t
  misc_feature (210)..(210): n is a, c, g, or t
  misc_feature (215)..(215): n is a, c, g, or t
  misc_feature (221)..(221): n is a, c, g, or t
  misc_feature (296)..(296): n is a, c, g, or t
  misc_feature (298)..(298): n is a, c, g, or t
  misc_feature (433)..(433): n is a, c, g, or t
gctttaatattttttttgtttaccacttaatttttatcaactttgattttagttagggcttaggtcatggttgaagaaaagtggaaaataacaagtgcccatttaggtttgaagaatccagaatgttttacctttgnctttatgagttatagnagcttggctttgctctaggtttcatgttgagagatgagaggggtggcagtattttcnttttnttcttnctaatttcagtttcctgtaaaggaaacaagttacatattgatgcttaaatccagaaagtgtcaaaggttttcttnanctgttaaaatatagtgtctgatatcaaggatgtaagttactcagctttttgcttcctaaagcaactagtgagtgtgaggcaggagaatctcttgagcctgtcaggcggaggctgcagtgggctgagatcgtgccnctgcacttcagcctgagctacaaagaaattccgtctcc

SEQ ID NO: 697686 - DNA, 134 bp, Homo sapiens
ggatcactagtactggctgcagttgtgctggaattctggttatgctggctgccctttttttcccagctactcgggagtgatgagtgcaggagaatggctgtgaaccctgggaatgtggatgcttgcaaataatg

SEQ ID NO: 697687 - DNA, 765 bp, Homo sapiens
ggaagaagactcgaagttcgaagtggaacaactggaagaccagaagtacgggacaggcgaagaaaacgaactagacgacagatacgggacacttagacagactaaaaaccatacttttagaacgacacaaacgatacactttaacaccctgaacaacgtacggacagtcagacagaacacaaagacacagctaggcaaacacaaaaggctaaggggcacaacatgtaccaaacgttagcaagcaaacatctggacagcatagcaaacgacagatcagacaacatggaagaatcatctggtcaacgaggtttcgagaatacgaacacatgaacaaacgaaggctaagggacaaggtacttggcacgcaagtactagaacgcatcagcaaaacatcaaaaggccaacaaattcggcatacaacatacgcacgtgaaacaacatgaggaacattcattggctaacccaatattatatctaaacagccgcatcgaatttacatttcctggtgggtgcagcacagttagcaacggtaacacgcttgcagacacgatgaggcgtgtcatacagtagcacccagacaccacatcatcgcaacgacataccttgacacgctagaacggggacacgttcggttcacaaaatcacatcaaacaagctactaaacaggactggttgtaatgtaaaaaacaaactaaaggcagaaggcttaatggaagagttagaagaatttggaaggccttaaatatagtagactacgttgaaaaa

SEQ ID NO: 697688 - DNA, 355 bp, Homo sapiens
  misc_feature (28)..(28): n is a, c, g, or t
  misc_feature (279)..(279): n is a, c, g, or t
agcttttaaaagattttttttttttctntcaaccccatgattcctttaacaacatgtttccagcattcccaggtaggccaaggtgtcctacaaaaaaaccttgggttaaacctacagggggtttggctggtgttaacaaaagggagggcaaaactggtgcggctggccatggaaaaaacttacttgggtggtgtggtacaaaaaaaccagcttgtttacatgcttattccatgactgcttgccctaagcaaaaagtgcctttcaggatttatttttggnggtttattacgtatgtttggttttcaattcccccagtttaatgaagatttaaataaaatggtaggttttcccttta

SEQ ID NO: 697689 - DNA, 271 bp, Homo sapiens
atctgccagtgcttagctcttggactgctcagcccttcgaaactatcagaaataaatttctgtggtttataaggcacccagtttacagtattttgttgcagcagccagaacgggctaagacaacaaggatgaggtgaagcatcctggatatcctctgcctgtaatccggtctgatgtgcggcacttcatgtccgagcctatccatttggttatggtcttcggaaaagacaacgttagtcacttactagtggcagttgcatggagaagaggg

SEQ ID NO: 697690 - DNA, 151 bp, Homo sapiens
  misc_feature (100)..(100): n is a, c, g, or t
  misc_feature (112)..(112): n is a, c, g, or t
  misc_feature (130)..(130): n is a, c, g, or t
aagacttcatactgccttccatagtgactagaccattttacattcccaccaacaatgtacaagggttccagtttctccacatcctctccaacacttgtantgtgttgttttntcataatggcatcttaanaggtattaggtgatattacta

SEQ ID NO: 697691 - DNA, 134 bp, Homo sapiens
aacggatggattagccccgtatgctctccatccaatgaatatctaatacacaagtatatctccacaactctatccatatccaagcatgaggatggctactcatatcctatacctatacagctatacagtgctac

SEQ ID NO: 697692 - DNA, 512 bp, Homo sapiens
tctacgatggcagcagatgagcggcatctgacatacgaccgcagggaatggaatgagcctcaacatggcgcggatgacggtgccgtagctctgtgtgcgggaggcggagcccgggtactccacatacacgacaggcacgtggagcaggaacctgtgtgagaggggctttcttccaggctctgtgaggggattacaagaccccaacaaactggattctccccagcttcacccatgtgagactctgaggtacggataaaagcctccgtgctccaccatctgtctgatgaaggatatgaccctctgggtcccatattaatccatatctggcacgttgatctacatcacagaacaacaccagccactttccaagttgaacaggagccacaaccaccccattaggtgtgcgcctgtactcgcagtagtgatcacaaagtcttcagaagcagctctggacgtagtcacactggagaagttgagacccaccacctccatgtcagggaaggcccggaggg

SEQ ID NO: 697693 - DNA, 279 bp, Homo sapiens
  misc_feature (123)..(123): n is a, c, g, or t
  misc_feature (131)..(131): n is a, c, g, or t
  misc_feature (161)..(161): n is a, c, g, or t
  misc_feature (203)..(203): n is a, c, g, or t
  misc_feature (225)..(225): n is a, c, g, or t
  misc_feature (232)..(232): n is a, c, g, or t
  misc_feature (250)..(250): n is a, c, g, or t
  misc_feature (258)..(258): n is a, c, g, or t
tggctgttgagttgcaggtgttccttatataccctggatattaacccctcattagatacatggtttgcaaatattttctcccattccatagattaccagttcagtctcttaacctgttttccnttgctgtncaaaaagcttttttaattagatgcagtccngtttgtctatttttttaaattgctttcgctgtagctataagntgtgttctgttaagactttggnaaccacnaagaaaatacctatatgnacgatacncggaaggatgcaaaaaaaggg

SEQ ID NO: 697694 - DNA, 237 bp, Homo sapiens
ctgtagaggatcccggcacaggagactgtaccaccatggtgacacgggtgatggggaatcagtgcttcgatatcctggagagggcgccatgagaaacggataccaccatccaaggaaggcagcagcgcgcgcaaattacccactcccgacccgggaaggtagtgccgcaaactcacactaccggactctttcgagtgccctgtaatgggaatgacgtccaatttaaactcctttacc

SEQ ID NO: 697695 - DNA, 166 bp, Homo sapiens
  misc_feature (32)..(32): n is a, c, g, or t
  misc_feature (74)..(74): n is a, c, g, or t
  misc_feature (87)..(87): n is a, c, g, or t
ccatctctacaaaaaatacaaaagttagccantcatggtggtgcgtgcctgtggaaggctgaggtgggaggatnacctgaccctganggcggtcgaggctgcagtgaagctgtgaacatgctacctgcacctccagtccgggtgacagagtgagaccctttcgcaa

SEQ ID NO: 697696 - DNA, 762 bp, Homo sapiens
  misc_feature (3)..(3): n is a, c, g, or t
  misc_feature (88)..(88): n is a, c, g, or t
  misc_feature (103)..(103): n is a, c, g, or t
  misc_feature (230)..(230): n is a, c, g, or t
  misc_feature (243)..(243): n is a, c, g, or t
  misc_feature (249)..(249): n is a, c, g, or t
  misc_feature (257)..(257): n is a, c, g, or t
  misc_feature (264)..(264): n is a, c, g, or t
  misc_feature (277)..(277): n is a, c, g, or t
  misc_feature (289)..(289): n is a, c, g, or t
  misc_feature (291)..(291): n is a, c, g, or t
  misc_feature (305)..(305): n is a, c, g, or t
  misc_feature (314)..(314): n is a, c, g, or t
  misc_feature (352)..(352): n is a, c, g, or t
  misc_feature (404)..(404): n is a, c, g, or t
  misc_feature (429)..(429): n is a, c, g, or t
  misc_feature (442)..(442): n is a, c, g, or t
  misc_feature (450)..(450): n is a, c, g, or t
  misc_feature (501)..(501): n is a, c, g, or t
  misc_feature (503)..(503): n is a, c, g, or t
  misc_feature (630)..(630): n is a, c, g, or t
  misc_feature (681)..(681): n is a, c, g, or t
  misc_feature (736)..(736): n is a, c, g, or t
ggnaggggggcccggacacagagacgcacaggttggggacgctgattgcagacgcggacgagcagggcgggcgcgggaggcagggttnaggccgccgcggggntcccccagcctctgggcccgttctggggggggtggaaggcgcagacagcccccgaaggagccagttggaagtagggagccacggctggactgcatcctcacttgccgcccttgcgggacagaaaccnggggaggcaaganaaagtntgtttgangcgcgcnagagcggcagcgnccggtgggcttncnggggggtgcgcggnaccaggggntgcagggtttcctcggaggctgctgagtgcggcccggnggaggaggccgaggtcgcggagccctgccggcagcgcttgcacagcggcagnagcgcgcgcaaattcttcttgttgnggaaggggctctngccgaagngctccttcagctgctggcgaagttttgggaactggcccagccaaactcttnanctgctgtctaaagtctgggttggggttggcgatgggcctggtggccttgatggcttcaagcacgtcccgccagcctagccccgtcacagtcatcacatacgctgtcacaatcgtggtgctgcgaganatgcctgcaaagcagtgcacaaggcagttctccccattaaggcggcagagntggatgaagttgatacattctttgaagtgctttttgatgggtactcaggggtatnagcgactgggatgcgaaggtaggtga

SEQ ID NO: 697697 - DNA, 591 bp, Homo sapiens
  misc_feature (400)..(400): n is a, c, g, or t
  misc_feature (587)..(587): n is a, c, g, or t
cttgcaaccagctttggagaaagcccagctcctgtgtgctcactgggagtggaatccctgtctccacatctgctcctagcagtgcatcagccagtaaaacaaacacatttacaagaaaaatgttttaaagatgccaggggtactgaatctgcaaagcaaatgagcagccaaggaccagcatctgtccgcatttcactatcatactacctcttctttctgtagggatgagaattcctcttttaatcagtcaagggagatgcttcaaagctggagctattttatttctgagatgttgatgtgaactgtacattagtacatactcagtactctccttcaattgctgaaccccagttgaccattttaccaagactttagatgctttcttgtgccctcaattttntttttaaaaatacttctacatgactgcttgacagcccaacagccactctcaatagagagctatgtcttacattctttcctctgctgctcaatagttttatatatctatgcatacatatatacacacatatgtatataaaattcataatgaatatatttgcctatattctccctacagaatatttttngctc

SEQ ID NO: 697698 - DNA, 434 bp, Homo sapiens
  misc_feature (201)..(201): n is a, c, g, or t
  misc_feature (402)..(402): n is a, c, g, or t
cctgctggggggtacagatggggagactgaggcttggggagcctgaaatttctgttgctcactggtgtgtggcagctgtacacaggcctcttggggaagtgcggacaggccttcaatcaggagtgcttttattttgccccctcttgaaatttaatatgttgcttattattagaaaattaagcagctgggcgcggtggctcntgcttgtaatcccagcacttcgggaggccgaggtggaaagatccattgagcccaggagttctgtaccagccctgggaaacatagcgaggccctgtctctaccaaaatttttaaaattaagctgggcatggtggctggcgcctgtaatcccagctactcaggaggctgaggcaggaggattacttgagcctaagagttcaanggctacagtgaagccatgatcatggccattgg

SEQ ID NO: 697699 - DNA, 1226 bp, Homo sapiens
gagtactgtcctttctctctccccgtgacagcatgagcttcaccgactcgctccaccttctccacacaacatacctggtccctggtgctctgtccagtgcgcccagctacgtgtgccctggcctggtcagcagctgctggcagctgtctatgcatgtgctgctggaggcgcatctgtgattccctgtgactctcccgtgatccctgctcacaaccaagcattcagaggatgcggcattggcggtcctggggagaccctgtgggcaacctgcgagatacgccaggggcgtacttggcgacggagactggggacgcgcatacccagcacacgggcagacaggacggacccaattgatacacacgcccttgaacactgaacctgcacttgtggccttccttacactcgggacccgcacgtgcagtgagacccttgcgacgaaaccggaacgacacccagggaagggctaggccccgaagccaacacactcccccggcgacgcaacctaatggggcaggacaacgaaacggggggaaccaccagtgctcccagcacccacctacggcacggcccactccaactctccaagactgacttcgcactccgacactgggacgcaatcgcagcgggcactctaccgaaatccttccccggcgaacacttaacctggttgggacaaaacatggaccccggcactaccggtgacatggcaagcactttggcccaaactgcccccgcacaatctcgctcggcctcgagttgaacctctttaccgaccgctcccgaccgcttaattggacggcaaccacgcagctcttcgtggcccaatgggctagccccaacggtcagtggatcgggactcgacaacggcacaagtccacattgcgcccttccccggcccaaacggtggtcacatttggaatttcgcactacccacaactacatacaacagccgacctcgggccggccacggtgcacgcaaccacgcacaattcggaaggtgccctccatccgacggtgtcatggatgccatggcattctgttccactggaataacagaaactcccacccgccacatgcacgggcggggccacacaggggcgccatcacaaagccccgccaccattgggccacgaccatccgtggcgattgtgcccccgcatggcagcgcgcttgaaagtggcgccccccagaatctcagggccaccagtcgcacacagcatacacgt

SEQ ID NO: 697700 - DNA, 332 bp, Homo sapiens
cggatcccggaaataacagagcctgtgcagtaaccgcttggcaagtaataaatatatccgaatttatgtcctaaatccatatcaactccaccacttgactatgctctctgcatcttcttgcttaccctctataccattatgagtggagcccttcaaattcacatgtaaaattgaacatgaaatctatatgcctcaaacaccaatacctatatatctataggaaaacaagtagcaacatgccatcctgacatagacaaaaagtaaatagacatttgcactccaactttataaccagctgcaagtatctttctatctttctttctttaaatcga

SEQ ID NO: 697701 - DNA, 769 bp, Homo sapiens
gctgaagtgccgccgccgccgtggtcagccacggggaatccgcccgcatctgccgccctcgccggcgtggcgtgcgtggggcccagagcgccggaggccaggctggggcggcaccgcgcagcgggccacggggttcccgttagagcagcgcccggcggctatgccgatgtagccccggaagtcggtccggtagtgtagcagtatgggtgccgtgcgggaagggagggaaacccttttctgcgaggatacgaagccataacccggtcaaggaaccccgaacttgaattggctcgggcattggggcgcaaaatactgacacagcgcgagggcaaggcgaagctactgacacggggcagggttattgctcccccttgttgccaaccggcccccttggcagggactcggcagccagggcagaattgcagctaggccattgtggcagcatttggccttttcctaagcaggggaagggcttccttgcattggcctttgcaggcattgattccttgttgcgcaccttcgcagcatttggagacacaacaaaccgcctttcggagggaagctactcacgttgggctgttgcgaccggcaaggccgggcattaccgggggcccagccaagttcttcctggggaacgggtgggctttcccggagagcctctggctttcattcatttttgccaggcgcgccaagagagaaaccccgggacccgtgattgcttgacttgggatctgtggcatgggcgatgacactctggagtatgggaagc

SEQ ID NO: 697702 - DNA, 619 bp, Homo sapiens
  misc_feature (338)..(338): n is a, c, g, or t
  misc_feature (381)..(381): n is a, c, g, or t
  misc_feature (398)..(398): n is a, c, g, or t
  misc_feature (405)..(405): n is a, c, g, or t
  misc_feature (412)..(412): n is a, c, g, or t
  misc_feature (428)..(428): n is a, c, g, or t
  misc_feature (443)..(443): n is a, c, g, or t
  misc_feature (447)..(447): n is a, c, g, or t
gctaccatctccccggtgtccctgagctctgggggggctggcattcggcccggggaaaagcgtgagcaggtctgcgaggctaacctgtctccgcgttgacgcacctcgcgggcgatgaatccggcagcgacgaaggaagactgccaatggataggcccaggaaaacgaactagatggagcagcctatgacagaatggagaggaacaccgccctttggggagagaggtgaagggatagcagtcgtgtacgggaaatcgagggtggacaaggctcgtccgacttgcccctaattttcgatgggcacatacccaataggcagatcaatgatgggatgggtngagatggagatgatatggaaatattcatggaggagatgagagnaatcagaagaaacttanggagctnagttgangaattgtctgcgtatncttatggggagctcnctantcaccatgaccatcatgatggaatttcgccttatgccttgacgtccgtgccatttagtcatgagattacatactgtgattacccggtgtttgctaatagtccttgcattttcctaatatgcctttagctgagtccgtgtggtgtgaaccctatgttatgtccactgtgtcag

SEQ ID NO: 697703 - DNA, 504 bp, Homo sapiens
gccgttgtagtccacatcaatgcggcggtgcaggtccacggagttcggggtgcctggcttgtcgccgaacttgccgcggtcactgagggggtgcttggaaaaatcgtggtcgtagtgcacgtggggggcggaggtccacatgaaaatgctgcggtcaatcacttcgcccatggagtgcaggtggctgcgttcctgcaggttcagcatctgcccacccaccagggttggggtgcgcgcgtagcgggctgcctggagggcacggagcacggcatcgggttcgatggcgatgtcatcgtccatgtacaggatgtagggggattgttttgcggctgcctctctagtgccgtcggggccacccatggcctcatacatgatgcgggagtagccgccggaaccgccgaggttaccctgctggtacacgaacagccgacctttgaaatgctccgcagcatcggcgaagcctggttcgtcagccctcgatccgcccgcgaatttagtagtagt

SEQ ID NO: 697704 - DNA, 1006 bp, Homo sapiens
  misc_feature (99)..(99): n is a, c, g, or t
  misc_feature (154)..(154): n is a, c, g, or t
  misc_feature (338)..(338): n is a, c, g, or t
  misc_feature (342)..(342): n is a, c, g, or t
  misc_feature (344)..(344): n is a, c, g, or t
  misc_feature (353)..(353): n is a, c, g, or t
  misc_feature (355)..(355): n is a, c, g, or t
  misc_feature (359)..(359): n is a, c, g, or t
  misc_feature (364)..(364): n is a, c, g, or t
  misc_feature (376)..(376): n is a, c, g, or t
  misc_feature (381)..(381): n is a, c, g, or t
  misc_feature (423)..(423): n is a, c, g, or t
  misc_feature (496)..(496): n is a, c, g, or t
  misc_feature (541)..(541): n is a, c, g, or t
  misc_feature (543)..(543): n is a, c, g, or t
  misc_feature (545)..(545): n is a, c, g, or t
  misc_feature (549)..(549): n is a, c, g, or t
  misc_feature (594)..(594): n is a, c, g, or t
  misc_feature (642)..(643): n is a, c, g, or t
  misc_feature (674)..(674): n is a, c, g, or t
  misc_feature (846)..(846): n is a, c, g, or t
  misc_feature (912)..(912): n is a, c, g, or t
  misc_feature (987)..(987): n is a, c, g, or t
cgtgccctgtcccatccgccccacaagcccatccaggagccacacaccctgcctgggctgtgagcactaaactcctgagtgacacagagcgctcagccngaaagagaacctgggaacaaagaagacaagctaatgatccagcattagagaggcnctaaaaggagagccttgggggctctgagcagcaggtacaccgtcctcccctcctgccagcctggttctgccctcactggaagagtcaaccccgccagcagcgcccacagccccagccccatcgtccaggctgccatgtcccggcgggcagtgcccaggcccagatagatatattttagcggacnggcngnactataaanancggnaggcngggccttcctgnatctncactctccgtaccggatgcggccgaagacctggcctcgctanaaagcctggctctgctgctccaggccgctgctcagccgcctgccttgctgtcggcgagggtggtcctggggangcctccagggactagggagacgcgggtgggaggagcctgtacttnantntctncagaagcagcagggccctcagtgccagcgtcctgcagtcctcgtncgggtctttctcagccacgtccgccagccaggaccgggcttccagcanntcgtccatcaggtcctccagcaggcgcgcanagagcaggctgagcaggacggaggagacggccgacaacagcccctggcgcacgtaggcatcgatgtggaagcgaagggcccacacgaattccagcagggccttgcccatggccacagccaccgtggtgttaacagccaggcacatcagggcccctaaggtgtgcgccacctntccgagaaccagctggtcttctcccaagaggtcgaaggtcaccagaggactgtcaaagcgctgaangaggggggaagaagaagtggccggccacggagttgaatctgctagggctgcctgccgggccctgcctctgggcanccttggagagccgctgggt

SEQ ID NO: 697705 - DNA, 148 bp, Homo sapiens
ataaagtagggcaaatatactatagtggccctcatggttgctatcgaacactagatcttactccgtctatgtgactgtatatttgacccacgaggcatgccctttctactccgctttgcactaccctattgcagactctgctaaccgg

SEQ ID NO: 697706 - DNA, 499 bp, Homo sapiens
gtccgtggaggaaaaagaggcgaggctttaccgagatcgtctcagcgatggcgcttcggtcgcagttttgggggttctcggtttggaggaaccctgggtgcaggttccgcagccctgtcaaccagctccgagccgggcgcgaaacctgaagtggaccctgtggaaaatgaagctgtcggcccagaaattcaccaaccggaacccccggaaactgagcttttatctgtagccaggaaagagcggggctggcggacggtgtttccctcccgtgagttctggcacaggttgcgagttataagggctcagcatcatgtagaagcgcttgtggagcatcagaatggcaaggttgtggtttcggcctccactcgtgagtgggctattaaaaagcacctttataataccagaaatgtggtggcttgtgagagtataggaagagtggtggcacagagatgcttagaggcgggaatcaacttcatggactaccaaccaaccccgtggg

SEQ ID NO: 697707 - DNA, 453 bp, Homo sapiens
gaggtattgtatggggaatggggatatctggataggtgttctttggcagtaggcataggatatgtggcatttgtgggtgcagctgttgttgttgctttgccgtggttgtgactgttgttgtggtggccttggatttcttcatatctgttacaaaaagctgccttcggacaatcaaggtgtacactttggacttgtccctttgttagattctcctatgcaccgttgaatctcaatgaactggttgttgttcttgggcttgacttttaccaacctgctttatttatcctgacaaaccactgctattctgattgctatggcgaggcaccatgtgaggcttaggcgagttagtagctctggcagggctcaaaggcctgacaggaaacggaccccaagtggattgagctggtggaaaagtacctccaaagtgggtcatgggcaaccttggtggacgga

SEQ ID NO: 697708 - DNA, 157 bp, Homo sapiens
ccggcagagaggagaaggagaaggagcgggtgcctatgctcagatcgactggcatgattttgtaggtggtggaaacagtggacttccaacccaatgagcaagggaacttccctccccccaccacgccagaggagctggggacccgaatcctcattca

SEQ ID NO: 697709 - DNA, 166 bp, Homo sapiens
gctccctgtggtgcttggttgtggctggcctgcgggccgggacggcgtttgcctggaacctccaccactcacgaactacgacgcgcacgtttcactgggatcacctccatcagggaaaccaaagagctccccacaaacagctttctgggctgcctgaagaactttc

SEQ ID NO: 697710 - DNA, 361 bp, Homo sapiens
agggtaccgtgacatcaggtgactggcagtatacatatcgaccaatttcatctgtagctcctgcgcctgcttcgactcattgagcgtcgatacgtcttgcaaggccacaaatccttcgcagctataattgcgggtattcatcacaatttgcgtgttgtccgaatcaaggatctgaaagcccatagcttggtagaaagcgactttggctggtgtgcacctaagctcgacatgaggataccgtgcaatcactttttccatcatcgttctgccaataccaagcccacggtgttgatgatgaacaaccatatacgttagcccgcaggcgtctggatggcttggtaccggaaggtagagcacatat

SEQ ID NO: 697711 - DNA, 586 bp, Homo sapiens
  misc_feature (12)..(12): n is a, c, g, or t
  misc_feature (18)..(18): n is a, c, g, or t
  misc_feature (178)..(178): n is a, c, g, or t
  misc_feature (519)..(519): n is a, c, g, or t
  misc_feature (526)..(526): n is a, c, g, or t
  misc_feature (530)..(530): n is a, c, g, or t
  misc_feature (537)..(538): n is a, c, g, or t
  misc_feature (557)..(557): n is a, c, g, or t
  misc_feature (567)..(567): n is a, c, g, or t
gaattgggacgngcccanccaaaaccctcccagacgtctcctctcctgcctgggcaaagtccagcttggcaccccgtctggggcctgcctgtggtcagggcaagtgttccctcctccaggaaagcctttaccctcctcatgccctgtagtcaggaggccgcctgctgtaaccctccgngtcgcctcgggtgcgaaatcagacccacctgacaccatcacgcggaggcccagcagcacctgcacccacccccaccttccccagcaaccacttccagctgctctggccaaaatctccgctcggccaggccccgtggctcacacctgtaatcctagcacattgggaggccaaggcaggcacatcacctgagttcaggagttcaagaccagcctggccaacatggtgaaatcccgtctctactaaaaacagaaaattatccgggcgtggtggcacatgactgtaatcccagctactcaggaggctgaggcaggaggtcacttgaacctgggaggcggaggttncagttangttnaggtttnngcatttgaattcaagcttngggaacaagnggaaatttttgcttaaaaa

SEQ ID NO: 697712 - DNA, 179 bp, Homo sapiens
  misc_feature (59)..(59): n is a, c, g, or t
  misc_feature (110)..(110): n is a, c, g, or t
cccggtcaacttcaagctcctaagccactgcctgctggtgaccctggccgcccacctcnccgccgagttcacccctgcggtgcacgccttccctgggacaagttcctggncttctgtggagcaccgtgttggaccttccaaattaccgtttaagctgggagcttcggtagccgttcctt

SEQ ID NO: 697713 - DNA, 651 bp, Homo sapiens
  misc_feature (12)..(12): n is a, c, g, or t
  misc_feature (18)..(18): n is a, c, g, or t
  misc_feature (178)..(178): n is a, c, g, or t
  misc_feature (627)..(627): n is a, c, g, or t
gaattgggacgngcccanccaaaaccctcccagacgtctcctctcctgcctgggcaaagtccagcttggcaccccgtctggggcctgcctgtggtcagggcaagtgttccctcctccaggaaagcctttaccctcctcatgccctgtagtcaggaggccgcctgctgtaaccctccgngtcgcctcgggtgcgaaatcagacccacctgacaccatcacgcggaggcccagcagcacctgcacccacccccaccttccccagcaaccacttccagctgctctggccaaaatctccgctcggccaggccccgtggctcacacctgtaatcctagcacattgggaggccaaggcaggcacatcacctgagttcaggagttcaagaccagcctggccaacatggtgaaatcccgtctctactaaaaacagaaaattatccgggcgtggtggcacatgactgtaatcccagctactcaaaaaaaaaaaatagtaataatacaaaaattagctgggcgtggtggcacatgccagtaattccatctactcgggaggctgaggcaggagaatcgtctaagcccgggaggtggaggttgcagtgagcccagatggcgctgctgcactcaagcttngatgacagagcaagactccgtttc

SEQ ID NO: 697714 - DNA, 1157 bp, Homo sapiens
cattgtaacttttcatttaaactctagggcagtgctgtgtctgatcgctctgatagtaacttgctgtatcttctttcacttatactttacaaggtcgacgctgttgatgcccacatgttggctgagactcgctgggaggcctcaagtgcgctactccttcgactagctgcacagaagctactggacagcgattactaaccaagggcacaggggactcgacccccacgtcctctaataacctgggtattacgggactcacgaatgacaacactaccgggttcacaatggttccccccaatgggcagcggcacctactgggcctttggggcctacggggaacaccggaaatattccttaaaaccggtggggaacttcttggacacttagcgggctaatccaaacattccccgaaaggaaccggctggctggccgtataaatgagccccttccagcaaatatctgggtacccaaggccggtttgagccacgcgggcccaattaaagacccaataatctatcctattcccaaggaaacggctcgttgggcgacgttgatacaccgggtacttttcactttggtactactccggttgcacacccaggggggccgactcccgttatgataaaaagaagaaacgtgaatacaccagccaagacacaccatagggcccccactgaaaagttactatgatgccctgtatagagtcatcagttggttctatccaacttgggggggggcgaatatatcactatcctgtgcattacagtggattattagtatcctccgttgtacctatgaactataaagcgcaaatttacacaatagcatcgcttagatctcgcgtccaaaagagtgtcagaaccccctgtgggaaagagcgtcattctcaacagggtttgggaaacataccttgtaacaccggggggggtatggagacatcaaatcttcctttttgctacacggagacaccacgcagcagccgtatagtcctaccccaagtatgagtagtattattttccacgttttaaaacacaggttttacacgggggggaaaaatacgcccgcaaaagcagtggttttactcacaggagcgaggacgaacgacactgtaaacccccctgtgtggccaaaccgttgccatctaacactgtggggaa

SEQ ID NO: 697715 - DNA, 322 bp, Homo sapiens
  misc_feature (20)..(20): n is a, c, g, or t
  misc_feature (22)..(23): n is a, c, g, or t
  misc_feature (31)..(31): n is a, c, g, or t
  misc_feature (154)..(154): n is a, c, g, or t
  misc_feature (166)..(166): n is a, c, g, or t
  misc_feature (182)..(182): n is a, c, g, or t
  misc_feature (223)..(223): n is a, c, g, or t
tttggtgagtttcccgctantnngcagcgtngcgggttgaagctggtgtctgcggggttccagactgctgaggaactcctagaggtgaaaccctccgagcttagcaaagaagtggggatatctaaagcagaagccttagaaactctgcaaattntcacaggagagngtgtctcacaaataanccaagatatgctggtacatctgagtcacacaagaagtgtanagcactggaacttcttgagcaggagcatacccagggcttcataatcaccttctgttcagcactagatgatattcttgggggtggagtgccccttaatga

SEQ ID NO: 697716 - DNA, 446 bp, Homo sapiens
  misc_feature (8)..(8): n is a, c, g, or t
  misc_feature (124)..(124): n is a, c, g, or t
  misc_feature (148)..(148): n is a, c, g, or t
  misc_feature (227)..(228): n is a, c, g, or t
  misc_feature (230)..(230): n is a, c, g, or t
  misc_feature (236)..(239): n is a, c, g, or t
  misc_feature (256)..(256): n is a, c, g, or t
  misc_feature (258)..(258): n is a, c, g, or t
  misc_feature (260)..(260): n is a, c, g, or t
  misc_feature (276)..(276): n is a, c, g, or t
  misc_feature (278)..(278): n is a, c, g, or t
  misc_feature (282)..(282): n is a, c, g, or t
  misc_feature (284)..(287): n is a, c, g, or t
  misc_feature (289)..(289): n is a, c, g, or t
  misc_feature (292)..(292): n is a, c, g, or t
  misc_feature (298)..(298): n is a, c, g, or t
  misc_feature (301)..(302): n is a, c, g, or t
  misc_feature (304)..(305): n is a, c, g, or t
  misc_feature (307)..(308): n is a, c, g, or t
  misc_feature (313)..(313): n is a, c, g, or t
  misc_feature (317)..(317): n is a, c, g, or t
  misc_feature (319)..(319): n is a, c, g, or t
  misc_feature (322)..(322): n is a, c, g, or t
  misc_feature (372)..(372): n is a, c, g, or t
  misc_feature (376)..(376): n is a, c, g, or t
  misc_feature (381)..(381): n is a, c, g, or t
  misc_feature (423)..(423): n is a, c, g, or t
agaaaganaaaacacataaatttcatatggtatgaccatatttaatcaaatgataatttactggtgaaatttaaattattaaatttatgcatggtttctcatgcatggtttatataaataaacnccttaaacagtataaacatttganaaactttactttccttggttttttataagtttagtggtctccaacccacaatgtcttaggaaataatttaacaataggnnancccttnnnnccatctatctctatgtnancncaaacatatacctgtnantggngnnnngnagntacatnganngnngnngcgtncccngnggngaacatttctggctttaataaattgattagctttttaaatcagtcaaganagtnaagancttttaaataaatccccttattcattcattgtactgcaatcnaacacaataaaatgggagtcata

SEQ ID NO: 697717 - DNA, 216 bp, Homo sapiens
gtggcagtcacagatttgagcttgaatgtcgggcgacgacgcgatgtgggcagtgaggggcgcaatgatctaggcataaatacgagaaggtagcggtaagtaacactgtacttagaatatagtagatgcgaataaagcgtgatatcgacggcgcagatttgcatgatgatcatgcaatggatccatatatagggccgggtaaaataacctcaggtc

SEQ ID NO: 697718 - DNA, 350 bp, Homo sapiens
  misc_feature (13)..(13): n is a, c, g, or t
  misc_feature (154)..(154): n is a, c, g, or t
  misc_feature (343)..(343): n is a, c, g, or t
  misc_feature (349)..(349): n is a, c, g, or t
tttcggcacggangtatacctgccacctcagcctcccaagtagctgagaccacaggcacacatcactacacctggctaattttttgtatttttggtagagacgaagttcaccatgttgtccaggctggtcttgaactcctgagctcaggcgatnctaccctccttggcctcccaaagtgctgagattacaggtgtgagccaccccgcccggctgtagtttttcatattatttgtataatagggttagggttccagcctggggtggacagaggcaaggctcttattcttcaaacaaacaaacaaacaaacaaacaaaaaacctttgggaggaaaattgggggantttgcnt

SEQ ID NO: 697719 - DNA, 365 bp, Homo sapiens
gtcaagtatctggctgagctctagggatctacaaggacttgggctcctggtcccatctgcagggtatactacaggtaaatcgatgccataatatacattgagaagaaccttctgcagcatgaaggtggttggttaccttatctaatacagcactacacgtaggctgcactgaatgactttctttgaattccttgccatacagagtcactacaatgctatatatgcacactgagatctaagacagatacccaatggactggagtcttgcctgtaccctcagactactgtttgacaccgatggataaatccagtggctgctggtagaacacactgctaaaaagcagactagctgtccacgtccataa

SEQ ID NO: 697720 - DNA, 412 bp, Homo sapiens
aattcatcatctctctcactagggttactataataaccaactaagtggtcagcatggtccagccaacctactttatccactagactatcttatggttatgttcttgtgacaaggtcttactctattacccaggctggaatgcagtggcataatcatagctcactgcagccttgacttcccaggctaagccatcctcctacctcagcctcccaagcaggtgggaccacacataggcaccaccatgcctggctaatttttgtatttatagtagagacaggaattcactatgttggccaagctggtctcgaactcctgacctcaggtgatccacccacctcagcctcccagactgctgagattacaggtgtaagccaccactcccggacaaccttcagcaacttcatctactgcc

SEQ ID NO: 697721 - DNA, 443 bp, Homo sapiens
atacaggatgcggaatataacactgtcactaagatcaaataatacaaaaaaaatcacatcatttaaatttgatgcatggcgaacaaagtggcttctttagaattattatgtacacaacttgcaaagctcaaaaagtaatagcacagagccataaatctgataaggcactttaaagatagcaatcaaacatatacaaatatcaaatacaaacactgttaaactgcaaaagcagtaaccacagaaataaatagggaaaaaatatgcattctttctaaacagtctttccctttctgaagtaaagtctttaaaaaaaaatcaaacaagtacaaaaaatatttatcatatatttttaaaacctatcatcaaagtccaaatctctgtaaaaaaagaatgtttttcttcaagtcaaaaaagttcagattcatacatttcctagaaaaaca

SEQ ID NO: 697722 - DNA, 200 bp, Homo sapiens
atgttggaaacacggcgagggaaagttggcccgaattcaaagacttggattggcggctatggttttgcctttttttttcccccagtttgtggttcaaaacgggggggcgggggaggggaaaaaaaccacccgtttccgaattgaaaaggccagggccggtttttaaaattaaggaaaaaagatggtttttttagggggga

SEQ ID NO: 697723 - DNA, 267 bp, Homo sapiens
gtatgctctagaggaccccgcctcattttattctgtgatccaccacgcccgggtgagacagacatttcttaatgttaataatggacaagaccattttggatatgcagtaaacgacgcgagtatacaagagtaacggcaccagctgcacaacatagcaagaccctgtcccccgcctccagaaaaaaaaaaaaggttaactgataaaggctaccttacttgggctagacaggaagagatctcccagggaagacccctgtaaactgagcc

SEQ ID NO: 697724 - DNA, 865 bp, Homo sapiens
  misc_feature (487)..(487): n is a, c, g, or t
agcggggtgtagcgcccttcatgacggaaggccgctgcacccgaggggctcctccaggcacccatgcgcagaatcccactcagccagtcaagtctaagagcactggcgggccatccccgtccagtcgggcatcgcatccgatgcgtgcacccatcagatctacttaccggcagccgaccatgagcttccactatccaagcaacacgcgtccgtgcagcattaccgcagtgccccgtggacatcctattcctccatcactcctctaggtcatccgcacatagggctagacccagaggttcgacttcgtgtgtgtgccaggtctattctttatttgaccggagatatgtacacagcggactacccacggtattcagtggggctccaccagagcaggtttgggcgaagttccctgttacgcatgttcatccatacgagaccacacattcacactcgtgcgtcttgccaaggccagaccttagaacactgncgtatagcttgggcacatagcgtctccagggggatcggccccacctgaagtgcaaacggcaggtcgcaggccagcgggttcaaggtcccaaggacgacggaagcacaaagcgcgccgttcgtgctccccctctgtggtgctctgaacccgttgaaaggccggtgataaccacatcctcagtaaccccctatcgggtcaattccgacgaagagtggcttggtgtaccagtccaaagagggcccacaaaacgtggcaagagagtttgcggtgtaatttgggtgtccagagaatcccgggagtggggaattattctttggaacccctaaccgagtggggccgttggggaaaggaagtaagcggtgggatgagttccccacg

SEQ ID NO: 697725 - DNA, 166 bp, Homo sapiens
gaagaaagaaattcagagctcgaccacaaagtcttcaatttgacccaatccaaccaagcacaaagagaaccacataggagaatatgaacacagcctccaaaaactctgggattatgttaaatgaccaacctaggattatttggcattgctgaggaggaggagaatt

SEQ ID NO: 697726 - DNA, 180 bp, Homo sapiens
ccttgcgcaacctgcggaaatcatcgcgtcagcgactatgtgcagacagcatgtgggttagacgcaattattatatttgcgccaggcacagcacgtcgtgctgagagcattgccgcttgttctcagtgcgatgtgtctgtgcctgggcggccaattattcttattggcgttaacggggtt

SEQ ID NO: 697727 - DNA, 265 bp, Homo sapiens
  misc_feature (156)..(156): n is a, c, g, or t
cgtgcaggcagggggaccatgtccctgcgcacacccggtccacagtgtgatcacacacatgcagacgcttggtcctggtttcccttgctgaatagaaacacaatcccaatggtaagttccacactgggacgatgggctgtgggacatgtgtgccancctgtcaccagtgagtctcgtgcgctgtgggcctgcctgtctgcggtcctggaagccctgtctgatgcgtgaggagaccctgcgaggccccgctgccatggactatcac

SEQ ID NO: 697728 - DNA, 474 bp, Homo sapiens
agaccacacgaaggagaaggggggtaagaaggaggtctctgtaccatggctcgtacaaagcagactgcccgcagggtcgccgaggggaaagcacaaagaaagcaactggctacaaaagccgctcgcaagagtgcgccctctactggaggggtgaagaaacctcatcgttacaggcctgttactgtggcgctccgtgaaattagacgttatcagaagtcactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaa

SEQ ID NO: 697729 - DNA, 120 bp, Homo sapiens
cgaaaggtaccagcacatcactatctctgtgtcctcctcctcctcctccttctatctcgttctcgttctcctattccttcttcttttcttctcattttccttcttcttcttcatcttttt

SEQ ID NO: 697730 - DNA, 138 bp, Homo sapiens
  misc_feature (19)..(19): n is a, c, g, or t
tatacttccgtgagcaggnctctcccttcatctgagataggacactcagtctataatcaggctccactgggaaagtttgaagacaggtctctgggaagtgcagaaatattttttaggtatagtttggagctgtgcttc

SEQ ID NO: 697731 - DNA, 214 bp, Homo sapiens
  misc_feature (79)..(79): n is a, c, g, or t
  misc_feature (168)..(168): n is a, c, g, or t
  misc_feature (209)..(209): n is a, c, g, or t
ctagaggatcccctcaacggcttatattctcatttcatttcccggtatgaagtataaagcgtggagaagtataaagcgntgagaaagtataaagcgtagagaagtataaagcgttgagaagtataaagcgttgacgaagtataacagcgttgacgaagtataaagcgnttgagaagtataaacgcgttgacggggtaccgacgctcganattcg

SEQ ID NO: 697732 - DNA, 329 bp, Homo sapiens
tcgagcctcggccctggtccagtcggctcatctgggtaggatttctggtaataaacagttattttttttagatggaattttgctgttgttgcccaggctggagtgcaacagcatgatcctggctcagtgcaagctccgcctcccaggttcaagcaattctcctgcctctgcctcccaagtagctgggattggcacatgccaccacacctggctaattttttgtatttttagtagagacaggctttcttgatgttggctaggctggtctagaactcctgaccttaggtgatctgcccaccttggcctcccaaagtgctgggattacaggc

SEQ ID NO: 697733 - DNA, 284 bp, Homo sapiens
cgcctcgggtgttttctaaagccacctccttctcggaattcttctcttgtgttaaggggttctccaatttgagggaccacttcactctttcttcaccccgccccacttagcccacctcgaggaggccccgcggaatgtcctaccacggaataagtttcactaagtgaccacggtggcaccttggctaaatatgaatattggctgaatattgtcacttaaatcacttttgtaccctgaacctgggttgtctataataaaactcggagccctttttgtgaaatcca

SEQ ID NO: 697734 - DNA, 103 bp, Homo sapiens
  misc_feature (55)..(55): n is a, c, g, or t
atttaccatatgagccccccaggagatcagcctggaccggtcacgccaccccacnccccagtcgaaagcctgctcaaccatctccttccacagtgcccctttt

SEQ ID NO: 697735 - DNA, 267 bp, Homo sapiens
cacacagcctgggcgacagagcgagacttcatctcaaaaaaaaaaaaaaaaaggggggaaggatttttctttcttttttgggaaaggccccgggagggcagaggttctgtataccaaaacaattttggaggcttaagggggacttaataaggttggggctaattaagggggaaaaaacaaaaaacaagggttcatcattgggaaaacatcaggttggtttggtaaagggaaaataaagtttttttaaaacacctgcaaccggggttg

SEQ ID NO: 697736 - DNA, 235 bp, Homo sapiens
gtgtgtagttgcagtagttgctgttgctcttctttcctcttttttttcttgagaccgagtcttgctctgtcgcccaggctggagtgcagtggcgcgacccggtcaccgcaacctccgcctcccgggctcaagcgattctcctgcctcagcctcctgagtagctgggattacaggtgcacaccaccacacctggctgatttatgtatttttttcgtagagacaaggtagagccgag

SEQ ID NO: 697737 - DNA, 501 bp, Homo sapiens
  misc_feature (14)..(14): n is a, c, g, or t
  misc_feature (63)..(63): n is a, c, g, or t
  misc_feature (66)..(67): n is a, c, g, or t
  misc_feature (81)..(81): n is a, c, g, or t
  misc_feature (97)..(97): n is a, c, g, or t
  misc_feature (103)..(103): n is a, c, g, or t
  misc_feature (105)..(106): n is a, c, g, or t
  misc_feature (118)..(119): n is a, c, g, or t
  misc_feature (123)..(124): n is a, c, g, or t
  misc_feature (133)..(133): n is a, c, g, or t
  misc_feature (135)..(135): n is a, c, g, or t
  misc_feature (148)..(149): n is a, c, g, or t
  misc_feature (153)..(154): n is a, c, g, or t
  misc_feature (158)..(158): n is a, c, g, or t
  misc_feature (167)..(167): n is a, c, g, or t
  misc_feature (173)..(174): n is a, c, g, or t
  misc_feature (187)..(187): n is a, c, g, or t
  misc_feature (203)..(203): n is a, c, g, or t
  misc_feature (220)..(221): n is a, c, g, or t
  misc_feature (225)..(225): n is a, c, g, or t
  misc_feature (259)..(259): n is a, c, g, or t
  misc_feature (299)..(299): n is a, c, g, or t
  misc_feature (343)..(343): n is a, c, g, or t
  misc_feature (377)..(378): n is a, c, g, or t
  misc_feature (390)..(391): n is a, c, g, or t
  misc_feature (432)..(432): n is a, c, g, or t
  misc_feature (436)..(436): n is a, c, g, or t
  misc_feature (482)..(482): n is a, c, g, or t
aagtatcttttttntttgtcaaattatactgtttccaaacattttggaaataaatagctggtnttnngtcggtcacttgcnctggttgacaagattngaacangnngtacacttttgnngttnnttttttttngngggggtttcaganngggnntggnttataaaangcaaanngggccaacgtccncaccaaattcttgatnaggaccaccaatgtcanngggngcaatatctacaataggtagtctcacagccttgngtgttcgatattcaaagactgttttgctccattccccagngtgtttcgtgcaaccatcctccagaactgtgtaggtgaatttgntatttccttcagccttgaattcaccttcatttgnncccatcagcttnngggccttctttacatttccactggcctgatccatgtatgcnatgntatttttgcagtgatatgtgatgttctgggaagctcggctggaganaagtcgaaggaatgccagc

SEQ ID NO: 697738 - DNA, 899 bp, Homo sapiens
tgctgttactggtctggaattttagggcattgcggcggctggcggtggtcgaaagcggagtgaaagagggagtgcagtggagcctgtgagagcctggaacctggagtctgcagcgtgcgtgagacccctgtgcgtgtgctgagagtggtgtgctggctgtgcccctgaactctgaccctgcgccgggggtgggccatggccggaggatcagctgacctggaccggcagatcgagcgagctgctgtcgctgacgagctcatcgactggagagcgaagtcaaggccctgtgcgctaagtgccagagagatcttggtagaggagagcaacgtgcagaggtgtggactcgcccagtcacagtgtgcggcgaacatccatggacaattctatgacctcaaagagcttgttcagagataggtggcgacgtccctgagaccaactacctcttcatgggggactttgtggaccgtggcttctatagcgtcgaaactgttcctccttgctgctggcacttaaggttcgctatcctgatcgcgtcacacatgatccggggcaaccatgagagtcgccagaatcacgcaggtctattggcttcatacgatgagtgcctgcgcaagtacgggctcggtgactgtgtggcggctacgtgcactgagatctttgactaccatcaggcctgtcaaggcatcagtcgatggcaagaatcttcctgcgttcacggggggccttctacccgcctccagtcgagaacccttgtatcagaatacggacgaatcgaagcggaaggcaagcaggtgcctcagatgatgcgcccatgatgtgaccgtacctcttggtctgacccagtaagaacaccacaggggctggggagttagacgccgaaggagccgggataactattg

SEQ ID NO: 697739 - DNA, 540 bp, Homo sapiens
  misc_feature (338)..(338): n is a, c, g, or t
ggaattgaagaaattcacagtttatgacccagtgacactgtgccttgtctcagtatcctatagtgtgtcatactctgttctgcacagaagttttgctcatcctattcctttgtttgcagaggtcccttccccatcccctatctctcaggcagactcctcatctcagtttatttacgacttcctcagggaaagccttccacacttccctgacggatgactttcccctgttgtgtgtgcccatagcaccatttacctacttcgtatacttgtgtggttattttatgtttatttgtgtgattctttgattggtgtctgtgctgccccaagatttaaaaaanctttcaattgacgacgcaacgcaaaacacacacacaacaacaacaacacccacaccacacacacccacaaacaaaccaaaccacgacacgagaacaataaaaaagaaaatcacaacacaacaacaagaaatcacagcagcccacaaccaccagcggccggcgccatcaggaccccgcacacaggcaacaacacacgagaacg

SEQ ID NO: 697740 - DNA, 116 bp, Homo sapiens
gctcggtaccttcctctcctcccacctcacagtggtttatgtgtccccctgtacatggtgccagcacctgcctccctgtactctgtcctctcccatctgtatagttatcctcttag

SEQ ID NO: 697741 - DNA, 577 bp, Homo sapiens
  misc_feature (137)..(137): n is a, c, g, or t
tatacaccataccaccgagattacgtcttcgtatcatgtctctattgatgaagacttcatttttcatcttcagccttctgacatatgtattttcagtttcttaatgtattcactttgaatgtccactgtcacctaanatgtaacatgcctaaaacataattttattttgaatttattattttaaaaaataaaccactggagaatttagacttaatggaaaagttgagaagacagcacacagagttcccatatgccttctcattttcccctattgttaatagcttactttatatagtgcaatctgtcacaactaaagaaccaacaatggtacacattttattcagattgtactaggtattttatgaggatgatggttaattttttgtgtcaacttcactgggccacacgcgtttcgccaaacattgttctgggtgggtctacggtgctgtttatggatgagattagcacttggacaggcagactagcaaagcagactgtccttcccaatgtgggtgggtcccattccatcagttgaaggtctgaatagaacaaaaaggctgaagctcccccaggactc

SEQ ID NO: 697742 - DNA, 175 bp, Homo sapiens
aatttggttctttggtatttatttagggtattttatgattcttttcatatttctactttctagttatgtgaattcattaacagagctaacttgggattatgtctatgaagctgggatctgtgcttgagaaggaaatcttctgccaatttggtgtttatatatgtagaaaaaaaaa

SEQ ID NO: 697743 - DNA, 784 bp, Homo sapiens
  misc_feature (315)..(315): n is a, c, g, or t
  misc_feature (719)..(719): n is a, c, g, or t
ccgttccgtctggcgcacctgaccacagcccctgtcccgagtcctggaccgctcgtcgtatgactgtagcggaccgccgatgttctcccggctggaccgatactccgctgccgggcgcccgccagaccctgctggcaagaatgcctgagctaccttccttggatcaatgagagcatttctaacgccttccaagaatgccaaactacagtcgaactggacacacatacagtgattatttccccggtatcgtctatgtagagttactccattgcctgtcgataccatcaaccatgagatcctcagctcaggagcagngcagacccatcactgtgtggactacctggtgctccattccacgccctagctatgccaatggcctctctcctctttccggatactcctcatctttggggcgagtgagtccccctcctccatctgacacctcctccaaggaccacagtggctcagaaagccccattagtgatgaagaggaaagactacagtccaagctttcagacccccatgccattgaagctgaacagtttcagtgcaatttatgccatatgacctattcaactttttctgggctggccaaacattagcagctgcactgcgatgcccagtctagaaaatctttcagctgtaaatactgtgacaaggaatatgtgagcctgggcgccctgaagatgcatattcggacccacacattaccttgtgtntgcaacgatctgcggcaaggcgttttccagaccctggttgcttcacggacacattagaactcaca

SEQ ID NO: 697744 - DNA, 976 bp, Homo sapiens
ggacctggttcggactggctggagcgcgggtgagagtctcgttccaagtttggatgagagagagaagagcgcctcagagcctcgtgtacccgcgagcggcgaggaggcggaaagaagtgacgcggcgtctgggagagcgaccaggcagacaagactgggtccgggcttccgacaggggggagtctgtgactgctgctctggtgacaggcagtgagctgccagaggtccgttgctgctcttgcgtcgtaacagagcaggagtccgaggcgggttgacagagtcgcgcgaagcgaccccgacgcgtatgatggcgagtacagagatgttgagggatacatgtggagggagcgtgtcaatcattgaagaatatacaaagtcgtgcaagaatgaattacactcctggtgtctactcttcatccctcggtgagattgatccggtgccttgtttcacgagtggggcccaagtctggaccttgtgcacgtcgggatatcccgtggatgttgacttatagcggcttgaattggaacatgattaagttgccctttcgcacggctttatgttagcatggggggacctcaatagccggtctgattagaaggcacgtatacctccattcgtggggttcggactgtcttccgaaagggaaggagttatgcgcccgaacttgcacttattgtccagcggagctcttggggttgcctctcgcgccaattatgtgtgaccaggtgcacaacagggggttgagcatttgccgctggcctctaatggatttccttgtaaacccagtggcttgctagttcgcccttgttgggcacttttaccacactggaaatacagtggagcgcgtagaaaggtgaacgccggtgggggcgcttgcaaatgcacgatctattcgtgcacactgtatccgggtagctatgtcgcgtccatccttgctgatgttgttgggtcccctgtactgtccaaaaatacaca

SEQ ID NO: 697745 - DNA, 333 bp, Homo sapiens
  misc_feature (7)..(7): n is a, c, g, or t
aaactanatcaaattacatataggaaccaaacaaaaagcccatatcgcccagacattcctaagcaacaagaataaaggtggaggcatcatgctacctaacttcaaactatactcacaaggctacagtaaccaaacagcatattaccggtaccaaaacagatgtatagtccaatggaactgaacagaggcctcagaaatactaccacacatctacaaacatctgatctttatcaaacctgacaaatacaagctatggggaaaggagtccctatataatcaatggtgttaggtctacctggccaggtagacctaacccaggtagaagtagaggtt

SEQ ID NO: 697746 - DNA, 684 bp, Homo sapiens
ctgggcgtgaggacagtgtacccatgggcagtggctgggttcagtgttctcacgctcagaggaagaaaatggcatgtggctgggttcagtgttctcactgctcagagtgaatgaaaaggcagtggtgaacacccgcctgactgccttacccatgatctaaacgacaccatcatcctcccccaaggaagacacatgccctgtgatgtgaacctaggatgggtgggaatggcttatgtcactcggtcattatgaggcagagcttgggcttggggttgcaggggcatcagccaatctgctctcaaggagacaaaaacttgggcgtaaaatggatacgggcagctggggctatgccaggcatgtctggaggtctggagatgacctggcagcacggatgcttctcccccgaacaacaccgaacacacactccttgacacttccaggtgatttatctacataactaagactgaacatccaagcagccattaatcaaggggaacaaaagattgggaaaacacaaagagagaagcacggccagcacagcgagcatgcatgaagcaaatccaacgcagaaggactggaaggacgggaacgaagcacgggcacaacagctgagcacccaacggaacacggcggagatgtcacatgtggcctgccaaggcccccaacacccaggccccatggggc

SEQ ID NO: 697747 - DNA, 210 bp, Homo sapiens
gttaggtaagctatattagggtgctagtccttccacgagacacatcaacaagttcatagggggtcgcctgtaaatagggtcctagtgactatgcctcttatttaggaggtcagtcttcgaatattattggaacaatgtacggtattcaggcctactccagaatcacatttattactatgtaccctatcctatttctagagtagactctat

SEQ ID NO: 697748 - DNA, 227 bp, Homo sapiens
tcggagaggccaaggtgcacttccttcggtcgtcccgaatccgggttaatccgaaacagccgcctcaccatgccgccgaggttcgaccccaccgagatcaaagtcggtatacctaggtgcaccgaggtaggtcggtgccacttctgccctggcccccagatcggccccctgggtctgtctccaaaaaagttgtgatgacattccaggcacgggtgactggagggcct

SEQ ID NO: 697749 - DNA, 146 bp, Homo sapiens
  misc_feature (87)..(88): n is a, c, g, or t
aaaaaggagaaaaaccggaagcgtaggaaccgaaagaagaagaaaaagccccagcggttccgaaggggtgtcctcttagagctcttnnggaccgggagaaagactcaacccgtttcccgtggctctgattccccagcagctgatgt

SEQ ID NO: 697750 - DNA, 337 bp, Homo sapiens
ctgatcctcatcaccctaaatttattatgcattaggaagctaacctaaaaacatagcatagtaaaagattgttatctctgtcatagcagaacaggtttcaaaatatattttcttttaaatgtattcagtcagtacacaatcctttataaaagttgtatatatttttttctgtcatataccttcattacattttataaattacaagaatttacacagtcaccccattcaagaaaaaaaaaaatttaaaaccctttcacaaattatctacattttttttcataccttttaaaacttttcaaagggggtgctcgtgtaaagaggtgggcccttagtttaa

SEQ ID NO: 697751 - DNA, 393 bp, Homo sapiens
ctgcgcggctcgagaagtgtctgaagcctgaaagaaaatttttttaataggaccaaagcatctaccatatttcaggaatggttaaggatgtaaaaaaaaaaaccccaaacggcctttggaggaaaacatgaaaccccagcccggggggattaattgggggatttatttcccagatgttccaggccccaacactaaagtctttggggggtttggcaggccacactaaagatgtggttaggggatgtccactgcacccacatcctttaaaaaaaaacgtagaaaaaggtctcagggctgagagttaatgttcctgagccttaagggtagaacccacagttttgggggctggtttcctttaggacaatcatttggggattttaaagcgtttttaaa

SEQ ID NO: 697752 - DNA, 2009 bp, Homo sapiens
ggcggccccagtcagacgcaggcagccccaaagcctgaacaggcagggccagacccagcttcttcgcctccgccagcggggaccccgagctagagccgcagcgggacctgcccggcccccggcgcccggcggccgccgccgcgatgtttccccgcgagaagacgtggaacatctcgttcgcgggctgcggcttcctcggcgtctactacgtcggcgtggcctcctgcctccgcgagcacgcgcccttcctggtggccaacgccacgcacatctacggcgcctcggccggggcgctcacggccacggcgctggtcaccggggtctgcctgggtgaggctggtgccaagttcattgaggtatctaaagaggcccggaagcggttcctgggccccctgcacccctccttcaacctggtaaagatcatccgcagtttcctgctgaaggtcctgcctgctgatagccatgagcatgccagtgggcgcctgggcatctccctgacccgcgtgtcagacggcgagaatgtcattatatcccacttcaactccaaggacgagctcatccaggccaatgtctgcagcggtttcatccccgtgtactgtgggctcatccctccctccctccagggggtgcgctacgtggatggtggcatttcagacaacctgccactctatgagcttaagaacaccatcacagtgtcccccttctcgggcgagagtgacatctgtccgcaggacagctccaccaacatccacgagctgcgggtcaccaacaccagcatccagttcaacctgcgcaacctctaccgcctctccaaggccctcttcccgccggagcccctggtgctgcgagagatgtgcaagcagggataccgggatggcctgcgctttctgcagcggaacggcctcctgaaccggcccaaccccttgctggcgttgccccccgcccgcccccacggcccagaggacaaggaccaggcagtggagagcgcccaagcggaggattactcgcagctgcccggagaagatcacatcctggagcacctgcccgcccggctcaatgaggccctgctggaggcctgcgtggagcccacggacctgctgaccaccctctccaacatgctgcctgtgcgtctggccacggccatgatggtgccctacacgctgccgctggagagcgctctgtccttcaccatccgcttgctggagtggctgcccgacgttcccgaggacatccggtggatgaaggagcagacgggcagcatctgccagtacctggtgatgcgcgccaagaggaagctgggcaggcacctgccctccaggctgccggagcaggtggagctgcgccgcgtccagtcgctgccgtccgtgccgctgtcctgcgccgcctacagagaggcactgcccggctggatgcgcaacaacctctcgctgggggacgcgctggccaagtgggaggagtgccagcgccagctgctgctcggcctcttctgcaccaacgtggccttcccgcccgaagctctgcgcatgcgcgcacccgccgacccggctcccgcccccgcggacccagcatccccgcagcaccagccggccgggcctgcccccttgctgagcacccctgctcccgaggcccggcccgtgatcggggccctggggctgtgagaccccgaccctctcgaggaaccctgcctgagacgcctccattaccactgcgcagtgagatgaggggactcacagttgccaagaggggtctttgccgtgggccccctcgccagccactcaccagctgcactgagaggggaggtttccacacccctcccctgggccgctgaggccccgcgcacctgtgccttaatcttccctcccctgtgctgcccgagcacctcccccgcccctttactcctgggaactttgcagctgcccttccctccccgtttttcatggcctgctgaaatatgtgtgtgaagaattatttattttcgccaaagcacatgtaataaatgctgcagccca

SEQ ID NO: 697753 - DNA, 2069 bp, Homo sapiens
ggcggccccagtcagacgcaggcagccccaaagcctgaacaggcagggccagacccagcttcttcgcctccgccagcggggaccccgagctagagccgcagcgggacctgcccggcccccggctccagcgagcgagcggcgagcaggcggctcacagaggcctggccgcccacggaacccggggcccggcggccgccgccgcgatgtttccccgcgagaagacgtggaacatctcgttcgcgggctgcggcttcctcggcgtctactacgtcggcgtggcctcctgcctccgcgagcacgcgcccttcctggtggccaacgccacgcacatctacggcgcctcggccggggcgctcacggccacggcgctggtcaccggggtctgcctgggtgaggctggtgccaagttcattgaggtatctaaagaggcccggaagcggttcctgggccccctgcacccctccttcaacctggtaaagatcatccgcagtttcctgctgaaggtcctgcctgctgatagccatgagcatgccagtgggcgcctgggcatctccctgacccgcgtgtcagacggcgagaatgtcattatatcccacttcaactccaaggacgagctcatccaggccaatgtctgcagcggtttcatccccgtgtactgtgggctcatccctccctccctccagggggtgcgctacgtggatggtggcatttcagacaacctgccactctatgagcttaagaacaccatcacagtgtcccccttctcgggcgagagtgacatctgtccgcaggacagctccaccaacatccacgagctgcgggtcaccaacaccagcatccagttcaacctgcgcaacctctaccgcctctccaaggccctcttcccgccggagcccctggtgctgcgagagatgtgcaagcagggataccgggatggcctgcgctttctgcagcggaacggcctcctgaaccggcccaaccccttgctggcgttgccccccgcccgcccccacggcccagaggacaaggaccaggcagtggagagcgcccaagcggaggattactcgcagctgcccggagaagatcacatcctggagcacctgcccgcccggctcaatgaggccctgctggaggcctgcgtggagcccacggacctgctgaccaccctctccaacatgctgcctgtgcgtctggccacggccatgatggtgccctacacgctgccgctggagagcgctctgtccttcaccatccgcttgctggagtggctgcccgacgttcccgaggacatccggtggatgaaggagcagacgggcagcatctgccagtacctggtgatgcgcgccaagaggaagctgggcaggcacctgccctccaggctgccggagcaggtggagctgcgccgcgtccagtcgctgccgtccgtgccgctgtcctgcgccgcctacagagaggcactgcccggctggatgcgcaacaacctctcgctgggggacgcgctggccaagtgggaggagtgccagcgccagctgctgctcggcctcttctgcaccaacgtggccttcccgcccgaagctctgcgcatgcgcgcacccgccgacccggctcccgcccccgcggacccagcatccccgcagcaccagccggccgggcctgcccccttgctgagcacccctgctcccgaggcccggcccgtgatcggggccctggggctgtgagaccccgaccctctcgaggaaccctgcctgagacgcctccattaccactgcgcagtgagatgaggggactcacagttgccaagaggggtctttgccgtgggccccctcgccagccactcaccagctgcactgagaggggaggtttccacacccctcccctgggccgctgaggccccgcgcacctgtgccttaatcttccctcccctgtgctgcccgagcacctcccccgcccctttactcctgggaactttgcagctgcccttccctccccgtttttcatggcctgctgaaatatgtgtgtgaagaattatttattttcgccaaagcacatgtaataaatgctgcagccca

SEQ ID NO: 697754 - DNA, 2367 bp, Homo sapiens
ggcggccccagtcagacgcaggcagccccaaagcctgaacaggcagggccagacccagcttcttcgcctccgccagcggggaccccgagctagagccgcagcgggacctgcccggcccccggcgcccggcggccgccgccgcgatgtttccccgcgagaagacgtggaacatctcgttcgcgggctgcggcttcctcggcgtctactacgtcggcgtggcctcctgcctccgcgagcacgcgcccttcctggtggccaacgccacgcacatctacggcgcctcggccggggcgctcacggccacggcgctggtcaccggggtctgcctgggtgaggctggtgccaagttcattgaggtatctaaagaggcccggaagcggttcctgggccccctgcacccctccttcaacctggtaaagatcatccgcagtttcctgctgaaggtcctgcctgctgatagccatgagcatgccagtgggcgcctgggcatctccctgacccgcgtgtcagacggcgagaatgtcattatatcccacttcaactccaaggacgagctcatccaggccaatgtctgcagcggtttcatccccgtgtactgtgggctcatccctccctccctccagggggtgcgctacgtggatggtggcatttcagacaacctgccactctatgagcttaagaacaccatcacagtgtcccccttctcgggcgagagtgacatctgtccgcaggacagctccaccaacatccacgagctgcgggtcaccaacaccagcatccagttcaacctgcgcaacctctaccgcctctccaaggccctcttcccgccggagcccctggtgctgcgagagatgtgcaagcagggataccgggatggcctgcgctttctgcagcggaacggcctcctgaaccggcccaaccccttgctggcgttgccccccgcccgcccccacggcccagaggacaaggaccaggcagtggagagcgcccaagcggaggattactcgcagctgcccggagaagatcacatcctggagcacctgcccgcccggctcaatgaggccctgctggaggcctgcgtggagcccacggacctgctgaccaccctctccaacatgctgcctgtgcgtctggccacggccatgatggtgccctacacgctgccgctggagagcgctctgtccttcaccatccgcttgctggagtggctgcccgacgttcccgaggacatccggtggatgaaggagcagacgggcagcatctgccagtacctggtgatgcgcgccaagaggaagctgggcaggcacctgccctccaggctgccggagcaggtggagctgcgccgcgtccagtcgctgccgtccgtgccgctgtcctgcgccgcctacagagaggcactgcccggctggatgcgcaacaacctctcgctgggggacgcgctggccaagtgggaggagtgccagcgccagctgctgctcggcctcttctgcaccaacgtggccttcccgcccgaagctctgcgcatgcgcgcacccgccgacccggctcccgcccccgcggacccagcatccccgcagcaccagccggccgggcctgcccccttgctgagcacccctgctcccgaggcccggcccgtgatcggggccctggggctgtgagaccccgaccctctcgaggaaccctgcctgagacgcctccattaccactgcgcagtgagatgaggggactcacagttgccaagaggggtctttgccgtgggccccctcgccagccactcaccagctgcactgagaggggaggtttccacacccctcccctgggccgctgaggccccgcgcacctgtgccttaatcttccctcccctgtgctgcccgagcacctcccccgcccctttactcctgggaactttgcagctgcccttccctccccgtttttcatggcctgctgaaatatgtgtgtgaagaattatttattttcgccaaagcacatgtaataaatgctgcagcccagcctctgcccactttgtgtgtatgtgaccgcctgcttacttgcagtgagagcctggtggccagggtctggccctaccttggctgaccagcctctccacagctgcaggccaggtctcccagcgtcgcactcctgggcctggcatttggaacctgccaggctggcctgggaacacccccctacaggcacatatgaacgtactgcattcctgccgacccccctgtctaggatgcatccacaccccccccaattttgcccagcagcctcctggctgacccttggccacagccttctgagggccaatggaaatatttgggaccaagattcttggtaaataaaaacgaaaatgtttgcaaaagg

SEQ ID NO: 697755 - DNA, 825 bp, Homo sapiens
  misc_feature (324)..(324): n is a, c, g, or t
  misc_feature (378)..(378): n is a, c, g, or t
  misc_feature (394)..(394): n is a, c, g, or t
  misc_feature (468)..(468): n is a, c, g, or t
tcccgagtttttcttttaggttctttgccgcaacattcttttcctatgaggtttcccaaaccctcggttatacacagtggtgaggtcccaccaaagcaaaaagaaatttttttgcccacttgaaaaaatggccacgtcggaatttttagatatgttacgcacccacgccccatccgcaatgcccgtgttaagagggcccaataaatgaccttttctctgaggttctaaaatgtttaatcatgtctatttgaagcgacccaaaatcggcccttgaaccctggcttagcgaaaaaatttcttaagtataaacttccacatggaccntggttgttcggcggtccaataagcaaatgtggtccgaagagtttctattgcgtnacacatgtcttctcangaatgatgtgccaatgcatgttaatgaagaatgtatcaagtctctcacctgaaagccatgcgaatatagtatanactctcgcaatacatggttattgtccagaacagtataactcttccacttttctaaaagcttcgaagacatggattagtgcttgtatctactgacaattaagtagtcagatatggctcgttagtcccttgagggatcctacacatgtggaatgccacattaatagaggcgttctgaagagcaagaatatgtctctctttctctgatcatgtacaaaggctgtgttgctcttcataagatattattgcgctatgacatgttaccaccgtggcactatgtctcggccatatgtttatgcattgaaaataaatttttcccgattaaatatgttaatgcttacataaattattaaaaattat

SEQ ID NO: 697756 - DNA, 2327 bp, Homo sapiens
  misc_feature (2013)..(2013): n is a, c, g, or t
ggcggccccagtcagacgcaggcagccccaaagcctgaacaggcagggccagacccagcttcttcgcctccgccagcggggaccccgagctagagccgcagcgggacctgcccggcccccggcgcccggcggccgccgccgcgatgtttccccgcgagaagacgtggaacatctcgttcgcgggctgcggcttcctcggcgtctactacgtcggcgtggcctcctgcctccgcgagcacgcgcccttcctggtggccaacgccacgcacatctacggcgcctcggccggggcgctcacggccacggcgctggtcaccggggtctgcctgggtgaggctggtgccaagttcattgaggtatctaaagaggcccggaagcggttcctgggccccctgcacccctccttcaacctggtaaagatcatccgcagtttcctgctgaaggtcctgcctgctgatagccatgagcatgccagtgggcgcctgggcatctccctgacccgcgtgtcagacggcgagaatgtcattatatcccacttcaactccaaggacgagctcatccaggccaatgtctgcagcggtttcatccccgtgtactgtgggctcatccctccctccctccagggggtgcgctacgtggatggtggcatttcagacaacctgccactctatgagcttaagaacaccatcacagtgtcccccttctcgggcgagagtgacatctgtccgcaggacagctccaccaacatccacgagctgcgggtcaccaacaccagcatccagttcaacctgcgcaacctctaccgcctctccaaggccctcttcccgccggagcccctggtgctgcgagagatgtgcaagcagggataccgggatggcctgcgctttctgcagcggaacggcctcctgaaccggcccaaccccttgctggcgttgccccccgcccgcccccacggcccagaggacaaggaccaggcagtggagagcgcccaagcggaggattactcgcagctgcccggagaagatcacatcctggagcacctgcccgcccggctcaatgaggccctgctggaggcctgcgtggagcccacggacctgctgaccaccctctccaacatgctgcctgtgcgtctggccacggccatgatggtgccctacacgctgccgctggagagcgctctgtccttcaccatccgcttgctggagtggctgcccgacgttcccgaggacatccggtggatgaaggagcagacgggcagcatctgccagtacctggtgatgcgcgccaagaggaagctgggcaggcacctgccctccaggctgccggagcaggtggagctgcgccgcgtccagtcgctgccgtccgtgccgctgtcctgcgccgcctacagagaggcactgcccggctggatgcgcaacaacctctcgctgggggacgcgctggccaagtgggaggagtgccagcgccagctgctgctcggcctcttctgcaccaacgtggccttcccgcccgaagctctgcgcatgcgcgcacccgccgacccggctcccgcccccgcggacccagcatccccgcagcaccagccggccgggcctgcccccttgctgagcacccctgctcccgaggcccggcccgtgatcggggccctggggctgtgagaccccgaccctctcgaggaaccctgcctgagacgcctccattaccactgcgcagtgagatgaggggactcacagttgccaagaggggtctttgccgtgggccccctcgccagccactcaccagctgcactgagaggggaggtttccacacccctcccctgggccgctgaggccccgcgcacctgtgccttaatcttccctcccctgtgctgcccgagcacctcccccgcccctttactcctgggaactttgcagctgcccttccctccccgtttttcatggcctgctgaaatatgtgtgtgaagaattatttattttcgccaaagcacatgtaataaatgctgcagcccaaaanaataaaaaaaataaatttaaaaaaaaaatatatctcaacgggatctgtaagctttttatatatttctaatccactgtaacagtaagacatcagaaccagctgttattctcaaataaatcgaagaataatcccaacactgaggatgcttctttacactaaagtcacaacatatgctttttgatcatttgctacaaagattggcgataccctcctttaaacattgtgaaagtatgcccaacaaagttaccgcggataatgtcaaacacaagtgagcttcttcttccaaagtaatccaaatagatctgagacttttt

SEQ ID NO: 697757 - DNA, 3679 bp, Homo sapiens
  misc_feature (799)..(799): n is a, c, g, or t
  misc_feature (1186)..(1186): n is a, c, g, or t
  misc_feature (1738)..(1738): n is a, c, g, or t
  misc_feature (1784)..(1784): n is a, c, g, or t
ggcggccccagtcagacgcaggcagccccaaagcctgaacaggcagggccagacccagcttcttcgcctccgccagcggggaccccgagctagagccgcagcgggacctgcccggcccccggctccagcgagcgagcggcgagcaggcggctcacagaggcctggccgcccacggaacccggggcccggcggccgccgccgcgatgtttccccgcgagaagacgtggaacatctcgttcgcgggctgcggcttcctcggcgtctactacgtcggcgtggcctcctgcctccgcgagcacgcgcccttcctggtggccaacgccacgcacatctacggcgcctcggccggggcgctcacggccacggcgctggtcaccggggtctgcctgggtgagcggggccgggggcggcaggcggggggctggcgggaaggccgtgcggggccgggggatggtctccgtgagcggaggggccccgcggcgagtcggtgggtaccgtggggagggttccggtccgcgcctggggaacccggcgaggatccaatccgggtcgctggcctgggggcggggcctggtttgttttgctccgagggtgcccggggcccgcctgtcgggcgcaaaggtttgggggcgggcaggtgcagcaaaagctgcttaattggacagaaaaagtaactcgtgggcgggaccgtgagaatccgaggagggacctaagtcaccccgtggccctggatattacaaccggtgccagcggtcggtcacagtgtcctgggcttcgcagttgcaggctgctatcaggnggcctggcatggggtagcctcttgagaggcgtctgggaaccgtgacctggtccttcccaagggcccggaggaggagccccgctgaggtcagggctgggcgcgaaggggctctcctgccctctccttgcacacggtgccctgtggcctggctccccgctgcggcccaccgcgtttgcacacttcatgggtgagggtgcttctgggctctggtgcctgggtcaggagtggatgggtctctgtgtgctgggctggcctcggctcgcaccatcggctgccatgagggagtgatgtttacagcacacgacttcaggagcctgtgaggacacccaagatgacaggggcactctgctcagcaggagcctgtccggggctcacccctgccctctncctctcatggaggccttcagacaagcgcctcagtcggccccctggcttcaagatacatcaaggtccctgctacccgagccaaggacacctctcccacagtgcttccccaccctgctcccaacaagactccttctcacgggtggtcttgcacagctggagcccatagtgcagcaggtgctggctgaagagcccctggctccacactgccccactcctgaccagggtgatgcactggaggagggcttggacctcagctcctccctcagtgctcccgaccacttccaggactatccccaagctggccagcactcctgcgccccaagaggagtgtttggggtgcttcctcttggctgcagtgggacacaggtgtgccttcctaggaactgggccctgactacttccagcccaacactcccgggcctgtgaactgtgacctgtgtgccgggatgggttttgtgggtctgccccatccccgcactgctggatctggccaagtgggtgaaggctaaggccggtcagagttgagtttctgccttgtcccctctcctgggntagatgccacaccaggcccagtgactcatagggcaggcagttggantcaggcagagggcaggtcctggtctcagctggccagcctctgctgtctgccatcccaggggaggtggccaaagtcccaactgtgagccaggccccacattcactgggcctcctccagggtctgtatgccatggaaccctggacatggggctatgaaggaaggtgggtgttgctaagcccaggagcatgggcccctaaccttggccctgtgccccaggtgaggctggtgccaagttcattgaggtatctaaagaggcccggaagcggttcctgggccccctgcacccctccttcaacctggtaaagatcatccgcagtttcctgctgaaggtcctgcctgctgatagccatgagcatgccagtgggcgcctgggcatctccctgacccgcgtgtcagacggcgagaatgtcattatatcccacttcaactccaaggacgagctcatccaggccaatgtctgcagcggtttcatccccgtgtactgtgggctcatccctccctccctccagggggtgcgctacgtggatggtggcatttcagacaacctgccactctatgagcttaagaacaccatcacagtgtcccccttctcgggcgagagtgacatctgtccgcaggacagctccaccaacatccacgagctgcgggtcaccaacaccagcatccagttcaacctgcgcaacctctaccgcctctccaaggccctcttcccgccggagcccctggtgctgcgagagatgtgcaagcagggataccgggatggcctgcgctttctgcagcggaacggcctcctgaaccggcccaaccccttgctggcgttgccccccgcccgcccccacggcccagaggacaaggaccaggcagtggagagcgcccaagcggaggattactcgcagctgcccggagaagatcacatcctggagcacctgcccgcccggctcaatgaggccctgctggaggcctgcgtggagcccacggacctgctgaccaccctctccaacatgctgcctgtgcgtctggccacggccatgatggtgccctacacgctgccgctggagagcgctctgtccttcaccatccgcttgctggagtggctgcccgacgttcccgaggacatccggtggatgaaggagcagacgggcagcatctgccagtacctggtgatgcgcgccaagaggaagctgggcaggcacctgccctccaggctgccggagcaggtggagctgcgccgcgtccagtcgctgccgtccgtgccgctgtcctgcgccgcctacagagaggcactgcccggctggatgcgcaacaacctctcgctgggggacgcgctggccaagtgggaggagtgccagcgccagctgctgctcggcctcttctgcaccaacgtggccttcccgcccgaagctctgcgcatgcgcgcacccgccgacccggctcccgcccccgcggacccagcatccccgcagcaccagccggccgggcctgcccccttgctgagcacccctgctcccgaggcccggcccgtgatcggggccctggggctgtgagaccccgaccctctcgaggaaccctgcctgagacgcctccattaccactgcgcagtgagatgaggggactcacagttgccaagaggggtctttgccgtgggccccctcgccagccactcaccagctgcactgagaggggaggtttccacacccctcccctgggccgctgaggccccgcgcacctgtgccttaatcttccctcccctgtgctgcccgagcacctcccccgcccctttactcctgggaactttgcagctgcccttccctccccgtttttcatggcctgctgaaatatgtgtgtgaagaattatttattttcgccaaagcacatgtaataaatgctgcagccca

SEQ ID NO: 697758 - DNA, 2211 bp, Homo sapiens
ggcggccccagtcagacgcaggcagccccaaagcctgaacaggcagggccagacccagcttcttcgcctccgccagcggggaccccgagctagagccgcagcgggacctgcccggcccccggctccagcgagcgagcggcgagcaggcggctcacagaggcctggccgcccacggaacccggggcccggcggccgccgccgcgatgtttccccgcgagaagacgtggaacatctcgttcgcgggctgcggcttcctcggcgtctactacgtcggcgtggcctcctgcctccgcgagcacgcgcccttcctggtggccaacgccacgcacatctacggcgcctcggccggggcgctcacggccacggcgctggtcaccggggtctgcctgggtgaggctggtgccaagttcattgaggtatctaaagaggcccggaagcggttcctgggccccctgcacccctccttcaacctggtaaagatcatccgcagtttcctgctgaaggtcctgcctgctgatagccatgagcatgccagtgggcgcctgggcatctccctgacccgcgtgtcagacggcgagaatgtcattatatcccacttcaactccaaggacgagctcatccaggccaatgtctgcagcggtttcatccccgtgtactgtgggctcatccctccctccctccagggggtgcgctacgtggatggtggcatttcagacaacctgccactctatgagcttaagaacaccatcacagtgtcccccttctcgggcgagagtgacatctgtccgcaggacagctccaccaacatccacgagctgcgggtcaccaacaccagcatccagttcaacctgcgcaacctctaccgcctctccaaggccctcttcccgccggagcccctggtgctgcgagagatgtgcaagcagggataccgggatggcctgcgctttctgcagcggaacggcctcctgaaccggcccaaccccttgctggcgttgccccccgcccgcccccacggcccagaggacaaggaccaggcagtggagagcgcccaagcggaggattactcgcagctgcccggagaagatcacatcctggagcacctgcccgcccggctcaatgagggtgcgcacctgggggacgggaggggaggaggggaggcaggagggaaagagagagaggagaggacggtgagcaggggagggaagccgagcgggtcctgggccccgctgcctccactggccgccgacctcccgcccacccgcagccctgctggaggcctgcgtggagcccacggacctgctgaccaccctctccaacatgctgcctgtgcgtctggccacggccatgatggtgccctacacgctgccgctggagagcgctctgtccttcaccatccgcttgctggagtggctgcccgacgttcccgaggacatccggtggatgaaggagcagacgggcagcatctgccagtacctggtgatgcgcgccaagaggaagctgggcaggcacctgccctccaggctgccggagcaggtggagctgcgccgcgtccagtcgctgccgtccgtgccgctgtcctgcgccgcctacagagaggcactgcccggctggatgcgcaacaacctctcgctgggggacgcgctggccaagtgggaggagtgccagcgccagctgctgctcggcctcttctgcaccaacgtggccttcccgcccgaagctctgcgcatgcgcgcacccgccgacccggctcccgcccccgcggacccagcatccccgcagcaccagccggccgggcctgcccccttgctgagcacccctgctcccgaggcccggcccgtgatcggggccctggggctgtgagaccccgaccctctcgaggaaccctgcctgagacgcctccattaccactgcgcagtgagatgaggggactcacagttgccaagaggggtctttgccgtgggccccctcgccagccactcaccagctgcactgagaggggaggtttccacacccctcccctgggccgctgaggccccgcgcacctgtgccttaatcttccctcccctgtgctgcccgagcacctcccccgcccctttactcctgggaactttgcagctgcccttccctccccgtttttcatggcctgctgaaatatgtgtgtgaagaattatttattttcgccaaagcacatgtaataaatgctgcagccca

SEQ ID NO: 697759 - DNA, 711 bp, Homo sapiens
gccaagagatacatgaaatctacatatgaacaggtggacctgatgggtaaaaagagactcagaaaacggcaataactgtggagcatctggctattaagtgccactggactcagagggcagcagatattggggatgtcatccgagtatatagtggtcatcaaggacgcactatcatcttttgtgaaaccagagaaagatagcccaggagctgtcccagaattcagctcataaagcaggatgctcagtccttgcatggagacattccacagaagcgaaagggaaatcaccctgaaaggtcttagaaatggtagtgttggatgttgtgggtggataaacaatgttcgtcgtgcacagtgggttagacatccctgaggttgattggaggttatacacagagctctccatcgaaaggatgtaaagtcattacattcatcgatccgggcggacaggcagagctggaaggacgggggtgtgcatctgcgttttatcagcacaaggaagaatatcaagttacgtacaagtggagcacaaacagcgcggaattaagttcgaaccgagataaggtgtacctctctggcaggaggaatatacctaagcgcttccagacgggagatggcatcaggctttgggcattccgagcctcccagtggcatgagtcacttgaaacgaatcagcatgataagctgatagaggagaaggggggctgcggaa

SEQ ID NO: 697760 - DNA, 2443 bp, Homo sapiens
  misc_feature (813)..(813): n is a, c, g, or t
  misc_feature (847)..(847): n is a, c, g, or t
  misc_feature (855)..(855): n is a, c, g, or t
ggcggccccagtcagacgcaggcagccccaaagcctgaacaggcagggccagacccagcttcttcgcctccgccagcggggaccccgagctagagccgcagcgggacctgcccggcccccggctccagcgagcgagcggcgagcaggcggctcacagaggcctggccgcccacggaacccggggcccggcggccgccgccgcgatgtttccccgcgagaagacgtggaacatctcgttcgcgggctgcggcttcctcggcgtctactacgtcggcgtggcctcctgcctccgcgagcacgcgcccttcctggtggccaacgccacgcacatctacggcgcctcggccggggcgctcacggccacggcgctggtcaccggggtctgcctgggtgaggctggtgccaagttcattgaggtatctaaagaggcccggaagcggttcctgggccccctgcacccctccttcaacctggtaaagatcatccgcagtttcctgctgaaggtcctgcctgctgatagccatgagcatgccagtgggcgcctgggcatctccctgacccgcgtgtcagacggcgagaatgtcattatatcccacttcaactccaaggacgagctcatccaggccaatgtctgcagcggtttcatccccgtgtactgtgggctcatccctccctccctccagggggtggtgagtattcctagccctggacaccttctatggggtgggccgtgggatgagggacagaggaggaggccgcctagagccatccttcaggcccttgctctgccaccgcctgttacccacttccccntgtgttactcaaaaacagctgtggcaacgcacgnttcctggncccccattcccttcctccgtccctgccttcccccgtctaccatctgctcagtgcccaggctggcccacagccagtgcccagtgggtaaaacgctcaaatgaggtagccactgaatggggcccttggtggccgggtggggtggctggggtgggtggccagtgcagccacaggccctcacatacggtcctgtctgtgtgtcccgtggaagcgctacgtggatggtggcatttcagacaacctgccactctatgagcttaagaacaccatcacagtgtcccccttctcgggcgagagtgacatctgtccgcaggacagctccaccaacatccacgagctgcgggtcaccaacaccagcatccagttcaacctgcgcaacctctaccgcctctccaaggccctcttcccgccggagcccctggtgctgcgagagatgtgcaagcagggataccgggatggcctgcgctttctgcagcggaacggcctcctgaaccggcccaaccccttgctggcgttgccccccgcccgcccccacggcccagaggacaaggaccaggcagtggagagcgcccaagcggaggattactcgcagctgcccggagaagatcacatcctggagcacctgcccgcccggctcaatgaggccctgctggaggcctgcgtggagcccacggacctgctgaccaccctctccaacatgctgcctgtgcgtctggccacggccatgatggtgccctacacgctgccgctggagagcgctctgtccttcaccatccgcttgctggagtggctgcccgacgttcccgaggacatccggtggatgaaggagcagacgggcagcatctgccagtacctggtgatgcgcgccaagaggaagctgggcaggcacctgccctccaggctgccggagcaggtggagctgcgccgcgtccagtcgctgccgtccgtgccgctgtcctgcgccgcctacagagaggcactgcccggctggatgcgcaacaacctctcgctgggggacgcgctggccaagtgggaggagtgccagcgccagctgctgctcggcctcttctgcaccaacgtggccttcccgcccgaagctctgcgcatgcgcgcacccgccgacccggctcccgcccccgcggacccagcatccccgcagcaccagccggccgggcctgcccccttgctgagcacccctgctcccgaggcccggcccgtgatcggggccctggggctgtgagaccccgaccctctcgaggaaccctgcctgagacgcctccattaccactgcgcagtgagatgaggggactcacagttgccaagaggggtctttgccgtgggccccctcgccagccactcaccagctgcactgagaggggaggtttccacacccctcccctgggccgctgaggccccgcgcacctgtgccttaatcttccctcccctgtgctgcccgagcacctcccccgcccctttactcctgggaactttgcagctgcccttccctccccgtttttcatggcctgctgaaatatgtgtgtgaagaattatttattttcgccaaagcacatgtaataaatgctgcagccca

SEQ ID NO: 697761 - DNA, 2031 bp, Homo sapiens
  misc_feature (1717)..(1717): n is a, c, g, or t
ggcggccccagtcagacgcaggcagccccaaagcctgaacaggcagggccagacccagcttcttcgcctccgccagcggggaccccgagctagagccgcagcgggacctgcccggcccccggctccagcgagcgagcggcgagcaggcggctcacagaggcctggccgcccacggaacccggggcccggcggccgccgccgcgatgtttccccgcgagaagacgtggaacatctcgttcgcgggctgcggcttcctcggcgtctactacgtcggcgtggcctcctgcctccgcgagcacgcgcccttcctggtggccaacgccacgcacatctacggcgcctcggccggggcgctcacggccacggcgctggtcaccggggtctgcctgggtgaggctggtgccaagttcattgaggtatctaaagaggcccggaagcggttcctgggccccctgcacccctccttcaacctggtaaagatcatccgcagtttcctgctgaaggtcctgcctgctgatagccatgagcatgccagtgggcgcctgggcatctccctgacccgcgtgtcagacggcgagaatgtcattatatcccacttcaactccaaggacgagctcatccaggccaatgtctgcagcggtttcatccccgtgtactgtgggctcatccctccctccctccagggggtgcgctacgtggatggtggcatttcagacaacctgccactctatgagcttaagaacaccatcacagtgtcccccttctcgggcgagagtgacatctgtccgcaggacagctccaccaacatccacgagctgcgggtcaccaacaccagcatccagttcaacctgcgcaacctctaccgcctctccaaggccctcttcccgccggagcccctggtgctgcgagagatgtgcaagcagggataccgggatggcctgcgctttctgcagcggaacggcctcctgaaccggcccaaccccttgctggcgttgccccccgcccgcccccacggcccagaggacaaggaccaggcagtggagagcgcccaagcggaggattactcgcagctgcccggagaagatcacatcctggagcacctgcccgcccggctcaatgaggccctgctggaggcctgcgtggagcccacggacctgctgaccaccctctccaacatgctgcctgtgcgtctggccacggccatgatggtgccctacacgctgccgctggagagcgctctgtccttcaccatccgcttgctggagtggctgcccgacgttcccgaggacatccggtggatgaaggagcagacgggcagcatctgccagtacctggtgatgcgcgccaagaggaagctgggcaggcacctgccctccaggctgccggagcaggtggagctgcgccgcgtccagtcgctgccgtccgtgccgctgtcctgcgccgcctacagagaggcactgcccggctggatgcgcaacaacctctcgctgggggacgcgctggccaagtgggaggagtgccagcgccagctgctgctcggcctcttctgcaccaacgtggccttcccgcccgaagctctgcgcatgcgcgcacccgccgacccggctcccgcccccgcggacccagcatccccgtttttcatggcctgctgaaatatgtgtgtgaagaattatttattttcgccaaagcacatgtaataaatgctgcagcccaaaanaataaaaaaaataaatttaaaaaaaaaatatatctcaacgggatctgtaagctttttatatatttctaatccactgtaacagtaagacatcagaaccagctgttattctcaaataaatcgaagaataatcccaacactgaggatgcttctttacactaaagtcacaacatatgctttttgatcatttgctacaaagattggcgataccctcctttaaacattgtgaaagtatgcccaacaaagttaccgcggataatgtcaaacacaagtgagcttcttcttccaaagtaatccaaatagatctgagacttttt

SEQ ID NO: 697762 - DNA, 264 bp, Homo sapiens
tcttaatcagggggggaagaacgggttcaaaactggttggttccaatggcccctttagtttaggaggaaaaggctgggttatgataaccatggcttggtaaacccttcaaaggaaaggggaaaggtttgggggcccccttgggttttttttttgggggggggcggttttaggtattaggtttttaaaaccgggcttttttaagggaaccacctggcccaaaatttggccccgaatttttgggcccctttaaaaaggttaatgga

SEQ ID NO: 697763 - DNA, 1321 bp, Homo sapiens
ggcggccccagtcagacgcaggcagccccaaagcctgaacaggcagggccagacccagcttcttcgcctccgccagcggggaccccgagctagagccgcagcgggacctgcccggcccccggctccagcgagcgagcggcgagcaggcggctcacagaggcctggccgcccacggaacccggggcccggcggccgccgccgcgatgtttccccgcgagaagacgtggaacatctcgttcgcgggctgcggcttcctcggcgtctactacgtcggcgtggcctcctgcctccgcgagcacgcgcccttcctggtggccaacgccacgcacatctacggcgcctcggccggggcgctcacggccacggcgctggtcaccggggtctgcctgggtgaggctggtgccaagttcattgaggtatctaaagaggcccggaagcggttcctgggccccctgcacccctccttcaacctggtaaagatcatccgcagtttcctgctgaaggtcctgcctgctgatagccatgagcatgccagtgggcgcctgggcatctccctgacccgcgtgtcagacggcgagaatgtcattatatcccacttcaactccaaggacgagctcatccaggccaatgtctgcagcggtttcatccccgtgtactgtgggctcatccctccctccctccagggggtgcgctacgtggatggtggcatttcagacaacctgccactctatgagcttaagaacaccatcacagtgtcccccttctcgggcgagagtgacatctgtccgcaggacagctccaccaacatccacgagctgcgggtcaccaacaccagcatccagttcaacctgcgcaacctctaccgcctctccaaggccctcttcccgccggagcccctggtgctgcgagagatgtgcaagcagggataccgggatggcctgcgctttctgcagcggaacggcctcctgaaccggcccaaccccttgctggcgttgccccccgcccgcccccacggcccagaggacaaggaccaggcagtggagagcgcccaagcggaggattactcgcagctgcccggagaagatcacatcctggagcacctgcccgcccggctcaatgagggtgcgcacctcttttgcatggccgagcggccggcggaggctcagtggtcctccgtgcgtcccagaacttcgcccgcggggagcggagaagccgtctggagctggagctgcagatccgcgagcaggacctccgggcccgcctcccgcccagctcctccgtccttggacgggatgggcccttgctgggctattggcgcccc

SEQ ID NO: 697764 - DNA, 1261 bp, Homo sapiens
ggcggccccagtcagacgcaggcagccccaaagcctgaacaggcagggccagacccagcttcttcgcctccgccagcggggaccccgagctagagccgcagcgggacctgcccggcccccggctccagcgagcgagcggcgagcaggcggctcacagaggcctggccgcccacggaacccggggcccggcggccgccgccgcgatgtttccccgcgagaagacgtggaacatctcgttcgcgggctgcggcttcctcggcgtctactacgtcggcgtggcctcctgcctccgcgagcacgcgcccttcctggtggccaacgccacgcacatctacggcgcctcggccggggcgctcacggccacggcgctggtcaccggggtctgcctgggtgaggctggtgccaagttcattgaggtatctaaagaggcccggaagcggttcctgggccccctgcacccctccttcaacctggtaaagatcatccgcagtttcctgctgaaggtcctgcctgctgatagccatgagcatgccagtgggcgcctgggcatctccctgacccgcgtgtcagacggcgagaatgtcattatatcccacttcaactccaaggacgagctcatccaggccaatgtctgcagcggtttcatccccgtgtactgtgggctcatccctccctccctccagggggtgcgctacgtggatggtggcatttcagacaacctgccactctatgagcttaagaacaccatcacagtgtcccccttctcgggcgagagtgacatctgtccgcaggacagctccaccaacatccacgagctgcgggtcaccaacaccagcatccagttcaacctgcgcaacctctaccgcctctccaaggccctcttcccgccggagcccctggtgctgcgagagatgtgcaagcagggataccgggatggcctgcgctttctgcagcggaacggcctcctgaaccggcccaaccccttgctggcgttgccccccgcccgcccccacggcccagaggacaaggaccaggcagtggagagcgcccaagcggaggattactcgcagctgcccggagaagatcacatcctggagcacctgcccgcccggctcaatgagacctggtgatgcgcgccaagaggaagctgggcaggcacctgccctccaggtgagccgccgaccgcgcgtccacccggggcccgcggtgctagcgccgggagctgaagccctccctgccgcatccctgccccgcaggctgc

SEQ ID NO: 697765 - DNA, 1049 bp, Homo sapiens
gggagtaacgggagtgctctctggacaacgtgggctggttcgtccgcaagctctcggtgctgctcatcctgcgtggtgctcttcgccatctggctatttcctgcagcgcatcatctgccccagtccacgcaggtacccgcgcgtgcaggcgcgcccgggacagcggcccgggcctccggggggcgccggaccgctggggggctgctggggcctgccctgacgactgactgactgactcgccctgctcgtgcttgctgctgactgaggcggcagcctggctctcaggactcacttgcttggacatgttggctggctggctggccgggggccgggggaggcggtgggcgctcggacccctcctgcgcctcagagcacgagatgcgtgtagtgtcgccggtcttcctgcagctgcccagctacgaggaggtcaagtatctgcccacctacgaggagtccatgcggctgcagcagctcagccccggggcaggtcgtgctgccagctgtcggtgcttggccgccctcgaggcgcggggtcgccgcggagcccgacggccggcgagggccggataccctcttatctgagcgctcgcggggatcggcggcctggttgcaagggctgcggggctgcgggtggctatgcaccggccgggggtgcctgccgcaactgtgctcagaccttatctggcaccctggcctaactgcccggtaccccgccgactgggcttggcggtcactcgtctccctcgcgttctcccgggatctcctgtccctctgcgtttcatttccggttcctagcgacacgttggtgccactccgctggccgcgcttgcggcatgctcgcaggctaccccttctaggtcgcagccgtttggactggccgttctctttcgcctcatgccccattgcgctccgatatctgcagtcctcacctagtatcgttcccctcgcttccctaccttcactcgcgcaccccctccagccccctctcgttgcctccctcgtacccgcccgccttcttttttcgctcattcctcatcggaccgcttgtc

SEQ ID NO: 697766 - DNA, 702 bp, Homo sapiens
cacacacacacacacacacacacacacagagtaatctgtaactctcaattccctgaaaaactagtaatacgtgtcttatcgtgctataaactatacatattgtgtctatgtgtcagagatgctacaagtgggaaaccatcgtcgtgggttactcatcttcaagagcgggagaaacagtgtagatattgagtcttctctcccaatcttcttttataccacccagtttaagggaacttcgtgaagatgtgtccactctcgttgatttacagtgtagtgttgctgtgtgtgtactcatttagcaacaagtagtgctatagtggagcgacactcatacgctcctagagaagcaattctcgtgggcgacgaagtcgaaagcacgtgagaccggtacttaaagatgtaaccccccaataacagtcgttgcggtgggcacaactacgttaagatgttcaactcatactccctatacagatgtttcttcctgatgggggcctattaaggggtcaaaaccacagagagggcttcccttagttatcacaaatgttcagaaggtcaacgttgggtagatcaccaatattaaagtgcccctatcatcgcgttaattcctggtgtgttacgaattcaagcgttgcaactagtggatatacataggtaactgtaccaggaacaaggtcagcaggtttacacacgggtagtgtcctc

SEQ ID NO: 697767 - DNA, 841 bp, Homo sapiens
  misc_feature (9)..(9): n is a, c, g, or t
  misc_feature (11)..(11): n is a, c, g, or t
  misc_feature (15)..(15): n is a, c, g, or t
  misc_feature (408)..(408): n is a, c, g, or t
  misc_feature (501)..(502): n is a, c, g, or t
  misc_feature (507)..(508): n is a, c, g, or t
  misc_feature (513)..(514): n is a, c, g, or t
  misc_feature (520)..(521): n is a, c, g, or t
  misc_feature (536)..(536): n is a, c, g, or t
  misc_feature (564)..(564): n is a, c, g, or t
  misc_feature (574)..(574): n is a, c, g, or t
  misc_feature (599)..(599): n is a, c, g, or t
  misc_feature (622)..(622): n is a, c, g, or t
  misc_feature (666)..(666): n is a, c, g, or t
  misc_feature (717)..(717): n is a, c, g, or t
agcgggctngnggangcggggtcgagatggcggcgcctttgaggattcagagcgactgggcgcaagccctcaggaaggatgaaggggaggcctggctgagctgtcatcccacgcagcctgtaggctctcatcaagaagctagtatgctgtgtgccgatgcattcattgtacgagttctgctagaactcgggaaacgcatctttgttatgtgctagccatgactttgtcagagggaaattaggtcgtatgatggctgtccctaggtagggttacatgcgttcacggaaggcatttacgtgtgcaatgacaaataaaccaagataaaagcgattccactatttcgatggtcccaagagggaaaagtgcaatcattcctaagagtagtatggcgaccgagtatgactgacnttgtctgtcccagagactctcaatacaagaaggaggtcatacacgatggccctggcaccatgttccagcagaggaggtcttggtgtgtcttcnnaggtnnctgannaggcanncatgaaagatctggncaggcttccaactggatgaactcaggangcagtatctnggaaggacatgtgtttgatgtgaanttgttgcaggttctttcccatcnaggccttgtggtcctgagtgggggaatgggatgcccagctgaangatatggtcagctgaagatgctagctgcgtggtgaccttcaaaggtcacanaggaggtatcctggatacagccatcgttgatcggcggaggaactgtggtgtctgctctctcgagatgggcacagcaccgactttgggatctgtgggcgctcagcctgctggggaagtcccttgc

SEQ ID NO: 697768 - DNA, 794 bp, Homo sapiens
  misc_feature (9)..(9): n is a, c, g, or t
  misc_feature (11)..(11): n is a, c, g, or t
  misc_feature (15)..(15): n is a, c, g, or t
  misc_feature (265)..(265): n is a, c, g, or t
  misc_feature (273)..(273): n is a, c, g, or t
  misc_feature (277)..(277): n is a, c, g, or t
  misc_feature (303)..(304): n is a, c, g, or t
  misc_feature (328)..(328): n is a, c, g, or t
  misc_feature (356)..(356): n is a, c, g, or t
  misc_feature (361)..(362): n is a, c, g, or t
  misc_feature (381)..(381): n is a, c, g, or t
  misc_feature (400)..(400): n is a, c, g, or t
  misc_feature (407)..(407): n is a, c, g, or t
  misc_feature (454)..(455): n is a, c, g, or t
  misc_feature (460)..(461): n is a, c, g, or t
  misc_feature (466)..(467): n is a, c, g, or t
  misc_feature (473)..(474): n is a, c, g, or t
  misc_feature (489)..(489): n is a, c, g, or t
  misc_feature (517)..(517): n is a, c, g, or t
  misc_feature (527)..(527): n is a, c, g, or t
  misc_feature (552)..(552): n is a, c, g, or t
  misc_feature (575)..(575): n is a, c, g, or t
  misc_feature (619)..(619): n is a, c, g, or t
  misc_feature (670)..(670): n is a, c, g, or t
agcgggctngnggangcggggtcgagatggcggcgcctttgaggattcagagcgactgggcgcaagccctcaggaaggatgaaggggaggcctggctgagctgtcatccgcccacgtggcaagcacgccgtgaggctcctcagtacagtaagtcagaatgctggtgcgcatgcttcttgtagcagtctgcagcaaccggaaaccatcgtttgtatggcagactgacttgctcagagagaattggcgctagcatggcatcccgagnaggttacnggcntcaggaaggatttactgtgaatgaanntaaacaagaaaagcattcatattncatgtccaaaggaaaatgcatcttctanagttnnttggcaccatatactactnttgtccagaattcatacanaagagtntaacatgcctggacatttccagcagaggaggtcttggtgtgtcttcnnaggtnnctgannaggcanncatgaaagatctggncaggcttccaactggatgaactcaggangcagtatctnggaaggacatgtgtttgatgtgaanttgttgcaggttctttcccatcnaggccttgtggtcctgagtgggggaatgggatgcccagctgaangatatggtcagctgaagatgctagctgcgtggtgaccttcaaaggtcacanaggaggtatcctggatacagccatcgttgatcggcggaggaactgtggtgtctgctctctcgagatgggcacagcaccgactttgggatctgtgggcgctcagcctgctggggaagtcccttgc

SEQ ID NO: 697769 - DNA, 238 bp, Homo sapiens
  misc_feature (8)..(8): n is a, c, g, or t
cagacggntagcatgagtgtgaagtaatggaaccctattgatgcagtgtattttatgcagcctgattgaatgcaggggatttaatggagcatgattgaatgcaggggattttatgcagcatggcccaaagcatactgattgaatgcattggattccatgcattgtgattgaatgcagtgtactccattcagcgtggtaaaatgcatcccgattgaatgcattgaaacacggtctctca

SEQ ID NO: 697770 - DNA, 719 bp, Homo sapiens
  misc_feature (9)..(9): n is a, c, g, or t
  misc_feature (11)..(11): n is a, c, g, or t
  misc_feature (15)..(15): n is a, c, g, or t
  misc_feature (189)..(189): n is a, c, g, or t
  misc_feature (197)..(197): n is a, c, g, or t
  misc_feature (201)..(201): n is a, c, g, or t
  misc_feature (227)..(228): n is a, c, g, or t
  misc_feature (252)..(252): n is a, c, g, or t
  misc_feature (280)..(280): n is a, c, g, or t
  misc_feature (285)..(286): n is a, c, g, or t
  misc_feature (305)..(305): n is a, c, g, or t
  misc_feature (324)..(324): n is a, c, g, or t
  misc_feature (331)..(331): n is a, c, g, or t
  misc_feature (442)..(442): n is a, c, g, or t
  misc_feature (452)..(452): n is a, c, g, or t
  misc_feature (477)..(477): n is a, c, g, or t
  misc_feature (500)..(500): n is a, c, g, or t
  misc_feature (544)..(544): n is a, c, g, or t
  misc_feature (595)..(595): n is a, c, g, or t
agcgggctngnggangcggggtcgagatggcggcgcctttgaggattcagagcgactgggcgcaagccctcaggaaggatgaaggggaggcctggctgagctgtcatcccccagggtagaaccactctttgtatggacacggcctgcagcttgtcatggatattagtgcccgtagatggcatcccgagnaggttacnggcntcaggaaggatttactgtgaatgaanntaaacaagaaaagcattcatattncatgtccaaaggaaaatgcatcttctanagttnnttggcaccatatactactnttgtccagaattcatacanaagagtntaacatgcctggacattttccagcatgaggaggtctcgcgtgtgtcttctagtatctgacgggatccatgataaatctggtcaggcttcccaattcggatgaactcaggangcagtatctnggaaggacatgtgtttgatgtgaanttgttgcaggttctttcccatcnaggccttgtggtcctgagtgggggaatgggatgcccagctgaangatatggtcagctgaagatgctagctgcgtggtgaccttcaaaggtcacanaggaggtatcctggatacagccatcgttgatcggcggaggaactgtggtgtctgctctctcgagatgggcacagcaccgactttgggatctgtgggcgctcagcctgctggggaagtcccttgc

SEQ ID NO: 697771 - DNA, 849 bp, Homo sapiens
  misc_feature (726)..(726): n is a, c, g, or t
gcggccgctactactactactaaattcgcggccgcgtcgacattgtggtgctgtgctgcagttactgtgctgatttaagtgagatcagggtgcgctgctgtgcccggaggacaaggcgtctcatgctgcgggcggtgcgaatcatcgctgaggagaccactgccatgttgtattcctgcaggacggagcggcggcggcagcagtttattcgcgcgctgctgcagcaccaccgccctatcctgatgcacgattatgactctacccccatgtaggcgtggacttccccttcgccgcccgttgagcaaccgcaagttggacagcagcctgtggctcagcagctggacagcgacatgaacttaagcgagctgcccggggagtttattaatatcactgatgagcgtttggctcgacaggaaaccgtgtggaatataacacctaagaatatgtctgttacccatgatatgatgctttttaaggccagccggggagaaaggactgtgtactctgtgtgttgggagggaggtggcaggttgaatactagggttctgtgagtttgattaaggtacggtgatcaatataagctatgtggtggtggggctatactactgaatgaaaaatgacttgaaattttctgcaattgaaaaataaacacgttgaaacataacatgcaacaggttcacgattctttattcctgggcaatgtaggagaaggtgtaagagttggtngcaaaagtttcagtggtgtattttccactttcccaggaccatgtaaaagacatagagtaagtgcttacctcgctagtttctgtggattcactagtaaattagtcacagctagaatgtcgacgc

SEQ ID NO: 697772 - DNA, 758 bp, Homo sapiens
cttgggacgcgaggagaggcgcgcagcgatcggctggacggaggcaatggtgtaagcgcgcgtctcggcctccccgctccccccagacgcggccgggtcctcccttcgtcttctggagacacacccctgcctcgtctcttccgcctctcttgcagtccggtccgttcctgtcctcgtgcggtaggccagccctggggaggtgcagcgcccgccaggtagtgagtgtgctccgtatcagaatctgctagagcgtcagctagcatccatcaaccggactatctcctaggcatcctctttagctttgctcagtgctgagggcttcctagatgggactcgccataccctgcaccgagtcttcatgtcacatgacgcgtgggcgtactggactaagcgcatcacctcagcaaagaattgacatacatcgggccgagcccttatggctcatgacggggaacctcgctactaccctacgcgaccacacgaattcagagtgctacagatgggctgagctaggcacggggcgcttactgcgaccgcaacgtcggaactatacgctgacggacgcctaccctaccggcaagacggggcgtatcgggagcaagaccgcgtgccaggaccaggacgccagttgtcggtgaaggaggagccgagaagcagaggtgcgcatggtgaatgggaaggccacaataaggtccgagaggccgggacgactactaccagcgacgaaactggccgccagaagcgccgaggtccaaaag

SEQ ID NO: 697773 - DNA, 201 bp, Homo sapiens
ttactgagaaaggaaaaccccaaggggctccccaagggaaaagccccacgttctttcaaagggtcccagaaaggttttaaaggttgggggaacccattccttaaggtgggttttggttttccgcaattccaccaggtagagtttcagttgtcaagttacgtctaatccaactttcaggctcctatggcatggcaagtcctg

SEQ ID NO: 697774 - DNA, 386 bp, Homo sapiens
gggacgcagcgggaaggctcagacttggcgtggacctggcaactcggggcggggctaccttctcctgtggctacagtgctgaacgggtcatccgccggcagcggttgtgatggctatgtctgtggacctgggctcgattaatatcacctgggccggccatactctacgttgttggctcgcgtcttttagaccgacgattgctatgtacgagctgacgcatacatgttcacgcaggagccgttgactatcagtgcgtgctacagtgggttgagcagcaagcatctcagtatgtagcagcaactctggtagatctactcacctcattgcgtagcgtcgctgagccagctgcaccatctgatgcatgcgaccactacgtcgtctttgtc

SEQ ID NO: 697775 - DNA, 1037 bp, Homo sapiens
  misc_feature (254)..(254): n is a, c, g, or t
  misc_feature (259)..(259): n is a, c, g, or t
  misc_feature (261)..(261): n is a, c, g, or t
  misc_feature (333)..(333): n is a, c, g, or t
  misc_feature (427)..(427): n is a, c, g, or t
  misc_feature (471)..(471): n is a, c, g, or t
  misc_feature (477)..(478): n is a, c, g, or t
  misc_feature (493)..(493): n is a, c, g, or t
  misc_feature (495)..(495): n is a, c, g, or t
  misc_feature (543)..(543): n is a, c, g, or t
  misc_feature (577)..(577): n is a, c, g, or t
  misc_feature (622)..(622): n is a, c, g, or t
  misc_feature (631)..(631): n is a, c, g, or t
  misc_feature (635)..(635): n is a, c, g, or t
  misc_feature (660)..(660): n is a, c, g, or t
  misc_feature (667)..(667): n is a, c, g, or t
  misc_feature (670)..(670): n is a, c, g, or t
  misc_feature (691)..(691): n is a, c, g, or t
  misc_feature (708)..(708): n is a, c, g, or t
gagttaattatagaatgggttatcgtgttattcttactcatgaagttacagattttagccagtcttgcttttatactttgtgaaatttaatttctctctatagcaccttcctttttcgttttcagttatcaaaagtgacttgacctcataaaagagtgagaacatctctcgtgtcacatactgcaggtgcatcagttactttgcacagattctagggggacatttttctgaataggaagacaggacaaagttancagcntnagggctcttaattctgtgagtgaggacttaaaagtatgtagcattgttggatccatgaaaaatgtattcagngggctttaaaatttccattgcagaattggtctctcaggctgttgggagctcttttttttacattttttctccttgacacctattttatggtgtntaaagtaaaggttaacatctgtagcttttccaggtttttttttntttggnntatgaaatggtcttncnccatggcagaaataagctagggaaacattaacccaaaaatttcggtanagctgtcccttgggaggcagcatcacttatgggnagtaaagactcagtataaaagcaccagcatccctactggggtganggggataantttnatagcatcccatttcctagtgcacntgtgaantgnttggaggatctaatctatatnctacccttataataaangatcaagaagatatatctcctatgaacagtctggggataggagattgaacaagtggggaggaggctcaactccaaatggggagggccggcaaaagctggggcttaccactaacggggggtgagagcaaggcatgggccctaaaggaggcaggtcccaattaattccccagcactgggactggggggaaacagcaatctttcaccggcaggacctgaatgcacaggcaggaagaaaatcgtggggaagggcccgcgatcggataagcacaaaagcgctaaaacaccgtgtggttggaggggcacgcagaggaaactgccacggagaacgg
